United States Patent 7,365,185 (GENOMIC PLANT SEQUENCES AND USES THEREOF) - sequence listing, part 46

SEQ ID NO: 65536 - DNA, 21872 bp, Oryza sativa
  unsure (1)..(21872): unsure at all n locations
aggaggaggtggaggtggaggtgggcagcaggcgtcgccggcgaccgtgttccggatccggctcaagcagccgccctcgagcctccgccacaagatgcgcgtgcccgagctctgcaggaacttcaggtgcgtttcgagattagttgtggtttttttgggggtgttttttctttctgggatttaaatatgttgggggaagcttaggtgtgatgaatttaaaccctgatctgtttcagcttattcatcgatttattgaaatggtttttttccccccgaaagaaattttcctctactgtattgcttagaccacttgttttaagctatttgttaagtttgtctctcaaaatatctaatttatccctataatatatccatgacaataatccactcaataatctaaatcaaacgatctgggtttactttttttttcctcttcaaatttgggtggcgtttcaatgattgggatgaacaatctagtgactcaaacttgcagaagcattagcgtgggcatggaattgtgattgctttgaatgattgtatcctgtgcaggcttctactatactagatcaaatacagttataacatgtagtgtcattatttcacataactaagtttagtcaggtcaaactggttactttgttcaccagttagaaaataccgaacgtgataactccatttttaaaatccacattatttttttttgtttaaaactgctttgatcttgtaggatgaggttgccttgtctgctttagcctacactatatcgggaacaactagtaactatcttatctatggttttttttttattgcagtgcagttgcttggtgcgggaagctcaatgcaattgcatgcgcatcagagacttgtgcacgcataccaaggtatacatttttccatcctttccctgaaaatttactttcctctgacctttagttatccataaataagtttgttctgttagcttgtcttagtgggatattcaaccatttggtagaattgtttgcttacagtttctggttatgaaggtttctttgccgtaaaacgatctaatgtatattttcagctctaattcaagcccaccattttggattcccatacacattctaaatccagagagaccaacagaatgttctgttttcaatgtgaaagcaggtaatccatggctaaatctcaattgttttggtaatgtgattacgttatgcatgtgcaaatcactgtccattgggcattttatagtcaggtgaagggtgagattcaaactcacttttgtttatatacgagtttttctacctccaatcctaactcactgtaattttgaacagattctccacgcgactttgttcaattcattgaatggtctcctcgatcatgccctcgtgcattactggtggcaaattttcatggaaggattactatatggacacagccaactaaggtacatctctaccttaagcaaatttcggtatgcatatcatttttttttgttagtagtaccattgaacttactttgttaatttgcgaaacactcaggattttcttttttcatttcaagtctatatacatatcatgctgttttgtgttttttctctaatacttgtttctttcttgatatggtgaagggtcctactaatcttgtacgtgatgccagttcctggcaatgtgaacacgaatggcgtcaagatctttcggtggtgactaagtggttgtcaggaatttctccggtttgttgccaatttgcaaacttacagtctgcttctcttgtttttgataattagcactttacacttggaatgcaaatatgcaatacgattgacccagcagtttatacagtccgcttcacaatttaacattcgagatttatatacttttcagtgtcaattgttaatcattatttttttaaaatataatattttataaagcagtgacaatagacttgagtttaaactgttctaagattttttcactggacatttatcataaacaattgcaacaattaggtaaaaaagattctggctcagtttatgtctgagtaagtactttgatctatttcaaatgacactacctgtgtttgattacccttttggcctgaaataagtggatcttagaatcgaaggaatataattactaagctgttgccacggctaaatttgttttgtttctttgactttgcagtatagatggcttcctgcaaactctagtacttcatcaaacttgaaaacctttgaggaaaagttccttacccagcagcctcaaagttcgggttggttaaacacatatattactgagcatatattttttttggaggagaaagcaagcatgcttctttacgctactctgacatattgctgtttactgcagctgggtggccaaacattctatgtgtctgttcagttttttcatcgggttctgttcagcttcattggtcacaatggccttctcaaaactcagcacaacctagatggttttctactagcaaagggcttttaggagcagggccaagcggcataatggctgctgatgctattattactgaaactggagcattacatgttgctggtgttccccttgttaatccatctactgtagtggtttgggaggtgatgccaggccttggcaatggtattcaggcaactgcaaagataaatgcaacaagctctcttcctccatcactaaatcccccactctgggctggttttgctccacttgcatcttacctcttctctttgcaagactaccttgtttccgagggcgcacagacaaaaaaacaggcacaggtagataatgagaccactgaggtagcatcgatccattgttgtccagtttccaacttttcagcttacgtcagtcctgaagctgctgcccagtcagccactaccacaacatggggatctggggttacctcagttgcttttgatcccactcgagggggatcagttattacagttgtaatagttgaaggtgcgtatatgacacctgggaaatgaattagtatgatgcaattgtcacatctcactatgactatttgtttctgatgaatggcatgaacatcaatgccattcataatcaccacactaatcctatgatcatccaacagctttaatagtaggagagttaatctaactatgtatgtccagagcatgcttatacatgttttagctccctttagttgcttttgttgtttctttgatttgctctggtagcttgtgccatggtaataaaagttcttgtctgtaaatgctatatgcatattcttttaaggacttttggggtctctgaaatttattaagtgaatcggttgatcttaggctcttggctaatgcttatttattttttctgacaattgttaaaccacatacttccagggcagtacatgtctccttatgatcctgatgaaggaccttccatcactggatggagagtccagtgctgggaatcttcagtccaacctgttgttcttcatccaatatttggaagccctgcaaactttggtggacagccacctacacagactgtttggtccacaagagttaacaaaagcatcccaccatctgaggaccttaagaaccctcaatcatatgttccaatgccaacaacttcagatgagcggagttcttctgagtgcagtgttgacagggcgaaccgacttagctttgacccttatgatcttccaaatgatgtcagacaattggcccaaatagtttattctgctcatggtggtgaggttgcagttgcattcctgcgtggaggtgtgcacattttttcaggtccaaactttgaacaggttgatagctatcatgtcaatgttggctcagcaattgctccaccagccttctcctccagtggttgttgcttggcatcagtatggcatgacacactcaaagatcgaaccatactaaagataatacgtgtgcttcctcctgcaattcttaatgctcagacaaaggttagctcagctgtttgggaacgagcaatagcagataggtatccacccaagttaacagaggttgattgaaatgatttatttgttgaaaatgtttttttttataactgcgatctttttagcagattttggtggagtctattggctggtgtggattggtgggatgctgttggctgcacacaaagtgctgctgaagatggtattggtaaggatgcttatgcagatgcaatttaaaatttgtgtatagtatttgcatttcaattgtgttctagctgtccacacaattagaaaagtagggattatctgctacacggtagaatttccacaactgtcactcaacctcttaaagtatatacttcctccgtttcataatgtaagtcattctagctttttccacattcatattgatgttaatgaatctagatagatatatatgtctagattcattaacatcaatatgaatgtggaaaatgttagaatgacttacattgtgaaacggagggagtaattaagaacagtgtaaccaagcaaatctctgtttggttgtttataatgttaagactttagagctgattgcacatttatgctcccaatttgaaagcattgtgcatctgcagtatgatgaattgtgttttgcttcatttttcccatttggatgtctcaatatgttaacattatttcctggtgtgagttgcaatacatctttttaagctgatacagaacttttcagtaagtttcatcattttctacatatggttggttaactatttcagcacctgtaacatttatatttgtccatgataaactaaatctcttgcttttccttccagtctcactgaacagtgtgatagctttgctggacgcggacttccattgtcttccaactatacaacagaggcaacaacactgtcctgtaagtgtgctgtgcttttagtacattatgtgcagttttaagcacaggccttcaatttttcatcatctactgcctactgccattactatgtgacatgcatgtcacaatatctttttgggttcttaaagattgtacattcaccaatcaccagtctttattccaccagtagttgaaagggggatacgaatcaaaatataatcaagatgacttttttccttttctttcctggacatagttttttagtattcttgtgacaagtcactagcactgctttgcagttctgaatgaacattttagcatgaagcttgccaaacttttctatgaacataaattatatctctggatgtattggtcagagaccatttacggtagtatgtagtttgctactttattcataatgcaatatattgtaatttgtgagttggacaagatttgtttttctaattgtgtgtttaccttttacttcagattttgaggacttgaagttgcaaggctattgctttcttctgttactgattagtctattttacttattgcagaatcttgataggataaagtgtagattgttggaaggaacaaatgctcaagatgtcagagcacttgtgttggacatgcaagcaagattgcttctggatatgcttggcaagggaattgagtctgccctgataaatccatcaactctgctacctgaaccgtggcaagcttccagtgacatgttatctagcattgggcctgacaaaatgactgttgacccagctctacttttaagcatccaggtatactgtgtttcatgttcttttgatttcctggtccacagtttcagttcaatttgctaatctcgttttcctttttttggctatagacttaatatgggcaaatgatgttgcaaacctttttgaatgataagctatttgtaaaccacaacctattcatgcatgaggatgaggcatgatatgccacagattaaccatgccatgtatggaatttacagtatttacagcagtattttgctgtttttatgttccaaaccgactacgattcaaacagcctccagatagctttcatcataagctttgctcctaggtgtgcaggaattatgctcagcccatcaactgcctccaatgccttagcaatttgtgcacacatttcagcataagcggtctgcatatgaactttcatgttactattttgtggatttaatttttttttgaacatggactgcaggggtacgttgatgctgttctagatttagcgtcacattttatcacacgcttgcgacgctatgcgagcttctgccgaactttggctagccatgcagttggagcatcttctggttcaggcaattctaggaatatggttacaagtccaaccaacagttctccttcaccttcaactaaccaaggttaattttgattccgtctatcttgctaaagcttgtgcttttttttttggtgctaaataaaaccacctatgaattatttgtttctttatttaattttttggaaaatgacaagttgctggcacatttcaaacttagcaatgatgctaatgtttcaggtaatcaaggtggagtagcgtctacaacagggagctcacaaatgcaagagtgggtccaaggtgccattgctaagattagtaacaatactgatggtgctgcaaatgctgcaccaaatccaattagcgggaggtcatcattcatgcctattagcataaatacgggaacattccctggcacaccagctgttagacttattggggactgccatttccttcatagattatgtcagctgttgctattttgtttgctttttcggagaaggcaatctccaaggatacctgcaaatgcacaaaaaagttctgattctagcatgcagaaacaacacttgatgaacagtaagacagaggataatactttggcagtcagatctggtctaggtgctgccaaattggaagatggcacaacttcacgtggacagatggttggagcaaagggtgctgaagaaaatccagtgggcaacaaatctgctaggataggttctggcaatgctggccaaggttatacttcagacgaggtaacaaacaaataacccataaatatggattttctcagcctgaattgttcaataagaaaacttttttcaatctgaaaatagtgatagttatacatataacagtatttttgtatgtgcgcttcgacatcaatatctagcctgtattgtttctgaatcaacatttagattagagctgttatatagtgtggttatatgtctgcatatcatatatcatgtgtgtgtctaaattgtttgcaagtgccatatgattaagggtaattagacatgattggataatttacctagtataatctttgatcggtgatttgcccgacatgtttctcccgattttattagttgcctttctgaaagtattatttgtgtagcactgtaatacatctagtttctgaattatttgtttcatgcttgcaggtgaaagtcctttttctcatattagttgacctatgtaaacggactgcaaccttgcaacatccgttgccttcttctcaggttggttcgagcaatattattataaggctgcattacatcgatggcaattacactgtgctccctgaggtagtggaagcatctcttggccctcatatgcaggtacaatacagatttattgtggaagtttatttctgtattctctgtgtactcattagagcattcaatgttctcttctcagcaatacattatagtaattctcaattgtgttggagaaatagagatatagtattttgcaagttctactctacttacctgggttaacgatggattgatccagcaaaagaatattgttgtccaagttaattatggaaattttcatttatacaagcacacgtgcataattggtttttatgatttcttttgttcatacgttctccatctgcctatataatttattactcatggcctcagcgccctcttgtcaccatttaggagttctcattttcatcagcatgtacatctttggtaagagtagtgagcatgtacatgtccaacaagagctgtgtacacgcatttctgtcgagaatttataccaatgttgcccatttgttccaatatttattgcagaatatgcctcgtccacgtggagctgatgctgctggccttctacttcgagaattagaactgcagccccctgctgaagaatggcatagacgcaacatgtttggtgggccatggtcagaaccagatgatcttggtccattggataatacgcgacagctaaaaatcaatggctctaccaatcgccacttatcggacatggaagaggatggcgacagctcctttgggattcaaaatctttggccaagaaagcgccggttgtctgaaagagatgcagcatttggtctgaaaacatccgtggggctgggatcttttctaggtgtgatgggttctcggagagatgttattacagctgtgtggaaaacaggcctcgaaggtgaatggtacaaggtaagcatacttgatagtagtagtctctaacttcagtattctttcagaattaattatcgacgcactctatccaattcaccatttgccgtgacaccgagacatgctatcttttgcagtgcatacgatgtttgaggcaaacctgtgcatttgctcagcctggtgctctagctccgaacacgtcgaatgagcttgaggcatggtggatcagccgatggacccatgcttgcccaatgtgcggtgggacatgggtgaaagtcgtttgaatttgacgcctccgggcgacaccttcaccgtactaaccactctgccaatagctttctcggccaaatctgtgtaggcgccatcggtttttggacaattttgtatctaactttagattgtttggtctcaggccctccctggtatggtatcatagtttacctgcagcagtcagagcagattgcaccagcagctgtgtaaaacggtaggaaaaaacaggattaggacatgcccaaacactgtcagagtcagcagttgtgttgtgcgatccttttgtacataaatgtagtgtactaatttgcaacattggaaaagaaactccgttagatactgcttgatgtcaataatatttgctggtgattgaaaagaccatgtatgtaatagcatgttcaattgggtgtttctctcataagctatgctatgttcaacttgtggctttagatcatcgttcaacgtggtcgacaaaataaagacgaaatttgaatttctgttcgaatcttttcgaagggtagaaagtattcaaactgcgcttggttctgatatttacagagctacctgtaatactgtcatcctagaacacttgcaaaaatttacaagtgcttaaaaatattatcgagtgtacagaatttgcttaaacttaacaaaatatattctcgaaatatacacactacaaaatttgctaaaaattgggaagtatcagcggtgtggtggtctaatatttaaatcttatacccacgaatattatgtacgcgtaatttggttttcaatataaatatcgtgaaaataggatttgccgctagtttctaattgtgttagagaagcatttgcgagtgtgcaagtgtggtgttgtatgcgtagtgctgtgcgttcgtgcatatggttcagtcgtgtaataaagaaatgctaagggtgtgttggatgctagtgacctagaacttgtccctttcacgcaaaacagagcaacaaattagcgcatagctaataaatatattagtaaataatttaaagaaataaattgatatgattatttaaatcaactttcctactttttaataaaagacagactatttagtacttgtcgacgtttgatgtcgcgattccggtatttgcatagtatggagatcgttggtactaggatatacgcgagaccgaggtaaaagagacgaagacagagatttttatacaggttcgggcccctgaattgtcaggtaataaccctacatcctgttggccgaagcggtcgttgctcttattcaccataatcacaccagtataatatttggagtagcatatctaattgttgtcgacatggcggtctgaagatctgactcatagtcgacgacagggtagtcttcctcctcgaatccatgcccggcgagatcagaaacagcgctagatccctacggccggcctctgtaggtatcggatagggtcgatccagaggacgccgaggtcgtcggtaaggacgtgggaggagccgaggaatagagagagagggatagagagaagggaggaaggagggaggattatgacgtggcgaccctgacatgtggggtccacgtgggttccacgctgattcaaccgccacataggataaaaccggagttaaaaccgtcgagggacctaatttgcactggttttgtaaattgggggatgcattgtatccggttttgcggttcaaggatgattttgtaattcgacgacaagttgagggaccttcggtgtaccttttcctttgtttttagccataacccagttcaatacctccccacgctcggcctatatctctttggcccaacacacaaacaggcccaagccacaagcataagtggagtcataggcccaacttacatagcctactgcgatcttcaaccttcggaagatatcctatgcatgcatgatgccggagccggtcctcgtcatcaaatccaaccaatctttcttgatttggttgagggcttttgatccactcgatctcttctccccgtttccccaatatcagagagaattcacaaaaaaacgggacaaaaaggcaaagctcggtcagccatcttcgatggagattaaatccaacaaattaaaaccaaattgaaagagaaaattatggagaaaataatgagttagaagtagggaatcgatttttgcaataaataataggaggaaacgtacagggaggcagatcgcggcggtgctagggtttggcccgggccctaagagcggtaaaaaaaggagattggatcggactgagtggaaaaatacggtgataaaaaaaccagatgatgaaaaaaaaagaagcctaatcggacataaaaaactggcgagaaaaatagacggacaaaaaaaacatattcaattaaaaccgattcctcaattaaaactgaaaaccgatttaaacacggatgacttactaaaatctcagcaaaaatatcttcaatttttacaatagtagagatttagacaaagaacaataatatcatattgcatgaaaataataattcatgaccgtcaaaaattatatataatcacttcaatatacaatatctcaatataatatacaagatatgagggcaatatatgtctgcaaaaaaaacaatgatccaaagttatttgattaacttgttgggggtataaaggcgggaaacgtgcgtgtggaaaatgagggagagagaagttgggaataagtagtataggacgccctaataatgttacctcgccaagcttttttttttccccattttgtttaaaaaacaacaaactagtctcgaatacatgtcatagatacatatgaacccacatgcagtggcgaacccagaacaaaaattaccggggatgcttgatatgtttataggtttatttttgagtaatataatgcttaatatgacctaaaacacgtccgtggacaccgggtagatacacataggtacgcccctgcccacatgttatagacaacgattgataaatcattagttaacttatcttaaaagtgacaaacaattaaatgtcccaaatacatatacaaaaattgctcaaacttaaccggcaaactgaactacaactagtctcgattaaatgtcccaaatacatatacaaaaattgctcaaacttaaccggcaaactgaactacaactagtctcgactcgactgcccgcgagagcgagccccccagatctccctcgttctccggcgatggcgtcgccctacaccggcgcgcagccgccgtatccggcgggggcgcaccagccgccgccgccggcgcaggcgctgctgcagcagaaccactcgctggcgttccgcgtgatgcggctgtcccgcccctcgctgcagcccgaccaggccgccgcgctccgcttcgacccgcgcgacgtcttcctccccgaggacgccctcacggggcccgacccctccgcctcctccgccgccgacgccgccgccttcctccagggcctcctccacccgctcgactcgccggccaccaccgtccccggcgacttcaccttccgcgaccgcttcctcctccgcgaccccgtcgacgccctcgcgctccccggcctcctcgtcctcccgcaatccttcgggttcgtctctctctctctctcgcttccattccagtagtagattgcagcgaatgattgtgttgatgtgatcgtgcggggacgcatcgatagggcgatctatttgggggagaccttctgcagctacatcagcatcaacaatagctccagcttcgaggccagggacgtcgccattaaggttctcgaaccatcgcatgattaccatcctcttctattatatcgcattagttggaaaacattatttgaaattctggatcgtttaccataaaatattattctggatgttttctggagaacggtattattgcacccagtttgtcattgatgctgttgtttcagtgcatctggttagagtgtgctaggttgatgtttttctcttcttctttttttcagtgttagaatctcacatcaccaagttcttattgttgcagtcatgaactgatgttaaattcgattactcgattgactctctgctgtggaattactggaatagttgcttgttcatctttttttacatttgttgaccaatgtggtgtgttcagtgattagaccaattctattagagcctcattaagaaaaaaatgtaacaaggtgttattaaggcatgcaagaaattatgaggtattataagctaataagtagctttgatgcaaataattataattgaccttgactttatctgtagttcttattggctagttctgtcgatgggttgcatgttgctctatgacaaatttgatactttagacacccctttggtggcatgcatgcaggacttagctgtccttgaagccttcatttcttcatattatgtcataagttttaaccggaagtttatttacattaggcagaaatacaaaccgagagacagaggatacttcttttggatacatctaaggcccctgttgagtcaatcagatctgggggtagatatgatttcattgtggaacatgatgtcaaagaactgggagcacatacgtacactatcctcttttttattttatttacaaattggttgcattagacattagtgaagcacaccttattgttgatttgctcatgtggtgattgaatccaggcttgtctgcactgctttatataatgatggtgatggggagcgtaaatatcttcctcaattctttaagttcactgtttcaaatccattgtctgttagaacgaaggtacttatttctctcattttttatatggctaatctatactccatatgtataatctctatgtccctctatcttagaatgtaatcccagcatattcggattacagagtaggtcacataaataatctgtgttcaccttttgtttcaggttcgcaccatcaaggtatgtaccctcttgtttcacaaatgcaaacaatattgtaagtcttgtaactaaatgttggtttcttttgtggaaacctttaaaactttacgctgtcacatttgcattttttttagaatatgttctgtcatcgcagcagttaccagttagccatttctttctttacttgccattctatctgtgcagaatcatccttttggttccataagaagtttatcagcgtcttgaattccccaaaaataaaatttggggaacctcattatactttatccttggtttattccaaactggttgaacaaacttctatgtaaatgtggttggccttgtttccttcgatattatagtatatattctactgtactactgtttgttataatgttatttatccctttactgtgcatttatttattcatcatggcagtcttgaactctatatagctagtccactttgacaggataccacttatctggaagcctgcatagagaatcatacaaaatctaatctttatatggaccaagttgattttgaaccttcccaacaatgggcagctacaagattagaagccgatgaacatccgtcaacagtgaagtctataatcgggtaagttgagctctgataacaaaccctatttggagaatggaacatagtgtctcgatgcaaggatgttgatatatcatgtcgatgcaaaaggattgctaatgtgagttctatttttcatatagggacttgtgcaagcaaccgattctcatcagagctggaggaggaatatacaattacctatatcaactcagaccatcgtctggtgagtctggtcaaacaaaggcagagggaagcagcatactcgggaaatttcagatcacatggcggacaaatctcggggagcctggccgtttgcaaactcaaaacatacatagcactgtcagtaaagttcctgacttatggtttgaactattttatatgaagtgtcgagggctatacctgttaagttactctatatataagtgttagctataactttggcaactctttcttttgagcagcccactgcaagcaaagatgttgatcttcgtgctgtgaaagttccacctgtgatatttctggaaagaccatttatggtaggtgattcgttggtgaacatctggctcggatatttagcaagaaatttgttcatgttctttttccacaatattttgatgtttatgcttctgtattgtttaacttgtaagataaaatatgttcctgctttggtatctatctgatatttcccttcaatagtttagctaagggaatctctttattagtatctttggacaaaaatgggtcagtcttgcagacttttttgtcaggtcctatggatcccttgtatagtctctgaatatttcaaaaaagaaaaatgcattaaagcattacactagggttatgccctattgttcccataaaaaacgaggttctggctgttcaaaactgttatgctccaggctctctagaatttcctccccatatcactcacccctttcaatttgttaacatgttatgtgtttaactttccacgaagcatgttgtgcaccaagctttcaaaagttcccttcctatatcattctacccctttcaattcattaccacaggagacatgcagtactgagtaaatttgcaggaatcatggtaatacatctcgcatgctttattagtgtcttttcttcatacagtttcatgacttgttgtcaatcgctatgcactaatgcttttcgttgaaccatgcacttagtgcattactgcattgcaaatattaacaacagctgctcttcacattactatcgatatttgattagatttatatcctcaggttaatttatgccttacaaaccaatcagacaagacagttggcccttttgaagtatttttagcaccaagcgtacttgatgaagagaaatatgttctggtcaatggattacagaagttggttagttgtttcacttgctattttatgtttgctgttatacaaatgctatactagtctggggtgttctgacagttgcttagacaggtgtcctgtgaaatttgtccctggtgttccataacatatttgcatagttaattgctctgtttctatggtatgctaatgtggcatgtagaagcgtgtcaggctataggtttctttgtttgagaaaacaggaagttaggatttttcattgggtacttgatttcaggctaatgttacaactttccagcaatctggccaatggaaattagattgtgagttaacaatgagtttgtgcgctgcttattaatcgctttggtgacatctagttttttttttttcttaagagatagtcaaacgtccaggaaaatctttatgttggagtacactactcagctggtctcaactaatctctttgtggtgccttttattccctcctctgtaacagtgggtgaaattaatgatgtgttgggtatgcttttgatattttgctttcatgatatgcgcaggttttgccactagttgaggcttttgaatccatcaactttgacttggtaagataactttatgggtacatcagtttagatatatngttcgagtannnnnnnnnnnnnnnnnnnnnnnnnnnnnnnnnnnnnnntaatagcacgaatgaggaaaatcagtatcgttgaggaaaattcacaaggcagtattgttgttatgattcatcaatagcgtcactggtctgataaatatccaagcaaaatgatgtgacacatcctaataccagtccctccgtcccaaaatcatttatattttgggacggagggaatggtattaggatgtgtcacatctttttgcttggttttttatctgaccagtgacgctattgatgaatcataacaacaatactgccttgtgaattttcctcaacgatactgattttcctcattcgtgctattatatgaatgttaaccaacagttgaaacaatttagtcttgtgtttgaccatcaaagccagtggcaaattcattgtcttatgaatcagaaagaaatgtatttgactatatctggaatgaatctgtgcagagtatggtagctactcaagtaggcgtgcaaaaaatttctggaattacactgtatgccgtgcaggaaaagaagctttacgaacctttgtcagacatagaggtaaagataagcaaattcggtactatcaattactctttcttgtagtgttctgcatgtttgtttgctaaagctacattctcgtgatagcattatagttctttaaagttctcatgataaatttgttgaacataagtgctcgagcatgtgaagcttttcggcatgttctcttttcattcctttcctgaagctgcattggtatcttatgcacggctgggttacttgttttttttcctgcagattttcgttgatgcagaatagaacaacgctgcattggaaaacagacacagatgttcccccatgttttcatcatctgagaaagggatatacatatcgtcaagcgtattctagttgatgtattttttgtttattgtacaattgattatatccgattgtaacgagacacatttttaccaaaaagggaaatagattgaatgttcttccaaggaatgcagatgcgggcattgtgaagttccaaacaagataagcaaattgtcttgtgtcatttgtatggtttgtcccagttaattatgtcctaaattatatgatctccctctaaatccttccttgcagacaatcatcaatctctttagattggcgtgtctttgattcaatttcccttccaggaattgagaaccttccggcaagtactttgccaactccttcagaaatctcaaaacaaattcccaactctttccatgcaaatagtttttgataagtcaaaactatttgcataatattccatgctggaatatatgataaccttcaatatgataagtgagaaagaaaccaccaataccaccaaacagagcaaacataaccataaatcaccgaactatttgcataataatattgtctcaaaagtgccacaaatgctgtggcacaaccaccatccgaaggcaagaaaatagcacacacattataccaccaacaatacaacgcaaaggaaaaccaacaaacaaatccaacaaaagaaagaaagagatatagagagcaatctagtactaatccaatgtcacagctgcaaattgtgccccaattgctgtgttcttcattcattcagtcattcattcaagtgaagctcgtcagaggtgatccgcacagctgcacgtcggagatgtcggagagcctctgcctcgagctggacgccatgccgaactcctccagctccaggtcggagatgctcttcctcttgtgcgcctcctgcttcgccggcctctcctccgacgcctccaggattgggctcagcatcggctgctcactctgctgctgctgcgatatcatcgcctgcgcctccgccaccatcgaggggtcatcctccgcagcgtagagtaccttatgaatcgcgttgacaatctccagaaagaaaagataaacaagtttcttgatcagcatcgccctaactgacaacaaaataaacatcaagaacctaagaaccagtgctactgtttattttccgaaaactgaatggttaactctaaaagcaagttcacaatccttttagagttttagtattccggttttaggatagtcttattgtcaccaagtagaacaataatcaggcaaacggttttaggataggatagtcttattgtcaccaagtagaacaataatcaggcaaacggttttaggatagtcttattgtcaccaagtagaacaataatcaggcaaaagttaaggcattctgctacggttttaccggcaaatgctcgacttcagggctctggcacaagatctccacatccctcagcttggagaaatagaaatctctttctttctcgagactatcgacgagcagcttcagctcagtgatctgcaaatgatgtcaagattgagtctctcaccctttagcagcatgagaataaaaaaggccagccgatcatggcatcacacaaaacctctcccacctgttcatcataagctggtccagcggagtttgcgggagacggctttgcgctccgtgacggaggggcgttcggcgcatgcccattggccttcttggcaccatgagatgatgcctgtgctttgtgggtggcggatgaggatttggccggcgcctgagaaggcactgatgtccttctgttggtctctttgccgcccttgctgctctcccttctttcagaagcattgtaactgtgaatcaattcacaaagaacagcaatacataaggttttagacgagcaattaaatgaaattgtcacaaacagaattttgaacctgacaaaatctcacaaatcaaaaattggacaggttagagaatagtatgtaacagattacctgttcatgaagcctccattgaccgaatcacagtatcgcttcatccattgcatgaattccagattgtcaaggggccttcccttggtaagcttgttcacttcgatgtgctgcgataataaggagcaaagcaaacaagaaaattgtaagaacacagtcgcagtaccagtactagcaatgattaatataagcaacaatcccaggtttttttttctatcatcaccagatcatgaaacactacagattcacacaacatatagtatcaattagcaacagcaggggatctagaatctgtggtatttgtgcaaaactacttcccttcccttctgaagtcaatcacgaactgaacaaacgcgcccaaatcagctacacgataggtgtacggaaccaagatttgctcacggtggggagaagaattaggggggtaggaatcagaaaccggccgcaccttggtgatcttgagcttgttgaagacgtcctgaagaactttgtagttctggatcatctcgtactccgtcttggcgtcgaagttgaccttgtgcatcggcaccgcccccgggtgcgccgcgtccatcagctggcacgccaccgcccccgacgcagcctacacgaaacccacacccaaatcaaatcgccacatcaagaaccgagaaaaaaaaaatccacgccccgcgcatcaagaaatccaacaaacaaccaaccgaatcaaaacccaagggggaggaagagcgcgatttacctcctcgaccttggagaggccgagctgcagggtggtgttgatccacgccaggatctcgttccgccccacgaagtaggccccgtccatcatcccgatgttgctcgccgccatctcctccgccgccgcgaaccagatcaccaccaccacggggatcgaagagatcgaagaagagagaagcctcgaagatctcgcgaggaggaggaggagatcggcgacgaggttttcgaatgcggcggcggtggtggtgggggaggaggaggaggagcgggattaaaagggaggcggcttttccatggacgattctgccctcgtgttcatggtttcaacggctggatcgtggggtggggtggtggatggacgggtggatctggtcgaccgttgggacggggcgggggtgatgtggtaatttcgcgaggacggggggaatttgaatttttgggaggttttgcgtttcgtgggtgtgtacagggtacagccgtcaaggagttgggcatgtggtttttgttagctggaataataactgatgaatggacccaatgcagatagtgcaaatgcgttcggttttcaccttttttttttgcccgttgcttttgatgtcttctcaagctgttgtaattttgatgaagaaaaatgtaattatttttttacatggatatttgtttaactcactcacaatttaaatactcgctccgttcacaaataggagtaactactactgtatttgattttgacatttgaggtctagtactattttgacaaaaattatttttataaaaaataacataattatttagcttcaaagtcgtatcagtagatttgtaatgagaagtattttactaacatcttacattcaaatatattcgtgttgatattggttgaaaattaatgctcaaagttgataagtatttgtcaaccgcggaagtaatattttagcagctataaattgtgtaaatggatttcttgctattctgcaagcatgttggcagctcggatgtgcatttataataaattggctaactaagataacatttcatactaatttgagaaataaactggaagaaaagagactgatttgaggaaaagaacgagagagcaatttgagaaaaaaaaaaagagttgcatcttgcggcacagatattcctatgttcaattttgaccagaacaccttaaactaatttttactaggtcatattacctttcttgcaatttagaccaactatctttatagccctataggcacacttccttctatgcggagctcacgctcaagattgagcctacttgactgcttcaaccgttgatcggtatccatgctagatttcgtgcctccaccaagcttgtcatgattcagcaccttgtgcttgagttttgcctatcaacgtggtgtcagagttcaaacttagatgcgccgtcatccctctaggtcgagctctaccgaaattggtcactcacatgtgctatagtacacatctctccccgcactaaagtacacatcagtggccctcttttgtgcttcactagaagaatgtagtttttctagtaggcatggatagcagcggttcacttgtgtagttttaaggaggcacggacagcgacgcatctacggctcaataatgtaaagaaaaccttagtctaaagttaaaacaatatctatataccccagacgaaaatagaaattctaattttgtcctaacccaatgaaactcaaaagaaatggagtaaaaaaaaagatatctatataccccagaccaaaatgaaaatactatttttaaccaggcatccaatgaaactcaaaagaaattgagtaaataaaactaacccaatcaaactcaaaagaaattgtgttaaaaaaaaggaaaaagtacaccaaaggtccctcaacttgtcatcgagttataaaatcatccctcaaccacaaaaccagatataaaacatctctcaacttgtaaaaccgttcactttaggtcctctggtggttttgtgcccggttttctctgacatggcagctgagtcacgtgggacccacatgtcaggtggccatatcatcactctttctctttcccctcttcccctcttctgtcccttcctcctctctctctctctctctcctccgtctgggcaagccgatgcggcggcggtggcggcgtggggctcctccgtctgggcgagcctacgcgg

SEQ ID NO: 65537 - DNA, 18875 bp, Oryza sativa
aaaatattgaaaattttgtttgagtgcacagtgtgtgcattttatgaaactaatgagactaaataattatagcaaaaaattttgacataaattttgaaaataaaaaatgtaataaattaaaaattttatttgaaattttaataggataaatttttatgttcatccaatgggtaaaatggatatttttatagaaattagatggtcaactaacgggaggagcatggaagggatcaaaatcaaattttaggggtatccttggaagtaagcaaaattcaggggtatagaagggattagttaaaatttcaggggtatagaagggattagctaaaattttaaggtatacaagggatttctcttgtaggttggatagtagaaatccaaatttcatggagaacctgctctacaacggttgtcctaccactcttatgccccgcttccacatgtacaatgcaaagagtgagggccctttacatgtagtactgctcattgacaacttgacttggtggaactctaaaaaatttgctcttgtataagagatatggatgcaaaccatcgataattaaaattaattgcttcttttcttgaatgaagcctctgtagcttctctcatgaatccatggcattaaaacgtcggaattaagaaaaactagctaagtagtagtactactattactagcaaccatataatagctttattgagaagcatttataaggtgttgagacttgagcaggtcaagcaagataacaattatacattgacctatcaagtatatattctatatgcaatgcatcttattctaatcaagccttgccgagctattcgagctcgagctcgctaggcttgagagcctcagcctaggctagagcttagcttgtctagtattcgagtcaagctcgaatcaagcctgtaacgaatttgacagccctagacgtatcaaatatatttggagtatgaactatatatgtttttaaaattctggacaaataacttgatctcaattcatgaggcacatgaatatgaaattatgtattctctgcatatttatatcttgttctgtacaatttgaaatattatatagttatttctctacactctaccaaatcctttgatatactcatgtgaaccgtcttcagatggccaccacgcgctaatgccgtctaatctggatggagctgattttcctaatcacaagtccaactgtagcctacagctaccacccaaaaggccattatgtactatcaggaaatttaatatcagacagccaaaagacatactatacttttataatggtctataggaggaaaggacacatatgttcaaacatcacagtcagccaaatattgagaacaaagaccgtatatatgagaagcagttgatgtcacacagatttcacaatggcttgttcataagcttataaatttcataacaaaattgagaacaaagaccgtatatataagaagcagttgatgtcacacagatttcacaatggcttgttcataagcttataaatttcataacaaaattgagaacaaagaccgtatctatgagaaacagttgatgtcacacagatgtcacaatggcttgttcatatgttagtgaatttcatatggaacagcataatagccaacagaaataaacagaggatgagttctataagtagtgagtatcttaaaaacttgttggttgctagtaactacacaaatttctttgattttaggtgtcttgtcaggggaatgagtgcccaccacatcccttaacttacttaacgtcacagaaataaacagaaatcacaaatttctttgattttagctgtcctgccagggggaatgggtgcccaccacgccccttaacttgccagggggaatggctgcccaccacgccccttaacttacttaacgtcacataaaataaataaacagaaatgcttattggtatttcttaatgtcacagataaaatccgtaagcgaacagaaataccgatgtagcactccaccctggagtattcaaggtatcgatttctacagggaacatgtgtgtcagctcttctccaggttcatccaaggacacgaagctaagataagctaagggtggagggaaattcactaagggtagagggaatttactagtgaaagacaagtgtctatagaaagctctatttaatcctaacgtggtatttcaggcgctggccagcccgctgctcccagatatggctctacaatgtacctagtcagggaggactttagtgtacttgagggctatcaccacctttacacccacctcaaacctattgtgggatacaaagcaaacaccggaaattaactacccagacaccatgtctacgcagttaataactattttagtgtttataactcactgaagcaatcactatattttaatggactatagtgaacaatgattccataccttgattaggaactaactgagaggtaactctcatagaataaatcttaattactcaatgatattcgattaaagcagagtatttaacagagtaaaagaaataagaagaggattgccgacaactttggaattcctccgacttctactctcctctctccctaatctagtatacaataaagtacaatagagcctcttgtaattcagctcatgttttggtgtgtgagaatgagggagaagaggggtatttatagtgtggtggtgacttgagagagtggagatgctaaggaatattctccatagaatccaaagggcatcttcgtccttcccttggcaagtgtcccttctgatgacggtttccaccggtattaacgaccaaaaccatcatagaatgaggattacaaccgtcatgctgaagttgggctggattgggccagctgggagttcggaaccctggccggctttgttggcctagcccttcctcctggagtctgatatgtgggccccattgtatgttcttcaaatgattgcatcttattgggtttatgggctcaaaactccattggcttggatatggaagttatattctcatccttcatgtatatttcatctcaactttggtgggttgcatcctgcatacaaatatacaccaacactcgtggaaattgttagaaataaatcttaccactatattgaatatcttatacttttatggtcttatgcagatattgatggcgagaattttgtacttaacaaccgtcaacaccaggctcgccggcctccactttcccctctcccaccggcgcggccggccgccactccctctcaggttcacggcaatgtcgacccgggtctcggtctggatcaacgtcagcagcggcctcgacagcggacgccagcgggggcgacgtcgggaaggggcactggtggcctggggaggagcacagcgaacaagcccggtggaggcggcggctcggatggagagcggaggatggcaccggcggacgtcgatgatagtcagagaggagctggaggtggccggcgacgggcgccgtgccagtggagttgaggcccctggcggcagcggcccgggtggagagcggacgatggcgccggcgaacatcgatgatagtcggagaggtgctggaggtggcctgcattgtgagggaggccgacagcgaacggggcatcgggccttgaggtcgtcgggtggtgaggagagcctcgtcccctggcggtagcacaggcggatggggatgccccgggatctaggcggatgcggcctggagaagactgcgttgggcgggcgacttgggctcggactggccggcggcgggatctcctcgctcaaaggcggcttagagaagctcggggcagtgaagcagcatccgggagatggcggcagagatccatgaggtggcggcgatgaccaagggcgcagcaccgcccaccagatcggcgtagggttttctcacttacatgtggatcctttttctgactaggatgccacgtcagctaaactagaggtttatattgctaggggatctaaattgcacggttttgtatagtttaggggtgaagatttctaatattggggattagggatgtcatacaaacccgatgtaaagttaagggacaactggtgatgcaatctcatgtgcattgtatatattcatccattcgaaatcaagttgagattaaccatacgttttgtttacctaatcgatggtcaatgttatgcttatcaccacctcatggtcaacctctacatcaccatcatttgaagcttgaaattaaagatatatatacataaggattggtaaaaattgtactaaatccttccatccatctaaaaataaattatatcgctaatgtgctagcatattcaaaatgttatttctgaaacatccaacccccctaacatcaaaccttcttcacatcacacatccaaaagataaaatttagaaaaaatagtgggtgagtttatctagttgtggtactacactatagatcagaattaccttgataaaaaagtttcatccaccgatgttaccaattttgaacccctgcattttgaaagcccttgttagttgtagcttcaatcatctgtttcacaaaggttaactttctttatattacaccagaaaatctttaagaattataaagtacttcatccgttaaattataagactttctagcattgcccacattcatatagatgttatgtatgctagaaaatgttataatatgaaacggagggagtagctgacaaaaccaagtaacattagtagatgacaactgcacacttgtatttgccttttggtttcactggccataacctaaataattttcagtggtgcaggaattaggctagacctaaataatatgatttcgtagttgctttcacgaagacagcgcatcagcttcattaatttgtactagaaaaattgtaaaaactgacaaaaacacacaaatccattaatttcacggtattttcccgcttgattaatatgttacaaatttataaaaactgacaaagacaaagacaaataagatacactgcggaacggtcccacctaaaataaaaatttaaaaactaaaaaaacaaaatacaaatatgacaaaaccacttattttgagacatctaaaaataagtgatgaaaagagtatagtttctctctcccctgctcaaagaaaaagtaagacacactgttggacggtcccacctctaacaaaattttaaaaactgtcaaaaacaaaatacaaatgacaaatgacaaaaccacttattttgagaagtttaaaaaactgaaaaaaaattgcaagaattgggcagtgcatcaacacaactcaataaaaacgttccaacagacgtggtgccccaagaatagctcatgcatcccaaggggcagatccatctaactcaaggtgtgtttaattcacgccaaaattggatgtttggttgaaactgaaacgatgtgacggaaaagttggaagtttgtgtgtgtaggaaagttttgatgtgatagaaaagttgaaagtttgaagaaaatttttgaaactaaacacggcgtcaatacaactgaaggatccagaaaaggcagaagtcaaaggcaggccgagggtgaaaacggttgttgacaaagcaaaagataaagggttaatttgatccatgccattgcaactttaccgatttagaaaaatgccactactattcgcgatatcggttgggttccattgcaattttgcaaaattgaaaccgtgccatcgtcgtgacattttccatcccttcagtcttcttgcttcttcctccgtcttctttcttctccttgtgggcaagatgctccagctggtgttccggagcagcaagatccgacgggcgatggcggaggccaaggatggcaagctggcgccggcctccacggcacgccgggcagcgcggcggtgttcgagctcaccgccaagttctgctacggcgtcagcgtcgacggtggggtcaggtgtattttggatgcgtgcgcaaaaaaaaaaaaaaagaaatacgacgctacctgtacatacactatatgatgtgtgaaggtgtgcacgaatcttattgctatcgtgtggatgctagcctaggtgccgcagcacctaggtgctaaaaggacaaaggagaaggcgccatcagccatgtaagaggaagacaagtaataaaggtgatgaaaataaaacttgagcagacgcaaaaaaaaaacattattttttgcgaatataggaaatataaatgtatgccttgttggctctctctaaaaaaattgttcgcacaaagcatgataagctcttaggtaaagcatcagtgctcatcgcactgcggcgtcctgtatctaccggattagagctctaatcgcatttaaaaaatcagaatcatgtggtaaaccggatcttgagagttcagactaacaaatccttatacaccaacagaacaaaaggcttccgcatacagaaacagagttacagattgtcagtaagaaaaaaaactaatctgaacttcacgtatgcatttcccaaacatatctgatgaaacagatctggtgacaaacattaagcatgtcctcataataagaaacatcaatcaaagaaagggaccttgtactgttgttctgaaccattctacttggacaaacagggaacaaccattctactgataaatgaacaaacgggggataatggcaagttagcatttcgacaatagatgacaaattatacctccacgagcagattgacgcccgattgccatcatagctagtaattgctaatccaggattcagagcaccagcggctggattcaacgaactcttggccgcatcactcgccggagagagaaccatggctgcatccatgaactgctccatgggggcttcgctgtcggccgctggaacagccatggctacctcgtgtcctcgtgtacagacttgagagcaggggtggagctacatagagctagggggtgcccaggaatccagttcaaaaaattttttagctatagtttgtctattttcaccatatatatactctgtcagttgaaatttaggcacccgtatcaagctaaatttgattcaaaccagagtaaaacaagcaagtggctccgcccctgcttaagagaagccatccccatcacgccgttgcccatcgggggaactcagctcccttgcggagtcgcggtccgaagcttgcaatgcagagccatccaccggggggcagacttcatggtggagctgtgctggagctacggcgtcgtcgccgattacgctgcttctgcctctcctttctccttgcttgaagcaatgcttgaccgcgtgacacatggcgcggggctgtgttacctgggatgggttgcgtgaaacataatttggtatttgggttgcgtgaagggtgcacaaatcgtgaacaaaatccaacgggccaaaaaaacggccggcaaacaaaaataaatcagcaggcagccagttagcaattcccctatttttttttcttattactacaaaaattgcccgtgcgttgatgaagtctatttaaatcttattagggttatatagtttagttaaggtgaaattcacagtcagaatttgcttggatatactccatccgtcccaaatataagaagtattttagaaaatcatgagctacaattaagagtccgatcatctcaagttaacatgcgagttttttttaaatagattttttatacgactccttctgtatttttaaaaacaaacgaacttaaaaactgactcaaatacggatatgtatttccaaaagcgaacaaacttaattaaaaactgactcatacacatatgacgtaccaaagcaccggtaaaaacacatcttcaatttttataatagtagagaaaagatagagatagatatgagttatgtactagttgagaatacatgatgagatgttttacacatgcttaaacacatacgatgattatacctccagttttaactgataataactaggtaagtttcctcctgttgtaagtgaccatgaccttccccttgggccccggcatgacgacggtccagtccgtctccgggaacggcgacaccagctgcagctcgaagttgcgcagcaggtggctccatatcaccttgatctgcatgtacgcgaacgcctcgcccacgcacgcgtgccgcccgccgccgaacgccgtgtacgccagcccacctgcaccctcctccctcccggcgccgaacctgcccgggtcgaactcgccggggtcccggtacacccgcggcagcgcgttgtggagcagcagcgggctcgccaccgtgtggccctcgggcacctcgtactcgcgctcgccgctgccgccgcgcacgacgaagctccgccgcgcgtggcgcagcagcatcagggccggcgggtggagccgcagggtctccttcacgcagcgctgcagggtgtccatcgccgctagggcggcgtggtcgacgcggtcgccgccgtgccgacggagtagccgcgcctgctcctccacggcggcgcggaggtggtcggggttggtgaggaggcgcgcgccggcccaggtgctggtgctggagctcgtgtgctgcccggcgaagagcgccgcgacgagcatcccggcgacctccgtctccgtcgtggcgcggccgtccttgtacctcgcgtcgatcaggcactgcagcatgtcgtcgtgccgggctccgccgccgccgccgccgccgccggagctgcccctgcgggacctcacgatgtcggagaatatctcgccgagcctggcgcgcgccctgtctcgccggcggtgcgccgggatggggaggcgcgggaacaggatggtgacgaggcgcatgccgtcgttgagctcgcggaggagcgtcgagacctcgtcgaacatcttgtccctgacctcctcccctagtagacaacggctagcgatgagggtgacgagttgttcaaactcttgcttcatgttcacagtgccggactgtccccatcttgcaaagtaaccctgcacaatgcgtatatagacacataccacgttaattaatatcttgggcctgtttggcacagctccagatccacctcttctggagctagagctcagctaaacagtttcagctccacgtaaaatgggagtggagctactcacaaaatgaagtagagatatggagctgggttagataactccacaacttaactccagactcaactcctgaagctaaatttaggaattggagctctaccaaatataccctaactctacgatcaacccttgagattgcatcgaaatttaccacattttgtattataaaatttagtaactccatgtatctcaaggtacttaaactattatggtaaaatttgatgcatataccgctaacttttaaggacggtaaaatttaatatggatataattttaatttattaccgtagtgaatttgcttttattcactaaagcaacatgtcaacactaaatgtgcatgccaaaaactcgtttgcttacctccacttcagcaaccatgagatcaacgtaagtcctcagcttcgccggcttcatgatatcaccaaagaaccggaactgctcgtgtcgagtggcataatccacatcaaaagcgaccccgggaccaaaggttggtatggtgaattgcgagacctcatcctggctgatctctgaatctaaccctttgtaaaaatggcttgacgcctctgacccaaccaagaaagtcaccttctgttggagcaagctaacagtgaaaacgcttcccatcttctcataatggtggcggatgaattccaccgggccattggcgagaagcgatggtaaaacccctacaagaggagctccacgggccaagggtggaggcggtggtctagagaattttgtgccagtggttcttgttctttctcttgttgcaatcttactcaacattgttgcagcgacgaacagttgagccaggaacaaccatatggctcctgttgttaaatccattgttgaaatataatgaagtctgctgacagcaagggacgatgaaagagtgtgttagttctattacaacagcaaaagatagaaatacacaatgatatatcagaatatgtgtatgaaaacgcatagagagaaatatttaatttaagttttagtcatttttctcgcccttgagacgaaaatctaacaactctcatcgcttccatctttcactaatttaaacacaatctttgtttagccaaaaggttaaataataaattgttttaaccaatacataagctaaatttacaatcaataaagatttactaaactaacatataaaattatacgaagtaagataagattaagtaaaacaaatgcatttaaaaattgcagtaaaaataaattaaagatatttttgggccccctcattaatactcatggttataattcttatgagcaagtttaataatataagctcactgctagttataaacctatattagagacaaaaacaaaatatattagctataaagttatttagtttttcttcctctcgcacacttatacgtctaatgtgtttatcttggagcatgtgtagaattagttcttgcttgagatccaacgtcctttatttttatttttagttatctttatctccatataagcttatggagtagctcactattatccttcctctaaattaagaatgcattggaaatgaaactttgaaaatctttcacgcgacaaataaattacaatgaaaaaggaactgctaattagttaaagcctttcagcatatgtatatctgatctccacctttataagtagtacgttttttgagcaatcaatacgttatatatacgtggtatgtagatccgaacatattgctagaatctaattagcattttctctttactaaaccatctcatacggcaatactaaaggtattatcaatgaaaacatgatatcacttcgactgttatatacatgcaaagaaaattcactctagagagtgaaaaaagtgtatatgtgagagacaaaaaaaaaagaaaagaagaaggaatgtgtgtgtgtcagagagcgagagagggacctttgttttagcagaaaccaagatgcttgttgtggtagtgaggtttttagctcgtgaagatggatgatgcgtggaggcagacgctatctagcaggggtatttatagctgaactttcactcaacatgtgtctaacatatgaaaaacatggcccttttctgattggttgctaacaacatgccagaagggcaaaattgtctgtcgatttcacgaaattaatattgcctgccatgtcatttaatattgcctgctatctattgacatctggatatgacggatcgaacgcgttatcacctggaccatgtgttgttcgttatgctctcgtgtttgcaaagtacgtgtgatcatctggaatagatgtgattattttgacatgggtttgaatttacatttatatatttgttaacaagtgtactatataatttacatgtatttctcaactaatttgtgaatctctttgttgtctactgctcatccatgtcccaaccaaacaagctaaagctaatacaacaattttctcgaactattaaaatatccagatgcatgcactgaaacatttaaaattcataatgcacccatccaattttttgatgcacctcccttgtcgctccttccagtgaagcgacaacgtcatcctcgagcacgccagccttctcgaacgtgagaatagaagaagagccgctgccgcctaaatttgggacctcaagacaaatcattgcatggcgccacctcaacatcatcttccccagtgccagtgaccacgccattgtcgcacgccaccctcagggccctggtttagttcccaactttttcttcaactttcaacttttacatcacatcgtttcaattttaatcaaacttctgtaaaatcaaagtgtttttgattgttattctgttatgaacaatttgcatatgagattattagttttgatatttggaatttatttacgaagtggttttggagatgattgaaatttgcaggtgaataggaactgatgtctgtgatttgggttcggtcagaccgggcagtgtgtgccggtcagaccagtggtgatcgagcgttcagaccggccagcccgcggtctgaccggccgactctgtgttggtttcggttttgggttgtttatttggatatccatgattgtttcatatttatggcttctagatggatactatgcgtatgtaatactgttatttgctactaatgagtcaagttggagatagcttggtctcgaaatatggtttctttgtttgtttcatgtgtaggtgacttgatgcttcgggagagtattgctggtgatggatcgggagtcagcttggggataagacgatgtccgtgacggtcagatattgtgcgggatacttaggctagagttcaatgcacgtggttggtgaagattccatatggcatacgatggaggtattgtgtgcgtatgggatgcggagtcgaatttggaatgagtccaaattttttttgatgtgaaacagcaggagaggctcctactgcgctatattaataatataataataaaaaaggggacaatatttacaaaatttacaaggagtccaaatttggtatgattggagtttgtaaagtttgtttcttgtacgagaaggtttcgtagatggtttaggacttctagtatgagtttggttcgtagctttagactgcctacctcatgtataaatagagagagagtgtgaggcttcccggtatcgcttttgagagcaattgagttgatagtttagttagagtttcgagtttagtcgaaatttttgtaaagagtgctgttgttgcactttgtaaacacagagagaagcaataaagttgtcatctactttgagagttcttcgatttgtgtttcatcgggttcggtggtctaaccgacaacaaaccggcagcatcgcggcggtcagaccggcggcatacctgtggtcaaaccggcaacggcaacaggaggcagaggcgactttggagcggtttggccgggcgatcaactctagtcagaccgacagcttccaggcggtcagaccggcgcatccacttcggtcagaccgcgatccatcgaatttgagggtaacttttaattccgcaaaaagtttgggttttttggcataccaaccattcaccccccctctggttggcttagttcttgtatttcgatcctataagtggtatcagagccttgttttcttctttggattttaaccgatttagagtttttgccatggctaataagtttacaactaagccccatgttttcgatggaacggatttttcttattggtgtagtaaaatgcaatcttatattatggctgaggatcttgatatttggagaaaagtttctaatccttatgtgattcctgaacaaattaatactgctactttaaaaactgaatttgaacaattgcaaagctcccaatattcttttgagtgggatttctcgttcggatgatgatcgtgtttctcatcttcaaaccgccaatgagatttggattgctttgagtaattttcatcaaggaactaccaatattaaagaacttcgtcgggatcttttcaaaaaggagtacattaaatttgggatgaaacctggagaagctttggatgacgatctttctaggtttaacaaaattttgagtgatcttagatctgttgattcttcttatgatgttaattatacacaatctgaggtttctcgctactttttgaatggtcttgacatgcctatttgggagatgaaagttacagctattcaggagtccgttgacatgtctactttgactttggattcgctttacacaaaactcaaaacacatgagatgaatattcttttctcgtaaagttgattctaagtttagtgctttggtttcttcctcgacttttttggatgttggtgctccttcatcgaagtcttctattcttgttttaattaatgccatctccgatgagcaactcgaacagttcgaggaggaggatttggttttggttactaacaaattttctcgagctatgaataatgttaggtacaggaaaagaggtggaccaaatcgttgctttgaatgtggttcgtctgatcaccttcgttcgcattgtcctaagcttgggagagataagaaggaagaaaatggtggtgagaagaccaatgataacaagccgaagagcacattcaaagggaagaagatcaaagagactctcaagaaggcttttgactcaagtctatgctgcttttgagccattaagcgatgtagatggtgaaagtggagatgaagataagggaaagaacatctctggtgtttgcttcatggcacctggtgaatcggattcagagtgtgaagacaatgaggtccgttcttttgaggaagctattcttattttgagtgcaaaaaataagaagtgtgagaagatgtatagaaaataggagtttattattgaatctcttaactttgaagttgctagattaaaatctcttattcccaatgatgatgattgcaaaagttgtgaggttttaatgaatgagatttctaaaattagatatgtcaaagctgcacatgatttgaaaaatagatcttctctagctcttggatttgctttgcacgcacgcactttggatgagttgtttttgactaaaaagttgttgcaaaaatatcaaattgcttttcatgctagtttgatgtttaacatgatttgtgccaaaaagttaaaacaacaacatgatgttttggattgctcaacatgcacactaaacaagatgaaactaaaagatgctttaggtcgtgttgagtaaatggaagatattgtgaaaatcaatgaagtgcttttttccccaaatgtagtaaaagcaaaggtgtcatggtagattgtgaaaattgtgctaattttggtgtgaacaaaacacacccttatgctctcgtgtttgcatcaacgtacgtgtgatcatttgaaatagatgtgattattttgaaatgtgtttgaattaacatttatatatttgttaacaagtgtagtatataatatacaagtgtttgtcaactaatttgtgaatctccttgttgtctactgctcatctatggcccaaccaaaccagctaaagccactgcaacaattttctcgaactattgaaacatccatatgcatgcactgaaacatttaaaattcacaatgcacccatccaattttctaatgcacctcccttgtgcgctcctgccggtggagcgacaacgtcatcctcgagcacgccaaccttctcgaacgtgagaatagaagaagagccgccgccgcctagatctgggacctcaagacaaatcattacatggcgccgcctcaacatcatcttccccagtaccagtgaccatgccattgtcgcgcgccaccctcaccgctagatcctctcccccaactacctccttcactcatgcttcacataaatgaatctaaccatcccaagttacaagctccacagtgacctcgggctcatcccaacgttgtgagatcacctccatgtctgcttgtgctcaccatctaataatggaggagggggagaggagggagtggcagaagagagggagaggggccttgcctcctatgcctgcctgcagtcaccgtatggccatagaagaggggaagatgagggagcgagagaagagagggagagcgagagcaaggtatgaaatgagtggtgagaattgaggagcgcctgatatttctatcttttatcgagcgttcaagcaggagtatttccacaatgttcatcaaagacatcgtaaaaaataacagcttagtattatccaccaccccgagcaccttatcataaaatgaccactctcgaactaatatatcctccacaaaaaatccgactagatcatacccatcgtggccaagtagtgtcttaggctgcgttcgttctggggtgacagggagtttgtttgtttcgttttccgcgcgcacgcttcccaagctattaaacggtgtattttttgcaaaaagtttctataggaaagttgctttaaaaaatcatattaatccatttttgaagtttaaaatagttaatactcaattaatcatgcgctaatggctcacctcgttttgcgtatcttcccaatcttctctatctccttttcctcaaacacagccttacacaccaatgaatacgtcgatctacaaggacatgtcggagccgacgtaggccctcacacgactgcctcaattgatgcaagacaagtcagatactccctccgtttcacaatgtatatgtctaaatacattaacatcaatatgaatgtgagaaatgctagaatgatttacattgtgaaacggaggaaatatatgcttccgttatactccgtggcgtccaccgtaccacatttgcccacgtcaccagccgtccaccgtaacctcgtgccaggacacatgcatgaataggctaccactcggactcattggttggccagctggctaaggcatttaaaacaagaaaggtgcaggtcacctacaaacgaactggtgctgtgctctgctccaatggtctcggccagtgaaagcgagccaatcaaccagaagcaccaccggttcacagctgacacgtgccatgcttgcagcttgcatcacccaagaaaacaagagatggattggattttataatttcttaatgtttcgaaccgtcgaacttttataactttggccactgataattttttttaaaaaataacttaaagtattacaaagtattacgataaaattaaaatattatttatttacgtataaactgcattgacgatacataaacttatttatttatcatgtgggtacaatcgtacgaacttataaaatattaaatatttaggtattgattgtacccatatgattaataaatactccatctgtcctaaaatataacaacttttagctcttaagatttgtcccaaaatataacaacttccccaccaacattctcttcccaaccaatcagaaccctccaccattcaattttcccacctactccactactcaaccaatcgcaatcctacatcatccatttctacctactttcttaataaccgtgtctaactctaaaaataattacattctaggacggaggtcgtaggacactggatggttaatcttgctggtttaggtgtcgatcaggatatacaatgtaaatactccgtcctcctttttacttgatgtttccgatagctttatagaaattaaggaagctgtgaactgacgcttttgcccttcgctgtgatggctgcattccgtcggcgcgaccaataaataatccacgccgccatctctgatgagtccgcgacaacgagaccagcactccccagcggccacgtggagggccagcgacggtagcgccgtgtggagcgatgtcgtagaatcaaatcacaataactaatcaaaccagagagggtgaatggttggtatacccaaaaactgaaaacttttagcggaaataaaagctaccctcgaattcgacggatcgcggtctgaccgaagttgtcctgccggtctgaccgcttgattgccgtcgatctgatcgagattagatctccggtctgaccgccgagatcagttgccgcttgctgtcgccgccgccggactgaccgtctcgccaccaccggtctgaccgccgcttgccgccggtctgaccaccggtatatcgccggttagaccgccgaaacccggtgaaacacaaatcgaagaactcttaaagtagatgacgactttattgattctctctgtgtttactgcaccaacagctctccttacaaaaatttcgactaaactcgaaaccctaactcaaaattcaactcaattgctctcaacagcgataccgggaagcctcacgctccccctctatttatactcgagatagacagcctaaagccacgaaccaaactcatactagaagtcctaaacaccttagtaaaccctatagtacaagaaacaaactttacaaaaccaatcataccaaatttggactccttccaaattcgactccgcatcccatacgcacacaatacctccatcgtatgccatatggaatctccatcaaccacgtgcatcaactctagcctaagtatcccgcatgatctctgaccaccaccgacgtcgtcttatccccaagccgactcccggtccatcaccgcaaatactctcccgagacatcgagtcacctactcatgaaataaacaaagaaaccatattccgagaccaagctatctccaacttgtctcattagtagcaaacaacagaattacatatgtatagtatccatctagaagtcataatcctgaaataatcacggatatctaaacaaacaatcggaaaccgaaaccgacacagagtcggccggtcagaccgcgggctggccggtctgaccgcgcgcataccgccggtctgaccggcacacactacccggtctgaccggtcacatgaaataacagcagtacctgtagattcacctgtaaatccaatcatctccaaaactacttcgtgaattaattccaaataacaaaaccaattatctccgatgccaattgttcatcacagaataataatcaaaaacacctttgattttacaatctcccccttgatgaacacattggcaaacccatcaaaaatgttttagtgtttggaaaaataaaaacaaaagtggtaaaaaatacacttcgtacaaacgtacacatcgtgctaaaaaattcaaaagaaaacttctccccctttttaaaaagagagaaattcccaatttcaccgtctcaacaactcgaaaattttcaccttgcttctccaaaaaactcatctcttcttccccttttgacaatgatttcatcaagcatagaaagtatggtcattaatatataagagcttagcatacatatagt

SEQ ID NO: 65538 - DNA, 11051 bp, Oryza sativa
tttgcgagacgaatctaacgaggtatattaatccataatttgctacaatgatgctacaataatcatccgctaatcatggattaatatacctcgttagattcgtctcgcaaaatagactagaagttatggaatgggttttgtcaataatctatgtttaatactcttaaatagtaagattccgaagggttatttaataccctggggatccaaacaagacgcttgtttggtagagcgagcgagcttgctccccacctctcctccgatcctcaagccaagcgtagacgctggcccactgccagcctccatccatacggttccgtcgacgctccagggaaagccccctctccccgacctaaactggttgggggtgttgatgcctcgctagagctgccatgactcgttgaagctaaaggaggttggcacggattaatagtccaaattttgatagaaatgctcatatttttttgtggaatgaaggatagcaattccgctaatttatgcttcatgtgcagaacccaacacatagggttaacaatcatggatcaacatttttcttgaaagctatggccaaagttgaaagttctcagtcaaatctaccatacattgctcgatcgcatccatgtatggagaagctgactttagaatttagataccccaaactgctctgtacagttgacttcaaggcatccccgacgactccgaaatcagatatcgtgaaggtaagaaagtacattgcatcgaccatggtatgatctctctatacgtagaggcgacttcgatgaccggaagagctagctcgaaatgatggatctgtctgtagattgaaatacagttgacttgcaaagggtcatacagttgacttggtgattgcctgattggtgtgccacagtgccagttgaccatgacgtatgattgatgaggaggccggaggcatggagccatgcttgcagattgagaattttttttatttataattttttttattaaaagttttacaaaaataatttttcattttgaaaattgacggaaggagtcgcctaccgccttaaaaatcgccctctcagagggcggcgaaaatgacgtggcagacggccgttcgctctcgggcgacggccgtcaacgaaatttgcaggcggcccccttgccgccctccgctagggcgattttatactgtgcggggggccgcctgcaaatgggcggcgagggggcatggaattttgcaggcggcccccttgccgccctgggggagggcgatttttgcctctccccctataaagcccagtccctcctctgtgaaatttcattatattcactaaaaatccaaaaaaaacaaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacatcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgagggggagagagtcggtataattgttgatgaaatggagaggaaagattcggataatgaggaagtggacgacgacgcatcatccgatgaggaaggtgatgtaatggccactgattgggcaaatgaggacttctctggacttgttatatcagagggtgatcatgtaccctgggagtataaggagaacgaggtaattgagggtgcaagatatgctcataaggatgagatgaaggaggcggtgaagcattgggcagtttccttgcagagagagtttagggtggtcaagtcaacaaattatgtgtatgaagtgaggtgcatgaaggaaaattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgttggtaccttcctcgcactcgtgcgcgtgtgaccttcactccagacgccccagagccgcacgttgccgctgtcacggacgcgtatcccacgcaccgtgaccgagactacttcgtggcggtacatccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctatttcacacggtactgctcagcccagaggtttcttaagttttgtttctgtttttgtacgaaaacatcaccccgtcgtaacttgatgatccatcctcgcaggacctcgtttgccttcgagcgcccctagcttcggatcagtgcgacctacagcaccggtttcgcacggtacagttcagcccagatattagttcatttttgtttcagcttttgcacgattatgtcaccatgttttaactgcacgtttcctcatcgcaggacctcgtctgccttcgagcgcgttcgcaggcacgaccggcgcttccacgagctccgcaggggtgttcgccacctcttcgggcgcgttcgccagctcttcctctcacggagcgtcgatccctcgcccacacggtactttactttttattactactgttaaatacttgtacgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaagcgcacactcaggagcagccagaggtcacacctgtacaggcaggacgggttggccgtgtcgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtccacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcctattcattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaacaaaatatttgtacagtaacaatccaaatatgccctaaaaaataataaaattgtattttaccagtcttggagattttaatcttgtatagttttcaatataaaaagatttgataactattgatatttatacaaaaatatagagcacagtacaaaatcgcccttgcggagggcggcaagggggccgcctgcaaaattccatgcccccctcgccgcccatttgcaggcggccccccgcacagtacaaaatcgccctcgcggagggcggcaagggggccgcctgcaaatttcgttgacggccgtcgcccgagagcgaacggtcgtctgccacgtcattttcgccgccctctgggagggcgatttttaaaaatcgccttcccagaggccggtaggcgactacttccgtcaattttcaaaatggaaaattatttttgtaaaacttttaataaaaaaaattaaaaataaaaaaaattctgcagattgacctatcctgggcttggatcatatgcgtgctgggcgggggaaggcggcgaattgagagtggagagggaacaggcctagtcaaggtttctcttattattgggcctccactaattataacggccttcgttagtgggccttccgctagaattggctaatttgggcaccatattgggcctgattttggtaaacatttcttctcgctttagaccacaaactttgatagggaccaaatgcggctttaccacctccatcatcggccggaagacgttcgctgacgtcgttgccaagcatgttggatcgattcgaggccttgttggccaatccagaatctagcccattgggatgccctcttgatatatgcgtataaattcagattttatcccattgagatgccatgatatttgctcaactttgaaagagacctcacctcacctcacctcattaagcactcaaaacacatccatcatccatttataaaattaccactcccaacctcccactgaacacaaacacacaaaaagaaaaactcacagcggaaaaaaagggacaaactaccagaggctgacagggctagaaccagcaaacagtgaagacgccaagcaagcaagtggtggtggtttggcccccatccaatccccggaaaagatccaccaactccaaaaaaatctaatttaacttatccaaagaatcaatcaatcagcaacattctataacatctacccccatcttcttccttcctcccaagaacctggacgcagagcaagaaaatggacaggaagagggttggcatcatcggcgccggtgtgagcggcctagcagcatgcaagcactcactggacaaaggattcaacccaatcgtgttcgaagcagacgacaccatcggtggcgtctgggcacacaccttggagtcaacaaggctccaggcaccaaccacggcattcaggttctcagacctggcatggccagcaactgtgacagagaagtacccaagccataggaaggtcatggagtacctgaggtcatatgccagcgagtttgatctcctcaagtgcatcaggttcaatagccaggtgcttggagttgaataccttggtgcaaccgagggagagataatgcagtgggagcactggtctggcaatggtgaggcatttggtgctcagaaagatggggtgtggcgcctcaccgtgaaggacttgaaaattggtaacattgaggtatgtgcattcaccttgcatatttatcaaattcacactggtgcataggaatggagtaacatgtgagaaaagacattatctagcaatgaaaatagaacagcatcctcaccctgaacaagaataatatgaagtcagcaaatctgcttgaaccaacaatataatgtatttcaccttttgtgtgaagaaaattgtatgccatactgcaactttgtatgttgatctcctgttgtcacaggtttttctagtggattttctaatcgtgtgcattggaaggcacagcggaagcccaaatatcccagaatttccggcaaacagtggcctagagttgttcaaggggaaaatcttgcactcaatagattactcttacatggataatgcagctgaatttgtcaaagggaagaaggtgactataataggctctggaaaatctgcatttgacatcgctgcagaggtcgccaaggtgaatggtgcgtcaaacagaatcagctcctcactaactggcaataatcagtctaaagaacatatggctaacacttctgttcaaaatgtaggtgaaacccagccatgtaccatgatatatagaacaaggcactggttggtacacaaatctagtatttgcggagttgacctcagttacttctatcttaaccgtatttcacagctactagttcataaacccggtgaaggatttctatattatgttttagccactgcgctctctcccttggtacattagcacttcaatttaattggagtttagaaaccagttcaactttcattcagactaataagcttgagaacccacaaaactgaaaatatttctttccatctgctttttcagagatgggcaatctcaaaagtaattgaaacttacttcaagcaaagcattcctttacaaaagcatgggatggttcctgactacagcttctcctttgccatgtcgtcttgcttgattgcaatgctaccagaggggttttatgataaggttgatgaaggcagcattattctcaagaaatccaagaggttcagcttctttaatgatggaatcatcctggaagatggaaatgaacacataaagagtgacattgtaattctagcaacaggatttaggggagatcagaaacttagagacatcttcacagcaaactggtgcaaagagaaagtggcagggtcatcagctactgcggtccctctatacaggtagaagttcaacatttctttggttagtgtgcatactttgagaacaatacagtgaatagacaggaacaagggataacattatgtccgcaaaattagtgcactgctattatgcatgaaaatgtccatcagctgttgaagctattaaccaatttttacgctccagagcagctaataggtatcattacgaaattccaatggttttgataacaataagccagtagttagcataatttgggatgatgagaatttaataaacttgatacatcatgtttaagttttaatgtttactagttaaagcctgtacgttcatttcccatttaccaaaatatttgaaacttgcagagaatgcatccatcctcggattcctcagttagcaattgttggatactctgagagccttaccaacatatatgcctcagaaaggatggccaattgggttacgcatttcctgggtggtcgcttcaaattaccaagcataagatgtatggaagagagtgtagcagagtgggctaaatataaggatctttacaacggaaagtactttcgcaggtcctgtataagcaccgttaacatttggtttaacgatatcttatgccaagacattggatgcaaccctaaaaggaagaaaggagtactggctgaatggttccagccatatgggcctgctgattatgcgagtctttactgacgactaccctacaagtatattcataggaaaagaacacaagtactgcctccaggatcctactgattgattagaaaggttttatatctttcaagtttgttgttatcataacaatataaaatagaatctaccatgttctttacacacttctactttcagagagagagagagagagagagagagagttagttctcaatttatgtgaatttatgcttgtacttcagttaatatcatgtaaatctacctaaagtccaaaacatttgcaaaagtcaacacaatgctaagaacaaaatatattgaactagtctgttgagtataatgcacctttgatcacttccattctctatcttcctatttatcccctgcagcccaacatcaacatgtacttgagtgtaatctgcatataacaatgtattagcaaaaatactaccagctatgtgcataccctaaagatgcaatcatcactatattttctaccaaaagataacaactagatgccaaaccaatgtggtaatgttacagccaaagaaccttattcagattaaagggttgtctttgtctcctaaaattaaaactaattagtaatctctttgtaaatgtacttctgtcatggtgcactagaaaatatgctaagcgtaatccatgataggttggaaaaggatatcttttttttaattagatgtaccttctttgttttactagtgagaaagatatatcttattgtttaacaacagatgatatcactgtatatgtcaggtatgggaagatggcactagcatgagactcaatttagacttaaattgagccatatgtagattggttcaaaacttcaaattaacagcatctcacgtctagttcaattcttggtatagaagtagcggtaatgattagttacttattattaaacgaatcaataaaacatcacaaccaagaatacattttcactaacttgtatgttggctctttctggtgcaaaaaccaccaaggacctgctctcgaacccaatctgtaaagtagataggtaaatgtcacaacatgatcaaacagcctggttatgatcagcaggagccaaagtttgcaccacaacaatgaaaggtttgcatccattaaatgcttgcaagcatatgaacgattctgaagacaatcaacatatgcaaacaatatatttacaaaccagcacagtaattctgtatttgaaatgactgaaatagagctcaacaaaacctatatgcaaatgttgtaacagctgcattttcaggggaagttaaactctgctatttactccatccattatagtacagaaaagataacaatacatatcaaagataacctcaaattgtctcctacagttcagcaaatcacgagaggaagtcagaaagaaaaacttgcctcaaaaatcctgcagtcatgcgcaaacccatgaaaagagccagcccagcccaaaccccagggaggccaaaaactttgggagcatatagcaaaaataaagaagatattgccccaacagtaatctgtagacaaaagacagtaattaatcacagcagaaaggaaaggacacagtggcaaactaaatagttgcagctaatgcaagatcaaaatattacagatttattatgtaagtgtatataccattgaagaagcagaatatgagaagtctgagacaccgaagtgaagtccatcgaagataaaagctagggcattaattggttggctggcactaacaaacttcaaaaacaaaaacagaacgggtaaagatgacgttgacagtgctgaagatcttattgtagtatgacaaaaaaaaggggcacataccagaacaccactcccaacaatttgtagaaccataggatctttggagaacagttctgcaattctaccaaaagaggcaaacagaagaagggctaaagctgcaccaacaagcagtcctatctggaaaatagagttcagttgtaagttgcttcgatacatgctcaatgaataatatccaacaatagaagataacacctgcgtaatttaataaaggttgttatttattaccttcaagacatagtatgtgacctccttgaccttttcatagt

SEQ ID NO: 65539 - DNA, 562 bp, Oryza sativa
  unsure (1)..(562): unsure at all n locations
tggtcagtatcgcttggttaaagatgaccaagtccctgaaacccataccgccaagatattttggcgtagacagccactcccacgagggccaatgcatcttcttcctcccgcctcttgagcaattcaagcatgctagaggcatcagtcgagacattttcattttctaaaaaagttagtcgagacattttggcaggtggtcaaaacatatttactactacctccgtttttttaatagatgacgacagtnttgaccgaaacactggtatataaaagctgctatggaatagagagcattctcatgagccttaaaatttgggggggattgatagatttaattggttaattgatccattgaaatcaattaaattaaataaattccaaggctcattatgctacgaattcatgtgtattcattctctaatgggatatcaatgggacgaggagttttgagaattaatccaattgataagggaattggtaacttatatcaattactcctaattaatggatggttgatggttgtatagtgaagaatggatcattactagttgatgacaattag

SEQ ID NO: 65540 - DNA, 26335 bp, Oryza sativa
aataaaataattaaaacacagttggctcaattagctactttagtacctgcaaatgagtctgggtggattccggggcaacccgaaccctccgttgaaaatgttaaggcgatcacaatgaggggaggtaagtccactcatgatccgccaaatcctaaccctgcagggactagcagtatcacccaggaagcatcatctggtaacaaggctgatgaataagtttagctagagaagacagtgtcgcaagaatactgtgacacacgactgttgctattccctcaaagaagcaggaaactgtcactagacgagcagcttgctcattttgttgaggtgattcaaaagatccatatcaatgtgccattgttggatgccatgcaattgccaacatacgcacattatcttaaggatattctcaacaacaaaaggccgctgccaacaactgaggtggtcaaactgacggagcagtgcagcaacgctatactccacaagctcctagaaaagaagaaggatccggggtgtcccacgatcacttgctcgatcgggacatagaaattcgaccaagctctctacgaccttggagcaagcgtaagcgtcgtgcccaaagacgtcttcgacaagctcaacttcacgatgttggcaccaacaccaaagcgcctgtagttggccgactcgtcagttcgttatccggctaggatagtggaggatgtactggtcaagattcgagatttcttcatcccgatcgactttgtggtgcttgacatggacactgaaaaggaaacactgctcatcttggggcgtccattccttagcaccgcaaacgccaacattgatgtgggaacgggaagcattcgtttccgtataaacgggaaggaagaaaaatttgagtttcaactaaggaccgaacaatgctccatggtccaaatcaaatatgggccaaacccgcaaaacattcaagtggtcgaagtggagctacccaagacgaacagcttggtgaagttcatgcagaacttcctggagaaggaaaaagttaatcccaggaaccgttattggaagatgccggtaaaatccaatatactggccaagaagctagagatgccggctcaaaggaagccgtcgctcgcaccaaaaccgattaaggtgtggcaagtaaagcaaaagacgcccgctccatcacctccggagacgggtggaaaatccgcaaactaaactgaagggaggtgtcacgcccagaaatttaacccaaatttccagactattttgcgtattaaatccctgtccaggaccagccagggtacacaaaacgacaagtaatatacagttccaaacataaataaagcgtaaaatacttacagaagaggcacttagtcctcacaccgaaacgaaagcagcagtagcggaaaaaggcgatcctagcggggcttcaactcctctccacaggcaaaactcaactggggtctgagccttggtcctctaacttcatcttcagctcagaagcactacacttctgaaaagggggaataatagcaaggctgagtacaaccaccgtactcagcaagccacaccaacgatgcagacgtgcaaggggaacacaaggacggtttgtggctatttgcataaaggtggttgtaaaacattttattgagcaaaacagtaaaactgttgagtaattaaagtaacattaaatctccactgatcaaagcaacaccacgttgaacaggcccaaccaacccacctgaactacagtgcattgagtcgatttattaaggtgggactaatcacggtgaatttggtcgaccgcccataaccacgggcacggctattcgaatagttttactctgatcagaggtctacaactgtacccacaagacacagccccacgacacgtttccatgcgccgacatgccaccacgacataccggaaagaggccgtgacaggaccctttgcataaccccctctaaccaagcacaccacacctcaggtttcacccccactcctcgcaaggcagcgggcagtcccctctcgtgtctaggtgaatccggaagccacataggccgtcgcagggcctatcaaaactccatcacgcccacccttgcctggatgcgttagctagaggaaagctacaatacaagcccaatgttgacaaaagacagataacaagtaaacatggcacaagcaagcaaataggtaatacccggatcccatgtaattagcaaaacatgcatatttatttgcaaatggtaagacatttgtaaattggaatcaacatgctcaagggggaatgtgtgacttgccttgcttcttcaaaacaatcttctgaactcttttcctcgcgaccgcggacttctgaaacgacggaatctactcgctggcacgcaaaatgaggaaaaactctaataaacaccaagcaaacagtacataaaaagtaaacaaacatgtagagctcaattttagatggattttgcaagttgaatggcccaatttggagtccgaatgaattagatatgaaatttagaagttttgagccattttaatggatttctagaattaattccaatttatgacgcatttattatttattttccaaaggaaaaggcaaagccgctgacgtcatcaaggggaaggggcggcgccggcaagcgggctccaccggtcagcgacacaagggcgccggtccaccgtggaccgggatcaccgaggcggtccaccgacggtccacgggaaccgacggctcggatcggcccaaagccgatcgggcggcgacgagacggcgtagccgggacacgggcatggcacaaagccgacccggttgagcgacggcgcacggcggcacgcggccagacgaccgccggcgacggcggcgcgtcgcggcagcgggcacacggagcggcggaggaggggaaaaaggaggaggcggagggagagctcaccgagggttgcggcggcgagacgaccacagggaggtgaccggcgatggaaaggatggcagcggccggcacgggaggcgatgggaacggtgttccgacgacgcccgaccacaacggaggctcggccgagggccggcaagacttggggaagatattggagcggttagggagggaagagccggcacggagcgaccaaaaacgacggccgacgcggcgatacggagtggagcttaccttgactttggaaaagcggctcacgtggggttctggacagagtggagcggcagccagggtgctgtggagcgtggcgacgctgcgcggtgacggctagagcgggagaggcagcggctggaggcggtatagttcaggcggctcgggtggacagtggaggtggaatttcggtggtagattggggaaaagagatgtagaacggggtggagctcaggccggcgatgccgacggtggcgacggcacggcacggcggtggttgaagcggcgagaagcggcggctggagccggcggcagcggcggagaaaggtggtgcgcgtggctgtggcgcttcgaaggtggagaggggaaatggagcggtggacggggtgcgcacggcggctgcggtgccggggagggcgacggcgcagtgcggggtgaacgggagcggtggcgcggtgcggctggagttcgccggggagcggcggcgcgtggactccagggaggatgtggtttcgtgcacggggaagctcggggaggaggaggaaacggaagaggagagcacgagggtgctttatataaggctcggggatggagatcgtggctgggagaggcgggaacagccggcgaagtgtggcgccgacgtggggtggtggaggagttaaccggcgccgattttcacggggagagtgggggaaaaggtggaggaggtggtagggaaccgattttactcggtttgggagcgagggtgccagcgggaaggcgccggattcgacgggacgtgggcggcaaccgtcggccatggcggcttcggcctgggaagccggaggtaggaggagggcctgacaggtggggtcgccgggcccacctgtcggggagggagagagggaggagaacctagggggttatttacactttgcgcgaggggaaggggaaacgggccgacgacccaagagaggagaggggaggccggccgaggaagagagagaggggcgcgggccgcgggagagaaagggggattgggccgggagcagcccaaaagggagagaggaggtttttaatttgtttttcattttatttaattggttaaatgaactttgtgctattcaaattgtttctcgagctccgaaaattcgcgggaaatttcagagagtattttagggcacaaagaatattacaaaatattctcggctaatgatttttaaaggaaattttaaattccctcaataatgcactttattaaattgctttaacttttatttaatttctagaaaatacattatttaatgatttttaatcccgaacgaaaatcggggcgttacaaatctacccctccttacaggaatctcgtcccgagattctgggatggctagaaagaaggctggttgcggggtggtctgactgatctgacaaatctgcacactgcactgttccttcctgttacaaactgactgatatcattggattggaccctggaattctgacaccccacaagaccgattaactaaccaaacctgtatgagtgatctggctagattcagttctacggtcctgttgcttcccaaaactgaattgattggttctacttgaactgacgcagactaggactacggatactcacaaaacttacttatcttgggctgaactgtcaatactagcaatttgataacctgacaactcaccaagctggctggaagagggtgaaacttgcatctggcatttgtaactcattgaccctatgtccgcttgaactggtcctgactcgaacggcaagtaattccaggaaaacctgcctgacctgtctttcgtctgaactgcaactctccttgatgtttcttctctaagctgaactattgacctggcctcacgagtgtaccttagaattgaacctatcgagttgagattggggtaactctgctagcaccttgcaacttgctccttcaagtacttcccaaattgttgcactaggttgaaccttcaagggaaacggcgacgaggcgagccaaaactcatctctgcgacctaccccccttacagagagtagtcatacttttgcctaactgggaacctttgaactgttgtccgtaaaaaaaaacaccaacacttctcgaatttacagagagccctgactttgaaaactgaaaacttcgtcgatctatcaaaatggagcaatgacgaggcactttcatcccggcaagacttggaacttaacccttagctgatgataggaaattccacataaaagtgactctcacttagctcatgaacataatgacccttgactaactttccaatcagttctaactgctggtaagactatcctgcttctagcgtggttctagtaacacatgcctgaatggatggtgtagttgacattctttgaaacataccctgatcacttaacagatcaaacttgaaaggtccttctcatggtatgacatcatacttaggttatcctttgctgactcttcctggattgatgaactgttggccctgcagctatgttcccagaaatactgcaatctgaacgactgccggaaactgactttgatgttgccgatagtttctgctctttgatcataaccacttcgctttcatatcttcggtaaagatgatccgttgaaaagggattctcggccatataccctactgactacacatttctggacttgactctgtatacttctaacccatgtatggaacaatttctttttcaacttctgagaaacattgaaatgattcctggaacttatactggttgccttgaactaaggaaatacatactgaattcatgctcgcaccactagggtgtaactgtcgcttaccattccctaacggtttccaaggctagagagttcccaagattctttatataatgtcactttcaaatattccatccctcttttcatttgagtaccactgatactgcctttaaagagatctcatcacgtcaagtgttgagtgtctaaccattttcactccgtttgttaaccattcctctattggctagcaaacaggttttggagctcaacaaaattgcgatgagttagaagagaaactcttagtttcttgtggcactgacagatacacatattaaattgcttctgcatgctcaagatgaaccataaaaggagaggaactggctgactcatattttattcaacatttctttttcattacatggctgccataaacatatatataccaggagaagtactacaaaattaaacattggtagactgatgctgattagaactgcccttttcacgactgaacttgaaaagtagaagtcttgtctagaactgctattgcttccattattcaaacctgactgacttgtttctttagttcctactaacagaagttgcatcggaaacattgctctgggcattgatcttcgaagagggaatggcaatcctcttgacagctgtagcaggtggggtcttcttgctcatgagattaccaagtggtgatttgccgatgggcctccggattggagcaatacgaggtgcattgctaggattgtcagttgccggatgacttggtgctgccgatacttgctgcgggtactgacaaaggagcgttctgcctttttgtagctgtagcaagctgttgttctcctggcattgctcaccctgctggcgttggtgttgtaggcttgaaacgattgccggtgaacaatgcggcctttgacggtgcccttgacaactatccgttgaggcggaggttgcaccttcagctgtcgtttggtgttgaggatagtgctggtgacttgtgagcaatgacgaactgcctttgttgctcttggaaaaggacaatcactgaaacaatgtcctggcttacgacaattgagacaaaaccgacttgcttggtcctgaggtgcaggcttctagttatgcacattgacagctgaaactggaacaagtagtgacttatgaacatccttggtgacgttgcttcttccatggttggtttccactggagctggagttggaggaagagcagaagggttgtgactgttgttgtcgactgccattggttgacgaatgggttgcacggttgtcccttgttctttcttggtcttagctatgaccgcgttcaactgacagtccttaggcacatgatctgttccttcacacaagaaacatgtgaccttcctcaaagggcatgcatctgagtaatgggtgtattcaccacaacggcatgtggggaggcataaactagcagtgtgtccgactatcccacatctagtacatgctttgaactccaatcctctttccatgaaactgttaagggtcgcatcatcatcgtcatcatcatcatcatcatcatcatcgtcgtcgtcagcagagaaccgctctcctgattcatcatcttcgggtctgggcggaccgtactttatgagatgccgggttagctgacgcgctcctcggaaggtatttcttcctctctgacgcttgggtatccttgctacatcttcaggagtaaattctgaactggtgatgaacatggtcctgccattatccatcttccattttactgtcctgttcgctccagagttgggctgcaaagtaccatccttctagtcggtagactgacttggagcttggttacttcctgggcactacttcttgtatttttcaggtgacctggcgaacatcttccatggacagttccttacataatgaccttgctcaccacagtcataacaggtagcacttattttcctttggtccgacggtgagttggctgaagttatcttcggggatctggacaacattttgacaggggtcttaggtgccgatattgggaactcctgactctgactctgattcaggttccgggttggcacctggacttgcatttgtggctggtggccttgacgcggctcctgacattgccgttgcatctgctgcatctggtatatctggtaccgacgtcgcatctgtcgcaacaattcttccactgtctgagtctgattagccatgactttggattgaggctgatcttcgaaaggttgacatgggaagctcatagagttgtgctgagttgatccatgaaactgttgagatcctgatccgatgaaattgtccctcatgctgaccaattgctgcgggcacaagagagagagggggagatgagaggggttactagagatgaggtactagaccacttgcctactgatctgttgtgagtagacttttattgttcaagttgcttaagcaaacaacctagtatggtcgcatccccaccaatgatgcaaaccatgcccctacacacaagcaaacaacacacgatctagaagctaatgaaactactcttccgggaaggattgggtttagggtaaattccgggaaaacttcacttgaccttcgcggaacgacgactctgaactgatcttctcgctcctttctgcacgaagcttgaggcttgacttccgaacaggcatgaagctgacggcttgtcctccaggttttacaactaacagaattggagggacagggaggagaattttgtaaaaaccgtttcacaaagaaatgctgaagggcaggaggagacattttgcaaatagggttttcggaaaacttgtccttagggtttgaccatttggctcacaccctgaagttcttctcccaagcctaaattgaatttataaatggtctccagaaaataccggtgcaaaagcaagagagaaaccctaaaggaattaatgcaaataataatcggaactggcatgtgggatttttcctgagttctacatgtcaaaatacgctaacaagatttttagtggaattttcagagctctagaaataattttaaccaattaaaaatgagcacaagcaatatttatttccctggaaattcttttccttctttttctttctttttccctcgttttcttttcggaatgggccgccggcccattctctcctctctccccttcccgctgggccggcctaaggctgaggcccagctgagccggccgcctccctcctctatcccgaggtcgccgacaggtggagcccacctgtcgggtcctcccctaacctccagccgacgccgccgcgccctgcaaccgccgccgcgcccttgctcccgcgtcttccgggccacgtcggccgcgcctgcgcgtgcgcccgcgtctcccgcgcccactccctctctctcctgcccgcactcgcgctcgagacggtcgggatttgattttcgaatcccgcctctctctcctctcccactccctccacgttggccagcgattcccgcttctcccggccacgtccggaccgctcctcccctatttaagcaccaccgccatcccctttctctttttccccatttcgctgagtcctcccatgctctctatcaccctagcgccgtcgccctcctctccgccgccgccgccgctgctctggtcgccactagccgccgcgccgagccgtgccatcgacgccgtcgcatttgccgttgtgcgggccatcctgtccacccctccatcggaatccgccgccggaatccactcctcgccgtgcgccggtgtgcaccgccatggccgccgtcttcggtcggcgctctcgctctctcgcgttttcctctctccctctaacccctctcttcttgctcgctaggtggttccacagaccgtccgccgttcactgtcatctcccggtcgtttctcatcgccattcgccgtcgccccgtgctgggcgaaccacggtgagcatctccccgtcgtctttcccctctccctcttagcgccgctgccttgccgttcggagttgcgccgccgtcgctcgccgtgcgccgccgctcgtcgtcggtagccgccgctccccgccgtcggccgctcgccgccttgcgtcgccgtcgcgtcgcgccgtgccgccgcgcgccacggccgccgggtcggcttgaaccgcccgtgcgcgccggctgcgtgccgcctcctccgccgtccgatccactcgggtggatcggggctgtccgttcgtccgcccgcgtggctgccgcgtggccgccgagtcggcaccacgtggtgcgccgcccctttcccggtccgtggacccgatccaccatggaccagcacccgcagccactgccatgtggggcccgcatgtcggcgccgcccctctctctcccagggtttatttattgcgcaataaatcagttaaggatttttttgtttatagtaaaaacactgtgaatcttctaaaattcatatctaattcatccgagctccgtttaagcccattcaagtcttagtaaatcaagaaaaatgcgtagaatccattaaaaatggttttgttctctgtttcagtagtcatatagtctgtttgtattgtttactttgtatgtcgcttagattccggctctcccgacgctccggtatactttgagatagtcgccgaggtttccccagcagcagagcaaggcaagtcatgcttgtcacttgaacatgttgatcctatattgcaaatgttctattgttttccttcaaatattgctttgttttacaatgataccatgggatgtttacctactgttatagccatgctatttttaccatgctcctttgttagcttgggatataacatgactagatattgggctagggattgcttagccatgcttagttcaactagcacacaatgggggcaatcacattaatgtttggacttcaggttctagtgttgatgttggtttggtgccaccgctccggtgttggtaaattaaaattaactaaatggtgggctgtgggtgcatggttttgttggtcgcgcccatgacacttaaggaccggttcgcgggaaaccctggaagaatacctcgtacttaccacaagccagcgtgggcaactggttggcttgtagtgtagctttcctctagctgacgcatccaggcaagggtgagcgtgatggagtttggatgggccctgcgacggcctatgtggcttttggattcacctaggcacgagaggggactgcccgctgccttgcaaggagtgggggtaaaacctgaggtgtagtgtgcttggttagagggggttatgcaaagggtcctgtcacggtctctatccggtatgtcgtggtggcatgtcggcgcatggaaacgtgtcgtggggctgtgtcttgtgggtacagttgtacacctctgatcagagtaaaactattcgaatagtcgtgctcgcggttatgggcggtcaaccagattcaccgtgattagattcaccctagcctagtctaatggaattgaatagtctaggtggatggttgggcctgttgcaacgtggtgtagcgttggacagtggatggttaatattgattaattattacaactgttttacagctttcaactactgttataaacgctcgctttatgcaaatgaaccaccctagctatcctttgattataccctgcatcataccccctattccggtatgacttgctgagtacagtgggtagtactcagtcttgatttattttccccaaaaccccagagtttgagtgcgtgtcagatggtggtttttccgaggagtaggcttcgtccatgccgtcgaagatgcctgtggagtggtgttcccactgcagtccaagtcaaggcttagctccagttatctattttaattttccgctgcatttatgtaagacttttataatgtttgtaagacgtggatctgtatgtcaactttgtcgtttgtgtaccccggctggtcctggacggggattttaatgcacattctgcttggaattctattcgggaatttctgggcgtgacaagtatggtcttgcacatcggacccaaaatgacgcgacctttgccaacaggtaaattggtatgtatccgcatatttatttccatcaatttgaatttttgcatcaatgcatatttgaatttcaaaatttgcatctagaattgaattttgaggaaagtacttcaaatgaattttccagagcaagccaaaataaaattttcaacgaaaattcgctgtgccacgaccacactgaccgttggaatcctacggccgaatgtggggccgattgaaccggccaggcaatggtcacatgccatttttggcagggtaacggctaatggggcccacaagtcggttttgattgttgtggctactctatataagccaatcggccgggagagagaactccaccccatttcaactcattttcattccttgtacaagctttgctctcaaaattcattcaagctttgctagtttgcctcaaattcaagcatttagttgcatacacaaaagttgcttggtggagctaaccggcgggtgaaactcttgttaatctaacgcctgccgggttagtccattcttgttcctttgtgcaaaatgaggaggcgactatttgtctgttcaagaagggacccggctctccatcaagtcgtcatgacgagtctagcgcttgtttatccgccgacgtctcgatggaggatgctgatgttccgcaacgtctcttgagcgacgccaacctcgaacttgtcagtgattttgaaagacaagcctacttaatgccgaaagaccgggattatgctcacacgcaggtatataattcggagctactgaaaaaaataggtatggatactgactttcgtgctatttggaaagctgttggatggcagagatttgctgtggtagatgagcctgctcctcatttgcttactttgcaatttttgtgcactttgaaagaaatagaatatggaatttcctttcactatttccataatgaatatacactttcatggaaaggattaaatatacttcttggttttcacgattcctgtaaaatcgatcttcggaaaagaatttctgcgttgtagaaaaacagattttgggaagacatttctggtgctccaatttgcaagaaacctaggatgaatgatatccataatcctacacttaggcttatgcacaaatggattgctatgactttgttttctagaggtgatcttagacctactagagaggatggattgattatcatgtttgccatggttaggaagattaaaattgctcctgtgaaatgtatgataaggcaatggttagagagtataagatttactgctcctgttgagtacacttccttgattactcgcatagcaaagggactaggggttattaccaatgaccaaattgcttatatttcaaccgcttgtccctgtgttgatgagagttatctagtgcaagggcatattcttaaacatggagtagatggatctttgatataccatttccccggttctacaaatgaaatcccgttgcctaacgcgggataacatttgtaccgctttcatgaactaatctttcccctgcagaccatagaagaatctcgtgtaggtggaacatacagggagacacgcaactgttagtgatatgccctagaggcaatcatagagatgattgtatcacatactatgtttacatatttatccgacactgttccttgaaatagataactccttattggttaatgaatatgtgattctttcatgagactctttatgttgtttgttactatttctaaaggatccctgatcaaatatcatatatggaacaaatatgtttatatgatcagcacatgtattaattgatgatcatgtctcatggatcatggtatagagataccaaattaataatgtggatacatgttggtgaacatgttgttggatagatccaacatgagacactgtaagagccatatgtgttgtgtcatcagtgatctcattgagtgttggtgttgaatccttagacctgagattatgatggttctcaacatgtgtagtagcttacttagggactgctaaacgctactccgtaattgggtagttataaaagtagtttttgggtatgctatgaaacacgtagtgggatatgaataatcaagatgggatttgcccctcctatggagagatatctctgggcccctcgatgttgtagattatggaagtgcatggccatgccaaaggtgattgaggagtcaatcacaagttatataatctatcaacaggttcgagtgaatgattgagctattagaggatggcacatatctagccttgagcttaatcgatatcgtgaggcaaaggggttcatgcaagtatacactagaggttcagccgatatgatctttatgtatgcccggtgggtcaatacgttctgctaggggccgctgttgacgcgtggatcgaaaagaagttttcgggttatagccgagtatatatgaacctacagggtcgcacggttaatgggccggaataaggggattagataaagatccaatatgagcttaattcgaatagggatccgaataggagtcctaccggccttggaggcccgagtgatggatcctatatattcgtgaggggtgtgactggcggaggcattgcatcacgtgagaaacccaagccgttacttccctccccgagcaaaaccctagtcgcgcgcgggtgctagcacatctgtggtggcgttccgtccctgtacgtgtggataccggtagtggcgccgctagtttgcggtgctgattggcgtgggagtacggcgaggagaacgcacgaggaggagaaggtcgagccggtgcgatcgactacttcctctacatcgacgcgcgctacttcgcgagagttccttcgacttctcagcatcttcttccactgcacagcgcgttgagtggtaatgatctatgatctaatacttgcatggttcccggtttacgcgatagaaatttttgatttatgctatcgtagcctacgcgtatcccaacagcaacatggcaaggaatgaacgagaaggttcaacatcctcaacacccgtacagatgtatgaggctggttgggagccaactagggatgcgcccagatggacctaagctccatgccatagcattggagtctcgagccagtgagagccgatggcgggcgcctcatgacatacagtagggaggctggaacaatcagtcccctagatcaagtggtatgcctccatctcccggtgaatggcactaaagttcctctcattgggacttgagtgaaatcactaggagaatggatactcttgatatgcagatgggagagatcaaacacaaccttgaggaacacatagcacggacgcaagaatggcaacagagggctgatccgatgtccactggaactgcacgccaatgagaaaaacgagccaatgagattgactcggtttcggcataatttgattacgccgttaaggttttcacatggcgaattgtagatgagatctagcgggaccgccgtgtgcgttgccccttagatttcgcttggggttttttatatctatcttactttattgttgttgtatatttgatatgacatggtacgatagattcccatagaaaaattaagtgtaatttatgctcttccaataattgcacctattacggttgtgatcataagtgatgggtttgccatagcaaagtgtcactttttatcatgataaaataggatagatgtcagacatctatatgcggagacaaggttatcaaaacagttttggaccttggggcataggttgggttggacatggagatgtcaccccaacagcacaagagtcacatatgatgtgattagcaaggtgttgcttacctattttgatagttgtctagctgtgatgccaaagctcactagacactaataaaatgaggatcttgactcactatgttactagagggaattttgtttcacaatacatagtgggagtatcttttgttaaattgtttaatgaaaggttaaatgtaaacatggtgctgattttacatatatttctattgtagatcatggcagctcctgcaccatccaattttaacttgcggtctattcttgagaaagagaagttgactggaacaaactttatggattggtattgcaacctgagaattgttcttagacaagagcacaaagagtttgtgcttacacagccttttccagctgacttgcccaacaatgctccggctgctcaacgtagggagcatgaaaggcgatgcaatgaataccttgatataagctgtctcatgcttgctactatgtcccctgagcttcaaaggcaatatgaggcattggatgctcatacgataatcacgtgttaacaaccaaattaggtaatatcagcgttgggagagaagattagatcgaagaaaagtcagaagcggagatcgagtttgaaaacagagcaggaatcggctggaatccaaatcggctacgataagatcggctgggtctgagtcgggctaggtaagccgatgtagcagatcccgacaatatgacttgtacgcgacatcgggttcaagttaatgtacttcaagatgattgccacgcacggatagagtcctgggaaggaaattgtatctattaattaggatatcttatgtaaattccttatagataaatgtgggcaaaagtctgccgcaaagacttatggtatcttagagtttgttagagataatagtcgtgtctggtatgggcatatcttgtaattctcgggtataaatagaccccgagccctatgtaattaacaacacacacgttcaatacaatttcggcgcatcgctacccttttttttagttttgtttcgatgagttcttgctttcgggttgagctgcatcggttttgatcttcaacaagaggtaaaacgtgttatgacgacttgcgttcccaggattagtgcttccatctttatgatactctaatctcatttatgtaattcgtcaagttatcgtatatcttacataatctctagcaatatcgccacctaatctattatcggctaacatatgtatacaaaaagcatccgattaggttagatcttgatgttgatctagattatatgagatatctaccattctatgaaacttctagcggcttgattgtctagatatcgttcttcttttcatacttaatgctgtatcagttgagtttgacctattaagtcgtgcttagaatatcaatctctagcctgccttctagttgcagctgatcgtatctgctttaactatatttgttctatatgcttcattgacatgttaaatctgccctttatatcaagatattgctgtgtctgagtatattaggctcttgttcgataaattattcttgctttaatatcctgatatagagtagtatcggagtattagccgatacatgctagatctatctgatcggctacgctataaacatatatagtcctgttattgatatatatttcgatctaagtgatttatactatctcggcatgatgaccgatctatcccaatcacttgattttaagtatacatcgatataaagagtatatatcgttaatatctacagccgatcgagtagatttagttcttctttacttattcatgactgccgatcgatacacagatgacatcggctcaaagataaatgatatgtcatcggcatctagccaatcggctatcatttatagatttaaccacggtttctttgcttccatttcttgttgattacaggatcaaatcagctggcacgctaacacatccgaaggcgagctttggacctgcattggagttaagcagatctcccaggccacgtgttttctgtcaacacgcttttggcaggcccggtgggacctataagaagtcagacgacagttcttcctcatggccgaaaaacaaccacaaccaccatccaccccaggctctgttaagaaaaagatgttgaagttaggattgactgacgtcaatgaagaaaacgtcatgccaatcgaccccgagaaattcacgcccgagcagaagaaaaaatttgaagcaatgttgcagcaagcacgggatctgttcttaaactcatttatacagacccgcaaggagacacttgttcagaaatacaaaataaaggtgattgctgatgatcctaggaccagctctctttgggatggagatgggaaacaagctccaggcggctcggctcagccgagtactaaaggtgctaccgacggctccccaagcgatcaaggcgacaattctcaaggagttcatggcgtccaaggtgatggtgctcaggagccacaaggaggaaatcttaaccagaatagtgaactagcacaagattttttcaataacttccaagatcgggttgattacgctgtgcatcatgctttgatcaatcagtccggggtattagtcaatacattgtccaccatgatgaagacaatagccgatggttcgatagttgagcatcaggctgcaggcccaatttacttgcaaggaggtgtcttcccaaattatctatctttgatcaccgatgctcagccatctgttcaagcagttccctctgttgcacccacgactcagccgacggcgccagcgtcgactcctttgcctgctacactagctatgtcaccaggacaaccggtgaaccctcggttgttaacaagggaacaaccacaacatggcgggcaggctacgaatcagctaacctaagaccaagttactgccatgtttctgccacctccacctattgttgatccagtacagcagcagccgattcagcaggcacccccaatccagccgtttatacaaccaacccaacagcaggtagtacaacaggctcagcaaacaccaccaaggcagcagcccctgtagccgatccaacagactccgttgaggcagcagatcgttcagccgattcagcatccggggttagtaaatacatcggccgggttcgcagtacctggtggccgatgtctaagatgatggtcaatggtggggccgcggtaaaaatttgatgccttatgctacgttcaggaagttgggtaggagcgccgaggatctcatcaagacaaatatggtgctcaaagactttggtggtaatccatcggaaaccaaaggtgttctaaatgtggagctgacagtcggcagtaagtcctaccacgttttttgtcatcgatgggaagggttcgtacagcttgttgcttggaagggattggattcacgccaattgttgcattccttcgactatgcatcaatgcttgattcaatggcaaggcgacaagatagagatcgtgccagctgacaggtcagttaatgttgccagtgccgatttagccctttgggagatggatggccttgattgtttatctggaaaagtctgggatggagattttctaaaagtatctgattctgatatacagccaatcgaggatggagaaaccaagctgttactttgagggcgtcgtggagggttcaaatgtctacgccaaggatacggatgacaagcaaggtcaaggtttcatgtcggccgatgagttggaagaaatagacgtaggtccaggtgatcggcaaaggccgacatttattagcaagaatttgtctccagagtttagaaccaagctgatagagctcttaaaagagtttagagattgcttcgcttgggagtattatgagatgcctggactcagccgatcgattgttgaacattggctacctatcaagccaggggttagaccatgctagcaacctccgaggagatgtaaagccgatatgcttgaacctgttaaagctgagatcaaacggttgtatgatgccggttttattcgtccctgccaatatgctgaatgggtttctagcatagttccagttattaaaaagaatggcaaggtcagggtgtgcattgattttcgagatctgaataaagctataccaaaggacgaatatccaatgccagtgaccgatcagctggttgatgccgcgtcagggaacaaaattttgagttttatggatgggaacgcaggatataatcagatctttatggctgaggaagatatccataagacggcttttagatgccctggtgcaatcggcttatgtgaatgggtcgtcatgacttttggcttgaagagtgccggagcaacatatcaaagggccatgaattatatatatcatgatttaatcggctggctggttgaagtttatattgatgatgtggttgtcaaatctaaagaagtggaggatcacatatccgatttaaggaaagttttcgagagaaccaggaaatatggcttgaagatgaatccaacaaaatgtgcttttggtgtgtcggccggccagttttttggatttcttgttcatgaaagggggatcgaggtaacccaaaggagcgttaatgcgatcaagaagattcagcctccggaaaataagatagagctacaagagatgatcggcaagataaattttgttagaaggtttatttctaatttgtctggaaggttggaaccttttacacccttattgaggttgaaagccgatcagcaatttacttggggggcagagcagcaaaaggctttggataatattaaagagtatctcagctctcgtcctgttttgattcctccacagaaaggaataccgtttaggttatatttatcggctggtgagaagtcaatcggctcggttttgattcaagaaattaagatataaggtgttaaagtatacactgttggataatgagctttattatcggacgattgatggagtattgcttaagtgcttgaatgccgatcaggctaggttgcaatcggcgaagttcatgagggaatctgtggtactcatcaatcagctcataagatgaagtggttgcttcggcgtgcagggtacttttggccgacaatgctggaggattgtttaagatattataagggatgtcaagattgtcagaagtttggagcaattcagcaagtgccggcgtcggctatgaatcctattattaagctttggtcattcagaggttgtggaattgatatgatcggtatgataaacccaccatcgagtaaaggacataaatttatattggtggcaactgattacttcaccaagtgggtagaggcgattcctttaaagaaagttgattctgaggatgctattcaatttgttcaagagcatataatctaccgatttggtcttcctcaaactattactaccgatcagggttcaatcttcgtgtccgatgagtttgttcagtttgctgatagcgtgggtatcaaattgttgaattcttcaccttattatgcacaagctaatgggcaagccgaggcgtctaataaaagtttgataaaattgattaagctgaaaatttctgattatcctcggcaatggcatactcggttggccgaagcgttgtggtcttataggatggcttgttatggatcaattcatgttcctccttacaaacttgtttatgggcatgaggctgttttgccatgggaggttagaatcggctctcgacggacggagttacaaaatgatttaatagccgatgagtattacaaccttatggccgatgagagggaggatctggctcagtcgcgattacgagtctttgcaaaggttatgtgttcatggtgtaatcggttgtggtttgccgatgtacaatggccgatattgttatatcgcccttagttgttttataattttatcaatgctcttgacattgtaaaactaggggggcacatatatatcaaaatgcagtgcaaaatttcaaagtcaaaattttttgagcaaacttcaaagtcatattaatcggcacaaaggattgttaaggcagtaaagtatcagaatgtcttagccaattacaaaagtttctaagtcctattacacaagggttattgagataagtatcgctggatagccgatatagccttctgcctaatctgttctacttcctctatggcttgggaatcttgagcatcggttctagggataactttcagagacttggtcagatcagcaacatgcttgatagccgatttgagtcttgatttctgttcttcaatagactttgggagatcggctaactttttgtgctccatatccagctcggcattgcattcttcgagttgtgctaagaggtcaatcttgcgagccttgagccgatcgatgttagacttgattgggcctttagaaagttgatcaagcttggacttctcttcatgcacaagttgtcgattagcttggatagtagcttcaatgtccttgcgctctcgcagttcggccagtcttaacttggctttctctagtttgaattgatgttgctcaaggtaaacggctagggtaaggatatcggctaactcatctgggattagagcctgaatctcatgtagccaagctctgattgagccacaatcaactaccaagctatctagtgatgatgcttctagctgatccaagatacttcctagagttttcttcacatcatcagataaaggggctaaagctttgcttgtggtatcttcttctccttcatcaaggtagtctccaatgtcgaaagagaaaagatcggctaagacctgcagcaatgatttagaagcagttagaggttaaacaggcatagccgatctgaatgcttgttgagacaaagaaaaacttactgggatagcaggagcagctggtggttctttctgctcaacgtgatgactccccacagctgaaggagtctggtcacttgatgattgctgtacaggaggagaaggaggagggggaggctgaaaacaaacaagtgttagacaaaatcggttgaaaattaactaatgagagttaaaactatcttaccggtggggatggcttagatgttgttacagccgatttcttcttcaccgcggtcttctttttctgcaattataagacctgggagtgaccggctataagacaaaatagttatgaaaggaattaaagtaagttgcttactcttgaaaagtggactggagcagaaggagttggaggggtttgcttgggcgaagccgatggtgttttttcagtatcgcttacttcggctgcagcctgatcaatttcgtcttcgattatctcttcatccagcacttgttcaatggatgggtctagggtaggcaggtcatcggctggtttggttttctttgtcttcttcttcttacttggggctgcgatgtttacagccgacgacctggttttcctctttttaccggcatcggctggttctctgataagcccttgaagaagagctgaggtcttgggggcatcatagccaataaccggaggagttagcccatctccgttagggattaaacctggagcatattggatatccttaccactgttgctttgacggggaggagaggattctattgtctgcaaatcaaaaggaggattagttgagattaatcggccaaacagctatttaaatctagtggagttaaagacttacttgagggacaacatctgggaagaggtctgtcatatacattgaagctggttggtggaatagatgcagcttccattcaccccaccatctgtcaaagtttttgcttctgaacattgccagttctatgttgtcaatactgcccagagggggtccttgaaggttgagtagcctccatcatcaaggtcgatgaaatttctcctcagcattggatcttgtcggcaaagaataaaccgattgggagttggcccattccaagttgtctagctgagctcattggatgatagaattcataagaagcttggatgtttcttccttgatgaatgccaatgggaaggatgcatgggctgattgcagctgagaaaatttccctggatgattggtatacttcatggttgatgtcttcgaatctgaagtccaatgggtgttcaagttctgcagaatcttcataaagaaaccaaactcgagcatctttttgaaagccttcatagaagctgcagaaccaatctttgagcagttcagccgatagttttgccccagcattagttggcatagaagcgtattctccgtatgatgtgcatctccgatgagtacgctcttctccatcatctcctacaatcggctctagccttgggaattcagcttctgatacggatggccgattgacaaccttcataactatcaggtttaaccaggtttgtagcagccaccagagtccacttgctccaactactgagctgatggctatcttagccgatgcattgttcaacatttggtatagatagccgaggaggattttgcccaagggaaattgtctctttgtttctagagcttcagctagaaattgccagttggttgtggggccgcaacttgatccacagaaaagaaatttttctagccacattaacaaaaaggccacatgttcccgaggggtgaccgagccctgacccatatatgccgctacatagcctgaccaacctcctatgcttttggtcttgaagtcatattggttctttgtgttcaagctcatagggttggccgacgaggtgacatccagacccgtgatcatgatgatatctatgagagttggggtcatcggcccttgattgaacaaaaaggcattaatggtgtttgaccagaaataggaagcagctgccatcaggggttcatctttggccgagtttgctataataaggtcaagtgcttggccgattccaatttcatcccagtaaaccctcttgctggctgatacacgtttgaaccatgtagtccaactcttttctggtggaactttctctagagacggccaggacttgaaagtattcttccagtgacctagatctggattggttaatctaaaggggatcctgttggtttcaccaatgatgaactcggtggggtcaggattgccgactgggccgagaaagtagtggttttcatgcgataggctgggaatcgcaactaggttggagtggtgctacaaatccaaagcgatccagaggaagagagcaatttgagatgtgagaaattcgatctgctgctaaagaaggggagttagccgatgagaacttacctcggcatattcggctgatggcgcaccagatgggctggcggaagacgacattgctacgggcggaaatctcgtcgaaggggaagtcgcctggaaatcgcctttgcgccggaggagtcgccggaggagagagagaagaggtttcgcttgagctgtgaaaacggaggtcacggtgtgagattctcgagggtaacggttagtatttaaagcgctggaataacggtcaaaagcggcggggtgcgaaatctactcgaagtcggtacacggcaaatccggaatattatgaaatatcccggacttgggggggcatgtgttaacaaccaaatttggtaatatcagcgtgggagagaagattagatcgaagcaaagtcggaagcggagatcaagtttgaaaatagagcaggaatcggttggaatccagattgtccacgataagatcggctgggtctgagttgggctaggtaagccgatgtagccaatcccgacaatatgacttgtacgcgacattgggttcaagttaacgtacttcaagatgattgccacgcacggatagagtcctgggaaggcaattgtatctattaattaggatatcttatgtaaattctttatagataaatgtgggcaaaagtctgccacaaagacttatggtatcttagagtttgttagagatcatagtcgtgtctgatatgggcatatcttgtaattctcgggtatacatagaccccgagccctatgtaattaacaacacacacgttcaatacaatttcggcgcatcgccacccttttgttttagttttgtttcgacgagttcttgctttcgggttgagctgcatcggtttcgatcttcaacaagaggtaaaacttgttatgacgacttgcgttcccaggattagtgcttccatctttatgatactctaatctcgtttatgtaattcgtcaagttatcatatatcttacataatctctagcaatatcgcgacctaatctattatcggctaacatctgtatacagaaagcagccgattaggttagatcttgatgttgatctagattatatgagatatctaccattctatgaaacttctagcggcttgattgtctagatatcgttcttctttttatacttaatgctgtatcagttgagtttgacctatttagtagtgcttagaatatcaatctctagcctgccttctagttgccgattagaatagcatcggagttgcagccgatcgtatctgatttaactatatttgttctatatgcttcattgacatgttaaatcttccctttatatcaagatattgctgtgtctgagtatattagactcttgttcgataaattattcttgctttaatatcctgatatagagtagtatcggagtattagtcgatacatgctagatctatctgat

SEQ ID NO: 65541 - DNA, 3081 bp, Oryza sativa
gggtgacgttcaagacgcgcacatgcgagcgcttggtgtcgtggaagggccccgacgacccgtcgccggggagcttctcgttcggcggcgacccggacacgttcctgcaggtgttcatctggaacgggacgcgcccggtttcgagggacgggccatggacgggctacatggtgtcgagccagtatcaggcgaactccagcgacatcttctacttctccatcgtcaacaacgaggaaaagagatacataacgttcagcgtctccgagggctcgccgtacaccaggtatgtgattacctacgccggcaagtaccagttccagcgctggaacatcagctcgtcggcgtgggatgtcgcggagtggcctagatgggactgcaactattacaactactgcggcccgaacggctactgcgacaacacagcgagggcgcctgctgtcccgacgtgcaagtgcctcttcggcttcgagccagcgaacgcggcggagtggaacagcggccggttttcgcagggttgccggcgaaaggaggcggtgcagtgcggcgaccgtttcttggccgtgccggggatgatttcgccggacaagttcgtgctcttcccgaacaggacgctcgacgcgtgcgccgccgagtgcagcagcaactgctcctgcgtggcgtacgcctacgccaacctgagtagcagcatatctaagggcgacaagacgaggtgcttggtgtggtcaggggagctgattgacgcggagatggtaggcgaaaggcttggcagcgacacgatctacctcaggctcgccggtcttgacgcgggtaagcaccaatttaaattgagcaattttactgttcgtaaggaggtatttaaatttgataccttatgctacctaactactatgaggtaccaaatttttcactaaatttttgatacctgatggtatctcctcaaagactataaaattactcatttaaatttgtttatctttctactatgcatgattgttgtttttcttggagaagtacggattacaatttgaggtattttactgtttgaggtttatacttttagtccttgagttgagaaagtactaccagatacagcgaggtgctaatgaaatataactgtccatctatcaagtaggatcggtctaaatagtacgttgttccttgcctttcgttttgttcatgcaaagcggcgatccatgaaatttttgtacctggaaaaaaatcttggtacatgttggggggatggattctaatagctcgagtggacgtccacccatttattgcatgtcaactaaatggctatgaaaaatgttcaaaaaaatcggcaagataaatcaatatgtaatatatcactccacaaacatacaagttaaaattcaacttctataagttgtaacaaaaataacaaatttaactgtaaatatacatatagtaattttttgagttttgttggacatcggcatcggcgtcagcgtcagtgagaacatggcgctgataacataatatagcatcaccgtctactgccaatggccgctgcatgtagtaccaatatatgctatgtgcaccgcttgggtatattgacaagattagattgtgcctttgccagaggttgacgagattatagtaggaaaatttgctaacaccgagattcgccacccatttcaaagtgcaacgagtttcagttctataaatccaagggtacaaaatccacatataccaaataaaacatccaaaatttcagttcaatagaaatcgaggaggcctgtgagctaaaattcttgctccttgctaactcgcctgtgagctcgaggaggcctttccgccattgtcctcagccatatctggtacctcgatgtcgtggcgtttggaggtgtcccgtggagttcgaatcctgtcctctccaatataaaaaacgattagctttttaacacataattaattaagtattagctatttttttaaatagttaatataatttttgaaaacaacttttctataaagatatttttttgcaaaaaatagaagaacgcattagaaagcgtgctcataaaaaaaagagagagtagaagatgataagagggaatgccgaacacaacccaagtatctctcatgaccagacatgcgaaaataccattatactgtcttaatacctggtaggattgagtgatggtaccacaagaaccctcgtagtactagttggaggccgtctaggactctaggaggcccttcaagctactttttcttacaactagctgggtggcccgcgcaattgcgcggctagcacctaaacaaaatcatatatttttcagtatgattttacctaaaatttattaaatagctatccccgtatcatccccgtatttataattatatagtttttaaaagtcactctaccccttacttctgtcgtatccttttttatttacttgctcggtctatcactatttttattcattctcctttaaaccttaaaaaattggatcttatagttttttgagtttattatctcgttgggtttctttttataatttctcgaagtcccgtcaaacgctgccattatattcctctacggcccgtccaatgtcttttctctttattgtaattaggattttacaaatcgaacataattatcgtttgagttcattttttactttttataagtcccgccaaaccgtcagcggctttgccattgtactcctttattgctcgcccgctgcctcccttctttattgccattgagattttaaaatcgaacaggattatcattggttgtttttttactttttagaagttccgaacctttaaaaattggaccttatagtttttagaaattattgtcttgttgggtttcattttttataatttttagaagtcacatcaaacgatgccactatactcctctacgatccatccgtcgcctactctttattgtcattgggattctaaaaaccaaacataattatcgttggaatacattttttattttctagaagtctcgccaaccgtcagcggctctgcaactatactcctatataccccgcatgctgcttctcctttttattgtcattgagattttaaaaatcg

SEQ ID NO: 65542 - DNA, 1617 bp, Oryza sativa
tcctttcaaagctgttttaataatataactagctgggtggcccacgcaattgcgcggctagcaccaaaataaaatcatatatttttagtatgattttacttaaaatttattaaatagctatatcattgtactaagacatcgaaagatcaaaccttatcattcccccatgtttttaattatatagttttttaaaaatcacaccagttgctaccccttatgtcatctccttctttatttgcttgctcgatctaccattatttctattcattctcctgcaacctttaaaaattggatcttatagtttgtagagtttattgtcatgttgggtttcgtttttataatttctagacgtcccgtcaaacattatcattataattctctatggcccgtccactatatcttctctttattgtcattgagattttaaaaattgaacataattatcgtttggattcatttttactttctagaagtcccaccaaaccgtcagcggcttttccattgtacttctctacggctcgcccgttgcctcccttctttattattattgagattttaaaatcgaacatgattatcattgttttttttactttttagaagttcttaacctttaaaaattggaccttgtagtttttagggtttattgtcttgttgggttttattttttataatttttagaagtctcgtcaaacgatgccactatgctcctctacagcccgtccgctgcctactctttatttcattgtgattctaaaaatcgaacataactatcgttggaattcattttttattttctaaaagtcccgccaaccgttgtgaccgtgcttcttaacggcctgtccgtcattcctcctcttaatcgtcattgggattctatttgggttttgtttataatttttagatgccctatcaaccatcaccatctactttataggcatgaccacgatcaaaaccttgagagcaaacgtagaggcttccttttacattactttgatgtattttatttatataaaactatactgatcaatataaaccgttaaaatctagatcctttaaatatttcactttttatgattaatgtggtaattttcgccgcttctcagctctgccccatcatcggagtatgagctataacatatggaccgtaaatatgtagaaaactattagggaatcttgttacttaggattgtttttaaaaaagaaaagcatactgctgcctctagagattatgcgatagtgcaaaacttgaatgtggttgaaggagtttggatgcccagctggtttgcctcccctgcacatgattttgtacaggacgtgtcaattgtgcctatatacgatttctaatttagctacacggacaggacatgattgtctcgtgtagtaaattaagtttcctaatccaattttgatttcaattgctattgcgtagcacacatcaaattctagtccatgctctttcacgtgtctgattcatgatctaactgtgtagattttttttcttcggttaatatgaaaatttctagaccccagagtgtacgtgatgtcttctttcaaagttgtcttaataattttgaagtatataaaaataccgatcatggtaatttggaaccaattggt

SEQ ID NO: 65543 - DNA, 6731 bp, Oryza sativa
agcagttcattggatgaagtccagctttgcatccacgtcgggctcttgtgtgtagaagacaacccgaacagcaggccgctcatgtcatctgttgtgtccatcttggagaatggaagcacaacatttctggcaatgccaaatcagcctgcatattttgcacaaacaacaagtgaaatggacaaaatgacagacggtagctctagaaacaccatgactatgacagttcttcagggacggtagagcaactcaaacttaatgtagatgtgtcaggacggtagagcaactcaaacctaatgtagatggctcttgttttaccagaataatgcttgggaggttggagtgcttatattaagaaattctgaaaggaaagtgcttatgactgtatctggcatcttctacattttcaggatgacttacaatcaaagacatattttaagatattccaatcagtgactatgggcagcagttaataccctagagggattatgttgagtattagatgcagataaagttagtattgttgctatggactgagtgttatttgacttgctaaagtctgcaaagaatctgaccagttgaagtatcaggttttcttgtttaaaatttgtgagtataagtcaaactgaaaaaaaaacatattttctcaagtatttatattagtaccacatatttttattacttctgatggtcctggaacgtttcatatatcaagtgcacttgcaaactcggcaattttctgttgaagtccttacaatagttgaatgcagcgaatttatcacttaatcaccagaaagtaactgcaacaatcaaataaatcaaaagcactgaatatcagtatatttctaacctttttttttgactaatgtatatttctaaccttacccagatagcttaacttgttgggtaaattcatgtgcaatccttcctcttagtttttttgcagtctggcctttgattgtggtaattaaattatgtaaaacctgaattgttcctgctgaaagaaatgatattaagcatctggcaggaggagaactgaacagcagcaagaaatatccaatcttacaaggacagtgcagaagcagtctgtgggaggtacttataataagcaattccttgcagctattctccacaagagaaggaagaaaaatagacagcacatatctctctcgtccccatccactctctgcacttcctctcgaaatgcagattccttcagagatcgaaagctagcagtactggaactgctcagtgctcatcaccacataacaatttcaccgcaatgcagttcatggaggcattcatcccagcctttgtgatgactcgaaaaaggaagagtaattggacggagaaatggaaatctatcccctttaatgcgcggtgctagccggcgacttcacctccctctcccgctccggtaaccggtacgacggcggcggggggcggaagtcgtagccgtatggatgaaagaaaacgaatctccgaacatggttttccagtgagggacagaggtggcggcttttccgcctgtaggacgaccatggcgtccggcaaggctgacgtcggcgttggcggaggagaagcgatgaggaggtggtggcagtctggatgggctggcagaggctccagtggagcatcacatatggcgtagggggtgccttcaggcttcagcgacggcgaggcgccgaggcggccgccggcgtcagcggacgagcgcggcggcggcggcggcggcagggggaggggcgaccaaaagtctcggaccgaattgggccagagcaaaggtgcgggccgtgcagcatagcccaacgcaaagcacatactagtatccggtattgggccctatatgtaccggtccatgtaatgggctaatggcacgtacatgcgaatcccgtttcggcccatattgttggcagcacgctcgtcggaatcgggtccagcccacaggttcaacaattctggacgccgcctacccgtcttcttcctcgggttcaaccccaccgagctgcccgtgcccggtacaatgagcggcggaagctggcgagcaccgagctccggcgagcggtatgagagggccactgtcctggatgcttgccttcagcttccccgcgttctccttgagaccagggatcccgctgtccaagtgtccatccctcctcagctcatgctccgcaacatctttccgtgattctttcgcttggtgtcctggtgctcctcttcaccaggaggcatggtcgcatctcgcatgggccgatgggcatgctcttaagcttcctcatccctggcatatccaagccgcagcagatattactttggcaggttgctattctctccttcctcgttggggctgggttcattgggctgtacctaaagttcttctactggtcgtcggaacggaagatcaagaaagcctaagtcaccgatcttctgtagaatcattttgctcgtcacgctctggaggattaagaccggccgaaaccagtttagagaatacagacacaaccttttgtctgatatgttttgttgagaatgttgttggataactactatgatgtagaaatttctgcatttctaatatgagaaactagagtacttattaccacttatgatgtaagaggaggtttgctactccgtatgaaatttacttatttaccacctctttgttgaactttcaattttaagcttattttactccatctatagttgctttgaatttctttccatgctgctgtggataccaaggaccaagctggatttgctagacatcgtcattttctttaagtcctgatactgaaagatactatttttttgcaaaactaatgatttgaattcaggaattctttgtgcacagggtttgagctgtctctgtcctaattacaggttgagcctaacagacataaccgaaaagatgtgtgacattctttacgaattgactgttagaggtaagtgttctccagaaaattttgtgatgtactattcttatctttttgtttccaacaaatatctgttgtgaacaaacattatttacataagtgaaagtagcatttataattatagtagagggtgattgtgaacacacttcagtttgatatgttagttccaactccaaactgtttcatgtaagctttgttgtatgagtgcattctctgacacaagggctcactttctacttaaacatcttgagctcctatctttattcacaatggagcgtctgaaccttgtcgagtatgagatgctgaaattctggccatcaatgctggactttgtttcccctgagtatgttggcaggtgtgtttggctgatcaaggaatttagactacttccatattttcacagtgttaaagaagataaaagtagaggttagcataatctcaattgtttgcgcttgaaatacctggtgtttgatatggtctccttgaagtttacttgtgtgttttacagtttaggaagacagcaagtgtgaatctactctagatctcattgtatttctacaacatttttgtttctgcagaatgaaatattctgcatattttctataagggacaatttctataatgaatacacgtgctcaatcattatgttctcattgaatagttaactagtgaacttttttagaaggaaaattttatcgtccagcacccccccccccgaggtaccaaatctgggccgttcgttcggtgagatctaacggataggattgcacggtacctcccggtaccatttttatccctggcgcggtaccactttgccatgtgcggtggaagggtagcgaggtcttttcacatcatcctggatcgatccctcggctgcggcaacaccggcacagacgcggcttcagctcctggggactccggcggatgctgccgaggctaggcaagactgaaacggcggcagtttgcttccggcgatgtatagtggctgctccggcgattcagaccacggcgcgacagccttcccccatccaggatggaaagcttcgcttcactcaagtcggccaagacggcaaaacggaggatttggggcgcgattttttggcggctagggtttcggatttggggtcgaggtttcttcggcggcgctcgctctcgagtctgaaaagaagacggcggcgctcttgcgggagagataatcgcgctacgggatagatgaggaggacagacaatgcttcttttccttttccaatcctacccacgcgaaatcaacggccagatgggttttggtaccgcgtggtacatgtaccgagcggtacaaaacgcaggacgggagcattgctctttttagaaagactttaacttcagtacaatagagttagattgactgtactattgccctcctgccacgtctatgggatgcggacatgaggcgagtgtgcacaccatgctcttttttagtaaagcttctaatttgatctataggctagtttatataagatgtgggttaatgtacagcagttataaaatttactcctatctaattagcccaccattccaaattaccaaaacgcggattaatttgcttatgagaatctaacggattttcacctttcttcactcatttgcacttccataaaaaacctaacaagtctctcatgctcgcagattcacgaatgcattgagcatcccgtgtcaaatggagtaccagggtggaaggtaatatgcaggctctgaagagagttgctctgccgtttctgaagaactgtcagtcattgtgttcctagagttctcgactaccattttgtctgagtaacaagggcctgcgtctagtattatggggagtgagaaaatagcaatccacttggaaacctggcggcaaatgagtgaaccagtagtccagtataaatcctaaacctaccgtggacccagaaaaggttagcaattacacgaaccaatatgtaaggtaacatcgagaacaggaatggcacttggctggagacatctcactggacttgatgttagtcaccttgtggccaaataacttgctacaatgggttgtttggttgaatttcaacttgccccgccacagcccacatgttcatacgacctatagcctggttcctggcgacttgggaatggggatgtcactgcgtatcctatttattgactttgatgctgtacatggtgcctccaattatatacttgcactccctatcccagaaaaaaaaaatccaatcctcaggatatatctgaacatgcacatgcactttgtttaaatacatctctatgaaattggagccttatcggttgcccatatattagggaataaaaattattttataggtaaaacttttatatatttgttcgtagcgatttaaaaactaatggtacaaagaaattatgttgaaaatattttaaattaagtttgaaaatttaaattttaacttttgctttgacttattaagccaacaagatggggctcttggtttttcacttttgggatagagtacaggtagagaaagggcccacccaaaaaattgaccctggcgacgtctcaacgtcttcatttgccagcgccaggcttctcggtcgctggcgcacggtgcgcccgccgcctcttcggctcaccggcggccacgtagccatgttcggcaccttcatgctcgccagcggcagcgccacgaagtccctgtcgacgctgccgtccttccaccggcactccggcaggcacccctgcgctcgccgccggctcgaactcgtccaggcactagctagcttgcacgttggaatggcgcctttccaggcgtcagagtggccggccatgccgcgatggtcatccactctgttatgctgaagggaaattttagccggccatgccgcgatggttgctgaatggaaattttagggtacctttaagtcgacattttagagcaattcagatcctttgcagtattacagaccgacatgtgggcccgagggtctgtggagcctctgcagtattgcagatcgacacgtgagctcgagagtatgtagagtccacatgttagagagcagtactgtacatagaggatcgcactcatttataacttattagagttgtaaggttctgtttttaaaagatgaattttatatatacctggtagtacaagaaatatgataggatcagttagtttttactgtttttaataaggcaactagcagaaccttatataaaagcgactacaataaatgtaagcaggatctacaaattatctagaagagcggagagagaagaaaaacaagctacaaatttaccatctacagctcatgtcagtggcggacgtagctttaaaacatagatcgggcggagaactgagatgtgcactcaataaaaacaattcaacacaacacatattatatttatatttcaatcgcataactacctcgatcatttcaatcatcgtttgcggcgtgcatgtgttgtgaagagatggactaatctgttgggtgttcacaccttgttatacctaattttgatggcccatgactattataagagggtagggagggccttgggggtatggggtgacacggatcgtagctgggtcggtcgatccaccttgcctgcctaatgattagatccacccctggctccagtatttgtttcaaggcattgtgtgtatgagaggtagatcagcagttaatggtgcgatacgtatatttatacgtacctatagattattggagaattttttttatttataattttttttattaaaagttttacaaaaataatttttcattttgaaaattgacggaagt

SEQ ID NO: 65544 - DNA, 30819 bp, Oryza sativa
tttctacaccttttgtttcacattataaattatcttcaagccagtgttctattaatgaagatgacaaagattacaaatcgcatgttccatatgccagtgctgttggcaatcttatgcatggtatgatttccatttgcgcagatttagctcatgaagttagtgtggttagcacattcatgcataatcctggcaaagaacattgaaatgttgttaagtggattcttcgttatttaaaaggtacttctaattttggcttaatgtttgatatgaataaggtgaagatagatgatgttgtttggtttgttcttaataaaaggtctatttccggatattctctttgtgtggttctgctgtaagttggaaagcttcaattcagtctgttactgctctttccaccatagaagcagaatatatttctactactgaaggtgtctaggaagctatttggttgtgaggtcttattcctgaagttggtattcagtaggatgttaatattgtttattatgatagacagggtgctatttgtttgaccaagaatcatatgtttcatgccaagaccaagcacattgatattaagcaccattttattcgtgatattgttgctcaagggcaagtttttatgaggaagatacatactgatgacaatcccgtagatatgcttacaaagttactctcagtaactaagttcaattattgcctatacttagtaggtatttgtggtacttagcagcccttcagggttttggagacattttcttctacaacatatcctatatacctatacaaatcatccccaccactagaaattctctgcttcctggtgcttccacgtcatcattttttcctcatcattttttcctaaccgttggatctaatctaattgatccacaccccatcccggcatcccgcatccgcgtacgtcttccttcccccgcgtctcgctccgccggccccaccgcattgctactctctcacgcgagcgcacccacatcggctccctctcccgcatctctctccgccgcccccactgcatctccctcccagcgattccttgcccaatcactcctccctgtctccttggctcggccccgcctcccttggactcccgcagctgccatggaatccaaatcgatccactacgatgcagtgtctttatcacttttcatccccacggcacaccatgcagtgtcattgtgtcgcttcttctcctaacccctgcaacaaatcgatggggccatggtggcgactcgagttcggcctagcgcggcgcggctcagggatttgggtcgcttcttttctttcatccgccgtaaaagccacctggaagacgaactgcgaggaaaaaaccgtcaccaccatcaataatgggcttaattccatttattccctccctacaattcatcctccgtttagatgaacctcaagcaccatcccctccagctcagaaggcagcgtcaacagtcgggaaatcctctttctgtattttcatattttgctaatttcaatttgtgcttgcctgcaacgcagggggttccgggctactggtctctcttgcctcgcctctttggagtaggttacagcatcgacgattggacggcataattaacgaagcaagagacgagcaggtggtggagagcggaggaggcatgcatgctatggtcgatgggcttcttgcgcgagacagacgaagcaaagtgcgaggtatgaagcgggttttctttgctacgctcttacggctattgaagcttaggcaaacttagcaggctttcaacgaaattatgactatcagacagtcaggctgtaaaatatatatattctcttttgccctacactcctactgtacaacacacatccttctccacatcgattatgtttggattttactattggtaaggtaagcaacccaacatatcgatctactgagggatagcaaaccgtaaagataatcaaactatgttttcattaaacatgcgcttggcattttgccttgctgtaggtttctgtcatttgattttctactgtattgacacctgaaatgtgctgctctccttctttcaggtcatgttactaccgtgcaaacaactactttgttgcctaaataggtgtgttttctttttttggataaatatagcattcatatatttctatgtgaagttaattagttttattcaactaaaataggatagctaaatgtacattcaaagagatcatcatggttgtctctgaaggtagagagaatcccttatatgccactctaaattaaccagctcccttatatgccacttcaaattggcttctctcttttatgccaccggttcaagtttctcctcccttttatgccattgccgtcagtccaccgtcagttgaccgttaacttcattgtaaaaagacgcatttgccctttagaattagtatacaaccaataataggtattttagtactaatatagctactagatacaacatatgaaaattgatttttttctgcatcacatgcaattttagccattaccatcacaaataaattttcaatgtaagcatgaaacatgcagttttccaataatatttttaatataaagagcatttttcactgattctgacaaaattttcttcactcaaaaaggatttaaaataaattagttatgaatttttgaagtttacacattttttagttgagagggcatattggtcatttacgaaaaaaactaacctttgactaacagtcaactaacactatagtggtgggagtggcataaaatgttggaaaaacttgaactagtggtatataagggggaagccaatttttagtggcatacaagggaactggtcaaattctagtggcatataagggattctctccaaaaaagaaggtaactcgaacaattttttattctagttatcgatttactttcgctgagcattgtgaatccatccctctttgttgcaccattttgttttgtagctaggtgcttttacataatcaaccatgccaggatgtatacatgtgtgttttgcttcctttcttctttcttttagttaacaatcttatgttacattcctagaaattattttgtcatttagaaagttctgctgcaacgcgcagggtatcatctagtttatagggtttttgagtcaaggaaaggttgttggataatgactcaaatatatttagtcctagggtcttgttcaatatgtgtctaaatatatgggccacccttctacatgtaaccctgaaccatcatagttgattttgtcttctatggttattttctctctatattagagggatgttttcacataaaattatgtatctcttttgcatctattttccctatcaataacattggagcgattggagaggataatggtgtggagatgtatatgaatcgaactaggacatttaattatttgccacttttaagatgtgccaattaatgatttgccactcgctgtgtatgatgtgtgggccctcatgtatctatctcatgtgtctatgatatgttggtcaagtggcaaatcctatataaccactcgtaagagtggaaaatatttaattattttgaatccaccgagcataattccacgaacaagagtaaaattccaattttcatttgcttggtaaatcaactaatatgcaagaggataaattggacaaagtggctgaactaaaagaaggataggaggataagaaaagggagagggagtggacgtggtgtgggtggagggtgcgatgcagtgcagtacaaagggcgatgtgatgtggtgtgcatggttgatcacccgattgagatccaatggctaggataaaatgaggtgacgtggaagcacgagaaagtagaaagttgctattaactacactaagtgcgaatgacttgtatacccgcatatcatctcccatcaacttaatttttctccatgcgttttataggttgtattacaaatccatcaaacttatgcatgctgatctataacaaaaagacaaaatttgctacaggacattgaaaaaccatggcctttgctgagggatatcgtaagaacatgaatttgcttagggacactcaaaaaatgtggtaatttattggtagacaacatacacattattttatgactttttgctattttggagggagaattttcacaacatgggagatttgcccctaggaccaattagtacaaagagttttgttttctttacaaatcaagtccctggtgctttgatggagtggagcccgtgtgtcattgtctcgaggagggagagagcagtagctgaggcagagccttgccggctggcactccttcacggcgacgctgacagtgaatggcagctccttggacgatgcggccaaatagagaaagatgtgcaggcttcttgcgaacccgacggtggtcgtcttttagccggaggtggccagaattgacgacggtgctagtccggtcgagccaaggagcttatagttcgatgctaccaagatgtttgtagagacgtagagacgctacattcatgaggaattgagagacggaatcgaagatggcagcggttggccagagtttgggaagacgatgacgatctcatgattcacgacatctcatgtcaattgcttgggtcggagggctcctagggtctcggcgatgacgatggcgcgatggatggcccgaccatgcgccatggtgcccagaatgtggagatggtcttgactgtgacacagagagctcgctccggagtcacgtcggcatgacggctttcttgtcgatccgctgcatgacagagggtgaggtcaaaagttaaaacattcgacatgatgaggtgaataaggaacagggaagagatgatggagagcacggcttgacgactagcggcaacacctccttctgggcggccgacttgggaagaagaaatacgagggtaaaatagacaatttacgtggtttctccctcctcacataagtaaatattatattttaatgcttattgtgtcctttagcaaattaccgtgttttatgagtattctcggacaaattcacgttcttacgatgtccctcagcaaatatcacatttttggagtgttctgtcgtaaatttttcctaactaaaatatatccgctttcatctccaacgtttttgtataagtatttttactgcatgtatttttgtgagggttatattaataacacagtatgaactgttcactctgaagtgggattatcacctactggtggagtaatgaagtttcatgtgttgtagaactctttattactatgtcttcttattagtatgctgtaaaacttttagagcaattggtttggacattggttggactggcggtgtgcggcggcaatgggcaggtagcaaggcagtgggggcaccaccggagctgtgaggatggaggccgacaatgggcagggttggcagcaacctgagcgagggaggccatatggtaactgtgcggtcggtgacaacaattccgacagcatacgggaatgacactaccgctggattatggagaaagagacggaggatggcagggatgaggaaaaggctgaggattatatggttttgtgggcctcacctgcgccgttgactccttttggcaagccgacaagccaagagtagcatcgtcgtgcagggaggagtcagcagcaacccatcatacatgtgtgcataggtgaaacggggttgaggagggaagaagtgataaggggagagagaaagagtccacccaattcttgcaatcctaaatggtcaaaaaaaattgatttttttttggggggggggggcaactgagaattagacactcccaaaaattaattaggaaaactgagccacccctgtaggacgacccagccaaacttgccgctctccatgatcaccgttcctttgagatgcatggggccaccttaggaaggggatgtttaggtcatttaattgtcagagcatgatgattatgtgtcgatgtcctcctattctgcatttaaccactcaagatccagagtactgttgccagacttaacacatctcgggcgcgatttgatccatattccttaatttattgggtccttgattatcacgatcacttatggtcgatcatgagacgtgggtgattgtgcagcacaaataattattttaagggattgtatagattatattaattttggacttgttcggcgggaaggaggcggtggtgatgtatatcagcggttgtgatacatcatgcatgtgtgcgtgcttgaaacagggataagaagtgtagaagagatagggcgagatagaaatagtctacacgaacctcgatgcaattctaggcgtttaaaaagtgacagtcttttaggcaaaacttagacaatctaaaaagttaattaggaaaacagttactttttaaacgactctccacaatcgacattcctttgagatgcacgaggcccactatcgtaggttgaggaagtttaggccatttaattgtcagggcatgattatgtgttgatatcttcctattctgcatttaatcactgaagatccaaaacattatattaccagacttaagatttcttgggcgcgatttgatcaatattatttattaggtccttgattctcacgagtcacgaccacttacgaagttatgatcgatcaagagatgattgtgcagggaagattaatatttgagtgagtcaattttggactacatgtctacattaatagcttgacgatcaagaacgaaataagaaaaatatgctctatgatttgatcgatcgatctcgaattatacgttatgatatgtaaacaccagagaaaattgggatcgggatatgcaatctagtactagatattatttaattacatactctagtatgaaaactatcgtgcaaatcgggatactcttgagctggccggaatatttttcctggaatgcaaaaataattacgaattacagatcaatgccgtgcgcccgtgcagatgcaatggatatatatatcggccacgttgctgcttcttctaatataataaggcaatctcgttgcctactttgcacgatgtgagctaatcacacgaagtggacaacaagttcgtcatgtgatttgttgtctttctcctttgtgctttgtgcatcgaatggcatcccacaattatccaaaaaaatttacaaaaagcatttcactgagcttttgtacgtacgttatttatactacctccgtttttatgtaataaatacataagcctgttaacatttcgatattacatttgtcttcctaaataaaactaacatttatatttggtgttgaacttttttaataattaaatgtacttggaccattatatacttttgcacatttccattaaagtttttaataagataaatgatcaaatatcacgttaaaaattaacagcatcaaatatttaaaaaccgagagagtagtttggaacacatgtttaagttacagtcatttaaacttgaaatattggctattattattgaacctaggaacaagatagtagttccaaaatttaaggtgtgatatcatattttgtattatccattttacaatatattgttgatactatctttttatggaccgccacttcgaaaaagcaaataatacttatctcagtctccagaaagttaccaggaccaaataaataaattttcaaataagtaatcttatttttcagtaaagcaaagcaataatgaacttatgattttaaggcttgctattcactctataattatatattgccgataaaattcatcacaacaaaacaaaatagtgtcaggaggagtagatttgttgagaaaaaaaagaccgagaataacgtatttggcccaattaagtatatacatatgtaatgcgtaatatacctacatgtgttgaattattttcggacaacttttgagtattcactccaatacccaagagcctccctgtgtcccaccctgaagcaaacaaaccaggaagaacaataacaacagcatgggtagatatgttggcatccctgtaaactctataactcaaacttgaaatcggcagctctaaattatttaattagtaactggactaaaatatatatttctcgaaaaacgaagtggacaaattagaacttccataaatttagttttctcattaaaataagattttgttcagatttaagcatgatattctgctggtaagttatatgatattatatggagcatgtgatgatttttttaaatattcttttaagtcatttactaatgcaaacatagttgggggttaacttggaccaggttgtcgaaaaactagtataaagccacacagccacaagctagaatatccatcaataaacacatcatactgccatctccctcaactagttgcaaaagcacacgttcttccaatattccatcagccatgcctggagcagctgctgccgctgttgttgacagccgcctgtgcacacagcacgcggaaggccctgctgcggtcctcgccatcggcactgcaaacccggcaaatatcgtctatcaagatgggtttgccgactactactttggtctaaccaagagcgagcatcttattgagctgaaggacaaaatgaagaggatatgtaagtagaacaatcctttcatttcgatcgttgcattgatcatcattatcgttagttgtttttcataaactctaatgagaataaattatgcaagcgcttaaatttttaggacactcctgccataattcattataaaccatacaaatatttatactatactacgtagaaagaagagtgaaatgatgttggagttcagccaaattttctttatttcgcgtgtgggatgcaatgtggatgcatggggtgtggttgcatcccaaaatttttgaaaaaaaatctactatatacagtatatacttggtacatatacgcagtatgctcaatacgaggcccacttaaggtcatccaggactatatgctccatttgaatttctacattatttatgtcattgtatttgtactcgctatatttaagtgttttgctagtatatttttttcactttatctcttatcttgaatcataacagtaaagttttgcatctccatctctgaaatcctggatccaccactaatacctcgttaaatatgatagtttgtcatataatgtccctcctgctcatcaggctaccatctcgcacccatgccactgtactcgtatagatttaaagactacgcttttaacaaaaatacaagagatctacagagtagtcatagcaataaatccgtggatcttaataaatttgtactgaaaaatagcacttacttgtctatatgttggcaccgggaattgagtcttagtggatagagttatgcacccacaagtacatcattagaccatgtttgaacgaaacatatgtgctaatccaatctttcagaacattaaactcatgattatcttcctaaaaataggacatatataaaccatttttgttttattacggaaaatgcttgcataatatcatatattcttgttttgtaaatattcggcatcttaattgaaatgtctcatgttattcttataatctcttagtgctatgtactaattgtaagagatgtgggtgcatccttttccatttcaggtcacagatcgggaatagagaaacgctacatccaccttgatgacaagctcatctgtgagcacccggagatcatcgacaaacacatgccctcccttgaaactcgtgtagacatcgtctctactgaggtcccgaagctcgccgagtcagccacacggaaggccatcgccgagtggggccgtccggccattgacattacgcacctcatcttcagcacctactccgggtgcagtgctcctagcgctgacctcaagctggcatcactactcggcctcaacccttctgtttctcgcaccatccttagcctccacggttgctctggaggcggtagggcacttcaacttgccaaggagctcaccgagaacaaccgtgatgcacgcgttctcgtagcctgtgccgagctgacgctaatatgcttctcaaacccagatgaaagcaaaattgtcggccatggactgtttggggatggtgccggagcaatcattgtcggcgctggcccactggtcgatgaagagcgcccactattcgagatggtcctcgcctcgcaaacaacgataccaagtactgagcatgcacttggcatgcagaccaccgccagtggcatagatttccacctctctatccaggtgccaacactgatcaaggacaacatccggcagtgcttgcttgacacattccgatcggttggaaacatggatcctaattggaatgacctcttctgggcagtgcaccctggtggccgtgcgatccttgacaacatagaaggcgagcttcagctgcaaccagcaaagcttgcggcaagccgccatgtgttgaacgagtatgggaatatgagcggcacgacgatcgcgtttgttcttgatgacttgcgtcgccgtcgggagaaggaaggagatcagcatcaacaacttgagtggggagtaatgctagcctttggaccaggtatcacaatagaggcaatggtgctgcgtaacccactctcatgaagtcttaaggaaaattaattgccactatcttatgcttgtctggtatcttattacggtatatgttaattaatcaatgcatgacactaaatcaattctgcatgcttaagtggaattatgacctaccggtgatgtattgatgttgtggagttcctatctaatgtttattgctgttttttctgtatttgtaacaaaatttgtaataccctgtgtataattgaaaaagcatattgcttatatgagttgcttcaatccgagtttggatcaattgagatgtatctttcaagaaaacacttgaataagatcaagtcagtattttgcaagtgaaaaaatgttccaaaacaagataaaaagatgcaatcaatttcaacttaatctttagtaattaagattgtttttcttctcaaatatacatgagatgttgtgtatcattgcattaatggaagaacggaggcgtaagatgcaaatacaaataatcagaaaagacaaaaagtgagaaaacaaaacacgagcaaaagaagaacaaagtgcctaaccgaggctctcccaacaacctgaatcatgggccttcttaaccgggatctataatcaacgaaattcccctaggctcaataggtgagcctcgtcactcgctagaactagtcgagaagatgattggagcagcctcgttgaaaacacaggcgtttcgatgcttccaaatagaacatgccctaagaatgatcatattatttatacccttccttatagcccgttttaccaaattcttgtgtcttagctagggagatcgatctgctttcagaaccggcggcgcgttcatcttctcgtcgttcgatctgatcagcgagaacaattctgacaccggtgtgttcttcgatagatccatctgatcggcggcagcatacgcgcttcatcccacggcgagttctttgatgaatctggttggtggcggcaggcgtgcgtcctcctgtcgtctcatcgagttaatcggctcgacgtgattgagttttcggcgcagcaatccgaagcggagttcttttttgctaccacgcatccaccgaaaaagcagcagcgcatagctgcacggctctggaggaggaagaaaaatcaattgaagatactgctcgcttcgtgtttatgtgaagttccaaattcctgttggatttttgtacgtccacaaagactttatatcagggaatttcttttcttttggaatctattatatatattttttgatctggaattgtttctccaacatgtcatgtatcaaatttgacattgagaagtttgatggcaagattagtttttgcatatggcaggttcaaatgaaagttgttcctacacaagttgatgttcggaagcgaatatgattgatcaaggggaagataggctgtgttatctgtgtgaatggtaccgtatacaggttcttaagaaggaatcacaaataccgttccaaagcagcatatttcgacaacactgaatagcttgatgatccaccaggaccatgcaagggtgatagagtgttccaaatgacgaaaaatctcaaagtttttttttgagaaggcaaaaaagaaggaaaccaagcggaagcgaaatgcggaaggaccaagcgttctattcaatagatatatagatacatcattttatcggtgtcatgcacctagagaaaaatgtgttctatagaaccattgggactttagtagccataccaagcaagacaaatgatggactgaagtcacataatgtaacagcccgtcctccagaaccgcgtagcctagaccatccaatgggcgggcccacttacacataccactcccgtacacgtttatcctcgctttgtataaaagtgttaaccctggagtgatatggttggagggacaagcccactcttgctaaactagcaagatggtactaaatatacgcacacaggtcttattggccacacatgccatgtcctaattataccaggatgtcacacaccctcctcaaaggacccgacatccccgttggcccaatttacccatatagtcacacacaggcatataggtaaatgtctaggaacacaccccctcttaatgcttagtgcagtccgccttacatagagcccacatgtgccatatacccgcacactgacccatacaagcaaccgcgagggtcggaactgataccattttgtaatggcccgccctccagaatcgtgtagcccagctcgtccaacgggcggtcccacttacagataccactccacttacactttcgtcattgcttcgtgtaatagggttaaccagggagtgatatggttgaagggacaagcaaaactagcaaggtggtactaaacatgctcacacagctatcatgtactccttccaaaaatctgagacctatttcattctttggtttttctcaaaatctaagtcctatttgtagtcactatgtactaaattgaattgttgatcagaaaccaataagtcattctaataattattggttgcatgctcattggttttgccatatggtgagtgagttaattgcttcttggtattgatgcaaaaagaaataggtctcatatttttggaaggagggagtaccacataggccatatcttaattgggccaggttgtcacatgtaaggaccttgtgaatacgcagataacagaagagcttcacctgcggatgaaggtaatggaagagttgtaacatcccgcctctcctaggccaggcctacttacatctggtagcttatcttggacatagactaccctcacagaccaacacaagtcttttctgcatactttgtcctcactcgtgtgcacccgggaagaattttccggtcggtcacccatcccaaaattgctctacgccaagcacgcttaacctctgagttatttggagatcggttaaggaaaataagttgcaacctgatggtatgagtattctattaatcctattaagccctaggccaggatgtcacaagagtgcacctttcgctgacttattacaccttgacaaattatgagaaaatggcattgtacaaatccctacacgaggtgagagtccctaccggtttctcctcaaacataaagcggctagtgtcgatgaaggatttatagcttttgggctacatttctcatgactgtcatgtaatgctcataatattcattgctattgcaatcaaagtaatcaaactagtacacgtaaagatggttgtcacaaaactgtgttatttcttcaatgcaatctcacataaagtaattgaccttgaagagttaggtcatctccgtgttttcgctatagagaccttgtgcaagcttgagatgtgtttccctctgtcatttttcaatatgatgcaacacctcatggttcatatcgtgcctcagatacttgtgcttgggcccttgtaccttcatcagatgtggacattcgaacagtatatgtccaatctaaaaaggctatgtacggaaccgtgcccacccagagggttcgatgatagagggatacactaccaagaaagtcattgagtgttgcattggttacttgcaagatgggaaagcaattggtttactagtacctcgacataaaggtaggttatctggaagagggacaaaaaggaaaaaagaatcctcgacaatgactacaaagcagtgaaagatgctcatttcattgtcctgtaacagcttgtgatagtggagctgtacatagagcagcacctaaaggaattacaagcaagaaatgtcaggcgctctgaagcatggatcatgaaatggcacaaatctgactttaccgaatggttaaaggacctcggccgaccatatggtgatagcacgaaggaaaaaactatgaaaagtttggctgacgggcattcaagagtgtacacctcatggtgagcgtatatctgaatgggtacacattttataccaaagcaagagacaaaaggagtgcatctcaaaataatggcgttcaagtataggaaatcgacacaacaggtcaaaagagcacatactatgaattcatagaagaaatttgggaacgggactacgaacccaatatgcagattccaccgtttcggtgtcaatgagtgaaacacccagctggcgtgtttgtggacaaatttagacggacaattgctgaccttgacaacgtaagccacaagaataacccattggtacttgccgatcgagccacccaagttttttacgtgactaaccccatctcagttgaagaaacacatagttatttccggaaaacaaaggattttgggagttggtgatgttgaagatgttgaggcatacaatcaatacgagaacatgacactattcatggattttggaaactacattaagcttgtagaagaaacaattagtgaatcgccgaagccgtacatgaggaataaaggagtaaggaagaatgtgaacggctaataaatgtagtcgctgttcaatataaatatgaatcaatgaatatttacatatgaatgtgtgacatgatggacgatgaattttttatggatggtgaattttatattatttgttctcatggtttttggtgtttaaaaaaagagaaaagaactaaaatttataaaataagaaaataatgatatattagttactgatggtgacatcatggagactctgatagaaaaacctgtggtttacgttttggggtgagggttgggctgggtgggggcactactagagccacagggatggaggctggcagtcggcatggttggtagtaggggcgagggaggctgtgtagttaggaggaggcgattggcggtggtgattttgaaagctatggcagtgcgccactgctgttcaatcaagaaggaagagagggagggacgtgggattggggaacgggaaggaggcttgtctggtgggcctcgctggcaccgttgaccccttccggccatccggcgagccaggggtggtacgttcggcgggaaggtggcggcgatgatgtatatcagcggtaatccatcctgcatgtgtgcgtgcttgaaatagggacaagaagagcaaaagagatagggtgagatagaaatactctacacaaatgtcgatacaattctaggcgtttaaaaagtgactgtcttttaggcaaaaatcaattaggaaaactgttattttttaaatgactctccacgatcgccattccttcgagatgcacgaggcccactaccttaggaagaggaagtttatatcatttaattgtcagggcatgattatgtgtcaatatcttagtattctgcatttaatcaataaaggtctagaacattatattagcagacttaccacttcttgggcgcgatttgatcaaatattatttattgggaacttgattcgaccacttatgaagttatgatcggtcatgagatgctgtgtggattgtgcagagaagattaatatttgagtgactgaattttggactacatgtctacattaatagcttgacgatcaagaacgaaataagaaaaatatgctctatgatttgatcgatcgacctcgagttatacgttatgatatgcaaactccagagaaaattggaatcaggatatgcaatctagtattagatattatttaattacatactctagtatacaaactatcgtgcaaatcgggatactcttgagctggccggaatatttttcctgtaatgcaaaaataattacgaattacagatcaaaaatatatccgccacgttgctgcttcttctaatataataaggcaatctcgttgcctactttgcacgatgtgagctaatcacacgaagtgaagttcgtcatgtcatttttgttgtctttgtcctaatttgtgcatcgaatgactgatctcacaattatccaaaaatatttacaagaaacatttcacagagctatgtacgtaatttatactacctatgtttttaaatacataagcctgttgacatttccacattacattcgtcttcctaaataaaactaacatttatattggttgtgatttttttaataattaaatgtatttggaccatgatatacttttgcacatttccattaaaatttttaataatataaatgatcaaatatcaccttaaaaatcaacatcatcaaatattttaaaaccgagagagtagtttggaacgcacgtttaaattacagttcatttaaacctgaaatgttggcagttattattgaaccttgcaataaaatagtagttgcaaaacttaagacgtgattatccattttacagtacattgctgatacaatcgtttttatggacagccactttgaaaaggcaaataatacttatcccagtctcgagaaagttacccggactaaaaacatatcaattttcattttcaaataagtgttttttgtttcagtaaagcaaagcaacaatgaactcatgattttaaggctagctattcactcaataattattgccgataaagttcatcacaacaaaacaaaatagtgtcgggaggagtagatgtgttgagaaaagaagaccgagaataaagtattaggcccaaataagtatatacgtatgtaatatgtaatatgaaaaagtatatatacatccctaaactttatattgaagtctgtctagcacattgcactttaaaatcgaacatccaaccccctgaactttgccataccatccatattaccgttaaggtggttttggatgatggttttgcatattttagaagcttaaactgttgagttgtgatccaaatttatttacacttaataaaggctagattctgccgtagtgaagcggaggcccgtcgccggtaggcttggttcagagccttttagggttccaccttttacggtacggatcgtaataccttttagggttctacctcatatatatatatatatatctcttgtaagccgccgtgcggcattgtaacctcacccaatatagtgaagatattttactggctagcgcccgtggctttttctctcctgctttgggagggttttccacgttaaatctcatgtcttctgtgattgatctgtattgttctttatcgtttatttgcctatcgtttcctaacataaatgacaattttgaataactaatgtaacatatttacgtatcatcagttataaatcatcaatttatcattatatagtgatatcatgatattattatattggtgcttgtttgttagtgagagcaaataaaaggcaaaaagaatgatttaagtcaaaatttttgtatatatgtccaaagtatatgacatgtgatcaaactcatccaacttatatacaaattagattaaaaaaaccactatgcaaaaccatcttagggggttacatcaacggtattctaaagtttagggggttgaacgtccagttttaaagttcagggtgctagacggaattccatcagaagtatagggggttattaggattggaaaaagtttacatgtgttgaattattttcggacaacttttgagtattcacttgaatacccacgaatctccctgtgtccacccctgaagcaagcaaaccaggaagaacaataccaacagcatgggtacacattttggcctccctgtaaactctataactcaaacaagaaatcggcagttctaaattattaaattagaaactgacctaatatatatatttctccaaaaatgaattggacaaattaaaacttccataaatttaattttatcattaaaatgagattttgttcagatttaagcatgataatctgcttgtaagttatatgatgttatatggaccatgtgatgattttttaaatattcttttaagtgatttactaatgcaaacatagttgggggtttccttgggctaggttgtccaaaaactagtataaagccacacaaccagaagctagaatatccatccataaacgcatcatactgccacctccctcaactagttgcaaaagcacacgttcttccggtcatcagccatgcctggaacagctactgccgctgttgttgacagccgcctgtgcacacagcacgcagaaggccctgctgcggtcctcgccatcggcactgcaaaccccgcaaatatcgtctatcaagatgggtttgccgattactacttcggtctaaccaagagcgagtatcttactgagctgaaggataaaatgaagagaatatgtaagcagatcaatccttccactttgatcgttgcactgatcatcattatctctagttatttttcataaactctaatgagaataaattatgcatgcacttaaattttcaggacactcctgccatagttcattgtaatgatgttggagttcggtcaaattgaaatatgtcctgccattataacctcggagagctatgtactaaatgtaagagatgtgggtgcttccttttccatttcaggtcacagataaggaatagagaaacgctacatccaccttgatgaaaagctcatctgtgagcacccggagatcattgacaaacacatgccctcccttgaaactcgcgtagacatcgtcaccactgagatcccgaagcttgccgagtccgccgcacgtaaggccatcgccaagtggggccgtccagccactgacattacccacctcatcttcagcacctattccgggtgcaatgctccaagcgctgacctcaagctggcatcactactcggcctcaacccttcagtctcttgcaccatcctcagcctccacggttgctctggaggcggtagggcactccaacttgccaaggagctcgccgagaacaaccgtgaggcacgcgttcctgtagcctgcgccgagctgacgctaatatgcttctcaaacccagatgaaagaaaaatcgtcggtcatggactgtttggggatggtgccggagcaatcattgtcggcactggcccattggtcaatgcagagcgtccactattcgagatgatcgttgcctcgcaaacaacgataccaggttatgagcaagcacttggcatgcagaccaccggtagcggcatagatttccacctctctatccaggtgccaacactgatcaagaacaacatccgacagtgcttgcttgacacattccaatcggttggaaacgtggatcctaattgaaatgacctcttctgggcagtgcaccctggtggccgtgcgatccttgacaacatagaaggcgagcttcagctgcagccagcaaagcttgcggcaagccgccatgtgttgagtgagtatgggaatatgagtggcacgacgatagcgttcgttcttgatgacttgcgtcgccgtcgggagaaggaaggagatgagcatcaacaacctgagtggggagtaatgctagcctttggaccgggaatcacaatagaggcaatggtgctacgtaacccactctcatgaagtcttaaggagaattaattgtcactatcttatacttctccagtatcttattacagtatatggtaattaattaatgcatgacactaaatcaattgttcatgcttcagtgggattatgacctacttggtgatgtattgatgttgtggagttcctatataatgtttgtgaagatatttgagttgtcaattgctcaactctagtacatgttgtaattaaactctttatttctttcatatgccctctgattgttaagttttttttttgttttgtaataaaatttgtaataccttgtgtataattaaaacaccatattgcttatatggtttgcttcaatcattttgatcaattgagagtatttttaaagaaaacatttgaataagatgaagtcaacactgtaagaaaatgatattttacaagtgaaaaactgttcaaaaacaagataaaaagaggcaatcaatatcaacttaatatttactaattaagattatttttcttctcgaatatgcatgagagttatgtagcattgcattaatggaagaacggaggaatacgatgcaaatacaaagattcagaaaacacgaaaagagagaaaacataacacgagcaaaagaagaacaaagtgcctcaccaaggttctcctaccaacctgaatcacaggccttcttaactgggatccataatcaacggaagtccctatggccccgcctaaactccataggtgagcctcgtcactcgcaagaactactcaagccaaaatgcttgaggcagcctcgttgaaaacataattgttttgatgcttccaaatagtccatgcaccaagaatgatcagattatttatacccttccttatagccccttttaccaaattgttggccctgctccacctatcggagaagtgggaacaggggttccctttcccccaaggtgctcggggcgctatgcgccccaccaagccttacaagatctacatctttaaggtttcaagaagagtatggagacctacaatatctacatcttcaaggtgcagaagcaggcactggtgtgtactagtgtctcgtcgaaagtcatgcccatcatgaactccttatttatcaatatttttgagaagctcatctaatataccaacgaaatatactttcggcaatgcaaatgcgcccgaatatgtagggttgccccgaggacttggcctgccttgaggacaaggggtgacccaaacatggcggccaaccggtgacaagattgtaatccctcaagaacccgaggactccccgctcaatcaatggagaggttcaccacattaaggaaagctactcgggtccagaaatcacatttaaaccaccactttacattaattatgatggtcctattgatctaaagtgctgtcatccacaagcgacttatgagattgatctcatcgggagtggatcgggcaatatggaactcggattattggttctgtgagcttcaggaatatcacgaattcggctctggcttcctccagattgtttctcaatgtggatttgtctacggcttctcaatgtggccctccttgaacacagtggccatgtgacgggctatagtttaggcccgttagagatgagagtcatccgtgacgggcttttgtgttggcccaattgagatgcgtcatccgtgatggccggatgcctgattgagatattttctcacatcacggacctttgcttagtgacgagggccctgcccgaaagagatgatgatttaagcccgttagagatagccgatcccgttctagtgattttatgtggagtacaatgatgcaaataaatattaaaaataatatgtaatttaaaatatataagtcattaaagggttaaaaaagacatacaccatatgctaaagaggatttatatatgggatagagtggtctccggttagaactaaagcactatagtgcactatctagtcacgtcctatcctaaatggtaaaaaaaagtgacagaacttcttattttggggcatctgaattagacacttccaaaaaattaattaggaaaactagaggcacccctgaaggtcgtgccagccgaacttgccactctccatgatcaccgttcctttgagatgcatgaggccaccttaggaaagggatgtttagctcatttaattgtcatggcatgatgattatatgtgtctatgtcctcctattctgcatttaatcactcaagatccacaatgttaccagacttaacacatctcgggcgcgatttgatccatgttacttaatttatttattgggtcattgattctcatgatcacttatgatcgattatgagacgcggggtgattgtgcaaagcagataattattttaagaatgtataaattacattaattttggactaagtacattaatagcttcacgatcaaaaactaaatatgaaaatatgctctatgattcagtcgaccgatctcgcgttatacatagtgatatgtaatctccagagaaattggggtcggtatatgtattctagaattagatattatttaatggcatattctaatttaaaaactatcgtgcaaatcgggacacttttgagcaggctgggatattttcttgtaaaatccaaatacagaaaaataattagtacgaattacataccaatgccatgcgctgcaggtgcaattgaaatatcatgatatggcaatatcggccacgttgcagcgtcttctaatataataagtgtttattgcctactttgcacgatcttggagctaatcacacgaagtggacaacaagttcgtcgtccagataccacattagctgctttgttatctttctttgtgtgcatcgcatggcagatctcgagacaataatcgtcttcttaaataaatctatacgagtatcatgaaagtacattaaccattatattacttatatttttcatatttacattaaaacttttcataagacaaatgatcaagcataatattaaaaattaacagcattatattaacatttcaaaacagagtgagtgagtagtttggaacgcacataagtaactagtattaattttaaacaactattaattttaaactttgaaaattattatagaaccggcgaaacaagatagtattagtaaaattaaaggcatagtatcactttttgggttatccatcttacagtacattgctgatacaattgtttttttaccgccactttgaaaaggcaattaatatttatctaaatctttggagaattatcaaaactaaaaagatcaatattcaagtaagacattaatatgtttcggtaaagcaacgccagtaacagacacgggacttcaagactagatattcactcaacaaatactgataaaattcaatagaacagaacaaaataatgtcagaagtagattctgagaaaaaagactgagaataaaatattagacccaattaagcatacacatatataatgtaaatgcatatattgaattattttcagtgaacttttgagtgtctgctccagaagcaaaggaccaggaacaacaataccaacagcattttgaccataagatgggtagatatgttggcattcctacacatttatgtaaactctataattcaaatgaccaggaacaataccaggagcattttgactgtaagatagatatatatgttagcaatcttcacattttctgtaaactctacaacgcaaactagaaatgggtcgaggccagttcagaattacaaaattagtacctgcactaaaatatatatttctccaaaaacgatttggacaagtcatacaaaaatttaattttatgatcaaatgtgattttgttcagatttaagcatgatattctgcttgtaagttatatgatattatatggagcatgttttgattttttttaaatattcttttaagtcatttactaatgcaaacatagttgggggctagcttgcgccaggttgtcgaaaaactagtataaagccacacagccagaagctagaatatccatccataaacacatcatacagccatctccttcaactagttgcaaaagcacacgttcttccagttccatcagccatgcctggaacagctactgccgctgttgttgacagccgcccgtgcacacagcacgcggaaggccctgctgcggtcctcgccatcggcactgcaaaccccacaaatatcgtctatcaagatgggtttaccgactactacttcggtctaaccgagagcgagcatcttactgagctgaaggacaaaatgaagagaatatgtaagcagatcgatccttccactttgatcgttgcactgatcatcattttcactagttattttttcataaactctgatgagaataagttatgcaagcgcttaaattttcaggacactcctgccatagttcattataaaccatacaaatatttatactatgtagaaagaagagtataatgatgttggagttcagtcaaattttatatacctcgtgtgtctgatgcaatgtggatgcacggggtgacgttgcatcccaaaattttggaaaaaaatctactatacacacagtatatacttggcatatgtacgcagtatgctcaatacgaggcccacttaaggtcatccatgactattgatctgctccacttgaatttctacgttatttatgtcattgtatttgtactagctatttatgtactgttttgctagtatatttttttcactttatctgttatcttcaatcataacactaaagttttgcatcccatctcagaaatcctggatccaccactaatacctcgttaaatatgatagtgtgtcatatactgtctctcctgctcatcagactaccatctcgcacccatgcctctgtactcatatagatttcaacagtctacgcttttaacaaaaatacaagagatctacagagtagtcatagtaacaaatccatggatcttaataaatttgtatagaaaaatagcactcacatgtctatatgttggcaccaggaattgagtcttagtggatagagttatgtccccacgttacgagaaaatcataagatcatgtttgaacaaaacatatgatgtgctaatccaatctttcagaaaattaaacacatgttcatcttcctaaatataggacatatataaaccaattttttgtcttgttatggaaaatgcttgcaaaatctcatattttttttgtatttattcggcaacttaattgaaatatgtcctatcattcttataacctcagagtgctatgtactaattgtaagagatgtgggtgcttccttttccatttcaggtcacaggtcaggaatagagaaacgctacatccaccttgatgaaaagctcatccgtgagcacccggagatcatcgacaaacacatgccctcccttgaaactcgtgtagacatcgtcaccactgagatcccaaagctcgctgagtccgccgcacggaaggccatcgccgagtggggccgtcctgccattgatattacccacctcatcttcagcacctactccgggtgcagtgctcctagcgctgacctcaagctggcatcactactcgggctcaacccttctgtctctcgcaccatcctcagcctccacggttgctctggaggcggtagggccctccaacttgccaaggagcttgccgagaacaaccgcgatgcacgcgttctcatagcctgcgccgagctgacgctgatatgcttctcaaacccagatgaaagcaaaatcgtcggccatggactatttggggatggtgccggagcaatcattgtcggcgctgacccattggtcgatggagaacgcccgctgtttgagatggtccttgcctcgcaaacaacgataccaggtactgagcatgcacttggcatgcagaccaccagcaatggcatagatttccacctctctatccaggtgccgacgctaatcaaggacaacatccgacaatgcttgctcaacacattccgatcggttggaaacatggatcctaattggaatgacctcttctgggcggtgcaccctggtggccgtgcaatccttgacaacatagaaggtgagcttcagctgcaaccagcaaagcttgcggcaagccgccatgtgcttagcgagtacgggaatatgagtggcacgacgatcgcgtttgttcttgatgagttgcgttgtcgtcgggagaaggaaggagatgagcatcaacaacctgagtggggagtaatgctagcctttggaccaggtatcacaatagaggcaatggtgttgcgtaacccactctcatgaagtcttgatgaaaattaatggccacaatcttatgcttctccggtattttattacagtgtatggtaactaattaatgcatgacagtaaatcaattgttcatgcttaagtgggattatgtcctagcggtgatgtattgatgttgtggagttcctttctaatgtttgtgaagatatttgagctgtcaactactcaactctagtacatgttgtaagtaaactctttattgctttcatatgccctctgattgttaagttttttggatttgtaacaaaatttgtaataccctatgtataattaaaacaccatattgcttatacggttttcttcagcccgaggtttgatcaattgagatgcatttttaaagaaaatacttgaataagatgaagtccgcacggtaagaaaatggtattttgcatgtgaaaaactgttgaaaaataagataaaaagaggcaatcaatatcaacttaatatttcctaattaagattatttttcttctagaatatgcatgagagttgtgtatcattgtattaatggaagaccggaggcgtaagatgcaaatacaaagaatccgaaaacacaaaaggagaaaaaacaaaacacgagcaaaagaagaacaaagtgcctcaccaaggttctcccaacaacctgaatcatgagccttcttaattgggatcgattatcaatgaaagtccccttggcctcgcctaaactctataggagggccttctcactcacaagaactagtcaagccaaattgcttggggcagcctcgttgaacgcaatcgtttcaatgcttccatatagtccatgcaccaagaatgatcagattatttatacatttccctatagccactttttaccaaattgttggcccagctccacctgtcggagaagtggaaacaagggttccctttccccctaggtgctcatggcgctgtgggccccaccaagcactacaagatctacaccttcaaggtttcaagaagaatatggagacttcaaagtatataagcgggcattggtgtgtaccagtgtctcgtctaaagtcatgcctatcatgaactccttctttatcgatatcttcaagaagctcgtccaatataccaacgaaatctactttcggcaatggcaccgtgcctgagtgtgtaggggtgccccaaggacttgcccaccctatggacacggggtgacccgacacacggcagccaaccggttacaagcttttaatccctcagggcccgaggacgctccgttcaatcaatgaagaggttcaccccattaaggacagctgctcgggtctgatgctcacatttaaaccaccactttacattaattgtgaggtgaactcatacacaacttgggagacgtggtagcacatgcaaccccttgcatgcccacgttaccccggagaacacaaggcgtgcgacatggcgcgtccacagcaaccatccccaagttccacccctgttggctacggtcgcttatgggtagcccgtggacaattggaacgaagacttttgattcatctctccacttgttagttggtaggcatggctttcacatctggtcagctggcttggagggactactacaagactaagcatattaagtttagaggagtaggccccactcgtacatgcatgcaatggcattgtggactccccttcatgtgtaaaatgaggatccgtgccatagagaaaagggttcacactctcatctaaattagattagccaaacatccagtgatcaagtaacttctcctcacacttcttcttttcccgcatcactttgtgattcccttcaacatccatagtccacacacagaagtaaggtattatgcacccgtgcgtcttgaacctatgtactcgcttggaaatttggagcaaaagactttcacatctcaatgttctaatctcaaattcaaacaattccattgtaatgttggacaatctaaaagaacaaaaaccactttccattcaaaatggaacttctggctaatcctgagagaacacatcctaaagctactacactatagaagtacattttggaaaaaaaaaaggtgtagtatcatatgggtgaaatttggagacgataataaaaaaaattcatgctgctaccacaaaaagatatagaagtaacaagatttctcaccttcatctccatgatgggattgtgatttcctcacatgcagacaaagcacttgctttcttagcacttttaaaaataaaatgggcacctcaaagcaaaatcaaatgattaagcaaaatcaaatcattatcaatttgcaggagttatttacaccttaggagggactctctacctggcttctatgatgaaatgctcgaaatcatcaattcaatgccttgagatagagatcatgggcctgatggtttcaatgggatgttcctcgaaaaatgctggcaaattatctctgatgatatctattccttgcagattcagttttgttttggcattatatctgtgggcagtcttaatagttcactagatgaataccacgccgcgttgctgcggaaaattaagttacataatatgtacaaataaaatatatttttattatcaaaactaaaacaatttgatacaattttgagcctaaaaataattgagattgcatgtttttatgagagatgaaagacgagacaatttagatcatagatctatcatccaaatgctagaaataattggggtgatatgacttaatgggagaagagagaaatagcattaactatacttagtgtggaagaactatataagtatataggattcgtcactctaattcctaagaagccaaccctggaaacaacaaatgattagttaagattcttaaaaactagttaagcatattagatacatacaatattattaatatgtcatgataattactagcaaataatgcaaaatttataaataatatatatcacagaacgtgcacaaacgaactggctgatagtgttcagctaccaagtttagtgaccacaaaatagcaatatcattatcgaaaataaacaccgccagagaaagcatttgtaaccccggtttgtaacccctttagtcctgggtagcaaaccggggctacgaatccgggactaaagatcgctgtctttagtcccggttcaaatacctgggactaaaggttttttttttctactttaatattgatttcaaaccgtcctcattcataaaatcatccacaaattcaataacaaaatcatccacatttacaaaaacatcacaaaatcatccacaaatttacatcacaaaatcattcaaaaaaaacatctaaaaatcatccactgttcttctactttttctactccacgacggccgcgcttgccaactacccagagggcaccaccgtgctgcgggagctcatccagaactccgacgacgcgggagtgttccacgtccgcctctgcctcgaccgccgcatgcatggcgcaggctacgctgccgctggccgccctccgcaatggcagggcccccgcgcggccacgccgccacgcccgccgccacccccggctccggtgccgggcgccgcgcaccgccaccgccaccggctgcccgcccgctgccgatgttagggtagagggaaaggggaagccgggaagggcaggaggggaggaaaagatagaggatgtgagggagagaaagagatagattaacataaggatgagaggaggagggaatctctgaaatttttctctctccccctctcatgcgcgccttttgttttctctagcccgcacacgatttttttaatctttagtcccggttgtgacaccaccagactaaaatattggggggggctgacacgtcctgacaatgaatgaaccgggactaaagatgaagattaaaaatacctttgaacttataacccgggactaaaaatggcttttagtcccggtttttgttcatccgagactattgtggtttttgcccaactcacgaaagatggtttctctagtagtgaaagaagaactgtataacaagaagatggaatatcgcaagaaatgctgaacaaaaattttcagttttaccttgcatcgtggtaaacaacaaaaatttgttaaaaattatgaaattttaataatgttaatacaatattgatgaataggagtatttaaatacttcaaaccagctgggatttgcggctcgaaatggcttttgccctggcgtggccctcgctgggtgccgacacgtcatccggcactggattttggctgggtttcgagtcatgtggttgcttggttcatacgccgttcgatcatcatcgtgtggctctggcaatcatcgatacgggcagtgcaatggaccaatggcagacatactcaacaaggcccaccatggcaagcgaatggttgacgaaagagcacgcaagcaggtgaccaaaaacacaagcagctaataagttgttgctttgtttttgggtgggcgtggtgtatggctcgctctcgctgttgctgtgtacagccagccagtgtttgatgcacatagtgagaatatgtccatgtcgttcccttgtccttgtgtgacaacatttttttttgtttatgggtggattttaatgggtgctttgaagaccacgtctgtagtgggagcactgt

SEQ ID NO: 65545 - DNA, 9484 bp, Oryza sativa
ggccggtctgaccgctgcttcaccgccggtctgaccggtgtctggtctgaccgaggctcttcagtcggtctgaccgcgggacccactgcggtctggccggtttcctcgaggggaaacccgatttttgccactttaattttgcaaaagcaatctctctctcctttttctgtttatgagctaatctgaaacaaaaatcaacaatatgtccatctttgccacaaaaagaacaagtatatttttcacgatgattagacacattggtagaattagaagacttagcaacacaagcaacaataggaggttttgcatgcacaatattggattttgtagaagatgcactcaaggtagacataataccagcagatttaaacacagttttgttagtatcaggtttaaccaaaatctcaccacttatagcaccaacccctaacacaacaggaggatgtctagaattatgaacataatgattaaaacctaaaccacgattatttgtgctaaccttagattgatctaaaatcatgttgaggttctttttaccatcagaaaatctaagcaaagaatttttcaaataagaaacctctttttccaaattagcacaattttcacaatttaccatgacacctttgcttttatgacacttggggcaagaaagcacttcattgtttttcataacattttccatgtactcaacacgacctaaagcatcttttaaattcatcttattcaaattacatgttgagcaatccaaaacatcatgaggttgttttaactttttagcagaaatcatgttgaacatcaaactagcatgaaaagcaatttgatatttttgcaacaactttttagttaaaaacaactcatccaaagtgcgtgtgtgcaaagcaaaactaagagcaagagaatatttatttttcaaatcatgtgcagcattaacctctctaatttttgaaatttcattcattaaaacctcacaacttttgcaatcatcatcattaggaataagagattttaatctagcaatttcagaattaagagattcaatgataaattcctgttttctatacatcttctcatacttcttattttttgcactcaaaatattaatagcttcctcaaaagcacttacctcatcgttctcacactctgaatcagattcaccacatgccatgaagcaaacaccggagatgttctttcccttagcttcatctccactatcaccatctacgtcgcttagtggctcgaacgcggcgcagacttgatcaaaagccttcttgagattctccttgatcttccttcctttatatgtacccttcgacttgttgtcgttggtcttctcaccatctttgtcttctcttttgcctctcccaagcttaggacaatgcgaatgaagatgatcaaatgaaccacattcaaagcaacgatttggaccacctcttttcctgttcctggcattattcatagctcgagcaattctgttagcaaccaaagccaaatcctcctcctcgatctgttcgagttgatcatcgaatgtggcattaaaaatagcaagaaaagaagacttagatgaagaagcatcaacatccaaagaagaagaagaagaaaccaaagcactcgacttagaatcaactttacgagaaagaacgttcatctcatgtgttttcaattttgtgtaaagcgaatccaaagtcaaagtagacatgttaacagacttctgagtagatgtaactttcatctcccaaatagacatatcaagaccattcaaaaagtggcgagaaatctcagattgtggataattagcatcataagaagaatcaacagatctaagatcactcaaaattttattaaacctagaaagatagtcatccaaggcttctccaggtttcatctcaaatttaatgtactcctttttgaaaagatctcgacgtagttatttaatgttatttgtaccttgatgaaaattactcaaagaattccaaatctcatgcgcagtttgaagatgagcaacacgatcataatccgaacgagaaatctcactcaaaagaatattacgagctttgcaattttgttcaaactcagtttttgcagcaacagtattaataacttcaggaatcacataaggatgataaacttttctccaaatatcataatcttcagccataatgtaagattgcatcctactacaccaatgagaaaaatccgttccatcgaaaacatgaggcttagttgaaaacctagcaggagtagccatggcaaaaactctagatcgataaaagtccaaagaagaaaacaaggctctgataccacttgtaggatcgaatcacaataactaagccaaccagaggggggtgaatggttggtatacccaaaaactgaaaacttttagcggaaataaaagttaccttcgaatttgacggatcgcggtctgaccgaagttgtcctgccggtctgaccgcctggttgccgtcggtctgacagagattagatctccggtctgaccgccgagatcagctgccgcttgctgtcaccgctgccggtctgaccgcctcgccaccgccggtctgaccgccgcttgccgccggtctgaccaccagtatatcgccggttagaccgccgaaacccggtgaaatacaaaatgaagaactcttaaagtggatgatgactttattgattctctccgtgtttacaaagtgcaccaacagcactccttacaaaaaaatttgactaaactcgaaaccctaactcaaaactcaactcaattgctctcaaaagcgataccatgaagcctcacgctccccctctatttatacccgagataggcagcctaacgccacgaaccaaactcatactagaagtcctaaacaccttaggaaaccctctagtataagaaacaaactttacaaaaccaatcataccaaatttggactccttccaaattcgactccgcatcccatacgcacacaatgcctccatcgtatgccatatggaatctccatcaaccacgtgcatcaactctagcctaagtatcccgcatgatctctgaccaccacggacgtagtcttatccccaagccgacgcccggtccatcaccgcaaatactctcccgagacatcgagtcacctacagatgaaataaacaaagaaaccatattccgagaccaagctatctccaacttgactcattagtagcaaacaacagtattacatacgtattgtattcatttagaagtcataatcatgaaataatcacagatatctaaacaaacaacccgaaaccaaaaccgacacagagtcggccggtcagaccgcgggctggccggtctgaccgcgcgcataccaccggtttgaccggcacacactacccggtctgaccggtcacatgaaataacagcagtacctgtagattcacctgtaaatccaatcatctccaaaaccacttcgtgaataaatttcaaataacaaaaccaataatctccgatgccaattgttcatcacagaataataatcaaaaacacctttgattttacagatgtggccatggagcagggcggcggcggttgcggatagtcatcggagttcccctgtcacatcgagtgagtccgtcgacatccccggcagccacgcatcgggccgtcgatggcagctacagccacgcagaggaccgccttgagcacttctccgccacagccccaagcaatccggcgcgtatttgttttgtctagcaacgaggtttgtctttactgtcccgtgtgtggcacggggcttcctaatgggcgcgggcgcagccgcacacgcccctatcacgcctctccttagggctaataacgctaattagcagtgatgatgttaattagcggtgatgataattgttagtattagtttttttaaaaaataatacataaatagaacttttaacttagatttagaaaactttcaaccagatttaaaaacttctgactcagatttgaaaactttcaactcagatttaaaaactttcgactcagatttgaaaacattcaaattaagattttttaaaaacttttaactcagatttgaaaattttcaattcaagatttgaatattttcaactcagatttaaaaactttcatctgaaaattcaaaacatttaactcaattttgaaaactttttctcaaaattcaaaaattcaactcaaattgaaaactttcaactaaagttgaagacgaaagattcaacttctaaaataaaaaaatcatgaaaaaaagcaaaaagaaacaaaaaacgcggacgttagcttttccggaaaaaataaaatacggacgtgacttcatccgcacgcatacgcgccagcgccgtgggccttatgggcctaaaatgcacgccgccaacgcgcgcgcgaattagctatcgcgttgtggcaccgtattaatgcagagaattgaatcttggtctgtgtgaattttgaatctcagtattgttcctgaaaacaatcttcatctgtatgagtacttcactagaaattgcaatcttggagtagtttccactggaaaattgcaatctccgtattgttcctgaaaatgatattggtttgactcttaaccaggtctgtgaattctgcgatgatcaaactgggactaaattcagagagaatttggtcaagctcaaaccaaattcagagataagtatagaccaaattatgagagaaatttagaccaaatccagcactatactaccatgtggacatgtggatgattacacatagcatctcttcaataatttggtgttattttttcatgcaacatgattgatggcctctgcatcttttcttcagacactttggcagttctactgcatgtacatgcattttttctttaattaactctaaaactgcaaccaccagatgacaataaattaattaaccacagtgaggagaggaccaacatgaatttagtgcttgcattgacattatctaaaagaagcagaagctaatggagtacaggtttagatcagagtaatcacttaaattcagtgctctgcatatgcagcagatgaatactcacaattcacaagaaacctggaagaactcagtatcctttattgcggcacatttatatcttgttaactttacaagagtattgatgttaactttaaaagaaattgcagactaacgttacaaacaattctgtcaagctagcttgcagatcagaacactctcaaaacaaacatgctacacataggtacagtgaacatgccacacatgtggagtcaagcattttgtcaaaacttgttgtcgcatatacagtgaacaaaattcaactgtgaagaaaatgattcatcaggatctttggcttggatgaatgcagcagattgtggtctgatgctgcatgcaaagttcatggacagttcagttctgtttcaattcaccattgcacatccgcaacgaattgcaggcatatgcaggaccagctgatctgcaatggttggagacacctagtctagtaaacagatcctgatatgttaaccatgaacattttttttaaaggaatattaaccatgaacattaggccaatgtcaaatcgtcattcatggttcctagataaatttcagcagggtcgatttacatcttgcccaaacgattgagcaaatcagacaacagtaggttgggattattgtgacctcgtagcactgaaaattgcagttgcagttatccaggtgacccaaaatgaactgctatcagaaattaagaacaagttcctggaaaaagaagagaaaaaatcgtctgaaaaggatttgggggaagttgacaatttatcgacgaacaataacaaagaacataaaccacgccagggcaccaggagcatatcttcttctccttgttggttgagcatatttctatccatgcatgtgataatgatcggctgagttgtgataagataggattagattttatctctttctgttacatccgttgtcgctgctgttttcctcctgagatggcgtggttgttgctgatctcgtaggcttctgtaaacgccacggtgagggcttttctgccaaattctttcacatggtatcagagcctgatccaatctaatctagcgacgttacttgatggcgtcgtcctcctccactaccagtagtgctaatcctctccagggaagttcggtgagtgagaagcttgggaaaaccaaccatgcactatggaacgtgcaggtttgtgctgcaattcgcggcgcgcatctacagggacacctgactggcgcagcggagaagccagacgctgagatcactgtcacagctgacggcaagacggagaagaaggcgaatccggcgtttgaagattgggaagccgtggattagcaggtcctaggcttccttctcgcatctctatcaagggatgtgctcatgcaagtcgcaacgtgcacaacggctgctgaagcatggacaacgattgagcaaatgtactccacccacactagagcgcgagccatcaacactcgctttgcggtcaccaataccaagaagggaaatatgtcccttgctgagttcttcggcgagatgaaatcgctcggtgacgagatggcagctagcaccgggtgaccggttgaagaagaggacatgatcatgcacatcattgcctgaagtctatctgccgtgattttggtgatgaatttgagaatggaattctacaaagctataggcatgtaatcattgggacatgattaaaccattcatttctacaaagctagtgttgagaggatgtccagtccctctaccgatgtgattaaactttgtaagttaataagcgtcctatgtccatctgaactgtccattctatttttgtattagtgtaaaaggctagagatttttaatcatgtgatgtaactagtcttccatcatgtagacccccgtttttataacaggaatcaatcgtgtaaacagtaccatttccctggatcaagtagtctggtatacacgagttcatagctgaaatatcaaatgcacatacacgagagtctagtgcgaattattacatcataagcctgcaggcgtagtcttaaatcatcggactgtgcggtccggaatacattccaaaagcagaaatagataaagcagcggaattaaggcagcggcatgccattgccacaggcaacgaccgtaactaagacctattgagcgccattgtcttcatcaccctcctggtaataggcatagggatcctccgaagctttatctccggcctctgattaagtttatatttgcaagggtgagtaccaaccgtactcagcaagccaccacatcaacaatgcatatgacaagggtatttcaaaggatggctatggttgttttgcgcaaagcaagtttttgtaattcttttcataagcctaagacctagtattgactgatcaaattttagtaccaatgtttacatttaaacaacgacggttctgtccaccatccattgtgatcccaaggatagcttcccgccattgagtcgtcatagttttctgagaacgtccaccttccctcctctctggaagtggctccaacagcataaaaatcatcatgcaataacccatcccacacaagttaagaatttagagtctagccaagtgtaatacatgtcccggtgctcaataaccgcgagcacggctattcgaatagatttgttttactcacactgcagtggatgtacactttacccacactccgcgactgcccaacacatgagccttatcccaacacatgagacgtgtcacggcaaagcttttcgataacctcgcattggcagtacccgctccatgaacttttcatcctcatgcactctaggcgtacacggtttctagcagtgagaggacttctggcgcacccgggaagggaagactcacacaaatgcattaagttataattatgtttaaattatcacatggcagtcctaccaatggcgacaccactatagagcccctgccttacacatcaagaagccactatgcatggatactgcctccgctcagctatttactccgctaggtctatccccatacgagaagtgtggttgtacggggtcgtttcatgcttaacttcatggctcggtccttaattgaccggggacgatactagtctttcccagataccacccaaatccaccgtccgccccagtctaaaatatgtatttaatttcattcctacttcctcaaatcatgtcattattatcatggcaatgtggagctcatgtctccacatgccgcatctcaattatcttcccaaagataattgccccaagcatatagcatttgataaaatatgagtatgcataaatctagagtagcatttctaagcaagtgtcataattgactaagtactcatacgtatttatggttacaaagatttaaaagtaaacaatattcaaggcatggcataatcacaagtagaatgttcatcattgcatgcaatcttatttgtaaacaaaataatttcgcaattgggatcaatatgttcaaagaatagtgatgacttgccttgctcaaagtcttgcgggtcttgaccttcgcttggatccgcaactccctcgggctctataattacgtgcgaaggaacaatttgaattctattagaattcaaataaaatccaaataattcacacaaaagtcgaacgcgaatcaatctttctaaattgacaacaaagtttgcggaaccactttattcgaattgttgggtcatttaacctaaattaattatttcctagggtctcaacataattatttatttcctaattaaatctaaattcctaccgcgaatcgacctcttattgagattaccggaaataatctataatcatatcaacgttttacgattctaggttataattaacctataattaaattctaattactctaaattttctaaacttcttaatctccctaatttatttcccctttctctttcttttcctctcattccttttctttccttctttttctctcttttctctccttttctctctttttctctctttttctctcttttctctccttttctctctttttctctcttttctctctttttctttctttcttcctcctctccctaccggcttctccctttctctctctctctcgcctttttgcccacccggccgacgcgcccgtgaacgcgagggggggaaaagacggctcaccggcggcggcagcggcagcggcgcaaggcggtgacgctcggcaccacacccggcacggcgcggcggcttcaaggcgacggcgcggcgcacgaaggcgccggcacggcggcatgacgacggcggcgcgtggagaaggagaagaggggggagaaaatgaaggggatgggtgtggggtggagaaaaggaggggccgggttttataagggcatgggggaggggcgggcggcctcgtggcaacgcgacgggcggcgcggctgaaggaaatggccacgggcggacggcgcggcgcggggctcggcgcggctcggcacggggctcggcgcgacggtgacg

SEQ ID NO: 65546 - DNA, 1860 bp, Oryza sativa
gtaatgattattatgcaaccatgacaatggaaaaatataaatgatcacactatgtttgaatggtacaacacatacacctttgtacttgtttcgtagccaattttgggaacacattaaggcctccaagatatctgaagtgagtcagctgcggtgctcactaagaaccctcccactagtgctgaatgcagcctctgatgcaactgggctaactggaatggcaaatatgtcccatgctacttttctcaatgtaggatattgtgtcccagccaccttacaccaatcaaaaatcttgaagttttccatattaattgagactaactcatcctccaagtacctatctagctcagatttaactcttattgctggtggcctccttcaagcaacacgtgcactaattgaagacaatacacctgaattagcaagtgaatgagctgaagattctgtgttatcttcatcctcttccatttcatactccttcatgaggtcatacaaattgtttttaacctcttcaagtttgtctgtacactcctcacttgattggctagtaatggactcaatgaacccaaggaggtagtctgttttaaacttaggatcaagtatggtggccaatcccattggtccttggatctccttccaatacttatcaaacttcgcaatcatctcagttgacatttcctctataatattattgccacatgcagcctgtcgacgggggatacccgtagacaggatatagagggtactggggtacgctggtacaaggatctacatagtacgacatcaagcaaataggaaacagagattatactggttcaggccccttggtaggtaatagccctaatccagttgatatgggattatatgatgaaaaccacagattacaaagggaacagtggaactcgacgataccgacaagatcgtagtcgagttgatccgactagatctcccggcgacttggctccgataagctccggcttcgtaggctgtggtggagttggctctgagattcgatgccttaggtcctcctggggggtcccttttatatcgcaggtcacctgtctcccagttggactcggagagactggaccgaacacgacacaatgacgacccagttctgaccgagtaggactccttccatctgtgaactccatgatgaatttccttaacgtatgccgaaaacgtccgtatacgcgtgaacataccatatcgatacgtgacgtatatcgaagggtagagggtataccttacccgtaaccctgacacagcccactgcctaatttgctctttagccccacaaattttcaagagttggacattggcagtcacataattagttccagagaacacttctgtgatatcattgaacaacttgagcctattaactacctctacagcaaaagcacattcatctttactaggggcacaatcaaagagcttctcaacatgttttgcacgatcaaaagcatgtgcataaggtaaagcaatgctaagcatcttgtaggtggaactccacctagttttgcaatcaaggcctaacttgtgatccattttaactttaacatgcttagcaatttcatcaaatttctctactctcttaggcgtggctgtccaaaaagcaacactttcacggatttttgcaattgaatattttatcacctctataccatccttcacaattaagttaagaatatgggcagcacaacgcatatgtgttgatgtgaaaaacacgaggcctgggagatctgcttaactccagtgcaggtccaaaaatcttgcctttaggttcgtgagcgtgccagttgatttgatcatgcaatcaacaagaaataaagacaggaaaatagcggttaaatccataac

SEQ ID NO: 65547 - DNA, 1028 bp, Oryza sativa
ttaatttccggatgttttatttttcaaaataaaaactatggagttcctcatttgatataaattcctaccagagccaaaaatattccatattgattaaaccatatatattttggttacttataattccattgaactttgtcaaattcttgtgacttgtgaacatacttctcatgatctatgatcaagatcatacatccacatatatgcacatgctaaactcctacactgcgagctagcaattatccattccatttccatactaccaccaaaaataaattcgccatgcttttatgcgctttcttctcctaaaaagaaaatcctttctgaaaaaaaagagagaaaagaaggaggaaaaggcggttatgaaaataaagttatgctctctcaagaatgagcatgatattgaaaaaaaaaaagagagagaataatgtagccatgccctctccttatttataaaagaaggattttaggagtaagcacaaaggagaagcgttttgatgcagcaacgggggttcccgatctttcgatgagaggaggataaacttcgatttggggaaggatacgacgttggcggtccgactacaactaccacaggggtgctgcgccttagcaaccggtacaccgactccacgttgttgctgttcttgccgtgccaagaacaaccttgaacctgcaagcaatcgaagaacaagcaagaacaagttgacaaggaaacagctcacggcacttgtcaaatgatgaaacttaaacaaaccaaaatggggttttgaatacaagtatccgggtggtctagccgacacacgcgagtacaaggaagtagctgcagctaaacttacatcaaaacaaaacccaaagtgcaaaatggtggctgctaggagtttatataggtggaggaatgaccaggagaggaggtgggagcaaaccctaggttttgtggacccctaatgggctgtaatgaaacaaggcccaagcccaagtttctgatgtaaaaaactattttcgtcattctgagcagccttggtcaaagt

SEQ ID NO: 65548 - DNA, 7298 bp, Oryza sativa
tttgtctcgtctacatagttcttttcattcatatggggctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacaccacacacgaaaatggaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacaatccaaatatgccctaaaaaataataaaattgtattttaccagtcttggagattttaatcttgtatagttttcaatataaaaagatttgataactattgatatttatacaaaaatatagagcacagtataaaatcgccctcccccagggcggcaagggggccgcctgcaaaattccatgccccctcgccgcccatttgcaggcggccccccgcacagtataaaatcgccctagcggagggcggcaagggggccgcctgcaaatttcgttgacggccgtcgcccgagagcgaacggccgtctgccacgtcatttttgccgccctctgagagggcggagggcggtaggcgactacttccgtcaattttcaaaatggaaaattatttttgtaaaacttttaataaaaaaaattataaataaaaaaaggtcattattggattggtcgtagctaccatcgtagtttatatccaatctttctttaggttggcatagatctaacttctaagagtatattttactcttaacaacatcgtattacacctaatatacatacaatagtagcaagtagcaagaagtttctcgttaatgttaaaccaacacacattgttatgactcctgagaagaactcggcgtccacggcgtatcagaagaccagagatgaactggatagctttcaactacctcaccacagccatcttcctcctcctccttccggcgtgcgtagctgatgaccagcttgtccccggcaaacctctgtccattggctccaccgtcgtttcgaacggcggcgccttcgccttaggattcttctccccgaccaactccacctcgtccaatctctaccttggcatttggtacaacgacatctcgccgctcaccttggtctgggttgccaaccgaggaactccggtgaaggacggcggccatggcagctcttcctctgcaccgtcgctcaccctgtcaaactcctctggcctcgtcttggccgacggcgacggccgcgttctttggactacggacatcaccattattgcggcgaattctccggcggttgcagtgctgatgaacaccggcaacctcgtcgtccggtcgccgaacggcgccacgctgtggcagagcttcgaccacccgacggacacgtacctccccggcatgaagatagggatcaactacaggacgcgagtcggcgagcgcctcctctcctggaacgacggccccggcgatccatcgccggggagcttctcgttcggcggcgacccggacacgttcctccagctcttcatctggaaccagtcacgcccgtactggcgctccccggtttggacaggcaacccgatccccagccagctgatggtcaacggcaccaccgtgatctacctgtccgtcgtcgacgccgacgacgagatctacctctccttcggcatctccgaccgggcgccgcgcacgcggtacgtgctaacaaactccggcaagctccaagtcctctcatgggacggcggcgacggcgcgtcggagtggagcaagctcggcgagctgccgaaatacgagtgcgaacactacggctactgcgggccatacggttactgctactattcggaggtggctccgacatgcgagtgcctcgatgggtttgagccgaggagcaaggaggagtggagcaacggccgtttctcgcggggatgccggcgaacggaggagctgccctgcggcggcgacggtggcgacgccgtcttcttggagatgcaggggatgcagttgccggacaagttcgtgcgcgtcaggaacaagacgttccacgagtgcgcggcggagtgcgccggtgactgctcctgcacggcgtacgcgtatgccaacctgggtggtagcggcagcgcaaggaaggacgcgacgaggtgcttggtgtggctgggagagctgatcgacacacagaaagttggcccggattgggtgccttggggcatagttggtggtgagacgctttatctcaaagctgcaggtttcacaggtaaaactttatcggactatcttttcacttatactttatactttcaattttaaatttaaagctgatttaaggtatttttattaaaatttattttttagtctttgcttttagatcgttaagaacatctatataaaagttttatttataaattatttttcatttgtaaatatgtgatagggcttaagtctcgcagaatatcaggtcgcagtttgtatgtttcattcagagttgcttgacatcacccgctgaacattctttttaatgtcaaaacatctcattatagttcgtgcaatattcccctcctagattcctttagtctccgggtgaaccttccacgtatgtttctttagcgacaggattcagcgcgcaatggtaaaagaaaggagctcctatatcttttgggtcaaatgaccgaatgatcaacggtgtgtggacaaactctagataagattactgacgagttaatgtgacatgtataatattgtaaagactaacccttcattccattcccctgacaggccgttcctaacccttataagctgaacttgctatttaaatgccagaagcaggactatttgccatggattcgtggaatgtcaatcctaggcatttcttaattctcaaaaactgttgctagtctgctgtaaatcctaaacatctgcattatttacttgcatgtcacgacccaagctgcagctcagcaatttcttactgctcctaatgcatgtctaaagaaattaaggaatggctatatatacgagcgaaacataggtgatctatctccttcaggccacagattgacagatggattggtcatcatctgctttcacctgcatcgccgccttcctcctcttgtcgccggcgttgtgcgccgccgacgaccggattgtctccggcaagccactctcccccggcgccgctgtcatctccgatggcggcgacttcgccttgggcttcttcgccccatctaactcaactccggcgaagctgcacctcggcatatggtacaacaacatcccacggcgcaccgtggtttgggtcgccaaccgggcaactccgatcatcgttaacggcagctctaactcctcgttgccttctcttgccatgaccaacacatctgaccttgtcttgtccgatgccagcggacagattgtttggaccacgaacctcaccgccgtagcgagctcctcctcgttgtcgccgtcaccgtcgacggccgtgctcatgaacacgggcaacctcgtcgttcggtcgcagaacggcaccgtgctgtggcagagctttagccagccgacggacacgctgctccccggcatgaaagtgaggctcagctaccggacgctcgccggcgaccggctggtttcatggaagagccccgaggacccctcgccgggcagcttctcctacggcggcgactcagacacgttcgtccagttcttcatatggaacggttcgcgcccggcgtggcgcgccggcgtctggacggggtacatggtgacgtcgagccagttccaggccaacgccagaacggcggtctacctggcactggtcgacaccgacaacgacctatccattgtgttcaccgtagccgacggcgccccgcccacgcatttcctgttgagcgactccggcaagctacagctccttggctggaacaaggaagcatccgaatggatgatgctcgccacatggccggccatggattgcttcacgtatgagcactgcggcccgggcggctcctgcgacgccacgggcgccgtcccgacgtgcaagtgcctggacgggttcgagccagtgagcgcggaggagtggaacagcggcctgttctcccgtggctgccgacgaaaggaggcgctgcgatgcggcggcgacgggcacttcgtggcgctgccgggcatgaaggtgcctgacaggttcgtgcacgtcgggaacaggagcctcgacgagtgcgcggcggagtgcggcggcgactgcaactgcgtggcgtacgcttacgcgaccctgaacagcagcgctaagtcaaggggtgacgtgacgaggtgcttggtttgggccggcgacggcgagctcgtcgacacgggcaggttgggtcccgggcaggtctggggcaccgtcggtgccggcggcgacagccgtgaaacactctaccttagagtggcaggcatgccaaattcaggtacaggcctaaagcatcatacttcatgttatgataaaaaacggttcaggtatacgagtgccaaatgcaagtatgatccatatgcatttcacgaaattaggagagaatatcatgtgcaagattctttaaaatgaaatattggtcgaaaatgaaatgaacagtgtgtctctgtgcaggtaaaaggaaacagagaaatgcagtgaaaattgcagtgccagtgttagtgattgtcacctgcatttccctttcatggttctgcatcttcagaggtaagaacagaattcttgtttttcccctcaatgcttctgtacatacactacaagagcagaggaacataatggtcataaacttttacggcaggtaagaaaaggagcgtgaaagaacacaagaaatcacaagttcagggagtactgacagctactgcccttgaacttgaagaagcaagcacaacccatgaccatgaatttccatttgtaaaatttgatgatattgtggctgcaacaaacaacttctccaaatcattcatggttggacagggcggttttggtaaagtttataaggtaacttccagtgatataattttaaggatttttagagtccatgagcaggactcgttaccacaaattagcactagaaagtctataaaatattatacctcttcaaggagcataaaaatctaattatctttttatgtgcattaacatgacactgctatttctcaaaaggggatgttacaaggttgtcaagaggttgctgtgaaaaggctaagtagagactctgatcaaggaatagtggagtttagaaatgaagtcactctgattgctaaactacaacaccgaaatttggttcgacttctcggttgctgcgttgagggacatgagaaattgttaatttacgagtacttgccaaataaaagcttggatgtcgccattttcagtatgttcaaccagcatatcacaagttcaaagaacaatttaatgaatgtttatttgcatttcacacatagcatatatgttcttttgcagagagtgaaagaggtgtaacactagactggccagcaaggttcagaataatcaaaggtgttgctaggggccttgtttatctacatcatgattcaaggttgacgattattcatagagatctcaaaactagtaatgctttgctggactcggagatgaggcccaaaatagcagactttggtatggcacgcatatttggtgacaaccaacagaatgccaatactagaagagttgttggaacatagtgcgtaattctttgtgccaatttcatagcttaacatgcagattaactcaattcaactttcataacttttcaatgtgaaattttctcaacagtggctacatggctcctgaatatgcaatggagggaatgttttctgtcaagactgacatctatagcttcggtgtcttactcttggaggttatcagtggtgtgaaaataagcaatattgatcgcattatggactttcctaaccttatagtctatgtaagtattttgcttctaagcttatatagctcttagatccttaaggtatatggagttcttatgcaatctgaagatgtaatttcgtttttctgttaggcatggagcctttggatggaagggagggcaaaggagctggtagacctgaatatcaccgagagctgcactctggatgaggccttgctttgcattcatgtagggctcttgtgtgttcaggaaaatcctgatgacaggccactcatgtcttctgttgtgtccatcttggagaatggaagcaccacactgccaaccccaaatcaccctgcatattttgctccaaggaaaaatggggcagatcagagaagagacaatgtcttcaactctgggaatgagatgactcttacagttctggaggggagatagagcaactattcagttttaattgcagaattgttgtctaacaaaatgccaggaatatacttgacatgcatttttttttgtaagttgtattagcctaatcttgacaataatatcttgtaccaggtatataaaggtcatcttctaaaaatgaaagctttcaactctgagtctctcacaaatctctgaaatgaccacctaaaggcccttaaagtttcccttatgcataccttggctagttgcaagacgttcctgtaacgctccgcttttcgtgaggcgttaaaaactaatttggcaaaatcctaattgcgaaaatttttgttccttgtgtgcaagtctaagttgtgccgtggatctcaattcaaatctgtccttgatccctctcgtcgccatcaaatccttctcctcgaagtccctattccgatttaagtattcgaaattcaaatcctttcttgaaaaccttgccaaatatcttcccgactccaaaatatccaaattcccattttgcattcaaatccaaactccatatcaaatttctctccaaatcagatttcccagtaaaagtctacttcgcctcctcttgttttggatgggccggatttcctcccatcagcccacttctctccctcagccctcctccctcagtcgccttcccccttctaacgtgcgccgcacgcgagccgctcgggagagaaag

SEQ ID NO: 65549 - DNA, 5735 bp, Oryza sativa
gtcatccccgatggtgagaggtttttaaccattttattcctcatggtgagtagatattaaccatccccgtcacctaatagatgaattcatcacggggaaacggtaaacgggcccccattgccatctctaggcgtcaatgagggtttgagctaaatgccttgtttagtttcaatttttttaaaaaaaaacatcacatctaatctttgacatatgcatggagctttaaatatagataaaaaaactaattacacagtttgcatggaaatcgcgagacgaatcttttgagcctaattagtccataactagcctaatctttttaaatatagatttttttaaaaaaaagaagtacagttctcgttgaaatattagaaaaaaaaaatctcgcttctatatgaactttaaaaaagaacacaataccatcaagacttagaatgagaaaagcatgggtaaggaagtggtgggtccggcgggtgtaaggaagtggtaggtccggcgggttggctcgcttgcatccactcagtggagcagtctagaaaggaccggtcaatcaatatagacttgtcacactgggttcaggagaaatcagacttgatcagggtggagtacatagtagaaaggaccagtcaatgtatatagtactaatcagaagatgatgctgtaacagtaatgtttcacaataaacaaaacaattattggtgcagaacatgttgctgtcgtagaagcataacaatacgagataacactacaactttttttttccggaataagacactactacctttttttttcgaataagacactgctacctgtataattgggtctgtttggcattgcagatagtagaatttatgggttaaaatcattttcgaattttcatatatccagctagagttgaagctgtgttcaaacagagccatcatttttgaatttaaaagtttttacagggaaatggtatttgattttagagaggtcatattcgaaagtttgtgctatgatagtgcagaaagtctttttccctcaaattttgtggatccaaattctttgcattcatgccatggacccatgcaagtgtcatgcatattctgatataatagcagtaatactggagttgcaaaggaacagagtacccattgctagcgaatggattaatatagtgagcataaagcaaaggagaagtctggtaacacgtaaccataaagcagtgataatcaagacaccatcatatcagaaggctaaagtaacaacacctaaccataaacatactctaagataagataactaatgtctactcagttggcaaatggcaatggcatagattttgtggccggcttcgcttggaaggaggtcgtcagacgcccccaagtccgagcatgccgtcgtcatcgtcgtcgacgaagtggtcggggcgccatttgcgggggctggcctcctccgcccgaatcttggactcctcctcctgtttcccctcatctgcaatgagcctcatcctgaaaacatccagaagatgcttctcgtgtttacccacgacgaggcgggtaccctgggaagcatacatcgcgactgtgaccaaatcctgcatgcacgcgacaaatcgaacaggtcggtcaggtataccaagggtgtgtttagctccgcatcaaaattaaaagattgattgaagttaaaacgatatgatgaaaaaattaaaaatttatatgtaataaaaatttgatgtgacattttttttttcgaaactaaactcggcccaagccaacacaaggaggtctagggtcggagaaaagtcatcgggttctgttctgttctgaccttggcccacgcctccttggggagcttgtcggccttgatgccgaaaatgttgaggtagtatggcagcgcgtagccatcggggccgcaagcgaaactgatgcagctgtgcaggaaactgaggagcccgtccgggaatccccttgtgactgggtcgccgtggtagcactgccaaaggtaccaatggtacctcagcagcgtgcacgtcgccgccaggggctccatcggcacctcatcggaatcagcaagctccttgaggttcttgaacgtgccgattatttcctgcacgtcctggcttgcggcgctcccggccgatggcggcggagtctgctccaggaggtccagcgcctctgcagctgaccatgcgatggccttgtacggcgtcacctgacagcaaccacatatccaacaaaacagataaagattcagatatatatatatatcttcttcttttcatctcaaaaaacaaacttcagttgaggcacgcatgtatgtatatggaattgttttacgaaactaagttccagcccatatagcccaaacatcatcagccccaaacccctcccagcccaaagaatttgccccataaccaatttcctctcagcccaaactgcatgctcgtacttcaattaaattgcatcagcctggcctggcccagaacaactcattggcccggcacgctcccctaggaacccatctcacaactgtatccacgcccacagtatgcccagggaccaacgggctgatcagttcggcccattctcgaaccctttccgatcaggccatcctctcgtcaaacagattccatcccccaaatccccaacgtctgtcctcctagcccaacaacgatcatcaacacggctaacttatacttactaataacaacaagtactttaagcataactttttgttttttatatttgcacaaaaaatttttttgaataagacgagtggtcaaacatttacaagaaaatatgaacatcccttgtattagtggacagacatagtaaatatttttccttcgagaaaacaaatggcccaacaaccaccaaagatctaccgtttcttcctccgtagttgctactgcgtacgctttgtttattgatcagaagagaaccttttttgcgaacaagcctgcacgatttttttaaaaaaaagaaaactttcttttcagaatgaagaacctacgtacgcgagaaacagatagaccatgtatcaacacaaccaacaagaacggtaaagaagagctagcgtgtgaactcctcgggagaaaaaagccgaaaagaaaagcacaacgtaaactccatagaagatacaaacaaacacagatctagaccgagagaaagaacgttgtaagagggccttactacctgcaggccaacgtcacacatgcatcaagtacaacatatatgttctcccaagcaacaagctcgcgcgatctcatgtttttaccgcaagagcagattttctcacggcatcccagacccataatcctagatctaccgtttgttacagcacgcaagcatcaacaagaaaacgaccagtttttttttccctccacgtacagatcaatacgcgcgaccgaaaagaacatttttcttcttctttttttttttgaaacacatcgaatcaaatgcgaggaaggcagaagtcagtcgagacgcacaccgcaaacatcgatccggttccgtacgtactacacatgcatgcagatgcaggtagttggaaagaagagtgcgtgcgttttctcaccttggtggagtcgtcgtcccaggccagccatggacctgggttagcagccgcctgtgccaccgtcagcctgaggggacggccggcgccggcgaagcgcgcgaccggcggcggcaggagacggccacggccagcaccaccaccatggccggcgcctccaggcaggcacaggacggggcacccgaggatgaacaacgacgacatctcgatctctcgttctcgctgatgaggagatatggccgggggtggaggtgaagtgcactactgcagtgcagccttgcgatatttataatcaggagccaatgctagggttttttggcaactatgggttatgcattttgcgagagtgttagaaaaagcagtcaaactttagagagatcacctttggctttggagtttggaccaacgtaccgtgaaatgcatacggtgtatgtatgtaaattggagatcgatgtagacggtgtatatatgcatcaacaagaaaacgactttgttagtatactactactattccatattaccatttcattaactgcatgtatatgcatgtgtatttcgacatgcagtctgtctttgtccccccgcgcgcgtacagggaaaaagggaagaccagagctgcaggcgtagacgccgtcgtcgtggtggtagcagtagcagtacgcgctgcatgcatccacggcgccgcgagcgcgtggatctgtagttcatgaaccgcgggtagagtagacgcacagaccgtgctagcctgctaggtgtatggatctttcaagctccggtgtatgtatctttccggtagcacaggtgcacccatccacacgttctgccatgcatgaagccaaccaaccaagcacacaaattccgtgggtccccctctctccctcccctggacaattccgtggatgtttgcgtgcgaccgaacagcagcctagaagaagcagagatcgcaaacagatcgataattacatgcatttctcggctacatgcatttcctcgcttaattactgcaacgctgcaataagtgagcgtatatatgtattttttaagttcaatttagtgatgaaataagtgagcgtacgtgtatataactaacctagcctccaccggcaaaaaaaaaaaaaaaaaccgggtcacatcatatacagacacacatttgaagtaataacaaaacaaattacataatcagcatagaaaccgtgagacgaatttattaagcctaattaatccatcatcaacaaatgtttactgtagcaccacattgtcaaatcatggcacaattaggtctaaaagattcgtctcgcaatttacacgcaaactatgtaattgttttttttcaatatttaatatttcgtacatgtgttcaaacgttcgatgtgatggagaaaaaatttgccggcggaactatttattgctccttccgtcctaaaatataagtatttctagtacagtgacaagttaaacatttttagctttaactattagtagcaaaagaaaaaaaatcaatcatatgtataaaattgatgttactagatttatcattaaacaaattatcataatatgcaattctttatatttaaaacattttatttttattgatattgttggtcaaagtagaatctcggagactgtgtcagaatttaaaaatgcttatattttaagacggagggagtagtacatatctacatccgatcgatatttgttgtttggcaagatacaaattgccttgttaagttcgcgaaaagaaaatttttgggtgtcacatcggatgtttgatcggatatcggaagtggttttcagacacgaatgaaaaaactaatttcataactcgcctggaaaccgcgagacgaatctttcaagcctaattaatccttcattagcacatgtgggttactgtagcactaatcatggactaattaggctcaaaagattcgtctcgcgatttccccctaactgtgcaattattttttttatctatatttaatgttccatgtatgtgtcaaagattcgatgcgacgtttttaggaaaaaaaatttggcaaactaaacaaggcctaactataaaatccatttagttcagcaataaataaattaataaagctacattaatttctttttcacaggagtataacaccagtagcacgaaaagcatgtagccatcatgacccatctactcctgctgcttaatt

SEQ ID NO: 65550 - DNA, 49735 bp, Oryza sativa
ctgttaattaagttcatgagctcgagctctagtcattggtccttgctgtgcaataggcgtggatgtatcgttggaaaggatgtcctcatcatcctccccttcttgcatttgagtcgtcctcgactctaactcatcttcttctcccaaatatggctttaaatctgcaatgttaaacgtggggctaaccccaaaatcggcaggtagctcaagcttgtatgcattgtcattaatcttttgtagcactttgaaaggaccatcagctctaggtagcaacttagattttctcaaattagggaacctatcctttctcaaatgcaaccaaaccaaatcaccaggttcaaaagcaacatgtttctttcctttgctcccagcaagtttatatttaatattcatgcgctctatgttctccttagtggtctcatgcagttttaacatcaattcagcgcgatattttgcatcaaagttcactctctctgaagttgggtggggcaaaagatcaattggagcacggggtagaaggccataaacaatctcaaaagggcacttcttagtagtagaatgttgtgaacgattataagcaaactcaacatgaggcaaacattcttcccacattttaatattctttttcaaaacagccctaagcattgtagataatgttctattcaccacctcagtttgtccatcagtttgggggtgacatgtagtagaaaataaaaatttagtccccaacttagcccacaaggttctccaaaaatgactaaggaattttgtatcgcgatcagaaactatggtgtttggcactccatgcaagcgaacaatctcacgaaagaacaaatcagcaacatgtgtagcatcatcactcttatgacaaggtatgaaatgcgccatcttagaaaatctatctacaacaacaaagatactgtccctccccttctttgttctaggcagccctaaaacaaagtccatagaaatatcctcccaaggcacactaggaacaggcaaaggcatatacaaaccatgagggttaaggcgtgacttagctttttggcatgttgtgcagcgagcaacgaacctctccacgtctctcctcatcttaggccaaaagaaatgatcagcaaggatatcctccgtcttcttcacaccaaagtgtcccatcagccctccaccatgcgcttcctgcaataatagcatacgcacggagctagctggaatgcataacttattagctctaaacacaaacccattggtgagaacgaatttgttccaagtccttccctccttgcaattcaacaacacatttttaaaatcatcatcgtgcgcatattgctcttttattgtttctaagccaaaaattttgaagtcaagttgggatagcattgcgtaacgtctagacaaagcatcagcaatgacattttcttttcccttcttatgtttgatgacatatggaaaagattcaataaattcaacccatttagcatgcctacggttaagttttgcttgacttcgaatgtgtttcaaagattcatgatcagagtgtataacaaattctttgggccataaataatgctgccatgtttccaatgttcgcactagagcaaacaattccttatcataagtagaataattcaaactaggcccactcaatttctcgctgaaatatgctacaggtttgccttcttgtaacaacacaccacccaatccaatcccactagcatcacattcatgctcaaaagttttgttgaaatcaggaagttggagtaaaggagcgtgtgttaacttatctttcaaagtgtcgaatgcattcctttgtgctgcagcccaagtgaatgtgacatttctcttggtaagctcatgtaatggggctgcaatggtgctaaaatccttcacaaagcggcggtagaacccagcaagtcctagaaagcttctcacttgtgtgatcgttgttggaaccggccagttatgtatggcttcaaccttggcttgatctacttcaattccctgcggagtcacaacatagctaagaaaagagactcgatctgtgcaaaatgtgcacttctcaaggttaccaaataaacgtgcatctcgtagagcatcaaaaacagcacgcaaatgaccatgatgatcctctattgatctgctatatatgagaatgtcatcaaaatataccaccacaaatctgccaatgaaagcacgtaaaacttcattcattaatctcatgaaagtactgggtgcattagtgagaccaaagggcatgactaaccactcatataggccgaatttagttttaaaagctgttttccattcatctcctaacttcatgcgaatctggtggtaaccactacgcaaatcaattttagagaacacaagtgaaccactcaattcatcaagcatatcatctagcctagggataggatgacgatatctgattgtgatgttgttaattgctctacaatccacacacatgcgccatgagccatctttcttaggaactaaaagcacggggacagaacaaggactaagagactcacgtacataccccttgtcgagtaactcttgcacttgacgctgaatctcctttgtttcctccgggttggtcctgtatggcgcacggtttggcagagaggccccaggaatgaggtcaatttggtgctcaatccctcgaattggtggcagccccggtggaacctcctttgggaaaatatcagcatactcctgcaaaaggttagtgaccggaggaggcaaagaaataggagtatcctcaattggaaataaggtttctttgcaaaccaaagcatagcaaacaacagtgtcagtgtcaacttcatccaaatctgattttgttgcaatgaaacaagatcccttcagcttaatctcatttttattattttgaacagagttggtgggtttcttcttatgcttctcaagttcattagccgcaataagatgctcactcctagtatgctcctgatttttttgtttgctagctctagcaagttcatcctttaaaataacttcaggagacataggatgtaacacaagtttttttccattatgcacaaaggagtattgattggatttgccaaagtgtaaagaatctttatcaaactgccatggcctacctaataacatagaacatgcttgcataggcacaacatcacagttgattgaatcatgataagaaccaatggcaaaatgtactcttaccaatcgtgttacctttaccttgccgctgctattaagccattgaatatagtagggctgtggatgtggctgtgtgctcaatgcaagtttctccaccatttcagcactagccaaattattgcagcttcctccatctatgatcacgcggcaagagcgttccttgatcacacacttggtttgaaacaaggtgtggcgctgattctgttcagccctttccatttgtgcgcttagcactcgctgcaccacgaggctctcatagtgctctgcagcttcagccccaatgtgttcctcatcttggtggggcgcgtcaccttcccgtgcattgttagttgcaagcaaagcataggtttctccatctaaatcactagcggaggagtacccaccatcagctctcacgatcattacacgagtgcttgggcagtccttgcgcacgtgaccatagcccttgcagcgtaagcactgaatatctcttgtccttcctgatgaagctactgatgatgaggtcttggaaggtgtagcagcaacccctcttgttggttcactcgggcatggtgtagagtttgttgtagagggacgcagcttgttgcttgaggacgatggtgctgctgctcgagttgacggtgcagcagcgttagaagatgtccaagagctagcacgacctgcagaaatgttagtcctgaagctagctcttcgtccctgtacttccctttcagctttacaagcaagatgaaacaaatgattaattgaattatattctttgtaggttagaatgtcctgaatttctcggttcagcccacccatgaatctagccataccagcatcatcattttctaccaatccacaacgaagcattcctgtttgcaaagcttgataatactcctctacagatttgtttccctgtctaagttgttgcaatttgtgcagcaaatcacgtgcatgatatgaaggaacaaatctagctcgcatgactcttttcattgcatcccaggtttggggagtgttatttggattggaacgaacaaattcactccaccaaatggatgcaaaatcagtgaactcactagtagcagccctaacacatttattctcaggaaaatcatggcaagcaaatttctgatcaatggctaactcccaagtaagatatgcatcagggtcatattttccatcaaagcaaggaatggtaaacttgatcttgcctaaagaatcatcattatcacgtacctcccgccgtggtggagcgcccaagccatggcgctgccggcgctgttgtctttgtggacgaccaagtacctcctcatcatgctcagtgtcagcaacgtactccagttcttcccttgctgcgatgctgctattagcatcatggccattgtggttgcgcctagccgatccatcatgaccatcttggcccattctctccaacgtattcaagatacctgcaagagaagtgttcacagccacaagggacctctccaatgaggaaagcttggagttggtgtcaatttgagcagcctccaattgaccaaggcgatcattggcgaccctaacatcctcatcaaggccttcagcatgctccctcacttggcgctcaaaatgttgtatgatgcccctcgtacgtggtgaatgttgagggtgctcccccgatcctcctgtcatggttaatgggaagaaacaattcacaagaaatatgtcctatcaactattggagctaggtgttgtccatctccacttctaccaaacttgtgcaaacgagttcttacatgttcttactttgttatgtaaaaggcgttggcaaacagcaagaacagcaacaacggttagtagtactggagccgacaacaaacacgatcctgtgatatagtagataaaaatttgtggagctataggtggctgcaagtaatatcaaggtacagctagaaccacattaatcaaagcaagttgaataatcattcaacgatggtattgtgctggtcctaggcaaaaccctttagagacgcgagcctagtcacaagcgtagccactcaaaatagcacgaaaataacacaaacacaacagcaacaacaacaacttcctctcttcccttcctttttttttttccttctcttcacttctgattttttttctttctttttttttggttttctttctttttttttttgtacagcaagctcaaagcttcagccaacaagtcaaaacaagccttagcaaaataaccttttctcaaacattttcgaaatttcacaagcttcagccaacaaatcaaaacaagaagtaatgatgggttggttggctagttacatgattcagccaacaagtcaaaagtgagagcacttaaatgctttcttgggaagggctgattcacttcaaaaagttgcaaaagggttggctgttggtggaggcagcaataaatgcatttgggggtggctgatgtggtgatgagggtgctgctggttgtggtggacgaaatttggtggggttggaggtggatttcgtggtgaatatggtggtgatggtggcagcgggatgaagataaaagaagtgatggtggaagtgtttgcggtgacgaattcgtgggcagaactcgaaactctaaaggactaaactactagaaccagcaactcaaccaatcgatgcaatcgaaaactcagcaagcaaagactaagtagaacagcaaaggctcaacatgttttggtgatttcgggtctgacctattttagtggtttttcttttgggctgtaggtaaaaacaaagaagtgataaaatctctcaccgagcaacttgagctctgataccacttgatgcagcaacgggggttcccgatctttcgatgagaggaggataaacttcgatttggggaaggatacgacgttggcggtccgactacaactaccacaggggtgctgcgccttagcaaccggtacaccgactccacgttgttgctgttcttgccgtgccaagaacaaccttgaacctgcaagcaatcgaagaacaagcaagaacaagttgacaaggaaacagctcacggcacttgtcaaatgatgaaacttaaacaaaccaaaatggggttctgaatacaagtatccgggtggtctagccgacacacgcgagtacaaggaagtagctgcagctaaacttacatcaaaacaaaacccaaagtgcaaaatggtggctgctaggagtttatataggtggaggaatgaccaggagaggaggtgggagcaaaccctaggttttgtggacccctaatgggctgtaatgaaacaaggcccaagcccaagtttctgatgtaaagaactattttcgtcattctgagcagcctgggtcaaagttgatggtgaggccacacatagctgaaagtagacgacgagatctttccaacaagtactcatttgccccgtttgccctccggagtgaagagcattgacttcatcaaatcagcgctgctagtgctgcttgcgatttggttcctctcccatattcctaacaacaagtagatcacaacaaccatttagtagcacccaattctgagaagaacttgtatgattagctaggaatgactttacctgataattaagttcacgagctcgagctctagtcattggtccttgctgtgcaataggcgtggttgtatcgttggaagggatgtcctcatcacgttttttctttattttaaacatttcatttccaccatatatcacacacacacacacacactttacacgatcttgatcttgagtatatttagtcatctattttagtctatgtttttgacttagtaataaatgtgaatgcaagtatgccatgtttgatccctaccaaactacacatatcaaccttagagtaggaatcaaaaaggcaaaatggtgaggaattcattttgatacacttggagagaccgagtgaatcatttgaggaacttggatttcttttacaaaaatcatttgaaaacttccggaataaaagttgaatgaagattgggtgattagtactctaattgttgttctgtctttcaaccgcttaaggcaagaagagacaatgtctcgtgggaatcaggggtaagggtaagccaccgtgccaaagattatttgatttaagagagagtacatatgccttgaacctatacatttgagatatacagcatagtagcaactcatgatcaacagccaagtctttgtttcctttcatcctttactcgtgacgagcaaaggttcaagcttagggggttttgttgacggtcgttagcgatcagtttcgaccgtcaatactaccaaaataaaggagaactagttatgcttacaatgcatatttgtgttagaataataagtattccactagtactgggattgctaacctcttgcagagaatgaacataagagcatccctagcagctcatctatatttcatcccccaaatgcccatatggattatcatccaaaaagattcctcatccatatcccttccaactccaacacatcatctatactatatcatccatatcccatcatcctatattttagtaatatcttccaactaaccttacatttatattttaagggatatattttgaacaacttaattttaacgttgtatttatcaccataatattttgaaacgaataaactttaacagatatatttttattgggtgactgaagcatttaaaatgataacccaacaaattaacattactacattttctcccctcatttaatcgctagggaactgctagtactacttcctcactgcttgttctctaccatctccgattctccgctagtactacttctctttgcaggcagtggctgcgcagaggagttggcgagaggcggcggcggcggctgtgcagccaaggggcggtggcggacgagctggcgagaggcggcggcggccaggcaagtgaggggcggcggcggccgagcgggcgacgggcggtgaggatgcacgcggtggccgcggagcccggcggccaggcaggcgagggccgcggatggctggggaggaagtagccggcggtgggcaagcaagggacggaggaggccggcggcggccgccatatcgcgatggcggcaggtgaagcgagcgaaggagcagcggcgcggcgcggagtcctgatggggcggcgcagacggcggggcctccactccggcgaacaccaacggcagacccggtatgtccatcctctctatgtccatctggatggtggcgcgagttcgtcgagctgagcagttggggggatagcgtgaggagagagaaacgccaaatttggcatggagagcgctcggtttggatgacatctaaagatggcgtgtgtgatggagactctgttggatcttggtttttcacctccatacgctaaaattgagatggatgcccgatggaagatctgctgggcatgctctaaaatggagaattggcatcaaaacaggcgatcaatcaatcagacgatgtcgagaaccagacttatcaatgaatgggccaagaattcagaaatgacatgatcaattgggtcaaaattcacaagtctacatatgggagcaagagaggaggccgccagccaaaacctgggcttgttgggccagccaatggttcagtcgaactagggggctcggccgaacccttctcagcatcatccgatctagggctttgcctggacggtgtggattagcccccaatgatggttggagggtatttccgaccattccaacggtcacaactatcattgggaaggtataaaaggagctctcatcctccatttcaacacacacctcaagcaagctctctcatactctcttaagcttagtttagtattctcaagctagtggagtaggaatagaacagaagtctgagtccggaagtattcggaagagttcggatatggctctagcagctctcctttcttcttttgtaagacttgtactttatttacaatattcttctttatacaactttggtattgtaatattttccgagtatatgaataccaactttactttatatccgagttatgttgattttactgctagcttatctgggagatgccatggtacaggtataatgtttgcttatgcaattactctatgtcatgacgatgatattagagtactatctggtagtttacacgtggtgtctagattactgggtatcattatttggggttatatgctgtggaagagaggtgggccactgatggtgacagctcagtacgggtattcctccgcgtgtgtatatagtcctaagttaatttcctggggagggtactcctccgtatttagcccctgttatatggtcatgacaggttgtcgtaagaaactcgtcagtcatgggtggcttctcgaagcaccaggagggcatcggaaagaggatattagctagttaatcttatagttaggatgtatgtacaatatgtatattagaagtataggaatatattatttttctattttctttccactttgctcagataatttaatatgagaatgagtagtcttatgcttgtgtgtcactttatcctctgcttatattaacccctgcttagactatagttattacaagtaatatataaattattagtacggttctctctactataatcttcccacgggattaaacaaacgtgatacccttggaatactctcgggtgaaatgttacaatggtatatccgtgcacttgtggatgaaatctgtaaccataatataccaggagtatttctgcgccattgctggaaattatatttctagtaatgttgttaagaaataccaacatcgatccaaacaccaccttagtcatactctaatttgcattttattaatgtatgtactgcaatatcgttaagaaataccaacatcgatccaaacaccaccgtgtctcggctcagcgcctagctggctcggcacacatgccctcagccccccacaggctcggctgctcacgagggattgtttggcccagcgaaaacatgcgattgtacaggcaaaatggcaagcacgcgttaatatctaatagtgctacgtggtccaatcgaaacccggcaaaattgccggcttaagataagttgactggattttgttaatcctagtgtgaacacatgttaagctacctaggacttgtgtaaggctgtggtcggaatcacccgctcccacgatgcacagtgcgcacggaaaacagagcggttaattagcgcatgattaattatgtattagctaatttttttaaaaaaaatggatcaatatgatttttaagcaactttcgtatagaaactttttgcaaaaaatacactgtttagcagtttgaaaagcatgcacgcgaaatacgatggaggggggttggaacccagggttccaaacagatacggccttggatatgtatgcgatgttgcttgtactctactttgtcattacctcgcaagtcattgtcactttcattttcaacactcacatgaccgatctgtgattcggtcttaggtgacaaagatagctcattttcatttgtaatacaatccgaaccgtcattcagtttggctatattttcaacgatgctattgtctaagctagcaacacaatccgaacgatcacttggtttggctattccatcattatttaaactagtaacacaatccaaaccgtcgcttggttcggctatattgattgttgcattattatccaagttagtaaaacaatctgagccaacctttggttcggctatacttgttatggtcttgttgcataaattattagcacaatccgaaccgtcgcttgattcggctatacatgttactgcattatcattgtgaataacatgtgtatgtggaataacatgactaatagtactaacatgaggcaaataacaattaaaatcagtgctattagttgtgggacaaaattctggaagaggttccaaggcgtagatctgatcggctatggatagcccggtctgaccggccaagcacccgatctgaccagtagtcaatgatgcggtcagaccgaccacaggaggcacaatctggccgagatagggcacggtttgaccggctatggtgggtgcggtctgatcggcgtcatgcgcggtttgaccgtcggctacgctttttatataaccgattcccgaggaatcggctgtgtaaatgccagtcgatccatccataatactatagatatgttgtatagatgcaaaactagaagtagcattagatttttgataactggctatctgagagccaattttcttaatagactcattaaagaaagttttacaagcatcttctaacatatcataattttttcaatataagtgctaacagatgcatctatataacgataaatatgttttcgaatggcaagagatggatcgggcgaattggagattaccttaaatttgagaggaggaccagacttgagaaccacaccttgatgggtcctgatgcatgatttcatcaacctctcttgtgtaatcaccttgatccactccttcatgacttgacgttgctcctcatcaagatcctccctgatgaggacatcctccactattacccgctggcaaagacgacaaagtcgggcggcgactgtgtgagactctgaataatcccaccttaaaagggagagccgcccttcccctattggactagtcttttagggagatcgggccttttcccgagtgggtgtgcctaagaactattggggtccggacaaccttaatttgttgggcctcggccgaccccacctgggccggattgttatcactcccatgtgaccttgtcgatctcgttcccgctcatcatagttgatgaagaaatttctcgattaatttcggccatatagctcataaccaaaatattttgaccgaatagattaatatactgtctttgatttccttcgtatactttgatgtgtaacaaatttgaccaaaattgatttcctcgagggtcaaccgatcaaataatatatgcacagtactagatcggctagaattgattttcaggttttctgattgtgcgcagcaacagacgtaattttgtgtagctctagcgaaatttggaactttttacagccgatgtgagtcggctctgattttcttttctcggtaacaaaccaattcagttttgcctaatctgggtagatcagctctggtagcctgatcttttttaaagaaaatttttggaatacgtatgcacagtatattgaattggattgagtttcaaactttctctgtgcacagcaaggactagcacgatcgatcagatcggtcggctgttgcttgtttcctgtgcctgtggccgtgtgtattgctgtattgccgccgaaacagatgtgttcggcgaggatgacacgatggtagccggtaaaaacaaaataaaatagtagattgatttcggccgcacggccgaaacagtcgtctcgacaaaacaacggataaattgcaaattcggctattttaaagccgaatagatttcttccccgacggagtcgtcaaaaaacgtgttggtgattttttgtgacaagtcaacaagcacgatcgcagcacctaaacgccttgcggtgaaaacggctaaaccagctagtggagccgatttaaagatcaaaatcagcctttaggccgatttagatcgatacgaggataactactcgtcttgtgggtagaacgaaaggttttcaagacaaacctacaaagaggtgtcgcactctcgcagtggcggcggacgatttacggcgcaaatcgacaaagatagactaaaactagggtagagtagaaaacatggctaaaattaaaaagaaaaaacgatttaagtagattatgtgtttggggggattataattgaaccagtcttatctcttaaataggggttggtcttgacctctataggccctcatccaagtccaactcgggatacaaactaaagaaaacccgaagcatgccttttcaagcaaggaaacccgagacccgacgaaaacagactcgggctcggaccctgacggtctgaccagccacatacctacggtcagaccagagttcaggccgcggtcagactgcccacacacatacatgcggtctgaccagccctgtgaaggaaacccgtcactttccaaactttgacaactttcccctatttcgttcataggtgccaattttgggtgtaaacacacctgcggtctgacttttcaaacttcggcaattttcccctatttcgtccataggtgccaaatttgtgaaggaaacccgtcacttttcaaacttcggcaattttcccctatttcgtccataggtgtcaaatttgggtgtaaacacacgggtctagtttccctgatctttcggtgagttgatgataactacgatttgctcatccggtgagttgatggtaactacgatttgggacaaacgttgatgatccgactacaaccagtaacagccctccctccagaaccacatagctagcccatccgacgggcgggcccacttacactttcgtcctcgcttcataaaagggttaacccgggagtgacatggttgcagagaagaggccttataagttggttccaaccttgctagactagcaaggtggtactaaacatgcacacagctctcatgggacacaggtcaaatcctaattgggccaggatgtcacatacaccctcccttaaaggacccaacgtccccgttggcctaacttagccatgtagccacataggcatataaggcaaatgtccaagaacacagcccctcctacgtgcgtgcagtgccggcaccatatgccatgccatgtgcctcacacagagcccacatgcactatatgctcgcacactgatccatagcccatccgacgggtggacccacttacacataccactccatttacacattcgccatcgcttcgtgtaaaagggttaacccgagagtggcatggttggagggaagagtccttataagttggtttcaatcttgctacactagcaaggtggtactaaacatgcacacagctctcatgggccacacaggccaaatcctaattggaccaggatgtcacacaaccgtacaagacgttgttgtgttgcgccttatcgattgatacacctctccatgtctttgtttatcttactgatggagatcaaccttattcctacaagcaaaacgaaggacacaagcaagaacaagatgaatgcaatccgaattgcaaagaatacacacgatgaattggggttctggagacaagtacttaggtagtctatgcgacacacgtaactacaaggtaaagttgcaatggctatactttaatgtaaacaaaacccgagaaaccctaaaggggtacctagctatttaaggaggtgtgaggatgaccaaagagactgttggtatttcttaacgacattactagaaatataattcccagcaatggcgcaaaaatacttctagtatattacggttacagagttcatccataggctcacagatataccattgtagcatttcacccgagagtattccaagggtatcgtatttattttatcccgtgggaagatcatgtagagagaactggactcataatttatatatcacttgtgataatcatattctaagcaggagttaagataatccaagggtagagtgaaacacaagcattaactactcattctcataatatatcatctaagctaagtgggaagaaaagagaaagaaaatctattcctatacttctaatatacatagtatacatacattctagttaactgatatactagctaataccctctattcgatgccctcctggtacatcgagaagctacccttgactgccgagttccttacgacagcccgtcatgaccatacaaccggggctaaatacggaggaataccctccccagggaattaacttaggattatatacaggcgcagaggaatacccgtactgagctgtcaccatcagcagcccacctctcatctacaatatataaccccaaataatgatatcccgtaatctagacatcacgtctaaactaccagatactactctaatatcatcgtcatgacataaagtaattacataagcaaacactatacccgcaccaaagcatcttccagataagctagccgtatattcagtataacatgtaaagtaggtactcatatactcggaaagtatttcaataccataaatgtatttagaagagtattctagtaaaagtacaaagcttataaaagagaaaagaaaagctactagagccatatctgaactcttccgaaggcttccgggcacctgatttctactctattcctattccaccagctagatactactaaactaaacttgagagaaatgagagagctattgcttgagttgtgtgagtgaagtgagaaggtgagctccttaaataggcaggtaatgacggttatggcggttggaaaggtcggtaataccctccaaccgtcatagggaaggaatccacaccgtccatccaaaccctgcatccagcggcttcacggcaggttcggccgaacccaatggttcggccgaaccatgggctggcccaacccagcccatcttcggcttgcggcctcctttgtttttctccttcgtagacttgtgaattttggcccaggttgtcatgttaattctgagttcttggcccattcatacataagtctggttctcgacatcgtccgattgatttatcgtctaagttgatgtcgattctcctccactttattgttattctctgcaaaagtttagtagacctaatactagtggaatattattattctaacatatttatgcattgaaagcatcactagttctcctctattttggtaatattgacggtcgaaacctatcaataacgaccgtcaacaaaaccccccaagcttgaacctttgcttgtcccgagtgaaggatgaatggaaacaaagtcttggttgttgatcaggagttgctactatgctgcatatctcaaagatacaggtgcaaggtatgtgtactctctctcaaattaaataatctttggcacggtggcatacccttacccttgattcccatgagacactgcttttccttgccttgagcgattgaaagataatagtaattagagcaccaatcacccaatctttattcaactcttattccggaagttttcaaatgattttgcaaaagaaagccaagttcctcaaataattcactcagtctctccaagtgtatcaaaatgaattcctcaccaattgttgccttttttattcctactctaaggttttaatatgtagagctaggtagggatcaaacaaggcatagttgcattcacatttattactaagtcaaaaacatagactaaagcagataactaaacatactcaagatcaagatagtgcaaaaatgtgtgtggtatatggtggaaatgatatatgaaggaaaataaagaaaaagcttctcctttgtgcttaccttcttctcccaaaaatccttcttttattgattaggagagggcatgattacattttttttttcaacatcatgctcatgcttgatggagcataacatttttttttcataatcatgcatttccctcctttttttttcaaaaggatttttttaggaggagaaagcacatgaaagcatggagaatttattttggtggtaatatggaaatgtaatggaatattgcttagctcccagtgtaggagtttggcatgtgcatatatgtggatgtatgattttgatcatagagcatgagaagtatctatacaagtcacaagagtttgatagagttcaatggaatgacaagtaaccaaaatgtatatgatttaatcatgatagcacatttttggctctgttaggaatttatatcaaatgaggaactttcaattttatcattttgaaaaacaaaacatccggaattcaagtcaaactagtatcataatcatagcaactcatatttactatctcatatctcgcaacaacctagacttagatcagcaagtgcagctcatttacctcaggttcccggataattgttggctacttttatttgacctttgagagagcacttaccaagaacccatatataagagatataaaacagagcaactattcatcatttctacaaagaaaactagcttgtcttacctagcatgactcaaacctatcctatctttttgtatttttttattttgcaaatttttatgttgttttcaagttttataagatgcaattggaaagcaaatatgtaattggaaagggaaaatatgcaatgtgatacaagttacctcagtggggggaagagatgaccccccccaagcttggctttcactcaaggtccttgataaggattgaacccctgaaagcggaactacgcttgaaggtcatcgtgctattgctgcatcatgttgttgaagttggcgaactgcgcatcagcagattgttgccatccttgcgtttgtgctagtgcaagggtgtccattctccaagtgatttcacccaagtccgaacgagaggaacttgagcgccattcacttggagatggaggcacaccacttgatctggaaggttgattgtccccccactagatgtcatgaggcgcatgccaccggtcctcactggcacttgcccaggttgagactccgatactgtgacgtcgagcttgggtccatccgggtgcatccccagttggctcccaacctgcctcatacatctgcacggtgttgaggatgatgaacattctagttcatttcttgtcatgttgcgcgtctccctgtatgctccacctacacgagattcttctatggtctgcaggggaatggttagttcacggcagttgtacaaatgatacaccacatttggcaacgggatttcatttgtacacccgaggaaaaagtaaatcaaagatccatctactccatgtttcagaatatgcccttgcactggataagcctcattaatacacggacgagcggctgagataaaagcaatttggtcgctaacgacccctagcccttttgctatccgagtattcagagaagtgcactcaacaggagcagagaactttatactttctaaccattgccttatcatacatttcacaggagcaattttgatctttctaaccatggcaaacatgataatcaattcatctcccataatgggcctcatatcacctctaggaaactgagtcatagcaatccatttgtgcatgagcctaagtgtaggattatggatatcattcattctaggtttcttgcaaattggagcaccggaaatatcttcccgaaacctatttttctcgaacccagaaattcctttctggagatcgattttacaggaatcgtgaaaaccaagaagtgtacttaagcctttccatgtaagtgtaaactcttcacggaaaaaatgaaaggaaattccatcttctatttctttcaaagtgcaaagaatttgcaaagtaagcagacaagaaccaggctcatctaccacatcaaatctctgccaaccaacagcttccaaatagtacgaaattcagcatccatacctatctttttttagcagctccggtgagtattctcgcgtgtgagcatacttccggtcgctcagcatgtagtaggcttgtctctcccgatcactgacaaggtcgaggtcggtgtcgttcaggagtcatcgcggagcttcggcgtcttccatcgagacatctgttgatgaatgagtactagactcgtcatggcgacttgatgaagagccagaccccttgaacagacgtgacagtcgcctcctcattctgcacaatggagcaagaacggactaactcggcgggggttaggactgacaagaatttcacccgccggttagtttcaccaaagcaacttgtatatatgcaactaagtgtttgaatttgagggaaactatcaaagcttgaatgaacttgagagcaaactttggagagggaatgaaaatgtgttgaaatggggtggaattccctctctcggctggttggcttaagtagtgcacccagaatggtcaaaaccgacctatggggcccactagccgttgccttaaagaaggaggcagccgaccgttggcctagctggttcggccaaacccacggtgggcccaaccggacccactttcagccaatgggttccaacggtcagtgtggtcatggcacagtgaattttcactgaaaattttattttggtttgctctgaaaaattcatttgaacaatttcctcaaaattcaaaaatcctaaatgcaactttgaaattcaaacatgtgatgatgcaaaaattcaaattgttgaaaacaaatatgcggatacataccaatttacctgttggcgaaggtcgcatcatttaaagtccgacgtgcaagactgtacctccatctagttcagtttgcggattttctatcgtctccggaggtgatggagcgggcgtctttggcttctccctccacaccttctttggttttggtgcggacggcggcttcttctgagccagctgctctagcttcttggcccgtatgggtggttttaccagcgttcctgggcatcgttgtttccttctccaggaaattctgcatgaatttcagcaggctgtccgttttgggtggctctacttcgacctcttgaatattctgtgggttcggcccgtactttattctgaccatggagcattgttccgtcctcggttgaaactcaaacttctcttccttgctgttgatgtggaaacggatactccccattcccacgtcaatgttggctcctacggtgctaaggaaagggcgcccaggatgagcggtgtctcttttcccgtgtccgtgtccagcactacgaagccaaccgggatgaagaaatcccgtatcttgactggcacatcctccgctatccctacagggtaacggactgacgaattagccagttgaaggtgcattggtgttggtgcccataccgtgaagttgagcttgtcgaagacatcttttggcatgacactgacattggctccaaggtcgcacaaggcctggtcgaactgttgtgccccgatcgagcaggtgatcgtaggacaccccggatcttccttcttcttcgggagcttgtggagtattatgttgctgcattgttccgtcagcttgaccacctccgttgggagcggtctcttgttgttgagtttgtccttgagataacgggcgtatgttggcatttgtatggtgtccaacaacggcacgttgatgtggatcttctggattacttcaacaaaacgagcgaattactcgtccacagacggtttcctactccgttcagagaacggcagcaaccgtgtgtcccagtactcttgcggcactgtcttttctggcggaacttacttatcagccgagtcattagatggcacttctttttctttttctttttcccccttttcttttcgaatgggccgctagcccattctactccccatccccctccccgctgggctggccgaaggccaaggcctagcagccggccgcatcctccctcctcccttcgggtcgccgataggtggggcccacctgtcgggcccgtctcccacctccagccggcgccgccgcatcccgcaaccgccgccccgctcactccgcgtctcccgggccacgtcgcccacctcgccgcccgcgcccgccttccccgcgcccactccctctctcacccgcccgtgcccacgctcgagacggccgggattcaattttagaattccgcctctctctcctcccaacctctccccactccgccggcgaaatcgcggtctctccggccacgatcgaccctcgtgagtctatataaagcacccccgttccctcctctctctttttcgttttgcaatcgcctgctcccgtgcactccaccgccctagcgtcgtcgccctcgtttccgccgccgacgccaccgctccggccgccgctagccatcgctagcggctgcgccgagccacgccgtcgacgccgtcgcattcatcgtcgtgcgggccaccccgtccacccctctcccgtcggattccgccgccggaacccactccgcaccgtgcgccggtgagccccgccatggccgccgccttcggccggcgtcctcaccctcttccatcttcctctctctctctctctctctctctctgtctatcccctttcatcgtgttcgttaagtggttccggagctcgtcccgttgccgtcatcgcagggactaaggatgccaactgagctagctgggtttctatcattttattaaagctcagctgattttgaaaagcagaagcaaagccatctaacttgacatttatgttttctaggaccttgtcattggccgcaagctttttgcttaacgcatcggtggttttagcttgcgcaaaaacaagatccttcaaggagggctggttagaaaaattatcgttgttgttacctccttgataatatgggcatggttggttccacccctgacctccttgtggatgatacccgttgttgttgttgcccatgtacatcgcctcctcatgggttcccgggcagtcattcccagaatgacctgtgttgccgcagacctcacatgtggcgtgagagtccaaggctttgacggtgccttgtggccatttctcgtggtcgtccaatcgcttcatgaggaggtccagcttagcagcaagtaactccgtctccttgacggtgtgcatgcctcgctgactggtctagagtcgttcctcgctccaacccatattggagaccatcttctctattagatcaacggctccttgaaccgttttagagaagaacgctcctccagctgccgcgtccaggtgatcgtgggacatcggggtgagtccattataaaagttttgcaggatcaaccagtcgtccatctcaagatgaggacaggcagctacgtactcttgcagtcgttcccatgcttccggaatagactcatcccttgtctgctggaaacttgaaatccttccacgaagggcattggttttgcccatcgggaagaatttcgagaggaatgtcgtagagcatttgtcccaggtattgacagcagcaaggttggcatagaaccactgcttcgctctcccgagaaggagaacggaaacagtcgcagcctgacggcgtcgggactgacacccttgatggtgtacgtgctacagatctctaggaactgttgcagatgagcattggcatcctcatcaggcttgccacagaacgggctagcctgcgccatcgtgatgaggctggacttcaagtcgaaatccacgtcccctatgttgacctacggcccaatggccacattgtcagcagagggagcagcgaactcgcggaaagtcttgttagctatagtcttgaaggtcggtggtgctggtacggctggtttctctgtcggtagagttttctgcagggctgcgactcgcggcctaacgctccggaagaaagcttctggattttctttgaagttttctggcagtttgaaaccagtcatgcactaccctgttttcacaacaaaagtgaaaacaaccaaggttagcctgcaaaggaaaatgattatacagaggcaaatataaattattagttaaaatagtctctattatgaatcttccctggcaacggcgctagaaatgcttgttactatttcttaacgacgttactagaaatataattcccagcaatggcgcagaaatacttctggtatattatggttacaaagttcatccgcaagcgcacggatataccattgtagcatttcacccgagagttttctaagggtatcgtatttattttatcccgtgggaagatcatgtagagagaacttgactaataatttatatattacttgtgataatcatattctaagtagggattaagataatccaagggtagagtgacacacaagcattaacttctcattctcataatataatatctaagctaagtgggaagaaaagagaaagaaaatctattcctatacttctaatatacatagtatacatacattctagttaaccgatatactatctaataccctctatctgatgccctcctagtactttgtcacaccctgaagttcttttccccaagcctaaattgaatttgtaattgatctcgagaaaataccggtgtaaaagaaagagtgaaaccataataaattaatgcaaataataatcggaattggcatatggaatttttcttgagttctacatgtcgaaatgtgctaataagatttttagtggaattttcagagctctagaaataattttaaccaattaaaattgagcacaagcaatgtttaatccctggaaattcatttctttctttttctttttcttttttcccccttttcttttcgaatgggccgccggcccattctccttcccctccccctccccgctgggccggccgaaggccaaggcccagcagccggccgcctcctccctcctcccttcaggtcgccgacaggtgggacccacctgtcgggcctgtctcccacctccagccggcaccgccgcatcccgcaaccgccgccccgttcgctcccgcgtctcccgggccacatcgcccacgtcgccgcccgcgcccgccttccctgcgcccactccatctctctcccgcccgcgcccgcgctcgagacggcctggattcaatttttgaatcccgcctctctctcctccccacctctccccactccgccggcgaaatcgcggtcaccccggccacgatcgaccctcgtgagtctatataaagcacccccgttccctcctctctctttttcgttttgcaatcgcccgctctcgtgcactccaccgccctagcgccgtcgcaatcgtttccgccgccgccgccaccactctggccgccgctagccgtcgctagccgctgcgccgagccacgccgtcgacgccatcgcattcgccatcgtgcgggccaccccgtccacccctctcccatcggattccgccaccggaacccactccgcactgtgcgccggtgagccctgccatggccgccgccttcggccggcgtcctcgccctcttccatttccctctctctctctctctctctctaacccctttcatcgtgttcgctaggtggttccggagctcgtctcgttgccgtcatcgccctccgtcgctcgccatcgtcaatcgccgtggtgagacacctcctccagccgcttagccgccgctaccgccgtccgtgtcaccgcgacgccgctgccctccgccgccggccggtcgccgccgctgcgtcgagccgcaccgccgcgtgccatgggcgtcgggccagcttgagccgtgcccgcgagccgcctcccccgtccgatcgaccgggcggtagatcggggcccatccaatcccggcaccggcgtggctgacaccgtggccgccacgtgtgcgccacgtcggcgccacgtgtgcaccacgtggtgcgccacccctttcccggtccgtggacccagtccaccgtggaccaccacccgagtcactgccatgtggggcccgcatatcggcgccgccccctctctctccccgggaatttaattattgcgcaataaatcaattaaggatttttctgtttatagtgaaaacacagtgaatcttctaaaattcatatctaattcatccgagctccgtttaagcccatttaagtctcagtaaatcaagaaaaatgcatagaatccattaaaaatggttttgttctctgtttcagtagtcttatagcctgtttgtattgtttgctttgtatgtcgcatagattctggctctcccgacactccggtgtactttgaaatagtcaccgaggttcctccagcagcagagcaaggcaagtcatgcttgtcacttgaacatgttgatcctatattgcaaatgctctatcgttttcctttaaatactgcattgttttataatattactatgggatttttacctactgttacagccatgctatttttgtaccatgctcctttgttagattgggatataacatgactagatattggactagggattgcttagccatgcttagttcaactagcacacaatgggggaattacattaatgcatagatatcagattcttgaaatgatgttggttaatgccaccgctccggtgttggttaattaaaatatattaaatggtgggtgcatggttttgatggtcgcgcccatggcatttaaggaccggttcggggatgccctagaagaacttatcatacttacaacaagcaaacgtgggcaacggctgggcttgtagtgtagctttcctctggttgatgcatccaggcaagggttggcgtgatggagcggggcgggccctgcgacggcctatgtcgcttccggattcacctaggcacaagaggggactgcccgttgcccgctggggactggggtgacacatgaggtgtggtgtgcttggctagagggggttatgcgaagggtcctgtcacggcctctatccggtatgtcatggtggcatgtcggtgcacggaaacgtgtcggggggctgtgtcttgtgggtacagttgtacacctctgatcagagtaaaactattcaatagccgtgcccgcggttacgggcggtcaaccagattcaccgtgatttgactcaccctagcttagtataatggaattgattagttctggtggatggttgggcctgttgcaacgtggggtagcgttgaacagtggatggttaatattgatgaattattaaaactgttttactgctttcaactaccgtctttaaatgctcgctttatgttctttgccattggatttgttccgggaaaattgggatttgttcctgtggttcaagggaaaaatcttggtcgctcgtttaagtgggatttctcaaatcagatcagactaggattttagtaacattatttgagatttatttgacagtcagtcgggatttgataggaggaatgcattaggtcctaactcgggaagatgggttgcaagttatttatgctcttattgttattattagtatgtatctaatttctcattattttatcgctatgtaagtccgtcttatttattcgctctcatgcaaaaatgatctatgcagaaaattatgctctcatttgttcattttaattgagtcctttactgctttatttaaattggatttgagcatgcattgatcctacccctttgtcttctctagatggccgaccacccatccaaccatcacggagaaggcatggatgattttgtggctgagttggctcgcatgaccttggtggtgggctaccccaacgcaccggagtactcgaccgttccaccgctcagtggcgagcttccccaccgtgttcgtctggaggttcatggctttgtgggcacctgcctcgctaacatggtggttaaggcatctggaggcaccgcagatcacgcctgtcaggaggcagcatacctgatgatggccaggcttcgtgatcaccacagctacatcttctgcaacacggcgtaccgcttcgaccctcgccgagcaagtggcgatgatgtcagcacctttcgcccgacggccggcgagaacgacaccaccttcggccacatgtgtgccgtgatgatgggaatggacaggatgcactctgacctgcacaaggcgtccaaggccttgaatgatgggaagcttgtgaggatcatagctctgaaggatgagatagcgcgtctgaagaaggagaatgctcaactgaagggtctccccgctcccggaggagtccggatccgcaccacgcctcgcaagtcaacgactgcacccgtgcgcattcagcttgcgcccaggaacccacctcctcccgcagctcctccagcacctcccgcagttcccgcagcgcccgtagctccagctccagccccagctcctgttccagcgtcagctcccacgtccgctctctcctgcgctcccgcgtcagccgccaggggtccagccagtggcaacggagtttgtgtgtttaggtttgttcgcttgtgggtcagtcgacggttgacatcatgtgcctatgatgtggctgtcttaataaggatttctttgctattttaagtgttttaattcagatcagaacaattgcagtttaaattcatatataataaagcttagttcctgagcatctgtttttcttcttttccatcccttccgtctgctctcccttcagatggtcaacaccaggaatggcagtcgtgcagcaggtgagggcagcaacgacgaagaacgcaccgacggtggatatcccaacagcgcctctggcaacgtccgccacagctccccgagaatccgactcttgcacaagtgatggcccatcagactcagatgatggcggccatgatgcagcagatgcagcagcagcaccagcagatgcaccagaggatgcagtagcaagctgagcagcagcagcggcagtttggtccccctccccctcagtccaagctgccggagtttctacgcgtcaggccacccaccatctctagcaccaccaaccccatggaggcgaatgactagctcattgccatagaaaagaagctcaatcttctgcagtgcaataatcaggagaaggtcgccttcgccacacaccagctccagggtcccgcatcagcttggtgggacaatcacatggctacccgttcgccaggtacggaggtcacttgggcggagttctgtcgcagcttcaggaatgcgcaggtgccagacggggtcgtggcacaaaagaagacagaattccgagcaattcaccagggcaacaggacagtaactgagtacctccatgagttcaatcgactagcgcgatatgcaccggaggatgtccgcactgacgcagagaagtaggagaagttcctagcaggcctagatgacgagctgaccaaccagttgatctccggggactacgcagacttcgagaagttggtagacaaggcaatccaccaggaggatcagcacaacaaaatggacaggaagagaaaggcagcatagttccggtccaaccaaggaagtcaccagcgaccgcgcttcactcccggacagcagggtggacctaccaccatgattgtccgccagcatcaccctttcaactcaagcagctttcaccagggcgccagtggcagccagaacaacccgggaggtcagcccaaccgcagtgcagctccgcgcccaccaatggccacaacacaggcagctccatcagtccaaggcaagaaggatactggagcaaagccagggtcctgcttcaattgtggcgagcatggccacttttctgacaagtgctcgaagccaaggcgtgccgggccaaggttttgcccaagctcgtgtcaaccacgcatccgtagaagaggcgcaagtagcaccagaggtcgtactgggtacgtttcctgtcaactcaatttctgcaacagtacttttcgattctggtgcaacgcattctttcatttcaaagaagtttgttggggtacatgggttaataagagaagaactgagtacaccaatgcgggttcatacccccgagaatagctccacctcggttcaattcagcccttctgtaacaatagaaatccgaagatcaccatttctagccaacctcatccttctcgaatccaaagacctagatgtcattcttgggatggattggctgaccaagttcaagggtgtcattgattgtgtgaatcgcacggtcaccttgaccaataagaaaggggaaacagtggtgtacaagtcaccagtcgcactgaagcagggaatctccttaaatcagattgaggtggaaaatccggtggtcaccgaggagaggagttcgaggaaattggaagatatccccatagtctgcgaatatccagaggtgttccctgaggacctcattaccatgccacccaagagagagattgaattccggattgatttggcacggggactgctccaatttacaagagaccgtacagaatggcagccaacgagctagcagaggtcaagaagcaggttgatgagcaactgcagaaagggtacattcgaccaagtacttcaccttgggatgctccggtcatttttgtggagaaaaaggacaagacaaagagaatgtgcgtcgattatcacgcactcaatgaggtcaccatcaagaacaaataccctttgccacggattgatgatctgtttgatcagctgaaaggagccaaggtgtttcctaagatagacctgcgatcaggctatcaccaattgagaattcgggaagaggatattcccaagacggccttcaccactcggtatgggttgtatgagtgcacggttatgtcttttggacttaccaatgcaccagccttcttcatgaacctgatgaacaaagtgttcatggaatttctggataagtttgttctggtatttattgatgacattctaatctattccaagtcagaagaagagcatgagcatcatcttcgtctggttctcgagaagttgcaggagcaccagctttatgccaagttcagcaaatgcgacttttggttatcagaggtcaaattcttgggtcacgtcattacagctcagggtgtggcagtcgatccatcgaatgtggagtcagttaccaagtggaccccacctaagaccgtgtcacagattcggagttttcttggacttgcaggttattaccgtcggttcattgaaaatttctctagaattgccagacctatgactcagttgcttaagaaagacgagaaattcaagtggacagccgagtgtgacaagagttttgaggaactcaagaagaaattagtgtctgctccagttctgattctgcccgatcagacgaaagacttccaagtctattgcgacgcgtcccgtcacgggcttggatgcgttctaatgcaagagggcagggtggtcgctttgcctcacggcagttgcgtccgcatgaaggaaactatccaacacatgacttggaattggcagcggtggttcatgctttgaaaatctggaggcattacctgattggcaaccgctgcgaagtatatacggatcacaagagtttgaaatatatcttcacccaacctgacctgaatctccgacagcgaacatggttggagttaatcaaagattatgacatgagtattcactaccatccgggcaaagccaatgtggtggcagatgcattaagtaggaagagctactgcaatgctttgtgcaccgagggcatgtgtaaggaattgcagcaggagcttgaacatctccacttgggaatcgtagaacacgggtatgtggttgctctagaggcacggcctacgctcgtggatcaagtcagagcagctcaagtaaatgatcctgagatagctgaactgaaaaagaatataagggtcggaaaagcccgggatttccttgaggatgaacgtggcacaatctggctgggagaaagattgtgcgtacctgatgataaagagctgaaagatctgatactcaccgaggctcatcagactcagtacttcattcatccaggcagtaccaagatgtaccaagatctcaaagaaaaattttggtgggcctgcatgagaagggaaatagctgaattcgttgcactctgcgatgtttgtcagtgagttaaagcagaacacctgaggcctgcaggcttgttacaacctcttcagatcccggaatggaaatgggaagagattggaatggatttcataacaggtctgcccaggacatcatcgggccacgattcaatctgggtagtcgtggatcgacttaccaaagttgctcatttcattctagtgcatactacttatacgggcaaaaggttggcagagctctatctctcaagaatcatgtgtttgcatggagtacccaaaaagatagtatctgatcgagggagtcagttcacctcaaaattttggcagaagttgcaagaagaattgggtacccgtttgaatttcacacagcttaccatccgcagacagatggctagaccgagagggtcaatcagatcttggaggatatgttgcgagcctatgcgcttgattttgaaggagcttgggataaaagtctgccttatgctgaattctcttacaacaacaactattaggccagtctacaaatggcaccgttcgaagcgttgtatggccggaagtgccgcacacctctcttctgggatcaaacaggcgaacgtcaactgttcggaatagaagtgctatcggaagcagaggagaaagtcagaaccgtcagagagaggctgagaattgcacaatctcgacagaagagctacgcagacaaccgccgaagggagctcacttttgaagcaggggattatgtgtaccttcgtgttactccgctcaggggagtacaccgtttccagacgaaaggcaagttggcaccacgcttcgtgggaccatacaaaatcttggaacgaagaggagaagttgcctatcagttagaacttccatccaacatgatcggtatccatgacgtgttccatgtgtcccagtgaaagaagtgcttgagggtacccgaagaacaagctgattcataccacattgacattcgagaggacttgacttatgtggaaaagccagttcgcatccttgagaccagtgaaaggaggactagaaacaaagtcagtaggttctgcagggttcagtggaaccaccactcagaggaagaagcaacctgggaaagggaagatgagttgaagaacgcccatccgcacctcttagccagctcttccgaatctcggggtcgagtttccgtttaaggggggtaggtttgtcacaccctgaagttcttttccccaagcctaaattgaatttataattggtctcgagaaaataccggtgtaaaagcaagagtgaaaccctaataaattaatgcagataataatcggaattggcatgtggaatttttcttgagatctacatgtcgaaatgtgctaacaagatttttagtggaatttccagagctctagaaataattttaaccaattaaaattgagcacaagcaatgtttaatccctggaaattcatttctttctttttctttttctttttcttttttcccccttttcttttcgaatgcgctgccggcccattcttctccccctccccctccccgctgggccagccgaaggccaaggcccagcagccggccacctcctccctcctcccttcgggtcgtcgacaggtggggcccacctgtcgtgcccgtctcccacctccagccggccccgccacatcccgcaaccgccgccccgctcgctcccgcgtctcccgggccacgtcgcctacctcgccacccgcgcccgctttccccgcacccactccctctctctccctcccgcgcccgcactcgagacggccgggattcaatttttgaatcctgcctctctctcctccccacctctccccactccgccggcgaaatcgcggtcaccccggccacgatcgaccctcgtgagtctatgtcacatcctgattttcgtcttacgatttataaattttttaataaatcattattagaatttatattaaatgttcatcaatttacaagtgaagttaaatgtgggaaataaaatttcctaaatataaagcatggatggatttaatttttattaaattctccatggttaattgtactctctggaattttctcggatttttcggagctcaattcctaattttaatcatacaaagaacatttcagtaattatccacatattaaattaatcattaaatggtctgattataatttttttaagtactttgagtgtccaagtattttcaggatttttcttgaaattatttgagcattggaagtatttttaacaattcaaagatcatttcagtgattattttaattgaaaaagttttaaaaaccctccccttggccgttgagccgtttcctgcccaactcctctctcctcgcgcgcgtgctgtgcggcccacgctggcccagtccaagccgccggcctcccccctctcagccagccaaaagtctactttacttccccgaatactgttcatcttcaagcttggacagaagcccgagctgccgtcctgtgccctgtgcagccgccggtttctccaccaaatccgccgcatcccgagctccgtttgcaaaattagttgaggggaaatattcctcttatcctcctctatcctttcccccaagaatcggactttatcccgaagaaatcaacgcggaatcgaattcgttttcgagtttatctctccaactaaccctctgtttttccggctcaaatcctctcggttggagtccgatctcttcaatccaagcctataaatagcatcccctagtcgccctatttcttttgcgccatctcccgagctctctcgtgcctcgtagtgccgccgccgcgccacccaaaccgccgccgtcgccggccggcgaacagccgcctcgcgccgccgcttgcatcgtcgccgccgcctcacgtcaccgccgttaggtgcgcacggtggagtagaagctcggccgccccactccccgccgtcgccggtcggcggagacccgccgccgccgtcgaccgaatcgccgccgccgcacaggctcgccgccggccgtcgttcgtcgtcgtccgtcgttgttctttgcaccggtgagttcgcgtcgtcgtcctctacgcgtaggtgccctccaaaagtccggccgagtctcctagcgccggcgaggtcgtcgcctatgtcgagccgacgttgatgatgtcatcatgacgtcatattccttttttttcggttttcttttcagatgaaaatcgattaaacttcggaaattcataactaaatcatcataactcggattcaagtggttcaagttgctaaattcatctaaaataagatctacatgttaaaaatatccacatgtactgtttatacttgttttttactgttttcttgattttgttctttcgctttagtttccgacgttccggaggagagggttttcgttgaggaaggttcagaagcatttgatgaagttcaaggcaagtcacacagatcccaaacgaccctttgagcatgttgaacccgtttaaagctaatgttttatttcaacttatgcattattttcgaatgtcagcgggtggtgagcctttcccaattaattaatggccgaagatgactttattttcctatgggttataatttgattagctagaaccttatatattggtttggttcagctaaatgctatatatatataattgcttagccatgtttagaaacattagctcactaatgggatgaatcatatatactacattattatttatggttatatttaatggtagctcacgatggttaatcgtgttatgataattaattgataattaaaacttgattaaaggtgggttgtgagcaaatggttttgaaagtcgtgctcatggcaattaaggaccggttcgcgagctactgttgtgagacattaaccgtgccaaccacaagccagtgtgggcaacggctttaccttttgtatagcatgattcattgcggggtgccagactgagaagcggtgagaagtccgtgggggtcgctggggagtccatgcctctggtttttgagggggtgattatgatccaggaatggtgcactgtggtgagttgtgttgtgcgaagggtactgtcacgatttccccctttgcagtgccgtggtggtacttcggggcatggcaacatgtgtggaatcgtgtcttgtgggtacagtggtacacctctggccagagtaaaactattcgaatagccgtgcccgcggttatgggcgggttgagcaatgtttttcgtaattagtctcacacctctcacaaataattattgatgcaataactggtaataatttatttagctcctggtttggagttagatctgtacagccgggtatggttgttcaggatggttgggcctgagcagcatgggtgtgctgttcagtgttgattaaaatttctgattaattactctactgttttactactcttaactctttgctaaatgctgcttttgcaaatgagcctatattatgccatcctttggtatccttgtgcacttgcatatttgctgtgtggcttgttgagtatgtcatatgctcaccttgcaataatcatcaaacctcagttgaagagaaaggatccagaaggagaagacgtttggcttataccccagttgagctgcctgtgggagtggagctgaagccatcgctagaccgttaattccgcagctgtttttcttttcttttgtaagtatgtaacgttattattatgatggatttgtatattaaattgtcagtttgtgtacctcggctgattcctggacgaggattttatgcacaaattagttcggaaattacttgtgaatttccgggcgtgacagtctatataaagcacccctgttccctcctctctcttttttgttttgcaatcgcccgctcccgtgcactccaccgccctagcgccgtcgccctcctttccgccgccgccgccaccactccggccgccgctagccgtcgctagccgctgcgcccagccgcgccgtcgacgccgtcgcattcgccgtcgtgcgggccaccccgtccacccctttcccgtcggattccgccgccggaacccactccgcactgtgcgccggtgagccccgccatggccgccgccttcggccggcgtcctcgccctcttccatctccctctctctctctctctaacccctttcatcgtgttcgctaagtggttccggagctcgtcccgttgctttcatcgcagggactaaggatgccaactgagctagaaaagccatctaacttgacatttatgttttctaggaccttgtcattggccgcaagctttttgcttagcgcatcggtggttttagcttgcgcaaaaacaagatccttcaaggagggctggttagaaaaattatcgttgttgttaccttcttgataatatgggcgtggttggttccacccctgacctccttatggatgatacccgttgttgttgttgcccatgtacatcgcctcctcacgggtttccgggcagtcattcccagaatgacccgtgttgccgcagacctcacatgtggcgtgagtgtccaaggccttgagggtgccttgtggccgtttctcatggtcgtccaatcgtttcatgaggaggtccagcttagcagcaagtagcatgcctcgctgacgggtctggagtcgttcctccctccaacccatattggagaccatcttctctattagatcaacggctccttgaaccgttttagagaagaacgctcctccagctgccgcgtccaggtgatcgtgggacatcggggtgagtccataataaaagttttgcaggatcagccagtcgtccatcccaagatgaggacatgcagctacgtactcctgcagtcgttcccatgcttccggaatagactcatcccttgtttgctggaaacttgaaatccttccacgaagggcattggttttgcccatcgggaagaatttcgagaggaatgccgtagagcattttgtcccaggtattgacagcagcaaggttggcatagaaccactgcttcgctctctgaagaacagagaacggaaatagtcgtagcctgacggcgtcgggactgacgcccttgatggtgtatgtgctacagatctccaggaactattgcagatgagcattggcatcctcatcaggcttgccacagaatgggctagcctgcgccatcgttatgaggctggacttcaagttgaaatccacttttgttgtttgtatctttttgatgtgctattcttttctaattaatagatcgttcttgatatcatgttgtcgaaaaagtttatgatttatgcactgagttgaaattgctagatgatattgaaattgatatcacatatatccagagaaattttcatcatatatagatatctattgatttttaagatattatattaagggcccctactttttgtttcgccctaggccatcgaaaactcaggaccagcccagatgatggctgtgacgatgacgacgtggtggcggaactcaacatcctggttgcacagagtggagcagcagggggggcatgatgtctcaacctatgggaacaccacatgatgaacggagaggaggaaatgatgaaagacttttatggtgtgcaactgcttaccaaccgtagcaaagaagaggcggcacaactttccgatgtaagtagcaaagaggagacggtagtagcaggaagatgatggtgctggaaacagaacgatgatggtgctggactgatcctcccatgcagccgctcgttctcgcgttgacggtttgatatatctccatgccaacagcacgatggccgtggctgggatttcgaaaaacagatcaaacccatcaatttgatttgatttttggtattgatcaatggaaatagatgaggagcggaagagacgagcagggaattgagggaagcatcatgaccttcatagcgaagcagaaacatcgtgcttgaagatgaagcagtagccaacatggtgactttggctgcacatggcactacatgcacgcacacggtgtggctgcgctggttaaacaaagaggaaaggaggaggggtgctgcagctatatatagagaagaataggagctaagcagccaggagaattggcttttacaaaaatggctcatgctcatgaaggtgatttaatttttggtgttaaataatgagattggtgagggagagggagagatttattagtgggaggacgaactcgaggagacagctcagatttttggaagatcagaaatgtggctgagggaggacgaagatggagagttgagagaagagactgggaattggaaaaacagatttgtctcatcatggtgattcaattggagataatgcagtgtaatattatttggttcttggtctgctttagtttcttggttgatgatcaacagatgattaaattcatggtggatggaaactgcaatcaactggagattaaatggctagcatttgcatttgatcaggagatctaaaggctgtgcatggtgaggtggataggaagaaggtggaaaactgatttggttcatgatggtgattcaatttttgtcattcaagtggagaaattaattagggaggagaagagattgcagagatagaatgacagggagagagatagagagagagagagaggcatcggcctggaggaaaaaggaaaaaggaaaagaaaaggaaggaatagaaaaggtggggatttttctggacttgggatttttttttttttgggatttatgggaaataatgaaatcgagttccacttcaaaaattcaaataaaaaccaagtaactctaattaacaaacgataaaataaaacggcggcgtaattaatttatttagtcacattaattttttttcatttataaaattttcattaagctattttaggcgaacaaacacgaatgtgattgattttttttaaaaattaagcaaattagaagacacaaaaaacgggacgtgacaccactccccttcttctccaccaggactatacaagaaacccactccgcataacgacatggcccaataaaccccgccttcaacaaccgatcaatctcctctttgactcggtcatatagcaaaggattaaaacgacgaggtggttgtttataaggcctaaaacccggtttaattggaagccgatgctcaacaagctcacggctaagacccggcatctcatggtactcccatgcaaagcaatcaacatactctgtaagtagctcgattatattaaccttataatcggctctcatatttttgtttacaaaagtcggccttggtttggttccatcaactatgtctacttcctccaatggatcggccgatgtaaacccttgtccaagcttctccacttcatcaaaatcttcaatagtttcaccaatatcgttctttgtagaccgatattcttgcaccctcttttgtaaccactctaaattagcctctttactcattatacaaatttatatggcttagctgtgctacactagccggctttatagagataggtacaaattttccatcagagatactaataaaatcatagttagaaagatccctccccgataagcattgaatattcccatgacgccactcaaaagtagcatcggccattgcaacctcggccgatgtatccgcttgaacaatttcaacatcatcgccgtcctattgaattaaacattgatgcaaggtagaaggcacacaacaattggcatggatccaacaacgacccaaaataacattgtagttaccttgcacatcgacgatgaagaaagcggttggtaacgtcttgttccccacggtaagctccgccgaaaagatacccttcgcctccgttggttcaccattgaagccattgagaatcatgttagtcttcttcaactcatcatcttcacgccccaacttcttgaacaacgagtatggcatcaaattcacagcggcacctccatccacaagcatcctagataccggctttccatcagtatgacatttgagatagagaggcttcatatgacggtttgattcatcgggcttctcaaaaaccacatctttaggacctagtgaaaattgagcaacctcggcttcatccatagcacaaaactccataggcaacatacataccttgttgatatccatgtcttcttttggagatgactcatctttagcaatcgattgttcttccttcttctctacaacaaccggttcttccttctctatggttttacgcctccataccggtggtggtcgcaactcattgaaccttttatccctttgctcttcagcctttttctctcttatttcttgggcccgaagacattgcaaccttctcctttgagtagccgttaaatacttaggcatcctcctaggtttcggctctgttccaggaggtaaataatgccccctattaggtctagttgatgacgatgaagccctcacatcgccctttgcaaacctcctatcaaaccggcgctggagcctggtcagaccggacgtagaccaccggtcagaccagccagatgcgctggtcagatcaatattcgatgggcggtcaaaccggcctgaggcgtcggtcggaccattgtcgggtcggcggtcagaccggcctgatggcccggtcagaccagccgtatggctgcggccgactgcgatgagctggtaccggcttcggattttttgcttgaggactctccaactttatctctagaaggtattggcacatcatgagaccctactttgatggtaattacctctgaagtccttgcctccactttaatgtgctttccttctcacctttcctcattggcccggttcttaccataaaaccggccgttgtttggtgaagacaaacgctcatgaattggcctccttggtcctccccacccttgattgaattgcattggaggcatatgattgaacattggcggcgttgccccccatggcatgtaataaggataaggataacccggcggcggcattggatagggaccccatggtatgtcttgtgaatgatgatatggaggtgaatgcgaccgtcttggcgagtgaccaaatcgctccctaggaggtgatctctgtattttccccttgttgcgagctctctcactaccttgcttttcatatttctccaaaagcatatcaagggtcactttggtcttcctaggagctttagaagttgaagcttcacttttattctctttacaaacacaaacctctgggttctttggcactattatctttggccttggttcaccaatgattactccttttcctttagtagattcggcttgctccggccgaatcaacaccttcttgtcattgaaattaattgtattcaccggaaaaggatcatgatcaagcttcatcttggagccatcggtgaacttcaatcgtccttcatctatggccaattgaacctgtcgtcgaaacacattgcaatcattagtggaatgagaatgagaatcatgccatttacaataagctcgacgtttcaattcttcttgagatggtatgatatggcctttaggtaatctaatttgtttttcttgtaaaagataatcaaaaatcttatcatacttggccacatcaaaactatatttaacctcactttgccgatctttgcgaggagtcggcattaggttagaacaaacaaaaggcttgtttttgttagtccatgaccattcagcaacatacatatcatgatcaccctcatcttcactatcactagcctcagggtaatcaatcacattaacattaggctttttctcatatggtctaacaatttttttattatccttaacccggctttcctgagccagagccctttgcataagttgactaacatcaagaaattgttggccatctagtctttctctaagaggggcaattaaaccattaaaagcaagaccagccaaatatctatcagttatattcaagctataacatcggtttcaatcatccctaaatctcttaatataatcaatgacaggctcattatattttttgcttaaccgatgttaaatcacgtaacctaagctcagtttctcaagtatagaaataatcatgaaatctttcttctaattgagcccaagtatgaatagaatttgccggtaaagaagtaaaccatgtaaaagcggtactggacaaagataaagaaaacaagcgcaatttaaaagtatcactattagcctcaccacattgcgctaaaaattgacctacatgctcccatgtggtcctaccatcttcaccactaaacttggtaaatttgggaactctataattacgaggaaacggcatattatcataatagtcaggatacggcttttggtaaaccttagcaagattcctagtttcaatcccgaatttatccctaataatcccaccaattatttcctccatattatcaggcctatgttgatttggtggtggatttggtggcctaataggttgtgtttgcggcgcaatatggttatattggacttgcctagtatcgggaggataccccctaccaacatcattataagcattaggaacatgtgggggaacttggggattagttgcagcactagatacaggaggatcaaatgttctaagatgatacaaataactagcattagtcattggatctatcccctgaattggtattattgcgccggtctgaccggtccagggcccggtctgatcgacatccagaggcgcgatcagactggcctaagtcccggtctgaccgccggggtaatacccggtcggaccggccgtttggcctgtcggaccgacagtgaagtcgcggtctgaccggccatcaggcccggtcggaccggctgtgtgcgccactccatcggttctactatttgtttgatctataggggcttggctagcagtggtagaggctttatttttacccacaaaatcggccaagagagggccgactttaaatcttaaaaactcatcaaatttatcctcaaaagttgcatctaattatctttaaaaacagtcatagatgaatctattgtagatgctacttgttgttggatagattgtgttacctcttcattgcttaccaaattgggagcgagcttaggacgtggccagggcttgatgatcacaccttgacgagtcctagtagacgccctcatcaacgcctcttgtgtgagctccttgatgtactcctccatggacttgcggtcttctccttcgaaatcattcaatgtgattggtatcacaatggccggctccacctccgccttggatgatggcggttccgtcatggcgaaatcgaagttgagttgacgttgaacggatctccccagtggagttgccaaaatcgtgttagcaactttttgtgacaagttgacaacaacgatcgcagcaccttatgccttgcggtgatcctagagtcgccaaccacctcgatctagcaaagagctaaacctagatggattttgacaaataaaccggctaatggagccgatttaagataacaacccgtctcatgggcaaaacggaaggttttcaggacaaacctacaaagagatgtcgcactctcgcagcggcggcggacggtttacggcgcaaaccgacaaagatggacaaactaagggaaaactaaaagcaatacgaaaaacgattcgattgattgattgtagattgtttttttacaatagaaccggccatgtcccttatataggggttggtcttgccctctacgggccctcctccacatccaactcggggtagaaactaaaggaaacccgaaacatgccttcccgagcaaggaaatctcgaaacccgacgaaacacaatcggactcggacctgtcagtcggaccggccacacaccgccggtccgaccggccgtcaaccggcggtctgaccgcccaacacacggcggtcagaccggcccactcgaaggaaaccggtagacttccaaattttggcaatctttcctattttaatcctaggtgccaaatttgggtgtaaacaattcctatacttgaatccgataagacatcgttgaaaaatagtttttcaatgaaggacttaggggaagcagcatatattctgggcataaggatctatagagatagatcaaagaggctaattggattaagccagagtacatacattgacaaggtgttgaagaggttcaacatgcaagattctaagaaaggtttcttaccgatgtcacatgccattaatcttgccaagaatcagtgtcctcaaacgactgatgagcgaaacaaaatgagtgtgattccatatgcctcggcaatctgatccattatgtatgctatgctatatacacgtctagatgtttcatatgcacttaatgcaacaagccgataccaatcagatcctggtgagagtcactggatagctgtaaataatatcctgaagtacttgagacgaactaaggatatgttcctagtctatggaggacaggaagagctcgttgtaaatggttacactgacgcaagcttccaaaccgacaaagatgattttagatcgcagtctggatttgtgttctgcctgaatggaggcgctgtgagtttgatgtgaccatggctactatggatatgaccattgctcacatcatgaatcaacaagaagacatcaagatcaagtcctccatgtgctgcaatctaattcggccacgtgttacattgctgatttcaaacggccgccaaatctacatacgtgctccgttttgggcccgtgagtacttgatggaaagctctcgaagtcctccttccaacggatccagcctcatctcggaattctatctcgtttggccgcaatcacagaagcaaggtgctgcgtcacctgtattgggccaatgggcttgtaactttgtttgggaccctggcccatgtggggtcctacatttgctaatttgattctaagttgttgtgagatatgagatagtaactaagagttgctataatcctagtctaagttcgacttaaattccggatgttttatttttcaaaataataacttatggagttcctcatttgatataaattcctaccagagccaaaaatattccatattgattaaaccatatatattttggttacttataattccattgaactttgtcaaattcttgtgacttgtgaacatacttctcatgatctatgatcaagatcatacatccacatatatgcacatgctaaactcctacactgcgagctagcaattatccattccatttccatactaccaccaaaaataaattcgccatgcttttatgcgctttcttctcctaaaaagaaaatcctttctgaaaaaaaaagagagaaaagaaggaggaaaaggcggttatgaaaataaagttatgctctctcaagaatgagcatgatattgaaaaaaaaagagagagaataatgtagccatgccctctccttatttataaaagaaggattttaggagtaagcacaaaggagaagcgttttttctttattttacacatttcatttccaccatatatcacacacacacacacactttgcacgatcttgatcttgagtatatttagtcatctattttagtctatgtttttgacttagtaataaatgtgaatgcaagtatgccatgtttgatccctaccaaactacacatatcaaccttagagtaggaatcaaaaaggcaaaatggtgaggaattcattttgatacacttggagagaccgagtgaatcatttgaggaacttggatttcttttacaaaaatcatttgaaaacttccagaataaaagttgaatgaagattgggtgattagtactctaattgttgttctgtctttcaaccgcttaaggcaagaagagacaatgtctcgtgggaatcaggggtaagggtaagccatcgtgccaaagattatttgatttaagagagagtacatatgccttgaacctatacatttgagatatacagcatagtagcaactcatgatcaacagccaagtctttgtttcctttcatcctttactcgtgacgagcaaaggttcaagcttagggggttttgttgacggtcgttagcgatcagtttcgaccgtcaatactaccaaaataaaggagaactagttatgcttacaatgcatatttgtattagaataataagtattccactagtactgggattgctaacctcttgcagagaatgaacataagagcatccctagcagctcatctatatttcatcccccaaatgcccatatggattacttcaccaagtgggccgaagctgtgccgttgaagaatatgactcatacggaggtaattgactttattttgaatcatattatccatagattcggtattccacaaacgttaactacggatcaaggtgcttcttttatatctaaggaagtgaggaattttgccgaatcttatggtattaaattgttgagttcttctccttactacgctcaggctaatggacatgccgagtcaagtaataagacattgttgaaactagtaaaaaagaagattaaggaacacccaaagaggtggcatgaagtgctttccgaagcattgtgggcgcatagaatatctaaacatggtgccactaaagtcactccttttgagttggtttatggtcaagaagccgttttaccggttgaagtaaatcttggttctcttcgttatatcaagcaagatgatttgtcaagtgaagattacaagacgttgatgggagacaaccttgatgaagtcattgacaagcgcttgaaggctttggaggagatagagaaagagaagaagagggtggccaaggcgtacaacaagagggtgaaagcaaagttgtttcaagttggagacttggtttggaagacaattttgcctttgggtactcgatccaaggagttcggtaagtggtcccctagctgggagggtcctaatcgagtatgtggcattgttcgatgaaacgcatattttttggagacacttcaaggggagcgttttcagcgagcaatcaacggaaaatacttgaagaaatacttcccgagtgtttggcatgacgcataggaggtactatggccggtaattggattatcgtactaagaccaaaacatgttctatgattttagattcacgttgttcatcaaaaaggcaggggggcatgtgtttacaaccaaatttggcacctaggattaaaataggaaagattgccaaaatttggaagtcttccggtttccttcgagtgggccggtctgaccgctgtgtgttgggcagtcagaccgccggttgagggccggtcggaccggcggtgtgtggccggtctgaccggcaggtctgagtccgactatgtttcgtcgggtttcgaggtttccttactctggaaggcatgtttcaagtttcctttagtttctaccccgagttagacgtggaggagggcctgtagagggcaagaccgacccctatataagggacatggccggttctattgtaagaaaacaatctacaatcaatcaatcgaatcgtttttcatattgcttttagttttcccttagtttgtccatctttgtcggtttgcgccgtaagccgtccgccgccgctgcgagagtgcgacatctcttcgtagatttgtcctgaaaaccttccgttttgcccacgagacgagtagttatcttaaatcggctccactagccggtttatttatcaaaacccatttagatttagctctttgctatatcgaggaggttggcgactctaggatcaccgcaaggcataaggtgctgcgatcgttgttgtcaacttgtcacaaaaagttgctaacagaaacttttggggatttcttggggatattgtagaggatcccattcccgcaactaatttggaaagaggagcaacgaggaggtcggattttggaaggggatcggcatcatcgggctctgctacagcgtgcactggcgggagacggctggagcttgaagtagtactatagcgagggggaggcaaaacagacatttctgcgggctgagagaaagggatagaatgggctgaattcggcccaagactaggaaggaagattttattgcttttccaaataaattaaccaatgagatgatctttcaatcgttaaaaatacttccaatgctcaaataattccaagaaaaatcttgaacatacttggacactctaagtatttaaaaatattaaaaccagaccattaaatgattaattttaatatgtgaataattattgaaatgttctttgtattattaaaattaggaattgagctccgaaaaatccgagaaaatttcagagagtataattaatcatggagaatttaataaaaattaaatccatacatgctttatatttaggaaattttatttcccacatttaacttcacttataaattagtgaacatttaatataatttctattaataatttattaaataatttataaatcctgaaacgaaaattcaggctgtgacactagttggcaccccgcgccttgccgcgggatttgctagttttatcatcaaataaaattaatattttaaatgattagatgcaactctgtatatatacaaaataaatggtaatctggcttcatagatagcctctgctattaaaatacaattaatgttttattttttataaatataattgtgtattgttatgatatacgaaagttatttttatgcacaatttggatatctgttaacgacgaaatttggtaagcccaaagtcatcatcgacttagagtcagtatcggtttcagagttatggaatcagccgataggagtcgtcaaatcgctagcacccgtgttttcgatggagtcggatcaactaaaggaaatttatccagaagagtccgacttcaagaaggatgtggcatggtagtttaactattaattaggaatagtttgttagttttcttttatctttaggaaagtgtgtttagtgttcgataaggagtttatgttttccttttatctttaggaaagtttctttcttgtctgacaaggacttgtatcaaccaatgggtataaatatgtacacccggggtctatgtaatcatctccacgatcaatacaattcggcgcatcgccaccttttaccttttctactttattttatcgtccggcgggacttggcacttgacgcggggctgcatcggtgctcgatctccggctaaggggtaagtccaatgatctgccggcctaggcaattgtatcgtttacgttggtgtcgttcaaggctgcatcagtacattcgacctattggattactcttgtttggatggtatatttgcctacctatttatcatatgtctatgttaatctagtcttagcatatcaatttagctctatcggctgcttctcgttttagggtttctgctggtatcggctaaatcgcgttgctagattatattagcttagacatctaccaccctgaaaactcagtcaacggcttgattgtctagatattatgtttcttttcatacttagtgctacatcagttaagtttgatccactaagtcatgcttagaaccataatctctagcctgcttcttgattgacaataagggtttcatcggggtttcaaccgaggagttatctggacgttgcatcggcttacaaggattgcatacgaattggatttagccgatagcgacaaaggtttcattgatttatctaatcgtttggattttatgacatcggacctgcagccaatgtatgctttaaccttcggatcagtgcttattctatcatattgttagccgattggtttatactggattatattgctatattatattatcagccgattgccttcatatcattatatacattggacatatagccgatagctcaaaaccctattgctatcggctggcattgtcatcggttagaactacaacatcggcttgtcagccgatcggctgtttgatctactgtttacatatcttgtcagttgcaggatcaaactgactggcacgcccgcatctcaccaacctttggacctgcactggagctaagcagatctcccaggccaatgtgtgtttttggcatcaacaatatcatcaaattagggtagtttgcacctctttgcttttact

SEQ ID NO: 65551 - DNA, 2928 bp, Oryza sativa
gaatatgtatgtcgtcgaggtcgatcggctttagcttgcgtggcacgctcgcaagcttgctttacaccggagattgcgcgacgggcaccggagattgcgcgacgggcataggctgtgtgtccgtctagcctggtgcatgaactcggtccaccggcgccgtcgatacatgctagcaatacgtactcctacgtcaccttcgtttctgtttttttttctgtacccacgcgggtgacgaaaaaacaagagagaaacggatcggatcagtgcatatcacacacattaaatacggcgcgcgaagggttgcccaagcaatgggatactttttcttttcaaaaattcgaacagccagcgtactttgtgcatcgtgtggaggaagaataaagcgatgcaaaaatcttctatgcgcgcatatatatggtgccaaaagtgcctaaaaatgcaatcaacattttaatttgaaccgcgatcatacagccattaagtgcttacaatattacttccttggtctagggcgtgtagcaattaagggatagaaaaagtctacaagtctaatagtagttactaatgaccacattgccctaacaaacgattgcgaaacttttgaagacgatgttgtttttccagcaatatgcatgtcgaaagcaggatgatcacagggaaaaccgagagatgtgtagctcgttatctggtgagaactcccaaggctggagctgccaccgatcagaaagggtttttcagatgggcggagaggattttcacatgcggttggctggcccgacgaggaaatgagttcaccactaatcagaaaactaataaacatcacagcaaacataaatttcataagcctgctagtgttaaaacaagtaccttgaacaatttattatttataacaagaatggacttgctttgcttgtgaggaaatatgtgcaaagcttattgcatcataaaggcctcttggaggagaaattagaactttatgctgattgaaacaaatatacattcagcaaacttgatgcacaaatcaagcatatatttcatcacattctcgatgctggaaaacagatagtaagatctagcatcctgatttttcattttttaaaaaaaaactttcacaagttagcaggaaatcatattgttagagtatatggtagttatagttatattagaataggatttatttgtgtggactccttccatatctgtaatccttctttatctcaccctatgtactcctatatataccggtccctaaggctcaatgcaattgatccacgttacgcaatatacctctctccctatactatccaatatggtatcagagcgagcgacctagaaccgctgctcacgcttccgtcaccgtcgccccgggagggctccgatctcccgggggcggccaactttttttttctctcttcgcgtcgtcaagtcatcatcctaagagatccatctctcaggcgtttgtgttgtcatcaatcaagcagcagcagcagcgtctccgatcgtcgtcgatctcaccgaccacctggcgcactgcccccgcccgtggccatccacgagcaaccgttgacgtgtggatctccgtcggccatgctaggcctgcctcgccgctgccgctggggggggaggaaggggaggggggacggccacctcttcacctcggccggcgtcatcgggccccgtccgccgctgaggacgcccgcctgctggtggtgctcggcgctgccccgcagccatctaccctagcgtgacggggcttgcctcttcgccgcgctgaggaagccacctccatcaaccacgccgccgtccccgcactcctctacgccgctggccaccgttgacgccacctccgccagccttgccatcgatctcttgctgcccatctctctctcttatctgtatacacatgcgttcatggataggatttgggaaggtagtaattgacacacaagagggcgttgtggaataggattgatttgtgtggattccttccatatctgtaatccttccttatctcctctccatatactcctatatataccggccccctgaggttcaatacaatagatccatgttacgcaatatacctctctccatatactatccaacacatatgatggagcttgataacaatgtaattatccaaaattaacactgcatacctcaacttcacaacgatatgctgaacacattttatcaatatttatacagtccatcacagcgaaaaaaaaatcctttgctctttccgtgacatttggagcaaacttttattagaaggtgtcatatcactactacagaaaacatttttccgaacgaggacatctttaggttacgggtgaaccgtaactagtcgtgcctgcaaacatcggtctacattttcgcatacggctacttaaaagatctgcatgcaaaaatcaatttcattccagttcagcgaaaacccaccgcatgttctagttcaccacccatcacattcccattcggcgattggtctagttcgatgatgccagctgccactcagctcttgtcttgccggttaattatcgcccttctccctattgctgaccgctcgctaccacctggagggaagcctggaaaagatggggacgagagagtaagaggagggaggagtaggaaaaccgacccgttcacatgtagcgtccatgtggtcaccttgactcaatgacacgtcagctaaaaccggacataatattatcatgtgaatttagtagtatttcagtattgtaagttaaagacgtgttatatctcgtatcatgatttatggatgtgatttaaactcgaagcaaatacgagggattaaagtgaacttattccgaatgaaacaaaacacatggagcaatctgaactgcgtttggaaagtgaactgtgacaccaacggtcggcgtttggaaacatgggatcgtgcgtcca

SEQ ID NO: 65552 - DNA, 2360 bp, Oryza sativa
ggaggaggacggctccgccgccgccgccgccgcccggtgggtgtggcgcgtggccatcgatctcgagcaggtgctgccatggccggtcgggaataccaagggcaaggagcgggcgtgcttggccgcagttgccgaggaccccaacgtcatcttcgtcggcacggaagaagacggcgtcttcgccgtcgagctcgattcgctgcgcatcaagaaagtgtgcgaattgggcaaatcacaaggccgtttcttccccttcgtcagctactgcgccgagtcatttctggtatccatctcatatttctcatctgttcatgcaagtttggttgctgatttaaaatgacatggtttggtggtttttattttattctatttttatttttacagctgagcctagcaaccagcaaattgccagcaccagcggcaaattaatccaccatcttgcagtctgatcgatgttcttcggtgatttgtttcttctgcggaaagttcagggagacaagcagtttagttcgatcacttgggtcagttagcatagttcctgacgatttttttgttgtggtgttcttcttatcaaattgtgaccatggatcatcacttaagtttcaatcgatcagtttcagcatacgcgagtcattttgtttcagtcattgcctgacaccaaccatcaagtgtcctgaaaaaatgaaccgttgttgttcagtctcagtcggattcagacaaaattaccaaagcatcaagtaattgggggataattcggctcattgaattcactgtgatcatgatttgagacattcttcattttacacatttttcttttttgacatagttgagttcagagtctgtttgccccatcctgtttgaagttttcggtgttttctgaagaatggtctgtgtttcagcttaaacataaaactctaggttatctcattatcttctgaagatttgttccgaaatgctcccatgaccgtggaattgtcgcattgacacttttaatcattcagtttcagcatatacgggtcatttttttcctcatggatcgaacactaagtttcaattctgtttcagcatgtccactaaaaattcagtttcaattcagttttgcacctgagcatgaattgtcctgaaaaatgaatcgttgtgattcagtctcagtctgattcagacacaattgccaaagcatcaagtgattgtggacaattcggggatctgattgaatgcatcgtaatcatgattttagtcttccattttttatatacatttcgacatagttgggatattgttcaggtctgtttgcccccatcaatttggagccttcggtatttttcagaagaactagtctgtttcagcttaaacataaaacaagaagcagtggtctcagctcttcgagtacatccatagaaggcagctggaacttaaaaatgtacccgtttcccatattttcgttgtatgctatcgtatcctacctgtaactttacggtatgcttttgcatggacttatttttcttaatcctttctctagttcaattccaatcccaccacatttgctcaagataaattaagacgcagaacagcggggagtattcagcaaattctgctgactggaccacaatggttgctatcccgagttccacgacaatagccatgtcaaagaatgcaagcttgcatcagttacaactgtcctaacattgaagtattggcctttttctctttttttttcttaaacaaaatacaaacgcagacgctcacagtacaaatgatcatacatgcagtgagggaggcagctctcgggtaggttgggtgacggtccgggctctaccgttgccgcctccattacctactagcgtcaatgtgtataaaaattgattcatcggctgtgtttagattccaaaaaattttggctaaaaatatcacatcaattatttggacatatgcatggagctttaaatgtgaacggaaaaaaaccaattacacagtttgcatgtaaattgcgagacgaattttttgagcctaattgcgccatgatttgataatataatactacagtaaacatttgctaatgacagattaattaggcttaataaattcgtctcgcaatttacaggtggattatgtaatttgttttgttattagtctatatttaatacttcaaatatgtgtccgtatacgttaaaaaaaattggccaacgaactaaacacagccatcatcatggaatgttattaatcgcccaagactcacacgatgatgtcgactccgccactgcatacataactctacgcgagcaataatcatactccatccgtttctaaatactttgacaccattgactttttaagcacatgtttgaccgttcgtctttttt

SEQ ID NO: 65553 - DNA, 1303 bp, Oryza sativa
aaagaaaaggaaaaaggacttgttaaggtggagcagatggttagctgtgaataataaaattaaccggaaataacgctacataacggtcaggatggccgagtggtctaaggcgccagactcaagttctggtcctctaacgagggcgtgggttcaaatcccacttctgacattttgttttttgttatccgtatttattttatttagtcgagagtttcatacaaaccaaaattctccgaaacgaattcatatcgacagctcaaaaattttcaggagatttgtgcgacatttcttcatttcttttttgccctaatgggccgtaatccgaccaaacgaagcccaatcgaggcccatctttcacctgtgttgctgttgacgctctgtgagactgacctctccaatataggctgctgcttttccctccctaaaaataattcacgttgatatttttacttcctttttttcctggtatttcccttttttaaaaatcgatgaaatttgatgtgaaatcattatgacaccacaagttgacaacactagctcaaccaaaaatctgtatagttggacatgaaaattgatgataacacctatgccgcgcctcccatccatgcaacatttgccattttaaattatagagtccaatttctgatggaatctataaacgtgtcgggcctgttcactttaatgctattttcaacttttttttgttgtgataaagttgccaaaaaagtggttacatttagtttgctaccaaattttggtaactatatactaaaatttggtaaggttttttttatctaagtgaacacgtccgtcattttcaaagttcaaaaaatgccctatgaatttgcatgcacctctcaagaacaccaccaagataatgagaaggtactgtagaattctatggcgtgagctgagttggcaaaattgacgagtgacgacattgggtgggggagaaagttggagttgatcattcaagatccagaaagtccgtagaaataatcacgcaatataatacataaaagcatgctaattgctttcgtagaagtgctgcttttctctagctgaagatcttgcaaacaggtcacactaaccaaacgattgttacagaggacggatgggtacgtcactaatatttttttaaaaaatacgttgagaacactcccttaaccgcacgcttcaagagcctaagatgtgtttacgttagaataggctaatgtgttgtcaaaattcactggaacattataaatgtttggtaattaactaaatccatctgtatatttattattttttaaaatatagtatg

SEQ ID NO: 65554 - DNA, 2485 bp, Oryza sativa
gtgcacgccgcccctcccggttcgccgccgctagacggtacgagccgctcgccgccagccgtcggatcggccgcccggcctcccctccctttcctccatccaacgaaaactgtccacgtgggcttgaccgggtcaagctgacgccccgccagccagcccccccccccccctttgggcctcgccagccgttgggctgcgctgctccccggtccaatggactaaagtccacttatactccctcgtgccgagcccagtaccccccacccaaaagctaaagtccatctttgctcccttcccaaacacagtgaccaaaagtccatatctgttccctcccaattcacctctctctcaccatatgttggccccacatgtcaatgagtgataaaagaatattcttgagaatattcttttccataaaattcataaatcattgcctgcattccaaaaaaaaaagattcgacaaatcatttccttgtccagaaattccaattaaactcccaaaattcatatctcccgatccgtaattccgattaaccccgttccacttccagtattcccgtaaaatcgagatctatttaatggcaccattatctagtctaaataggatttttcttttggtcttttgtttaggtttttgattgtttgcgtatagttgcggttaccggattttcgtcgatcgcgggttttctcgaagattcgtgaagctccgtgaagaccttgagcaaggcaagtcaccctttgatcaattgctcctataattggaaaatcattattattttgtttgcaacttgcattagtagaatcacacacttaatttgcttggcctcggtttgcatgtcaaatcgacggacctacccagtagtcgcactaattcctgtaggttgtactaccctgattccttgtcgctccacccttgtggtacttcggtatttgtactctctgagtgcgtataccaaatatcccacatacaccgttgattgtcgaaaatttgggaaatgggtttgagaagccttgaaaacccgacatgtggtgtcggtgtgtttaaaaataaaatgaattatgaaaactcgcgatgcgggggttgtgcctatgtggcactgtcccgtattcgcatataaggaccgattcctgtgggaaactcatcgagcataatcaaagtgcaaccacaaggtggaatgggacaccctggctaagtaactagtcggttcagggaaacctcgcatgccaatagttgggaacgccggagcggggtctgttggagccaaaccgggttcctggtaagcaaggaagagaagcttgctgaattaccgatcgaggtggttggagtttgatttgtgaaaactaaaatggcctatatttatgtgaggattcgatccttctatgtggcatgaggtaaccctgggtcggcttgggaaaggctttgttgcgaacctccgataccgacgggtgttcggaataagttcgtatcttgtgggtaaagtgtacccctctgcagaggttaactaactgttcgaacagccgtgcccacggtcatgggtggatgtgaggtggttcccgttgcgtagatttgtttgcctgtgctttgtgaaaagttgttgtggtgttggaatcgtaaccagaatcagcctacgtggcagatggatgacctgagtggtcagaaacgaatctgtgtgattcgggatgtctgcgggcatcatagactaggcttcccgagtggaagcggattgctttgctgctgggcagctggactctgggagtccgagaaaatgaaaaaggctctgggagccgcttaatcaagtgaaatggctctgggagccgataagtaatgatatgacccgggaggtcggtacattaccatttgacttgttgaaaagcatctcttaagtcgaatcgagacacaagtctcttttcgatccaaactcaaaaagaaataaatcacttagtgttttcaaaatgatttcaaacaaaggatttgcaaaacaaccttgcctctcttccaagcttgcattaaacacctaaattcccgtgacttgctgagtacgaaagtactcacccttgctctatataaatatatatagttcccccgccttgaagtgaagtgaagattagggtttcgtcctggttcccagccatcgcctgtggtgttgggtgttagtccgttggttccgctgctgctgctgttgttggtgtttcctcgtccatgtcgtcggttgcattctcgggctgttctgagctgcaacctaagttaaggtaaataagtcatctatttattttaaggattttcaatgattcatatttgtcaccatggataccagcactatggtcctgggactggtaccgagatcgcggtttcgtaggaagcggttcgcgccgttattcctacgacacgctcctatcaggtgacgttgtacggcggtgccggattggggtgtgacagttcccctccaagtcaacacatgttggcatcagctgcgttgtgttttag

SEQ ID NO: 65555 - DNA, 6159 bp, Oryza sativa
tgacggcggcggcgcgtggagaaggagaagaggggggagaaaatggaggggatgggtgtggggtggagaagaggaggggccgggttttataagggcatgggggaggggcgggcggcctcgtggcgacgcgacgggcggcgcggctggcggtgatggcgacggtcgggcggcgcggcgcggggctcggcgcggctcggcacggggctcggcgcgacggtgacggcgatgcgacgacgacgcggcgcggggcgcgaggcggcgacgcgacgggcggccgaaggcgacggcgcggcagcggcgacgcgacgggcgggcggccgacggcgacggcgcggcagcggcgacgcgacggactggcggcgatgggacggccgatggcgacggcgacggcgatgacgatgatgcgcggcgacgggacggcggcgcggggctcagggcggccacgcgcggggcagaggggaggggttagggctagtgacctcaatcgaacacctatggggcaatgaacagtgacttttcctatttttccaatttggttgattttcctattcaaatcttgtcccaatatttctaatttttgcacaaatcaagtttacacaatatttgtgttgctctaacctagattatcactacccatattttatttttatcattatttttatatttaatttattcgaatttaattagggttaattcttattccatcgcacccaaatttaattgttaccaatatggtcgtgataatattttatttatttccaacctcacctaatctttattttaattagttattttgccaatttaattttagtgtttattcctaattaattattccttattcacgatcggtaaactttgaaaccaaattccaataaaataggccaataaaatcggcatgatgcaatttattaaaaagttttttgaaggcccatattttcagagtgttacacattattaagctaaatgtgtgagattttatttcttctggggtaaattaatagtccaaaaggtggaggcaaggcactagtcgaattgttgtatcaaaggttgatcttgcagattgctccatgtatatatatatgctcttccttttaagagtagtttaactagaccaacattgctaataatctcaataaaatattatatcattcatatctcccctatgcaaaattttgttctcttttgacctgataaaattaaaatcttccaagaaaattcaattttggtcatcatccacctcaatatcgttcagcttggtgacgaagtcatcccttagctcgccagcacatgtacataaatgtttgtcaaattccaggtttctgataagtttgaatttgaggtaaactgaattaggattgcataagtaaactcgtaagaacgttgcaacgtaactaataatggaactattccaaatcactatcagagctccttattttacccttgggaagaaggaagggtagtttgcaaacttatcaaatcttctaggacaaaattttcttaagaatgatgaaattctctctctctttaatttacctgcagacacatgattacacaagagctatccgctatcttttcagacagtgccagaattaattcctctcgcattctaacagagagaatattacactcacgttattttgacttatattcattataatcatcacacaagtccagacaaaggagagtgaaaacgtgtaggcatgtatatcacgaggtgtattcatgggcggcgcacacccaggtgtgcatgggcatctctcgatctcaagattcttaacctggagattgccctagagatatcctactcgatggacataaattgggtgtcaggtagttgtaatcaatcttccaagccgtagattgagacgtacggcgtatgaaggagacgagaaaaacatggggataatgcagaggtgacacgcgattggagaagacgagtcggcagtgcaatgcaaacacaattagcttcatccaattcatcacaaatcaatcagtagcccagctagttcagtccacatcgaaaaataatagtgactccatttgctgagcttccgtaaaaaaattaggtttctcagcttcttgctttaatttttttttttgggaaagcaatagtaaaagtttagttttttcagcctttttattgtctaaattttataactgtcaagtctctcgatgagaatattaaatctgaagtatttagcaagctaagatttttaaaaagagctagctactataggctcttcaaacagaactagaatcacctgtggttcctaacaaaatgcttcaccacatacaccaagaaccatattggaggatcacaattttgagcttccaattctatgtatgtaccttgttgattatcccgaagatcatttctagcacacatgtctatgtagtattttagaatttatgtgcggtggaattgtggattataatagaggcctatgtttggtggtgttcttttctcttgaagataaagatgaagatgaagattaagttttttacgtaaaacgaggtagtattaacataagattgattgagttttaattattacaaaattcaaaaacagattaatatatatgatattttagagcaactttcatataaaaagtttttacacgaaacgcaccgtttaacagtttgaaaagcatgccataaaaatcttaatcttcatcaaactcttgttcgagaaaagaacgggaccttagccctgctttaaaagatatttgatcaaggtaaattcttaaaattgatgctgaaatcattctagtggaatgatgcattaagaccatcactttctcttaattagggctaagctataactaaattttgtgatgttacaatattggcatgttctgccatgtcgtgccctctctttacgagagaatcccttatatgccactgaaaatttgtctgatcccttgaatgccactgaaaattggctcttcccttatatgccattggtttaaattttcgctccctctcatcattgccgtccgttgactagtagttgactgttgataggatgtaatcacttgtcatttttttacagaaatgacaaaaataccctttggcccaaacatgagaatatggcccaatcgtccaagtgggccaagcccaacatccctctgatgcaccatgtcagatgtcagtaagcctgaacatgtattttggtactgtgtcagtatgcattttggtactctgtggtcatttaaacagctccctataatatttgttgcatattctgtgctactgtgtatatctccttgctctagcaaacaatctgtttgttatttttgctgtttagccgtgcattacaaacaatgtgcaattacacattatcttaaatgtctgtcagaagcaatctattatattgcttgaatgttttgtcatactgtgaaaaacagagaaatgttgtgctccctagtaaatattgttgaagcttttgttcgagaagtacgtacatggttaatgtatgtggaaaatacattaatgccataacagattgctttgttctactatgaaaaacagagaaatatgtgcctcaaaattatgtgactgaaaaatattcatatattcaatatatagattaatgctatacattcatatattcatttattccaaatatatgtgatgcctagctaaaatgtagtatataactgacatactaacacctactgcatgcctatcaactcaagaagggcaaatacgtcatttcactctacagttaacagtcaactaccagtcaacggacggtagtggcatgagagggagcgaaaatttgaaccaatggcatataaggaaagagccaatttttagtggcatccaagggatcagacaaattttcagtggcatataagggattctctctttatttatattgtcctcatgggtacctgcctaacttgtacctggcctagggatggacagctcgtctccacaacatttacatttacgacaaaattgaggagatcatgtcaaggatttattgctgaatgaacacacaatgctgctaccacctaatccatccattgcaaaaatataaacatgtttaattcaaaatctatactctctgtctcaatataaattcatttctatcactttaattttctcccaaaataagtgcattcataaaatactacatattccaccaatcatttcttatttaattttctctccatcttacccccaaccaatctacacttttaaccatccctttcttaattgggggcatataagtcatttttctttcctactactaatttgtgcttcatgtgctagaaatgcacttatttagagatggaggtagtatcataatataaacatttgtggagtactactcagaaatccatacattttcaaccaatcatgtgtttggaaggggaatataagcaattcaaaattcataattggccacttagactaaaagagaatatttttctattaacataatatattttggaactaactaatagattaattagttaaaaatatatattttagaaaatccatatttctagtcgaagtcacgaaaaatcatgaatattgtgagtttcacactcctccctttgtttaaatctcaattgattttaccatattcaaacaattattcaaagtagccaagatcgaaacaaataaagttaattggtaaccaataattaaatttctatagataaattgtggcatgaacatttatatgtccaaaagtcatattttttagacgttatacagaggttggaatttttttagactcgtcaccacaacaccatggttaattatattccacatgttataataattgggtttagaaaaatatgtaatacccgggttacgtttaatgcaagttaacaatattaacatgtggttttataagagaaagttatataatataggtgatggctacctctttaattttatccacaccatctctactgattaatttaagttaatatacataatacagaataatgtatcagaaataacgaacatatatacaacgatacatcacaatgatttaccattgaatcataagcaatagaaacagtttgcatgctaaccgtttagggccctttgttggaatgataaaacggaggaatagaaaaaaaaaacacaattgtgataggaaagcaaatacaaaacattgaaaaacataggagtgaaatttgattgaaccacataaaaaatataggaatcaaatgacagaaatggactcaaagaaaatttttcaataggttgaagctcttgctaattttttttctaaaatctctacagaattgtccaatcgataggaaattcaaaggataaggtgtgattcaattctttaattctttgtttgaaagatcttcataaaacattttctacagtatttcaatactccaaaatttccagcatgctttttctctaaatcaattagtgatgggtcggcctgcataggtgaccagccacctcccaacttataaaagttgctgccaaaatttaattttatggttttttaagtcgtagtttatttttaaatatatatttaaataatcaaaacaggtatgtaaaaattttatcattgaattattttaattttgtcggcttatagttatgtatattgcaaagcaacggggctggccaagatagcttatgcgcgtggtttttattcatctgctttaaacatgtaaaataatttatgccactttgatttcatcttaccgttatggcctatatatatacggaatatggattaaccgtactccattatattcaagatttgcatacaactatcactgttccatcacgctaattcttgctaactcttatttcattcatttttccagtcattggattattgcgcctcaaacttctaaaaatacatttttctactgtattatttagaccatattttagctatttctaagtttatttctcaaatatttaatttatctcaataattaaatggataatctatggaaataattaattaaaatatatcttccaaacgggacctaacttaaattaaacttgtctattcagccattaattaaggtcgccaaatactccaatcatgggtgcagatccctggagttggtgccaaattcaccgggtggatttcaacagatctgaaccattagtttctttctaggagctagaaatagccacgtcaccttctttttt

SEQ ID NO: 65556 - DNA, 57129 bp, Oryza sativa
  unsure (1)..(57129): unsure at all n locations
ataatctatggaaataattaattaaaatatatcttccaaacgggacctaacttaaattaaacttgtctattcagccattaattaaggtcgccaaatactccaatcatgggtgcagatccctggagttggtgccaaattcaccgggtggatttcaacagatctgaaccattagtttctttctaggagctagaaatagccacgtcaccttcttttttgcctaatcctatgtacgaggactgaagcataccaaaattttttaccaatctcttgatatgacattaagacattgtatagaagcatcagaatgagtacaaaatttccttcacgcggttcataatgattaatcatggcgttttgatttgctatgcccgtgccgatgtgctatatacttaaagttaaatggcataacaaatgtaacatgcatgtccgatgttttcaatcaactagcggtaatattacaatatccattccctaggaaatatatatctaactactcatattattcgatctgctcctgatgtgtgttatattccagaaaaaaaaagtaattatttgggatgtggtgtccactcgtgtagatggggagaagtaacttgcttaatcttatccgttgaaatcaaacaattgcttggatcacctgaaatacatcgggtggatttggaacgtactccaggggatctgcacccctccaatcatatcacgacaaattaggtgaatggagcagactcaacgacgtgatgctttcaatctttggttcttcctttctgttttgacagcggtgcatttttcttatctaccaaggtcctatctgtaaaaaaggcgatcccaggtatttctcaccaatggacttccaggtttgttggtggatgatattttaagaaataaacaattaaaaatcaaatttaacaaaacaacatatatttggagaaaatatcacattactacccccaccgttaaaaaaattacactcacagttcaacaacttaacgggtgggtgagatgtagtacatggacttaaaaattcttagcacagtaagtgtgtagtataataacttgacaattcagtattttttttcaagcaacttagctaagtatgtgatgttttggttaacgattgctaggtgacttcttttcacgatgtcaatatatatgccatcacatagcagttctacggatattaccttatagtattaaatttaatctttaagaattacattgcacattcaatttgcactactagtttggattttttttctctgacttctcaaatgtagacaaaaatataatattttatacatagtaaagtttaatcaacttttagttatcagaacaaaaattgaaatatacttacacaaatctgcgctagtatattgtcaaaataagtacttaaaaattgaatatgtataaaaaaatactcgaagaattaaattgtcgcatcacttcttaacatagggtgtgtttggtttatggcgaaggaggctagggctgagatgggaaacacaccagtgagaaaaaaaaaagaaaggatgggaaatgagaggaattgagagatggaagaggtgaacgtatgctctttttatttatcacgtgtgtcgcctgtcgcagggccagttcatccgaccgattcaatcggatgcaaaccatcccgcttctatagagaatattctctatgtggtgaccatatcccactcccacccttcaaccaaacacgtctaaaaaataggcgaccatatcctatccagacaaatcctattgtataaaaattagcacccaccttacgaatcattatactcatacactcacttataaagtttttacacttaaattgcaccttcagttgtccaaatgggacgggcccaaccatgtcggcctagacaggaaggaactgtggggactacctatgcatttatcgacaaatttttcctcaaaaatttgacagatgtaattatagtacaatcgtagtgtaattacactgtaacttacatataactacactgtaacttatatgtaagtttcacataattttgaatcgttagatctattacaagatttgttttggtgaggaagaaaacaaatcatagcacacacatgtgaaagaatttgttcccatgaccttcattttaccgaaataacatgttacggagagatttttgaaagttacatacaagttaaactatagttgcagtataattacatgtaagttacagtgtaattacactgcgattgtactgtaattacatctgtcaaatttttgagggaaaatttgtcgacaaatatatagcaaaatcggaacggtgggagcccatggcccggccgggccgtgccgtggttgggcctccaccccggcacggcgtggtagcacggcacagcaaagctgcacctgcgcagcgcagccttcctctcagccctgacgccgggagtagccacgaccgccgccagtgaacctagtagttttagtccgttgggatgaagtaggcagcacggcagcaacctcgtttttgtgggccaaacgtgccacttctagccccatgggccaatttttgcccggcccggcccggcccagcacagcatggcctgccaaagaattgggccatgcttgggctcttagctcagcacgtgggctggcactgcacgcccgttggaataagttcactttaggtccttctatttgtcgcccagtcctatttttgtcccttagaccgcaaaaccgggtataacccgtccccaacttatgaacaccgggtaaacgtggtccctcggtggttttgaatgcggttttggctgacgtggtgcctacgtggcttgtttgactaggtctccgtcccacgtggtattgatgtggcgcttacgtggcaattatatctcggaaaaataataaaaagcgtggccccacatgttagctgaaaaaaaagtaattttaaaatggtggggcccaccacatgtcagcctcactcctctcttattccctctcccttctctctcttctttcctttcccctttctctctctccttgccgggcagcagacggcgcgggtcggcggcggagcaacgcgagctccggcgacggcggcgggcgtggtcggtgccccaccccccgagcggagtgccgccagtctgcgtgaagacgagcagcgcggcggcgccctggaagatggcgatgaggacgacgaggagtgggagagccgagagggggaagggaacgacgaggaggacttccttgttgggtccgcctggggcgccgccgcgatggcggtggcagccgtcgcgccgccaccttcttctctggcgtagtgctcgctgctggggaggccccccggaatccgacgccgccatctgtgtcgccgccgccgaccacccggacgccctcctctcgccgccgctccctcctctctcgccgccggcgccgccgcgcgccgctccctcctgtcccgccgccgcacgctgctccctcttctcccgctggcggccatcggggagaagggcgacggatggctaggcgagcggcgcaagagagagatagccgtcgccgccccacgcgcctcgcgcgccgtcgcccaccgccggtgatgcgctgtccgtcgctatgccgcccgccgctgccacgctgtccgccgccgcccgctgtgctggacgccgcccggcgagaggaggaagcagagagatggggagaggcggagagaggaggaagaagaggattggatttggtcattttgagaatgacatttggggtccacgtgggcctcaccattttttttttagctaacatgtgagacgcaccattttaaaattatttttggtgtgcagctgacatgtgggatgacgatttttattatttttccgagatatattaccacatcaacgccacatcaataccccgtgggatggagaactagtcaaacaagccatgtaagcgtcacgttagccaaaaccgccttcaaaaccgccaagggacctcgtttgcctggttttcggaagttgggggacgggtcgtacccggttttgtagtcaagggacgaaaatcggactggacgacaaatagagagacccaaagtgaacttattccacgcccgtttcattgggatttaagtgcactttaggtccctcgtcttaacgttgagtttgaatttcgacctcgaacaaccatactagaaatatcgcgtctatcaacttgcaaatctggtgtacccaacctccaaatcaatatactatctggttttttttttacgtgactagtgggccccacatatcaggcctatttcttcttcctccaacctcccctctctcttcatctccgattccccatctcccgaactactactccattgctactgcctgttcctcccagtcagcggaagtgtactagtggatattacatttgcgagttccttaggatcaataggagataatgtatggtttatggagctgtaagtacaaatcatcaatacgttaattaaattaattgctaacaatattcattgctatgattgtgatgcaccttccaaaatttctcaagagtgaaagggagctggatgatgaagccattcagaacatacaacgagacatgtggtatttcatacaccatgaggcaaacttgttgtcaccagcttgggagaaattttttatataaaggagagtctttgaacttcccaaaaaacgagtgtcttactaactgcagtaagagtataatttcaatttcacatacgcgtcatcggtcgagctataagacattgaagtactcggatatgatcgtccaatatctatgaacatataagtgcttcacaattatgtgggttaattaattaataccttccattaattatcgtgtcttgatttatatattgcgcatgtatattaattgcaagcaataataagaaaacatttatcatcgattgctcgatcgataaatatatcctctaagtgtgattcccaaatatgcgaacaaactaaatagattatcaaattttgcaaaaaaaaaaaaatcttcgcaggcgggtcctgtatcatctaagcaactggcgaagtgcatttttactagcgggccatgtagcttaagtgcgctagcgaaggtcattttcgctggtggtcgttataaagcagccgccaacaataacggtctttgctggcggctgcattatgatgcccgcctgcgaaaatgcatcttatgctcgcggtctgttgtcaccagcgaagatgacgcatcttcactgccctttgatctctgacgaagcagtagaccgccagcaaaaaatctgttttggccgccataaaaaatgtttttcatagtagcagtgtagggagcatggtgtggcgcgatgcagctctaagggtgcgtttggttcccgatcaaggttggatgggatatggcggtccatattttgctggatatgacgatccagttttttatttggtggagtggatatggcgatccagttttttgtttggttataaggaagaagatggatttggtgatctttttttttatggttggaggagtaggatggatgagtggttgcaatcaccctttcattagaggtggtgagtatacccccttgaaattcacctaacccaaaaaatatatcaatcactacaaacaaaaaatatctaaataaaataaaaaatcagaaagaaatagaaggagaatggagaagaaggaaaaaaagaaaattggtcctcttcgccgaccgctgtcgcgcctactctcccacccgccggccgccaccgcacctcctctcccgccgcctcctccaggtccagtcgtcatccctagctatcccactcctgcccacaaactaaacacccataaaaaatgggcctccatgtgttctatccacccaaaaccctccatccaaacacacagtgagtgcaatgatcgtgcgtatcataatatgcgcacgcgatgatcgcgcgcgtcataatatgggcacggaacagcacaatgtaggcaacagatatatgatttcgtcaagcctgggaccaagatttattatgaaaaggagaaatatttaaattgaaattttataactgcatatttctccatttcatattatacgtccataatatttccctgcttcatatcataagatttttggcttttttttttctagtcaagcttccttaaatttgatcaaatttatagaaaatatgatagtattttagcacaaaacaaacatattatcaaaatatattcaatgatagattaatgaaactaatttaatatttatatgttactaaatttttctataaaattggtcaaacataaataataaattttgacaaaaaaaagtcaaacgagttatataatatgaacctgggaggttactatttatcaagtattcccatacatgtatatatagtcatcgtcaccaaagagaaaaggatttaaacattttaaagaaagacatatatgcaagattaagaactgaacaacaactaaaaaatgtacaaagtatatatataactacatatctgcctggtaaaaattacagtacacgaagaaaatgtaatgcaaaaaatacaaatcaacattataaacattaaaggaatcaatctctcaagaattcatccatctcctcgatggaaggcatgacgtccaggaaaccgccgtcgtcgacgttccgccttagccaccgtctcggcgccggcggcggcacgacgtggcgatgatggcctgttcgccgccgccggcttccctcctcctccggcgaggccgtcgccgccgtggagtccttcccggtgaggctctgcacgacggacttgaactccgcggcgtcggcctcgacgaacctggtcacgatgtacttcaccgtcatgggcttcacctcctccattctcaaactaggattagctagcaacacttaatttgcaacagatgaaatgctactaatccgaacgtacgttcttaactctcacttcatccctgacttatatagagctggcttactctttcccggtcagatttgtggttggtgcatgcatgtacagagagagagagacagtgacagagggagataattttgactttgtgacgataaagtagaagactgggcaaggacgcagtcatgttcatgtatgctgagctcggtcagggatagggattgggtgcagaccaaagatcaaccccctagtccatgctgcaaaagtatcataaatggcttagcacaatttgacttgaacagcagtacaagtggtcgattggaccttttcctctcacttttgggatttgaccatgttgagagaaaggtattacctgtgttcttatattttatatatgtatgatgatgattgtcaactgtaaagaaatttgatattgaaacagttttcaaagtacctttttatataatttctttcaaattaaatatatatatagtgttgtcaacttttggacataagaccatacatcttattttaaaaactatgtaaatattatttagtttgttctgacttattttactagtcaaggtactttaatttaaggataaattatacttctacttatctgtattaaaatttcgaattagatgaattgtcaaactttatgtcctaaagacaacagtgtcatttatttaaaattgaagtataatcataataactagtaaattaaatctacagtattatggaattaccttttgagcccggtgtgtacacgtagattttgatccattccataaaaatagttcaaaagatcaatatagttaatttgatgcatcatcaaaactatagtccaaatcaaaattttcgtaacttgtttttgtaaatatattagtactatgacattacgattatatttttatgacaacactaggaacatatttcttgatgtataggcaaactttaagcatatcgattatatattcttgaatattaagtttaataacacatgaaaatggtatgagccatagaaactaaactgttgtaaaattaatttactatcattcataatccgaagctctagtcgtcgttttttatgcatcaccactactacttttgatgcttgtatatatgatagatataataatttggatgtagtatggtttaattcggtcaaaaatctatatagatcgttatttgtgacgtcactttctttaaatatgattaatctcctagctcgtgttgacttttgtaatcttgtgttttgactggagatgttatatatgcagcgccgtttacgacagtgcgactcgacgccgttcatgcatggacaattcttgcatgcgaagcagcgaaagcctttcttgcatactcctacggaaaaagtacaccaaagatctctcaacttgtcatcgaattacaaaatcgtctcccccaaccgtaaaaccaaatatataacatcccttaacttacaaaactgtttgttttacatctttcgatggttttgaccattgttttgtccgacgtgacggacgagccagcgtaggacccacatgagccctaaatgttaggacgccacgtcatcaggctctctctttcccctcctctcccttcctcctctctccctctctcgaaaacgctttgcatctgccgtccgacggaacgaaaagtatcggacgcttccgtcctaccgcgccacgcagtcaacgctgaaacatatcggcgtccatccatccaaacttatccatccatgtaataattcctctctcctctagccttctcgtattctcctttttctctttgcttcaactaccaacgctgcgccacttttctcaaataaagatgctattagatggcaggatgaggagctagatggagtaagagtcaggccgggcatggatgccaggggagtcgcgagagatggcgacgcatcgccgacggccacaccgcagcatcggcggccgggcaaggcggcgcggggtagggaggaggtgctggatcttggcggcggccacacggcagtggcagaggtggcatggcaggggcatagggtgatgtgggatagggtggaggtggtggacctcgccgctggctgcgacggcggctaggcacagcgacgtgggatggggaggaggtgttggatctaggtgctgatgcggctagcctaggccctggccggagtccgcctacctcgcgctgtcacctccctccgccgcattggtggttgtggtggccggagtagaagaagaagatagaggtcggttcattttgccagagtttttagcgaggttgcaccatattatttttcctgttgcactttattgcattaaagcgtttcattttattttgattcgatgttgcatgtattgattcttcgtgtttgccattggtatgtgtttgaatattgtatttgcccttgtcctcgtctaacaccatcaccttatttgtctctcccatgccgatcgcttgtttccggtggccggattagaagaagatagaggtaggttttgtttgagaattttttggtaatgttgcagcttatttattattttttttactttattgtattaaggtgtttcattttgttttgactggatgttgcatgaattgatttcttggtattgcaatcagtattgttgaatgttgcatttggttgaaacaattttgctcaagcgtttgaaacatttttctctgatagtgaaacatctgaaacattttcattgaaacaatttttaccgagcggtgaaacatgtgaaacattcttcaataatacggtgcaacaccgtccgatctgtagcagcctcctctttcactcactcatctccctctgggcaggccggccggcgaggggtagatgttgtgtgctgggcgtggcgacagtgctgcacggacccacggttgaccgctgcttccaccctcgccactggaccatgctccgggagaacgcccccacagcatccacccctcgccgccgcttccgcaacgtctgcactagcaaatccgtagaggtagacctccccgagctcgatggacactacgtcttcgtccccaaaggcgagggcctcctcctcctcgtcgacaagcgcacgtccgtcgtccgcctgctcaacccgctcacgcgcgcgccacctcgcggagctcccgccgctcatcccgttgcttgaccacggcaccagcaatggtatcttgattctgatggtaataatctccggtaggacacttacatggatatattcatgggtttaagtgccggcctcgccgacgacgctacaatcgccttgcatgccttcaagcccaagatcatgctcggcgtcggccgttgccaagctgcgcgacgaacgatggacgttgccccataagggcaaatcgttcatgtcaaccatatcattcgatggctgcttctactgcgccacaagccgagctgtcttggtagtggagaccggggctgacaaagaagaaaaccacggaccggcgccgtggctggtggtggcagctcccggcgacctcctccccaccacctcaccggccttctccgcccgacgccgcctcaccggcttcgcgccgtgctgctccacatcgccatcgtcccactccgcccgccgccgtgctcgatctccccgtgctcccgccgccgcctcccttcccttctcttgtgtcgccgccgctgcatcaccggctagccatcggacctcctcgtccagacgacctcccccccaatgccggccgacctgcctaaggggagatgagtgagagagagagagaggaggaagggagaggagaggaaagagatagcctaatgacgtggcgttctgacatgtgggcccatgtgggtcccacgttgactcaccgtcacgtcggacaaactgggccaaaaccacccaagcatgtaaaacgaatggttttgtaagttaagagatggtatatatatgattttatggttggggcatgattttgtaattcgatgacaagttgaggtaccgaaggtgtattttttcctactcctatttgtgttcatacttcggagttcaactcgtcatatggcctccccgcaccggaatatgggcttgatgccgattgggctagcatatggaatatactcccgacagattattgggctgggtatcaaattttacatcctagcactctccacaggaacccaatttccaaaggggcaattgagttattgccctacttcgatatccaaaattgattttgcccatgttttttattttttcgattttacccctaattttttgaaatgaaacagtcgtttgcccatgttccgttaattcttactaaccgtgttaaatgtaggggtaaaaagacaagtatatccttagatattttcctgtacttttgacataatcaaaatacaaatctatttgatgccatactatagcagtaaatttatcaaaattttgtgaaagtttgccaaaatttgggacaaatttgaaagtggtgtacaaaagtaccggaaattatccaagggtatacttgtcctttttaccccacatttaacaccattagcaagaattaatggaatatgggcaaacggctattgcgtttaaaaaagtagggggaaaaacgaaaaccctaaaaaggcaaaatcaatattggacctcgaagtaggggccagaatgaaattgccccatttctaaaaggctattttaaatcggaaaaggtctgatcattcctcaaaaataaactgtgtatagagcgtctcacaactatcaaaaccaaatcaagtccctcggttgttttagcggtgattttctcctacgtggcatctacattgatctattttttatttgatgcaacacttatgtgtgattaccgctaaaaatgtgatgggatctatatgtcagtgcaaaaaaaactcaaaataatctgtcacacaaatgttagccacatgtaaaaattatttttttttaaaaaaaatctctattccctctccctcctccttggtcctcccctctccattcttgccccgtccacagtgcaccaacaacaccactgtgcgagaccgcgcgccccagcgagtctacctctgtgtgggaccaatacgacctcagcatcgcgccagcaccattctacgctacaagattgtcatgcgtgtaactaatgcggttgcgtctgcttacacccccttactctttttgtgcgagttcggcatgcccagctctgctcgaataactttttcttcctagatgcccagttcgccttcatgtaacccaatgcgtcagcctccttctaccgccggccccgaccggggtaccaaggagagaggtagagatactttttttctcatgtgagtgatatgggttccataaattcattcaatttttacgatataattaccactcacgtgtgggtctttttttattttcttatttttctcaatgacaataaatacatgtaagcgctacgtcagacgaaaactaggtcaacttctcacatagataccatgtagaatgaaaccgtcaaacgactggatttacacttgtgttttgatagtttgtgggcgctatatacacgtaggggtgggcatatttagaccgaaccgaaaaaccaaaccgaaaagaccgagaccgaaaagaccgagaccgagaaattcggttatctattcggtcccagccctcaaaagaccgaatttatttcggtcatttcggttattaggctcgatcggttaaccgaattaaccgaaatgaccgaaattttggcccaatagacctaggaagcccaataagcccactaaaataaaccctagaagtgatactagccctactactagtgcagcctcctcctccagcccccaccacgccgccgcctcctcctccagcccccaccgcgccgccgccgccggctccaccctccaccgcgccgccgccgcctccaccctcccctgcgccgcggcccgcctccgccctccaccgcgcggtcgccgccgccgtcctccaccgcacgaccggcgccgccgtcctccaccgcgccgcggccgatgccgccgtcctcgactgtgcggcggcagccgccgtcctccaccgcgcggcggccgacaccgtcctccaccgcaccgcggccggcgccgtcctccaccgcgccgtggccgacgccgacgccgccgtcctccactgcgccatggccgctttttcgttccaaactctcctcaaaaatttcggtcagaccgagaccgagaccgaatttgccggtcctgagtttttttggatgaaattcggtcctgagtttgcgaagaccgaactgaccaaaaaaccgaagaccgagaccgaatttttcggtctgaccaaacgcccacccctatatacacggatttacggtgagaaacacgcataaaaacatggactttttcattttaaatgcatttctaaaaagacaagtatatgacgtcatccaattatcatcatagtactctttaactaattttctatgacaaattaaacttcaaagcagtttacctcacatatcctccaacttctaaactagacctcttaattaattagcaggccccttatccatagtggtaacacatacaaaatgtgaagaatatgggtaccaggtatctacatggcctgtctaaacaactagggataggaggtggaccatatccatatactatgtaataaagtcctcaattgccatgttgccttatatcacacggcaaggtatagatactggctaaataataccttgaaacagaagtcgaagtcgtatctaaataggttttccatttttataaccgccaatctatgtaaggtgggcaggtgggcagggagccccttaagggcaacccagacataacattcagaaactggcagatacaatccaacaaacatgagtagggctaaaccttgagagggccaaaacctatataaatctttatttcctgcatccatccacttttagatcccgtacactatctcctttattattaccaataaaaacactggcacaaaacggtattgttaaaaaactgtcacatgttttttgggcaaaaaaactttcaaatgtaactgtagtatagttgtagtataactacaatgtaattacactatagttacattgtaactacagtgtaattgcactgtaactatattgtaatctctatataatttagatataaagttgcatatattattttaatacttacatacaagatattatagttatagtttaattatattacaattatattatagttagatttgaaagttttccttaaaaacttacagcagttttttagatagtcccacacaaaattccaataatcattatactggagtagaaatgtacctactcctcactgttgccttatataatcacaccacagtccacactgccatcacaactcacaagtgaccatctctctaacaagcaaacccatgcacacagctgatgggcaacatgctaacatgcttggccaattattccacagccacttcaaccatgaacaccaccatccggccacagaattctcactgctccatcgagcttcttctcacaaaaaccatccacatcatgaagcggcggcgccgacgacggcgccgcaataacaacaaggagacaccaccggtaggagatcgccggagagcgccgccgcagagcgccatggccaccccaagagctctgtttcttcagaggaagattcgtgatggcagcgagaagaagcaattacctgcagcagcaggcgtcgtcagggtcaaggtcgtcctgacgaggaaacaagcggcgcggctcgtctccctcgccggcgaggggaggaggaggaggaccgccgcgcagcttgtccgcgagctgaggaggatggaggacggcgccggccgtgtcgatggctcgccggcgacggcgacggcgacggcgtggaggccagtgctcgagaccatctccgaggagtggtaataatgtcaaatgtattatgtataaataatgtgtgtttgtgcatgcttgtacagtgtgcatgcctgcatgttagttatgtagtaagattcttttttctttgtatggtttggtcgtcaatttaggttgggttcagaggtgaggtaaacagcacaatatctactatccctcccatatgtatgtacccagattcgtgagacatattacatggtaaattggtcatggacaggtggatataatgttcatcatgctgggagacggaaaaaataagaaacaagaggatatgttgtctacttgtctcgaagaatgaaaacactttcccatcacgctgtggtgctagctacggagtactaactagatactgtatttcccttctttctgtccttgaacttctgatttgttcttcatatgtcatcactactggagaaactatcttttttcgtgggttggccaaaaatcacaataatcctggtccaaaaatcgagactaaaaaccatttttagtcccgattcaaaagcccggggatacgttttatctttagtgtcccggttgtttataccaacggggaccaaaattgaaataaaacggattgaaaaaaaaggcagccgcactcccttggcaaccgcgcgtctcgagtcttcttatcccttcgctactactcatcctcttctatccgatttctttctctccttctcactcctctcctcctcctctcgatttctctcctctagagtgcagggcggcggcaggccgtggcgggtggtggtgcacggcgggtgggcgggcggaggggacgacggcggcaggcggaggggagggcggtggcaagcggtgggcgggcggaggggaggatggtggcaggtgcagggtgggagggcagaggggtgcgcagcggcaggcggcggcctggcgggcgtagggaagggcggcgatggcccggaggggtcattggcaaccaccgaatgctgcgccggatatgacgatgtgttgtttttgtgatatacttttaaatgtgtggtgctgttgtagatttattttattgatgtttttgtgaatttgtgaatgattaatttttgttgttgagtatgtgaatctgtgataccaattatctgtgaatgtttatttaatctgtgagtttggtgcgaaatcaatatgcaaacaaaaaaacaatgaaaaaaaaacctttagtagatggtagtgtcacgtgggggtgctaacatctttagtcctggttgatgttatcaatcgagactaaagatctatttttagtcccgattattttaaacgtttcgaattggtagtcccagataagtacccaggagtaaaagaggttctgaattggaagtaaagatgggttttccgaaatgttagtgttgtttggtgagcacaatacggtttgtactacagatcgatctagagaattatttgcattatttaatgaaacggataaaacttctgccatgcatctttgttccaaaatatatgtttcaaatacaaaaaaaaaacaattactctattataaattgagcgtgcaaaatgtatcttgttttgtttatgggttagctagcctaacttactaattctcttgtatatatgcacgctttggcttcttcgtagcatcaacactttgcagggttggtggactgatcgaaaccataacaaatgcttacatttttaatggtgaagaagcgtaacttatggaattggtttataattgattaatttaattttgtaggagcatgtacgcataatttttgtttaatttgctttggaagaagacagaaacggcgttgtatagtagtacgtgtgttggtagtagtgggctaagaggaatctctcgttaattttgtccttgctgagtgttgtggttgttggttgattgagttggtacgtagcgcatggacagacaggggtcaacagcgaaacttaacattaattgtttaattaattagcaaaagatttgtttaatctttcacatttactactagtatgtagcaagtggtggcaggaagttgtgcatacgtacgtgcagattctttccctgtagaatgggggataatgttaggttatatgatgtattttttgtgatgtttagtttctaagaaaatgatagcttatattatattggattcgatcagggcgtagttagctatagagtaaattccctgtgtatccctgaaaactcacttaatccctttcatgcccctgaaatttacccgtcccttcaatacctctaaaatttcaacctcatctctttcatgcccttaccgttacatttttattcatttcactattacgtttggtgcaaatgtcttttttacccttgatgctttaagtttaaatataagcttgaaaaatgattgaaaattttatttgagtgcacagtatgtgcattttataaaactaatgggactaaataattagtgcagaaaattttgacataaattttgaaaataaaacaaatgtaataaattaaattttttatttgaaattttaataagacaatggattttttttatcgggagcattcatacaacaattattgtgagcacgggtagtcctatctttctaggaatgcttctcttttttatgactttttttaaaaaataaatacatatttttttatttcattatctaaaaataaattttaggataaataatgcaccgcacaacaaactcataactataatagtctcatgcgacaaacttttatatttttgataatgtaattaataaatttctatgtttatctaaagagtaaaatagttatttttatagaaattagacagccaactaacggttaaatgacggcatgggtatggaagggatcaaaatcaaattttgagggtacataaggaagtaaataaaattcaggggcataaaagggattaactaaaaattcaggggtatacaagaattttctcattatagagtatacaagggattttctcttaattatagcggggttaggagcaattagaaacagttatgtaataagaaaaacagtgcttgcgtattagtgaaccaaaaacagtgattgcgtattaccctgccagggtatacataccctgcttcatcagaagggagataagaaattaagaaataatgatagatgaacgaaacagatgacgtatagtccatagccatcaatcccattattaattagcaaaagtgcaaaacaactgcacaagtgacgtattgtagtaccatagtcgtccacgtcggcaaaaatttcgggtatcacggtcaatttactattcgtttggcaagtttgacaccgcaaatttgtggaattagttacgagattatggtgaaacttagttttggctttgctctcagaagtcacgaggcagaaagttgctgagatttggcagttttctcaatttttttaagcattaatcttggctaacaggcaacatgatcgagttacgtacactactaagcatacgtccactgtccacaaaacacaaggatatatgcttcactgtgtacttacactgtagggttttctttaagaaaaaaaaaaggcgataagaacgagaaatttgtctccttatctgttggacctattattttcaatgaaagatagccaatgataactaaacgaatggatgattcataattggtggcgatgacgatggtaatgataattatatatcacatttaataataggagttcatggttaactcaatgtgtatacagtagcattagcatctctagccactagcagccagtttgaggtcgtgtttttcattttgtgtttttggactatagcatgcagttatatattgtgcttacctgctcaaagataggtcctcgttttgaaaatatgttgcgatactttttcaataaatttggttaaagttaaatgaagtttgatttataaaaaattcaatgcattttatgttatgaaacaagtagagaagcgactaaagctggcattacaagctgattacatagattgaggacatacagaatcagaaacataactcggtaatgccaacattttaagagaaaaaggaataaagttaagtcaccaaatgtgctaacagcccggcactatagctacttcaattttgtgagataaaggaatgggacaaatttaaacgagcatgcctgttatttgttgggatgaggaaataggtagagaaattaaaaaaatgattgtgattagctgaaacgatgaaataggtggagaagtagttatattataagataaaatttggatgctataagtaactacataaggacggaggtacgtagtagtattgtttatgggaaaattgctttaacgttgctcactaataatttttggattatcagatttattgtacgagaattgcatggttatgattagtatgtaacatacttggataatatgttacattgttacatatattcaaatacttacatatttgttgctaaaataagtgatcagattttgaatacgagcagtagtgtttggtggaacaaatagttactattcacaagccatccaccaacaactatggtttcactttcaaaatcgcaaaactacttaagaaagcaaatgaacaatctcgagccaaaatgtatagatagtgtttctttttagcacatacaaagatgaagataaatttcactgtatgtcgagtgtgcgtaccttttcaaaatttgccattatgttcgtccattttcagaatttgtcactgaggatataaatttcttcgtaccattcattttgcttgtcagccgcaagcaccatccgtgcacaccagcaccatcatgacaccccacggcaaggagccattccacacgctactgttgtaatattaacaacgccatgaacagcgacaagaggcccaaccactactcacaaccggcggcaccacccatggcatccagaaccactggagagacagaaggacgacatacaagatctaatcgaataggccttccatcatagactcgcagcgcgtgtaaagcgaggcggtgccaaggatatatgtggtggccggtaagtggcaggttgaatgatgtcgtccccatccaccaccaacttgtgtgtctctgtacatgtattcaccaaccaaccatagcggtatgacaactgtgtagcctagtcatcgtagtagccaatgcttgccatgcctgcacctcctcctcctcctcctgcttctttatcacaggatctagaagaggggtgcttggagtgcggggtgtgctatcaatgatggtggggcaactaggatgtgatgctgatggattggaattgaaagagagggtgcaccttcagggctcgtgcagcggtggtgcatgagtggggtgctttcttcaccttaggcaactaggatgccgtcggggatgagagtgatggtggacggacgacgctggtgctgatgctagcgaacaaacgaagtgactgatgaacatgatgttggatgtatgggatggcacggggcgaatgaattcgcattcctagtggaaaatttttttaaaaaaaacacgtgaattaggtggcaaaaaatattgaaagacgtggatattcggtggcaaatagtgaggctcctctgatttgtaggaaaacctgggaaacttggaggaatcaaatcctatatgaaaaaaatcctaacaagttggatcaaatcatatccttttctttaaatttcctatggaaggaatcatcctataaaaattttggatcaaaataagcttgatgttctccttgacgttttcttctttctataaccccaaatttttggaactatcaagtgatttttgttccgtaggaattcaattggcatgatattctatttctactttttttttctattcatgtgttttaaaggggcaggaaattccttcaaagatgaatgggaaatgctctatctgttttcgtcgttggaaagcgtaatcgagaatgccgttagctatccgaaggcatcgccgtcgtctccactctttcccgccacgccatggctgccgccgtcgccgccctccccggcaagctcccacggcagccgccgccgccgccgcctccaccttcacctcccaattcgaccttcccgcgctacccgaagtccttggccgcacaccccgcgctctcctcgagccacccctccgacgtgtcggcgctgctcgccgccgccgcgcgcgccggcgacctccgcctcgggcgcgcgctccaccgtaggctcctccgcggggacctcctcgacagagacgccgtcgtcgcaaactccctcctcaccctctactccaggtgcggcgccgtggcctccgcgcgcaacgtgttcgacggaatgcgcggcctgcgggacatcgtctcctggacggccatggcgtcctgcctcgcgcgcaatggcgcggagcgggagtccctgctgctgatcggcgagatgctcgagtcggggctacttccaaatgcttacacactgtgcgccgtggcacacgcatgcttcccccatgagctctactgcttggtcggaggtgtggtccttgggttagtacataagatgggactctggggcacagacatagcagtgggcagcgcattgattgatatgcttgcaaggaatggggatctggcatcggcacgcaaggtgtttgatggattaatcgagaagacggtagtcgtctggacgcttctgatttcgcgctatgttcagggcgagtgtgcagaggaggctgttgagatttttctagatttcttggaagatggctttgagcccgataggtacaccatgagcagtatgatttcggcatgtacagagctgggatcagtcaggttggggctgcaactgcactctctcgcactccgaatggggtttgcatctgatgcttgtgtgagctgtgggcttgtggacatgtatgcaaagtcaaatatagaacaggcaatggactatgctaacaaggtattcgaaaggatgcggaagaatgatgtcatatcatggactgcactaatatcaggatatgtgcaatctggggttcaggaaaacaaggttatggtgctgtttggagagatgttgaatgaaagtatcaaaccaaaccatataacatattccagtattcttaaggcctgtgccaatatttctgaccacgattcaggcagacaggttcatgctcatgttatcaaatccaaccaagctgctgcacatactgttgggaatgctctagtcagcatgtacgctgaatcaggctgcatggaggaggctagaagggtattcaatcaactctatgaaaggagcatgatttcctgcataactgagggaagagatgctcctctagatcatcggattggaaggatggacatgggcatcagcagttccacatttgctagtctaatcagtgctgctgccagtgtaggtatgctaaccaaaggtcagcaattgcatgccatgacactgaaggcaggatttggatctgatagattcgtaagcaactcccttgtttccatgtattctaggtgtggttacttggaggatgcttgccgatccttcaatgaactgaaggatcggaatgtgatctcatggacttcaatgatcagtggcttagcaaagcatggctatgcagaacgagcactttcattgtttcatgacatgatattaactggtgtgaaaccaaacgatgtcacttacattgcagtgttgtctgcctgtagtcatgttggtctagtgagagaagggaaagagtacttcagatcaatgcagagggatcatggactcataccaagaatggagcattatgcttgcatggttgatctgcttgcaagatcaggccttgttaaagaagcccttgaattcattaacgaaatgccactgaaagctgatgcattggtttggaaaactcttctcggcgcttgtaggagccatgacaatattgaggtaggtgaaatcgctgctaagaatgtcatagagcttgagccacgagatccagctccatatgtccttctctcaaacttgtacgctgatgctggtttatgggatgaagttgcaagaataaggagtgcaatgagggacaacaacttgaacaaagaaactggcttgagctggatggaagttgagaacaccactcatgagtttcgagctggtgacaccagccatccgcgagcacaagacatctatggtaagttggacacattggtcggagaaatcaaaggaatgggctatgtgccggacacaagcattgtgctccatgacatgtcggatgagctgaaggagcagtatctgcttcagcacagcgagaagattgccgtggcatttggtttgattactacttcagcaccaaaaccaatcagaatatttaagaacctccgtgtttgtgctgattgtcattctgcaatcaaatatatgtccaaggccaccagaagagagataatattgagagatagcaacaggtttcacaggatgaaagatggggaatgctcgtgcggagaatactggtgagctgcacagcgcaggtttgtctttgctaatgatcctgatccaggcttaacacagtgaagcttttcttagatagttgtagttcataatttttgtagttgctttgtatagttcataattttttagttgctttctgttttgtacaatcacatgttggctacagacttgttgtgttggtttgtcagactgctacatgatttgtacagttacatgaataaataatttttatttcggcagaattctctactcatcatgtagtacttatttctgtagcttaatatttttctgaaatagtcgcctgattcataaatgctgacggctttaagaacacagggcaacttttttgtttttaaaatgaatatcgctaatatgtccacagccaaacagttcaacgttagagggaaatctaatctcagcattcccctttattgtgtaccgtagaaaacgtccagagataatttagtagataaagagttttgatatgatttatattgcatataacatcctaggaaatacagacaagcggacatgtaaaacaatacaagatgaaagtaaccaagaaaattgctggaaaaactgctggttcgatcagctaccgtcttcaaacccaaaaaggaacaggatgaacatatccagaaatatgttctaggacctcgcttcaccagagcaaattcatttgatttggccaacgggccagaaccaacttcatacaaaggtggaagatgatcaaacatcaaacagcaccacagatcccaaagcatcaatagtttagatccatgttttcagccatcaaccagatggaaatgcctcaggaatggatggaagacctgaccgaaaacattcttccattcatattttctaacaggtcgtcagactgatcttcgcagttctggtggaagttgcgcaacatgcattgaagaatttgatttagcttggtgttgaagctccatcatttcttccttgctgtactttattctttcatctgtcatagaatttatacaaacttacagtcaatatactcttaattgcatggcttcatctgagatgtattcctaatcaaaagagaaaatcccttacctacaaagcagatttcagcaagtctacttgggccagccgaactttttgccacttttgcttttacctgttgaggttgtctagaggacttgtgaagatgcgaagtaccaccataatttgcctgaagttcctgtataagctcatgtctcacttcaatcacagggtgacacgtacagaatgctgaaattgcatctcctgttaagatccaacagccgcttaaatccaacatacgcagcgtggcagggggaacaaactttctaagcccagtggtggacaatatattcccacagaacccaagatgtatcaaatttgaggcagaagacagtgcatgcaaggcaggatcagacaagaaatcactttttaggaacaaatatttcagtgctctaagggatgctaagggaggtataacatcatccatcagctgtgtattattcaaatttaggctttccaggtatttgagttcttcaagcgcagagagagacagtactttcacagagttttccatcatgaaacctgcaacatgattaaaatgagttactcgaagatgaggtacactgatattatcatataaaatgctgggcaagagaatcacaacctttgatacatgtgcgactcaggtttaaaattctcagtgaaggcatcatgcttatgtataataaagcagaatcatcaatttttgtatgagctaaagacagtgttgtcagacttggaactgttcctgccagaacacacagtgcttgagaagttacttcagaattactcaggctcaaaaacttaaggttcattccaatatttgcaatatattcaattgcatcgctaattattctgctgtagctaaggtccaagtgctctagattcctcatatttcccaagaaatacaagttgcttgaagagcaacttgacatatccaagtatgtcagtgaacttggtaggatgcttgaaaaaacttcatcaatgttgccaaatgatgctgcggagataatcaacttttccagatgaataagaacttggaattccccattgcaaatagaatgaattgtgcagttgctcatatttagacacctcaaggtcggaagaattggtaagcatgtcacacgtgtccaagaaatattcaagaagctcaaagatgtaaatgcaataaggacagaagctccctcattggtaatttcactgccccatatatcaaggtgctcgagctgtgtcaatacctagagaaaaattcaactaggaaaagtttatacccaatagatatcattaaaaacaaatcaccaattactagcatgctgacagcctaacatgaacataccaaattaaaaagaaaaaaaataaagaccatatgatgatgttgaaattttgttcctgaaacaaaatggctgtgcaccatgagtatacatacctgtaaagaccgtagtgctttgtctgtgaaacgaactccccccaaatctaataaacgtaagtttatcagcgacgaaatggccataactccattgtcagtcaacccggtttgcgaaacatgtagcttctccaagctttcaatggaagcgatatgtttgatgccagcatcagagatcttggagcaccttgacaaatccaactctttcaacgtacgcatacctacattatcatcacaagagtatcgcgaaagctagttcgatcgaggtctccatgatagatacaatcgtgattgagaaaagcttcaagtattgtaccggagagcgcccagaccgcagaactgttgacgttcttgcaatccgcaagcttcagaaccctcagataccggaatgctcctaggtaagccagccactccgcgtcgacggcgatgtgaccgctcagatcgatctcctccaccgagtgctggaaaaccctgcacacacacggatcaagaattcatccacgcgcgaaaccaaacggagattgatccatccatttcggccctgtaagtgccgggggggggggggaggaggaggaggaggaatcgggcggttactcgaggagggaagggaagaggaggcggcgggcggcgaggcggcggaggagcgcgtcggcgagctgcgcggggaggcgctccagggagcggcgctggcggcgccacgcctccacggtggcggccccgcccgccgccgcgtcgatgcagcggtcgaccagcggcgtctcgccgccgccgccgccgccaccggcggaggcggaggcggacgccatgggcaagacggcgtcgccgcggcgcgagctcaacgggagaagtggggggagagagagagagaggattggatccgaattgactcgtcgccggtggcgagaggttggaggagggtggaagcggatgctctgacgtggcgtgtatcccgcggcgttggctttcatctcagccgtccgtgtcctttcctcctggagaatgaaaatgcatttaggacagcgagatacggtcttcaaaacacaattttgacttcttgtttctataaaaatatttattaaaaagttatatatgtatacttttatgaaagcctttttcaagacaaatctatacatataatttttacattttcaaactcaataacttgatagttattcatgatttatattttaaggtttaacttaaatattgtcataaacgaggagtatgttagtgagaaattccctggagtgctcctcgcaacacacacgggaaaatgtgaaactttcttgtgtgatcgagttttgctcaatccttcacgtgtaaaaaaaacaaaaaactgaagggagagacatatcttcttttaagaagatattgaacgggttagggattaaacataagacctcagagccaaaaccacatacccctttccactatactatcaagtgtacaactccaattcttcacatatcacaacttatttggataatgaaaaataattctgcccttcagcttgaaatctcaatccacaacttattatattataaagttgagcatttaagttgtagcgaaaagtcatgcataacagaaaaccaacattgtttaagatgaagaagataaacaagcaaaagtcttttgctaaatatccgtctatggctgacgaaattttgtatcactaatatcaagaatacggtatgtcacatgtttgcatagatttatctttatcacactattgacacctaaatttagtaccattatgaaatttgattggatttagaaagatcatatctttccgttgaatgtcaatctaaccgtccatgtatggtaggtctacccggtctatcatacatgggcagttagaatgtgaatttctcataataacatttgatactttcttaggataatcaaagatataccattgacaaacgttcaaatttaagaaatgcgcgccatcgataaatatgagttctaagaaatgtcatcatacaaacgattttatcctaaaattgtcattgccgccgttagggctccatcaatttcacactgttaaatacactattttaggacaaagaaaatatcaattattactattgtatttttatattccttaaaaaggaaggtaattttagtgtcacgtacctcatagaagaaaggtaataatagtgttatgtatctccactatgaacaccgagttttaactccaagtcaaccattagataataacaaactcaggaattaatacaagtgaaagcatagactgtgaagaagcaaggaatttgggaatagggagaagcactaatggtgttcatgcatgactccatccaccagggtttaaatcctaatgcccagaaatattacgcacatataactggactttcaaccagattatactgagatcagagatgtgctgctagttttcatctcttagggcacccacaatggttatctataagctctctacaagagatacatgtcggcatattttcctacttggaagagattaaatgaagagagagagcaaagctatctactaacctggagatagtctatagagaaaaacgaggcaatggattagagagctatagatacccatgtagacatactattgatgtgatttactattaatctagtctattgctgagatgtatatgttttatagagagcaccttactttaccattgcgggtgctcttagagcatgtgttaggagacgcattctttagggtgtgagtgtgatgttgtgtgtgtagtggtgtgtgcgcgtttgttgtgaaattaaaaaaagaggattttaggaattagggaatggataatagagtttagggtggagactggatagagcactgctacactggcccactggggaaggaagacgagaacccaattctgttgctgctgctgcctctttttcatagcttcgacgttgcttgtttgggccccagcccaaagaccgtgacaaagggcgtatgttatcagaatttatcgcaattaaatgaagatagtagctcagtcgcatattaatagttacttaattaaacttgatagggcaaaaggaggacgatgaacaactaaatctcatctctccaaacccctaaaatcatagtattcgaggaggaagaggatgagtatacgtactcgcgttccttggactcttctctacttcctccaaataaccacactctactctctctctaccacaaattaccatttcagaatagttgagtacttgagttcatttcagaccagtttgtagccggtgacccagatgttcgccggcgccggcgccggctgcacgtacacgaacctgaggctcctccccggccgcagcgccggcagccacctcggcggcacgtacccgtacctcgcctcctccagcccccacagccgcccccggagccccgacacgcccaggtgcagctccctcaccgtcttcccccgcgacctgttcgtcaccgtcaccgcgtaccggtagtacgtcctccgcctcctcgcccacgtccccgtcacgttctgctcgatcccgatcgccgtcgccgtcgccggcagcgacgacgacgacgacgtccggttcacgaccggagtcgccgtttcttgttcgtattcctcctccttgaggccgccgcaggaggcggcgaggcgggcgaggacgccgagcagcggcgcgttgttgtaggtggcggcctccgtctgctcgtagttgtcgcgctcgtcggcgaagtcgtcgtactcgtcgggcccgccgacgacggcgccgtcgagcaggttcgggttgccggcttccctcccgtaccacgacgagtacccctcctggcagctcacgaacgacgggtccctcttgatggacacgatggacgcgccgcggtggtgcacctgccgcgggtagctcgcgccgtacccgaccatgtagctcgtccccctcggattatcacccaaaatataattcacctgaaatcaattcgacaaaatttgagtaattcgtcaaccacatttgacaatgttttttttttctcgtgaagtggaagcggtgagagtattgccgaatatattagaaggacagagttgaccctgtttataaggaaaaccggctcaaaaaccatacaattgcacggcctttgacaatgtttttgtttgttttttacctgagatttgacgaatttgaggatgtcgaatggttgggcggcgccggcggggcagtggacggcgccgcggccggagatggcggcgaagtcggcgtagacggtgaggaggaaggaggcgctggtgacgaactggaggttgttccacctctggtggtacatcatgccgccgggggtcctggcgacgttgacggcgcccttgccgacgcaggagcacacaaagaactccgcgttctgcctgtacctctgcagcgcggcggcgtggtcgccggcgcggccctggaggaggaacttggcggcgaggacctgcacgccggggtacttgacgtcccacccgaactggttgatggaccaccccgtcccgcccagcgcctcgccgttgccggcgaggtactccaggtaggacctgtcctccgtcgcctcgaacagccacgccgccgcccagagcagctcgtcctgcagcaagatcaggtcatgtcagcaaggtgttcgtccgaatcctacggcgccgccgccacgccacttaccccgtatccgctgaaggagccgtagtagtttcgcgccaccgtgatgctggcgtcgtacttgccccggtacttgtcggcgaactcgaacagctgaacgcgccacaaaattttcagaggaaatttcgtttgatttcgagctcatttgcgagagttcttggagtgtttggatgaccgacctgcttggagtgcacaaggaggaggttggcgtagccagggtacgtgccgcggaagacgatggacgcggcggccatggcggcggcggtctcggcggcgaggtctgacccggggtgctgggggtcgacgcggaacgcctggcggctcgtcgtcatgtcctccggccgctgccagcagctgtggtcggtgtcgccgtcgccgacctcgccgtagagcacgtcgggctccgggtgcgccttgatgaagtagtcggtgccccacttgacggcgtccatggcgttccggagctcgccggccgccgccatctgcttgccgtactctaatatgctccacgacatcatggtcaccgtgaacgccattggcaacccaaacttgacattgtcccctgcatcataataacctccaacaagatcaacctgaaagacaaacaaaaacacaaacatttgcattgcactccattagaacccaactcatcatatctcctgaacaaattgaacacaatgccattgatggcatcatggttttgatcaaagatttgaaggtagaatggtgcatactccattggcctttccatcaaagaggccagagctggctctccaggagaccctctggttaggagggagaacgccggaccgctgcgcctggaagtagaggatgctcttcctcaatgccatggcatagtcatggccacccccagcaacaaatcccagcttcaccattgatgcaagtgccaagagaccaaacaatgtggctgcaccgtgagcaccaccattcttggccattgcaaaattgcaatgtaccaagaaggtgagtgagtgagagtgaagcagagtgaaggagcaggggagcagaggactttggttggcttggcttggagggagctcaaaagagtgcttcttatataccactggagtggagggaagatcagataaagcaggagattcaaagcatgagaaatagtttactgaactccagggcccctttctcactttagcaagttgttgatggcaaatattattccaaatgcatgcaactgatgaactcctaggtaggttacatcctcctacaaaatggcaagttttgtccatctctttttagtaaactactgactaatatagccacttctatgattgattatattattcatcgatggtcaccatctgttgtgagatatacactgaaatgcgataagcaacattagacagtggccacataatcagggcatgtattttagaaagctttcatgaactccacaaaagtaaacatttggtgaaaaactgaaaatgaacataaatcggactaaagttgctagattgccgatataaaatcatgatatgatagttgtaattttacagttattgtcactgagaaaaattttgtgatgttatggatagttaataaatgggataaagataattcaattccattgaaaaataaataagaaagctacatattacagaagttaactttgcatgcatatgcttgagaaacaagcgattcctcgtgcaaaagaacaccataggaactaccaactttaaaaaggaaataatgcaggcaattgtcttgcaattttgggagtatctgtaaaagccaaagaaaaggaaaaggttaaagaacgtcgtttctctatagaatgatcgtaccagcgctatcactattgataatactcttgttcttgcaatatacatgttttttttattatcatttgttttctagcagtttactgaaactaatgctccatttgaaatccaagtataatatgcgaatttcattagaaacagtctcccacgtagcctagctagggagtagggactagaaaatttcccaacttcatattcttacaaaagtatatttccatcccttaattccatcggtatctttgatgatagctgacaaaattcgctctatttgaggaaattagatcccgatctttcgataggtattgataactctcgtggaaacttcacacacacgatccagcttctgatcaacatgatccaaactctggttatcagccgtgccctactcagttgacctcgccgagaagactaatccttgtatgcaaatcgaaaaacacaagcaagaacaagatagattgcaacacaattggatatgaatgactaagcactcgaatttggggttccacaaaccaaagtagcggcgaaactgcaatggcaaaataatctaagcaaaacccgattctaaactttaacgactactgaataaatatgatttaggacgtcctagggttgccctagggcgcacaccccttaggcatagcccacaacacaaaagtgacatagtgagggtagaagtggacttggaaaaggtcttggtttggtccccagtgaacttctttgattatctatgcatttcttacacttggtctcttttccttcatccaaacaagtacatttgcaaacgataacatacgaaactcattgtgtagtaacatttatttaaatatataacaagtaaatctaatataaaacatatgcacctttggttgatgaatacataaggtagtcatggtcatatctaagctagttgtgtcctcatcactattaatgtgtggttgctttgaaatattgttacttggattattagtatttgtttttacgttttaccaactatagttcatattctatgccatatgttaaagaccaaaattattgtccataaacgaacatgaacaatgaataatgagtttattgtaacacaattcatccttaatgcttaatgaaaaaatatctgtattgtttgcatcctttaaattttgaactaattagtagggatgaaaacggctagaaatggttggaaacaatatcattattttattatatttatgcaaatggtttaaagtagtcatgaaatttctatattcatgaatttaagtaactaatgtcaactataatgtgacaccgacagaaataaaaaaactaaaatttaaaactgtaatggttgataaagatattattattttattagttttttgaaaacggtatcagtatagcctggacattttcactcgtactaattaggattactttagaacaaaagaattaagaaacacataaatatgataaattatacattcacatttcctctccaatcttacagaactgacaaaattaggaaacaattaattttctatggttgaaagaaaaaaaaatagatgatgtaaaaatagagagaaggaaggagataaccttaaggccccttttaaaatgtgtgaagatgataacatatgaatagaaaaagatgaagatttttcaaaagaaaaaatggaacaacaaaactgaggattgtaaatggtgaaaaacttacgaatttaagtagtgctataataaatcaatgcactgggcctggtcgggctcagtttgaacatgccaatagaggagattcccaactcatcctcctagtttttcataggcacgctttctaaaccactgaacggtgtgtgtttttttaagaaaaaactctataacaaagtttgtttaaaaaattatattaatctattttttaaaaaaatagctaataattaatcaatcatgcgctaataagttgctccgttttacgcgcgcgaggcatgagtttccaacttcaaacatcggaacacagcctcaaggaccttgccaaaaaacaacaaacaaaatccaatgattttttgttgtgggggtttctgaagaacttgtttgggttgaaatccaatgaatatgagatgttcgttacggtaaaccagcaaattgacctgctgtctgctgcagcgcgttcgatggatcgatcgatcgacatggcgccgttagagcaagtataatagatggctatacgaaggctaaatgctgaggtggatgaggaaggagagaagagagatgagaagcgggttgtaagtttacagccggcttaggcataggaaccaagaaaatctatgagacagacatgtggactatatatttatagtgaagagttaaccactatatgagtaagctggtagataggctataagtaagcagttggctttattattatgcttgctcttagtccagccgcaccaccccaattttcaattccgccactttcgcgtcgtttgatgcaggtggtggccgcgcgcgtgaacgccgtgcgcgcgtagcgtctggtcgtcgtctcacccctcccccaaccccgtcccaaagtgtgcttttctgacttgggtagcggccggtttgacagaaatcagggcacgatcttaggagcaccagcgacagcgattgcggctgccgcccggataatacatgagctaattccacgctgtgcccctcaacttttctgtgcactcgccgtgtcctgcgccagaaatggggacataccctcttgtctagtgtctagtgttaagattgttagtacgtacaccctagatttcaactttggcaaatgaacatcttagatggtttggattattactccatcattaacatggtcagttatatgacaatgttgatgatgagtaacaatccaaataaaatgttcttgcttataattaggatgacatacgatatttcaataatatagcatccttttgagtatttgcaaatttattttctgtagaaaagacaagtagtcaaagtttaaaaacgaatagtgttggcagttatttaagaaaatggagggagtatataccaatttccttttataaacagatataccattgtttttagattacgtgaaatcaaaccataaaagttttcataatgctttctctcatgcaaccgaaacccgagagaaatatagaaatataagatgctcaaacccgctcgccaatcctcttccaccggttcctacaaacaacggcgtggtggtccacctcgagacaacgatgccacttcttccatggtgcctccccatccttctcctccgaatcttgtttctcctattgccctctccctcccctagtaactgcccttctccctaatctccctttgtcacgtttcttggagcagacctggctgcccccaatcttaaggtgccaaatctgattgagggtcacctaaaagaaaaagagtgaggtggggcgatggctttacgtagaggcttttccttagccttcattttccttgccaccacgagaggcggcgacgaaagtgaagctagtcgtaagcaatgaatgtgtgagacataccagaggctagtgtaggtggttgccagacacatagaggaagcagtgctcatggtgctattgtcggcaccaaaagttgttggaaatatggtcacaattcagcatattttaaactaaattattaagacaataagcatggcattttcagggaataaactagtgcgaatgctaatcaagagcaacatacaaatcatgcttaatatagaataagcataaacattcatcacatgtcaatgtaaaaaaacattgcggttaacaatagtatattagaaatgagcgcgttgatgatagatatataccctgagaatggctctccgctggaatatgaggtagagttgcctctgttgatggagctgttccctgcaccgcctcctccatcgccattgtcgacatctccctcagcagcaccgttgatgttgtcgtctgtcgacatgttggcgttgatgacgaacaggaacaggaacttgcagtaggagtagtcatgttgaagaacgctccctaaaaaccttattgcccacctacccgtgcaggaactcagacgaacagagtttcggaggcccgactcgtcccaatctcttgtgcatgcaagagatcagagaccggggagaacagaagcagcacaagaacagagaaactggggtggaaggagaagtgcgccgagagagaggaaagaacagaagacactcgatctgttcgtccctttggcagagtgtttctcatgagagtaatgtttgcgcaattaatcctcaaattaacagcgaatgaatcgctctccgttaatacagaatcaattcccatatattttccgcctatccgtgcaggaactcagacggacagagtttcggaggccctactcgtcccaatctcttgtgcgcacaagagatcaaagacccgggaggacggatagagtttcggaggccctactcgtcccaatctcttgtgcgcacaagagatcagagaccggggagaatagaagcactggaaggagaagaagtgcgctgagagaagaaagaacagaagacacccgagcccttttggcagagtgtttctcgtgagagtaacattcgcgcaatcaatcctcgaattaacagtgaatgaatagctctaaattaatacaaaatcaattcccgtccattacaaaacaagagagagagagccgccatggccacggccggagcgtgtgtggtagtccgcccacctttctcaactggtcaattgggagccttaattgtctcactatttaaggtgagatctctccacttaagtttccaatgaggtattattgcctctaacattaattgtagtcctatgaaatttaattgaattaaatcgagcctagcccatttattcaacagaagtgccatagaggatgcatattttttcttcattttgcaactcgccgtttgtttgaatgttccatatattagttataagaagatgctgtcgggttcttggatgttccacacattgttttctttttttggcaaattctgctacatacccaaattttatgtaatttactgatttacatcgtaaaaacgtgtcacggctgaaagacaccttaaaaatggtaatttgttagaggacactctcggcttaattaaagagataaattcttaagaaacacgagaatatccctaggattatatgcttcaaacatagcgctaaagtaaaaaattaagaaattatgtaaatctaaatttaccatcatcccaagtatatcactaacataaatcgtattctacctttcactttagtctcaactcaaaaacttttgtccttagggacattatcatctttctaaagaatttctttctcagttgagtaaaaagtgttcttcagtaaattactagtttttatagtgtattttagccatgacatgtttttgcaatgtcaactagcaaattatacaatttaagtgtcatgtagtgaattttgccttattttttattgcaattaatattttaaatgttgcatctatttaaaatatttttaatcaagtgataaaatattttttacaaagtgacgaaatattgatcaacatgttggccaggagttcctagtcactttcttaaaaatttggccccaagtatcaagatgtctcgcggagaagatgacagcagtatgttgtgacggaaaataatttcatatcacttacacgaaaagtgattgtaaatggtatttttttttctgagtggactagctgctagctaaacggtaaatgttagaggtttccaatgtcctcacaaaggattcgacgaggtagaggaagcgggtaaacggaggtcccactatcaccatcgccgttgccgccgtcgagtcactgccgccttcgcctcccgaggccagatccggcgagccctaggctagatctggttatgaggggggcggtgccagcgccccgacgaggaaggtggagggaaagccacgcgtgacgagtgacggttggggggagggagagcaccggacactggtagagaagtactttttagtcccggttcgtaacccccctatagtcccggtttttcaaccggactacgaatccgggactaaagatcgctatctttagtcccggttagctatctttagtcccggttcaaataaccgggactaaagattttttttttattttttttctttttcattattttttaatatacaatattgatttcacaccatcctcaaatcataccaagaaatcccaaatccaaatcatcagatatcatataatatctccaaatcctcaaatagatcatctccaaatacatcacaaactcttaaaaaaattacatcacaagttaaaaaaatgcttagattcagatgtaatatgaccaaacgaggacaacaatctcacgagttaggagacacaattcgtttggtgggcaggcatacagcagagaccacacaatactatatagagatgtgttgatttacatatgcagaaggaggatcggagaacggggcgggcgttctggctggtgcagttcgccggctggccgccgccgccgcgcaggccgcgcggcctcccgcgccgccgcgccggccgtcgccgagcggctgcaggccgcctccgcgcggccccacacgccgcggcaccggccaccgccgccgctgcgccacccccacgccgccgcgcaggcagccgcctggccagcccgctctcctcgtgccagtcgtcttcttcgctgtgaattgaaggaaagaaaggaaagagaagacagtgagacaaggtaaggtataagaagttattgaggaaaaaagagatacagggcaggagtttgttgtatggacgggaaaagaagatagatactattgtgtttttttatttttaatcccggtcagtaacatcaaccctatttttagtcccggttggtgttactaaccgggactaaatatcctaaggccctgacacggcctgacatgtaatcaaccgggactaaagtttatgtttagtcctgttggagttaccaatgggactaaagatgatgttacaacaaccgggactaaagatcttcctcttataaaccgggattaaaaatcatttttagtcctggtttttaatggaaccaagactattgttgatttgggtcaaccgactaaagatggtttctctaccagtgggaggaggagaggggaatcaacgatgggtggtagggagagaggggcgttatcgtcgttgctcgagccatcctgccgcagccacctcgtcgccatcgtcggcgattggaccacctcgcgcagccaccgctgctcagctctggcggctcttctggcctcagcttcctccgatggggaccgagagaagagagagagttgttggggaaagaccaagaagatagagatgaaaagtaaaaaaaatggtataggtaggacctactacaagcaacttgcactgtaaaacatgtagctcaaaacgtttttggtcaacgtggcatctgaggaacacccactgtgaatggccttaatggctctgtttttgttctttgatttgtagtgaaaatgaagacttataatagtgaagtttgttttgtagcgcaataatttgattatctcgcacctgcggctgcattgtgtttcgtaaaattatttaatacttttaaaatattttaatattattgtttgcaacacagatctaaaaataaaagtggtccaccaaacaccgaaatatccaaaagtcgttgcaccaaatgagattatcataattcaccgtaatggagcataatgataatgagtataaacacgatttactgtcaaaacttcggcttcttgggaattaacatgatgcaatataggagtataaactcttatgcttatacttatcggccaaaattgaattttcaactttaaatttggagctgattgaggtttttttatcgaagtttattttttagtctttgcttttagatcactaagaacacttatataaaagttttattcacaaacaatatttcgtttataaatatgccatttagcttattctgcaaataagcgaaccaatgggtcagatagaggtgtactaaaaatatctagataaaaaaaccaggaatttcaaatccaaaatcccgtactctttttatgttagtttggtctcatcctctttgttcccagaggtacatgcaggcattattaagtaggcaatgatgattaacctaggtataaaatgggagagcactaaagcgaaagcagttggaataatttgtacgtagacggtgaagggacagagtagtgagtgtgtgaaaaaggcaaaggcaaaggcaaacaaacaaagctaaggccgtttctcccgggaggaagccgtaatctacggtttcaatttccaataatccgaccaacataatccgagctgcataaacccttgtgagttgtgtaagcgcgctgatcaatctaactttgtcaatttgtcgcatatatactcactttgacccatgcagatctccagtgtaataagggtctgtttggcacagctccagctccagctctactcctcctggagctggagctcagccaaacaatttcagctccgccaaaactgggagtagagttggatggagctctctcacaaaatgaactagagttgtggagctgggtttaggcaactccacaactccactccagacccaactcctggagctaaattctacttcctccactgtctagatcagctcgttctatatgaatatagctttaattatttgaaatttttttgggaggaaacaaattaaagtaaggagtaataaactgctgtaaggtagcaacggcggcagcagtgtagttcgcgaaaataaaatttttggatgtcacctcagatgtttaaccggatgttggaaagtgtttctggacacgaatgaaaaaaccaatttcataactcgcttggaaaccgcgagatgaatcttttgagcctaattaagccgtcactagcacatgcggattactgtagcacttatggctaatcatggactaattaggctcaaaagattcgtctcgcgtttttcatgcaaactgtgtaattagttttatttttatctatatttagtactatatgcatgtgttcaaaaattcgatgtaacgtttttggaaaaaaaattaggaactaaaccaggcctcatccgatgacccgggacggcgttcagcccttgatcggcttagatggacatctccttggtggtagtgtccttagatgtggacaaacgactggtttacggttcagttaattaatcttcgatattattggttacacctaaacttagcacctagtattaaattaaaaaaaattaccaaagtttgaaagtctaccggttttcctctgagagggccggtcggaccgccgtatgtcggctggtcagaccggtagtttatggccggtctgaccggcagagtccgagcccgagtctatttcgtcaggtctcgaagtttccttgcttgggaaggcatatttcgggttttatttggattctatcccgacagaaaaagttgccaacaattatctttcgttttggttcaatatcggttatcggcatcgatgtacaccaaattcgataggcacaatgaacattcgctgattttggaggttttgctttctggtttgacaaaggcaataaatacatacagcttgcaagttgcaatgcaaaaacaacggttatgtagattttcgtcaagatgtttagtaatatgtgttaagtgttatctttgcgtttaaattggtattaaagtaactttcttgtttttagtcaagctgtaactttgtaattcgtagtcgttcatcaagtgatctatagtagttttgtaaaagcctgaatgattcaattattttgaagaaatagtgcctggtggatttggatgataagatgaatgggataaacaaggagagagaggatgagctgctacttgtttaagagacttggacatgagcttaagaggaagagtagattagacaaacaaataaactattataactagttataactatgttgctcatttttccagttctaaaaatgacacatacaaagggattggaacgtagggatataaaccataggaatataaaacgtaggaattactgtaaaatatattggaatgcgagcgttaaacggacgaatgaaaaaacatgaaaaatctagatttttaaagtggtgtctggaatagaggaattctagaatatgtattaattacctagcactaatgatctctgttttacctgtgatgactgtccagtccaattaaacgttatcatgagataattgcttctgaaattatgttttatgtcctgtgttttgcttctgaaatggaggaaaggaaacctttcatctgttttggttttgcttcaattccttcgaaccaaacgcagctacatacattagttttcccttcaaggaactaataaatcctttgaaagcagctgctacggcagtttttcttccttttggagctctgcggtgccggagtgtcggtcagatcgatgaagccgtagcccgtaaagactgtacttggcagactgacaatgctccttcagttcgctgctttttgtttgctgctttcgctcaaccatccacagcttcatatcccgagagagaaaagccacaaacatagatccactttcccttttcttttcttttgtggggggatcatttgaggggagcatggatgtcttttttttctctctttttcttcccaaaagaaatgcatgtttttattaagtaaagatacaaatagaatactcaagaaatataaatgtaattatcatattctctatattcattatgtaataaaactgaagtctagaataaataaataaatatcaagttgtgctcaaacatggaatctcaattttttttcctttgatttaactattatagtgttttcttgatttaataattttaaacttcagaaatagcaaatagtaataatattttcctaattcaaccccgtatcactattacaacttttcagtccaaccataaaatatcaggactactattgtatttgacacctattctacctattctagtagaatgtctgtaaaacttatgttcgaaagacacataaaaaaagatatgttgttttgaacgtaggaatcgagaaaacacgcgattctcgctaacttactataaaaatatctttttggttaatatatgtttaaatggtcatatgcattaattagtcttaagacttctcaaagaaaaaatataaggaggtcgtaatggatgttcaaataatctatggattttctataaaatcaatggctaacaaaaaattcctccgattttctgatgtccttttcgccattcagaaggggtgaacgataccaaatcctgtaagaattaaaatctgccaatttttcttcaaaaatacctagctccttctgaatgcaggaattttactacagtttcacataaatgagttcatttctataaataaatcccttccaaagaaggcctgaaaagtattaagtccagtcaaatatattttaccttggctgaacagagtttggtaaatataaatgaaaggagggagcagtaagccagtctataaatcctagtgttaaacttcttgtgaaattacaagataacatacaaccaaaaatagtattagctagcagccgatctttgagttgggtgccaatgtaaacaaggagcactttctgccgtccctggcaacaaattttgaactttacagaaaaatatgtaagctcgaatccgtacacacaaaacaagaacccagttctggcagcgatttgtgtctaaaacagacaaaaggaagtcaaaatacaaaaggcatgtccccacgaagaactgactcaatctattatctaccagactaccacgacccaaattcacgtgtcaacaacgattgcaattgtcaacagtttgcatttccggttagcaaatattttgcgatgtttggaatttcaatataccttccctataagcgcaatttgaagctggcattgccaccgtgataagttgaaaaacccaaaaaattcaaggcgatataaagagctatatacaacatcaatataatttcccttatattagctttgaagatgccaagccaccaaaaaacatgtccaggtaataagtagagtagtatagctttcacaattttgctacttggaacagataaaagtcacctcaagtgtttattataaaaaataagattagtcagcacaaaattttagttctacttgatggaaggctgcttactgcctaaagaaggcagtttaaataagaaagccaacaaataagtttagattgcatacatcattgcgaagaacattacaagtagcagcctgacctgagtttctcgagactcttgtctttgaatctacgactatttctcttcgtctgactgagaaggcccattgatggcatcagcaaaatactcaactggaatcatgtcaacatacaaatcatcaaacttttatagtagtgaatataggtttttcaaaattcactgtactgcatatattttaaatagacaagtacaaaattacctatgtcatcatccggggattcaaaaatatcagagtctgaaggcaggaatgggttgcctgaatagttttcaagggctgccaggtctgaaagtcaatgccaacagtagttagatgtaagcagtagcaaaagctgaaaataagttcatttagcaaagtggtgaacgtttttgtttcccgtctacaggtcaattctagatgaaatatgattgtcccagaaaaatattaagtagaaatatattcttttaagcactgacaaaaagtgaaaagcacattcaggagcttgttttcaaatactacactgctagaatactgtctataagtcaggtaattcagtatgtgggggagaacagaagcagcactactcaaacattttagccaagcgaagatcttgatttactccaacaaggggtaaacaaaattgaggagagaaatacaacactatatatggcataagttcaactaattaaccaagatatcaaacaagcaatgagaatcccagagaattaattaaaaatgcaagtgttatacaagataatatctcacaacataggacattacctcccagatttgtcaaatctgctgataaatcagaaagactgaaatcccagatctgctgccccaaggaagagctatcaccaccatttggtcctatttgcagaggtcctccattccctaaatcatctccaaaggtggcatttacagtagatgcatccacatccatccctgatatatcaggagtgaaagaaacatgattgcttgacattgcagatgatggactcacagccatctctgatgacatggctccagcatgtgcagttccaggaacttcattctctgtcatgcttcagaaacataatgcaaaaatcaaacgaattgtataggtgctgacagcaagattttaactgtagctacctgataggtacatatgtatgccattgtcttacaagacacaagaaaataattagtataagaaaaatgtattcaatttttacagtcaaaatgaacatttgctgaaataaagagggcaatttggtaattttgaaactacaacatattgcatgacttgggagagctaatgcatcagaaatttactctaaattaaataagcattcaaatttacaacatggctatcaagtggtttgatactgcaccaagaacaaattattatcattatgtatgttgtccaaatctgtataaatggtttcattctttgatttctttccaaacacctgatttggagggtttccagtaaacaacaaaagagaaaatatatgagataatctcaatagtagcaatagtcagtgtgatgataattctttctaagactaaaaaggaaagagggagggctgtattcaagacaaaacagagtttacattgtccatcttatcataatgccgtttatagagcgataaaacaacaagacaagcattagaacaaaacataagaaaaatattctttacccatttcctgagctcatgcgaatcggattataaccacctggtgcaggaattccatttaccacatggcaaccaggtggaccacaagatatcgaattaacatgaggctgaacaggagcaggtattccaggttgttggagtactggatatcccataggcaaattgttaactgcaatggtaccaagtaaattgtaaggaaaacaaatgggacttcataaagcaggccagccaacaaaattagccagctaagcatccagaccaaacagaggtgatatcagcaatgttatgatgaaaacacacgaattaacacgatttagcatgaactatatagaactgagacacaagtaacccacttcagtgtcatgtgggcctcaagaactcccagagcagcaggcactgatacacctatctttcaaaaatgtgctcatttagcatcttttctcgaagttatctagaagatacatatttatcaattagctaagctacaaatcttttaagaaaaccatgcacatcgcaaatagcccgtgacatttcaacacagtttatcaaacatctgtggctaggacataaacaaatgaaaattccacaaaatgatgaaatgagtcttccaaagtgcaatagtcattctccatatcaagacagttttgtaagagcagaaatgcaagtgtttaggaattcttccaatgttatggcatcgatatgaaagaaatttgtggacaaaggcgaaagcaatgtattcatacatattttacttcataaatcagtgcttttgtatttatttttcattttgtcagtgctaagtggtccttgagtcctgtaataaatcagtgcttttgtatttatttttcattttgtcagtgctaagtggtccttgagtcctgtaatacactggcctacaagtacagggccatgcagcacatggtgttagataggtcagggccaacatacaaccctaaacattttaactataacacctattgtttaaccctctaacacgaaatgatcatgaaatacaaggggacgctatgtgtaagtgggtctgctcctccaaagatctaggctaatacggattttggacgctgatagaggcctgtgtggtccatgttgcggcgctggttggattagtctcacatggagaacttagattggttggaactagcatataaacccacgttacaattatacctcaaggttaactcttctatacaaagcaaggccagaagtgtaagtagggtgctatctgtacatggccgctccttggaaaagttgggctaatgcggaattttgaagttggggtgttacaccttgtacaactattggtatctataagaccatgtaggggcatgagagtatgggggagaagggagaaaccaacttagaaatccaagtgccaaacatattccaatcccaagttaatccttttacatgaattggtggtttgtttgtgctccagattttgccatattcttataacggtccctaaagtacttgtctagttgaactccaaaaatccatgattgtgatcaagcgcggatgactacagactaccttatgtgaatgcatggagacaaaaaagcaaagggcttactttccaaattaagggttgaacgtagcatagtgccttgaactagttaagttcatatctgtttgataaaatctatgaagaaatttctttatgacagctctggactgaaactatgtgtgtcggatgttcaagattagcattgaccttactatgatttccaaaattttactatgaaccaagcattgcaggatcagagtgaattaatttgtctctttctatactctggttcagtgccaagctgtacacagcagagccagtaatatcaatgaaagtacattgccttagatgcacatcggtctatcaggtgataaactgatgacctaacagagaatagggcatcaattaagggcagtgctatgtatgtagtagtagtaggcaccaccaactggcaaatggcacataaaagtagcatggaaactagtaaaacaacaacattctgaacttacaataatgaacaatgatacatgagtgggtaacactgaaacaaacaaaaaaggctaaatgatggcaagaaactctgaagcatggaatcttaaaaggaatgtgtaacattataagtacaataaattttgtaaattatgattataagtgaaatcaggttttcaattaattttcacacaagtcaaatatgcacattatcacagttatggcagaatagcacatatcctacatggataatttgatttttgtgaaatcacactatagagttagatattaatactatagagatagacattaccaggcataggacgaataccgttctgtgttggggtcaacggaacctgctgtggtactgggtacttcataagatggtattggtgctccaataagtggttaaacaagttaatctgttttttcaatttcaaccttatgtagtaagcccgaaagaactcagaattttcttcttcgagtttctgccatactgaaaaaaaaacaaaagggaaggctttagagctatactagatacatcaaaatgctgaactgtctccaagcatcatagaagtcactcaagtattcaatagatctttttcattaataaacaatgttaatatatgtacgacgtaaaaaaacagctttcaagttttcactataacttccatattcaggaacagaatactaaacgaaaggaattagtggattatttcagtatccatacatatttatagtactacacgatcgatcttggctataataaaatgcaaataagcagagttgtagatgcacagctgatgttcacaaaacagattaaggagaatcttattactcaactcaataaggtgaccaaaattgtcctgactgaagaagaaagaactactcctatattatatccaggtgagctctcttcttaaaatagcataccctgagcagattataagaaacaggtgttacgaaccaactcaacataagaaccttacctaaagtagtgaaaccaggttcaattcttgcacgagtagaaagagtcctaacaacttctcctctattcatatatagctgtagacagcgttctattaaattctggacctacaacagcgcaaaatatttggttagttaataatggaaggtattatactttgtatacaaaaattatacacttttcaacattgcctccataatagaaaagactagccatcttacaagttcaatatcttcacgagaaacccttttattatcattacttgcagcggataaggaatcagaatcccctaaaggtgcatcagtatttggctgttcacccttgatttcatcatcaccttgcaccaatggatgcacctttgccttgctctcaacatcctgtagaaatatgctcattaggatatagttcacttgaaatgtggtataaatgtaaagatgtagtaacaaaaggtgaaagcaagggcaatcaatggtcatgacatcagcaaaaaagtgagaggtgccaatacaaagaatatataaccttgaatgaactagtttttatgtcagagatccacaagagtttacctcatgagcacttggtatcttgaacggttgctcttatatttaccaagtgactctactgactaatacagagttaacaggccggttactagagatgttctttattttgcctttcatagacattcttacacctctccagtcttcattgaagtccatcaactacaccatccaagttctccttactagaattgtgcagctgctacatttcacactggggacctcacagtgcatggcactaggctactggaggctatctttgccaaatcgatcattgcggtagattcatcatgttcaaaactgattagaaatcagttgcatggccaacactgttcttggagccaatagttggcaagctccgacttgttgttcctggaggctatctttgccaaatcgatcattgcggtagattcatcatgttcaaaactgattagaaatcagttgcatggccaacactgttcttggagccaatagttggcaagctccgacttgttgttcctcaaagtcgaagggggagaagattacaagggacatgattttcattttacagttcagtacaaacaaattctcaaaaaaaaaagagactggaaaaaatatattgctcttgtctaagagttgcataaaaattaaattaccatattagcctggatggtaaatcttctagcattttacactccaaaagtcatctaagtacattgcatatagattctaagaagtaaaatccaatcttccgagttggcaagctatctatttccgaattaatttatatgaaaggttctctcacagtgtgactgacatcagcactttaaacaaaagacagtgcatcgaatttatttttttttcaagaaagattcttacagtacgaggtactacgacatcagcactccaaacaaaaagaaacacagcgcaacaaacaagctcacctgggaaccctccttcattgcggctcaagcccccacgtgttcgtcagattaacacttctcctgaaaagagctattaggatattattaagaattcaagattttggcaaaaattgagagaaaaagcctcgaattagtctaaagagaaacgagggttaacgcgaattggaggaagagagtgcgtgggtgggtagagtgggacgaatgctcaccaggatggatgcggccgaagcagcagctggacgaacgacggcgcacctgctcgctcgccgggatggatggggacgcgcaggcggcgggcgagctcacgaggagtcgacgacgaggtgggaatggacggggaaaaatatcctcggcagccggcaccgcaccaggatttctcctctttcttcttcttgggcacaattacgcctggaaatatgagtactaacttttttgttattgttttttttgcttattgtatatgttaatttaaactaatatttttgaatcaaatagatataattaatgatttcctagttcctacagttaaaaattacgttctaagatttaaaaattatagtggaatttacattgtaagatatggaattataatatttaaacttttttcttgaaaaatggggcactataaaatgcgtaaatatttatagctaatcctgaaaaatattggttatccagcatgtaaaaagactgcaatgtaaaataatttagttaaattgtttctcaactcaattcaaagtgagacgtttgtcaattgaacgaactttgagataataaggtgaaaagtagaggaggctaagtcaccaagacaccaaccacacacaagggaagatttgttcacatcccttataggatactagagcgggagcacgctttgcgcactgcaccagcttatctggatcaaaatgcgtttgttcttttttgggaaattagctgtgttttttcttttttgggaaattggctgtgttttttttgctgttttaggtggtgaaaaagaatgaattagtttgaagcattgaattgtgagcatttgtgaagaagggtgtcaaaatgtcgcttgttaatgtaacggcaggcattttactggaactatttagatagtataaaggcaagtcattcagctagaatgcatgcatatatgtactatgttctatagcattggtagcagatgcagtagcatcttggatcatacaatgctaaggaaggtaggtaaggcaatacttatatacaatgataatcatgacaaaaagccatgaacaaaagatcttggttctttagtcctaggtaatttcacaactgccatctgtcttctagctgggacatagctttgtacatatatataagcaaaagtcttgagatggattgcacgtcgacaactcattcactgtgtagatgaaattaagagttgtgagattaggaaatgcctttaaattgctaattagttatgtgtagataggtgagtttatgtttgaggagtaacctgtcattgcctttttgctgggcaccatccttgaacaatttcttagcaaccggaggtgttgttgtaggtgtaggcattcctctgtttattgaaatgatgtgttagttacaatggaagaaagctttattattggaatgcacctaggagtgatcaaagcaccttttttggcttgggtatctgtagggaatgatggggttgcttgtttggcttcttcggcagtttgtccctttcccttgtaaaagaagtggtggttaagtcttaatgaatgagctgaaaggaaagagatatagtagtaccttattttcagtagtatcaggcaggacaacaattgaagatttatcatgtgaggtgttttcttcagcttttgtgtcagttttgggcttgcaaaattaggaaagaagtgagagtggatgtaattcagtatgagtgacaacaagtttaagggtggctataaagtggttaccttatcatcagttttaggtttggtcctgctagactgcatgcgagacactgagacaacaatgtttttcttggtaggtgttgaagaatttgatttgctagttggggtgccctgtgttccttgagtgatagtgaacttggttggtgttgagatggtttgtcttggttgaatgggctgctgtgattcattgcttgtttcacttggtgttggtgctatttggacagagctgcttgagcttactgagacagtagctgatgtcacttgtgaagcatctggggacataaggagtagtggctggtttgaagcaccagaggatataatgctattaacttgtaggcactcttgactcatcatgacagtatcccgcgtaaagctaacattccatgcaaaattgctgccaataagtgacgtgatttcacttggaatgtattcactgtttggtggattttcttcaatgagagattctattggcctgcgtagtaggcgttgtgcgatccttccgaaaaggataaatgtagcattagcatcatcatcgccggcaattaatactactttgtacctacatgaaaaatggatatggctatagcaatgtgtggatgataattgctaaagatgtaagaagacagagcgtgttctattatgaaccttggatctggtattccgatgttagaacagctggagcatctgtagctagagccatatggttctgaagttttatagcatattcgacatgaattgtaccatcaagaatattcattgcatatccttctgacagtcacatttactataaaacatgttccctgcataagaggacagtgaaaatatcatattggtaattttattatcaaaaagtggatagatatagttaagatgtgttttagagatagtgtcaaccttgtgtttgtgagggtagatattaaggatttctgcaatactcttttcttctggtacatcttggttgtatcctgtagcaggctcatcaacccacttgattggctgaaagtttgtgctaaagctacatagaagaattgcatcttagattaatggatactgtgaaaaccttgaagaatacagtggtgcacatagattgtaagaataactgtaagtaaattaaattacctctcgtttaattctgctactttaggaatatttagattaatataccatttgcatggtgagcttccagttagtgtaaggcctatatatgtggaggaaaatattagatattgttagttacatgcagtcaatactacagtaattgaaagtttagaaagaaatgtacctaatcctctgtaatctttcataagtgttccaacaaacacaacaacttgagcttgagtttgactagcattgtatatctcatcaacatcaaaagaggttgctctttctccccagagtgtgacaggaagagtcgaattgctagttttgtggatttggaggggaaaaagtgatttaattgtaattggaagagatgaaatatgtgagatagtttgtgtgaatgctagcgaaaaagattaagtaaataataaaaatgtaaatatttagctgtactaaactaaccttgcatcgcggatctgtaatgtcctttttaagctctcagcgtttctggacttaggacgtatagtagtgactgcaccaacttcagtgatcacacccataatgtctgtttgcattgcataaaaatttaataaaatgatatggcattgcaaaatatgcatataacaatagttgtaacacaataaaagtatgttattactaacgtagaatgaattcttctcgacaagggaaggaacatcttcgaatggtgtcagtgaaaatgtaataccagtgaaatgaggagggacattaatgtgttcttcaagtgttgtccatttactgaagaggatcattaggttgtttgcaactggcctgtatgttctgtttgcagccttaacagtgaatgagtcaatgtagtaaaccttttcttcctttaaggagaggtttcatattttttgttatagggggataaatttgggcatgtatgctagtcccctgcagattataaatacaaatcatgttatcaagagaattattggtatagtaaggcaaatatagaaaatggatttggcaggtaaattattaccatttcatcgagtaagacaagatcagtgtggaaaatttttgtatcatcgttgagatcagcaaagttccatagcctggagacccttgcaaggattcttttgtttgaatctccaaatgataactgtgaaatcagtacatgcgccatatggaatctgcaataagcagaaaatacttttagtatagacaaaacaataatgctatatatgtacaagaaaatattactaagaagaacaatacataaactgcagcggacaaatcgtatactatgtatatagtatatggtatatgtgaaggaggtatatttattccaaaatatatgtacaaaattgtttcttttttagggtaaaagaggttaagtatggagcggcaaagcctgcaacagaaagctatttccatattacattatagatgttcctgatattaaataagcatagctgcaatcttgtagaagggtctatatggatttaagtacgcacacataggacaataaaaaaactacgatgatatgaatccaagcttactatcgtcaataaaataactaaactatattgaacaacatgcgtgagtaatatagtgatggtctgtatgatcagcataatttaaatcgttgaatacaacctaaaagcaacttaaatggtagatcatcctaattttctgtgcactaccattgagtgaaaactataatcatgcactacaaaatcatatagtcagtagctacaggctcgtgcgtagtttcaatgagatcagtcgttgcacccaaaaaaaaaatactggctgcaactcaactgggacaacaatggatggaacaagtagttctatggctgcaagcaacctatcatcataatgaaattcccaaagaaaagaaggggttggaagcatgagctgtcgtacatcaatattcagtagggaaatatgagagacatctatggctaactacaaaggaagaaagatgaccatggaaagttggaaacagaagctttgaccacatatctaacgacgaaatactgaggagaaggtaagaatatgtatatataagaaggcgacatactatcatcgcaagataaagtcgagaagaaagctatgcacacccatcgacttacagatagtaaaaggaattgttataacaattggtcgttataacagttgtgaccattgtaacttgtaacgtctctcttttcctactaatacccaaaattatagggggaaggagggatcactttcactatatgcacacagcacagaaccatctaattatataaaaaaatgacaaagctagggaggaattgcagttgcacacacataaacttacaggggcacacatataccatataatatcatgcaaagaattaaactaccagagaaaaataggaatgcataaaaacaagaagaagaaaataccttcagcacaaagggagaccgaattgacagggaggggaaaaagcagggaaatcagagcaatatcnactcctaattaaacaataaactgaaacaccaagcttcgcagcaaggaaagagagccaacactgtcgtgcgcaaataaacaaccagagctgcatggtacaaacatcatggttagacactaacaagtttaaatctaacgcataacagtagaagaactcctcagagaaatgccagactgaacagaaggatgaactgaaattacctgccaagtatttccagcagctcttgcacatctgactaaaaataattaagaacctttgaagctccgatgcaacccatgcagatcttctcccctaacaaaataggaaagattaaaacaaatcaataagcaattaagattgaacaccattgaaaggaagagcagcaatgaatcttaatttttgaggattttactttaaaaaaatatgctccaatagacttccaagtctccactgctagcatggagcctcatctcgtcggccctctcttccacgtccactgggcctgcgccgatctggacccgcctttttccctaacatcactctagcctcctgatccgcctcgtctcttgattttcgccgtcgcctgggctgctactaccttcgtctgcaggccttcaccccgccgccgaggggacggcgcctcctcgccgtcggccggggaacgcgccttcttctcgtcgctactggtcgagacccaccgcatataggcgtcaccatcaaatcgactccgccgccagcaaccatgtccccttctctgcctcactcctagtggcaagcacttcaggccagacacctcgagcgaacaggtctcctgccgtcctgcctcattggttcctatgctataagatcttttctttctctgtttatctggtaagaataaggaggaagagagggtctagcagcctagcacggtgagaactgagaaggggttgacctgtttgtgtggttatgctagcttggaacctgctatgcgttggacatatatcaaagtattgctactgtatcagctttttttcttgctcagagagcgttaagggggtgtttggg

SEQ ID NO: 65557 - DNA, 2669 bp, Oryza sativa
tatggtggagcataaatctacacatgtattagaaaataagcaaggaatttgaattagtttctcggaccatcatcgtcgatgggtctggattgggtcttaggagattttatggtggaatgatctacctctctcattggtggagcccgccgtttcagcagtgaactcgacctgtggctgcttcaggacacagtagtgtagggattgaattcggttcgctgcagtctgtagcgtgaacactatatccgtttgatcttatttcaaagggcagagtcatccaaaaagcttcatgcagaaaatagatgtaggagtacttatgccgtgtttagttccaaaataattaattcttcaaacttctaacttttccatcacatcaaaactttcctacacacacaaactttcaacttttccgtcgcatcatttcaatttcaaccaaacttccaattttagtgtgaactaaacaaagcaatgtgcagcatgtaatgtaggagtagttatgttctttttccccttctttttcctaggtctcaagaaatatgagtcgccgaaaggatcttttctacttatatttgacggctcagatatcttctctctttttgtccttttagatccgatggttattatttgttacatgatatggcatattctagttctattttaatattaacttttcactagttaagattggaggcaaaaaaaaaatgctctgaagtgaagcgaaacgaaggatctcctatagtgtgctccctctattttaaaatatagtaatttaaaattaaatttaacatcaattagtattatgaaaagctagtatcaaatttaggttgatagtagtatactattatatattttaaataagagaggtaagagttccttaacgattgtaaacttcttcattgcgtacgtttgtgccaaactgccaagcctgtcatcaactttactaaaaaccgcctttttcattgttgaccttagaccttgctaaggtatgtgcaatcaagggtgtgttttttaagtacatttacatttactctctttttttcgtgtacggctttccaaactaccaaataatatacaattttaaaaacaattataacaaagtattattttaaaggtttttatcctagttcttaatagattctaaactaatccgtcgctctatctttcgtgttgaggtagggttcccaaaacacacacaacacaacacaccaaacccaacccgagtacccgaccgcgcgcgtgccccctttcccctgaaaacccacaccaccaccgcgacacgacacgtacgacacgacgacgccgcgagtcacgggagattagccgaagaccgcagcggcgccccccgcgcgcgcgcgcatgtgatccgccccgcctccgcgcgcccgccgatcgattccgacctgtgtcgccgccgcacgccaccaccaccacggattcctcttcttttctctcgcagccatgaataatcccccgaaccccagtatctatctatccatctatctatctgctccatcctctcacgagacaagataccaataatcctgtggcttccgtgatttctcccaaagcaacaacccgagccgtgcttcccttcccctcttccgtccgtttgttttgtccgtctctgcttgtgtttttggttggatcaggacagcaacggccgaccacaactgctgatatgatgatatatcactgctaacacccgaaaaaaaaaattgggcatcgagaggaggaaaaagaaatccggcaatcacctggcgggaaaaaagaatgaaaaaaaaaatgaatattgagagagagaaatttgatggacacagaggaagtgcaagatcggaagcttcaatggattaataattcactaatcacccagaataacaataataatgtacacgtacaacaagtacagctacaatcacctgcactgctgctgatcgctcgctcgctcgtgcatcgggatgcacgctaattacaaaacttcccgatgattagcggcggcgattagcgatcagcaagggagcaaacagaagcaacaagttccggattaagggactaatggcagattaattagctggagctagtaggagcaggcgaccctgagcatggagcggccgcggagcatgccgcggtacagcgcctcccggttcgccggcatcgccgtcgccgccgtcgccgccgcgttcctgcacgacggctcggccgccgccgggcgggacgacgcattgctgtcgttgtcgacgacgtcggcggcgaacctcacccgcttcttgctcccgcgccgcgccttctccctcttccgcttctctgcaagaaacacacgtcaggtgagaggagagtcctaaagaggagccaagaagaacagcacgcacgacggcgcgctatggccatccatggcggcgcttttgctccgctcgctcaccggaggaggagaggcaggggcggaggcgagcaggggcgtcgtcgtggtgaggcggcttgttggcgcggcagagggagaagaggacgagggtgccggagagcgccatggcggtggcggcgagggcgaggccggcgtgggagccgccggccgacgaggacgaggacgacatgggagcagctcaggtagctcgagctcggcgcgcggcggcggcgactgtttggggaggtagttggttgggtggttaaggcgagaggga

SEQ ID NO: 65558 - DNA, 1964 bp, Oryza sativa
attcctgcagcccctaattttaaattgtattcctacttgaactcttcttttattttttttttctaattttggattttatttttatttttattcccaattttaattaatcgcgctcatattgggttcttatatggactcttcttttaatattctttatttttaattctaaattttaactattttaaaattgttattcctacttggactatcattttcttttataattttggattttatttaatttttatttcgaattttgattaatctcatattgagttcttatatggaaacttctttcaatattgcttatttttaatcctgaatttcagctatttttaaattgtatttctactgggactcttttttttctaattttgaattttattttatttttatttcaaattttgattaatctcatattggttcttatatagaaacttctttcaatattgcttattttttaattccgaattttagctatttttagattgtatttctactcggactcttcttttcttttttttctttttcttcgattaatgtgggaatttctagcccccacagcgaacgtggtgcctcctttcaaagctgttttaataatataatagatagatagatagatagatagatttgctacttcctattttttaaaaatgtgtttactagttggattgtaaaagtttacacccttgtgtttgttgcacaggtcataggaggaagagcaatgcggtcaagattgttctagcagtgttaagcagtattttggttgtcctatgcatttcctttgcatggttaaaaatcaaaggccggtatattcagtgctcttttatttacttagatgcgtatggtatactcacaagaaaaattaaagttggttacatttgattttgtgagcaggcaagaaaagaaaacgcgaaaagcacaggaagctatttttggatggtgcgtgtacatctgaagagattgaggatgggagccctatccaagatcttgaactcccatatgtaagatttgaggaaattgctttagcaacccacaatttctcagaagaaaataagattgggcaaggaggttttggcaaagtttatatggtaattcgttccctagtaaaacttcctcttatttattatagtttgttcactaattcattttgtatgacacatgctcaaatacaaatttcttctcaacttttttaaggcaatgctaggtggtcaggaagttgctgttaagaggttaagtaaggattctcgacaagggacagaggaattcaggaatgaagttattcttatcgcaaaattgcagcataggaatttggttcgccttcttggttgttgtgttgagggagatgaaaagctgctaatttatgagtacttaccaaacaaaagcctagatgctaccctttttggtatgccctggtgacatatcaagcataagctactaaatcgacttgacaatagattgcttacatttgcttctttctatagatgtttcgaggaaattgaaactagactggagaacacggtttaatataatcaaaggagtggcaaggggacttctttatctacaccaagactcaagattaaccataattcacagagatcttaaagctggcaatgttttgctagatgcagagatgaaacccaagatagcagactttggtatggcgaggatcgttggtgataatcaacaaaatacaaatactcgacgtgttgttggaacatagtgagtttctatttgaattaattgttcaaagtaagtgtgattaatttaaatcatgtttagtaactcttgcaattgaaatggttacagtggttacatggctcctgagtatgcaatggaaggtgtcttttctactaaatccgatgtctatagctttggtgtgttactattggaggttgttactggtataaggagaagctcgactagtaacatcatgggttttgcaaacctcatagttttggtga

SEQ ID NO: 65559 - DNA, 2208 bp, Oryza sativa
gcattgccacatcagcgctatggagcgggttagaacccgtttggacctacatgacacaaacaagtttagagacctaaaaaatatattttagtagtttggagatctagatgacacactggcacaagtttcgggatcgcccatgtgcttcactctattctatatggataacaaatgtcttgattgattgtgcgtttgtgcgtcaagtgttatagcggctgcgataaccagcccagccgagcaggtccaaattggatgctattagaaaaaaaaagtgtaaaacgcttttgggtaaatcctacaatgaaatttatattcatgaaattcatatttgtttgaaaattcggtcggtctcaaattattgatacttttatgtgcatatatgaattcatcaccaagccagtccatctgaaatacataaattgcagcatagaagatacaaagggtcatacaagaaaccactctcactagaaaagaatagaaacatgggaggtagtagtagtaaataaaaccaataaaactagaatttcgtatttaatttaaatctgtgttcccagcattcagaacctgatgagacagagtggaattctgtggaaagctggaaataatacccctgtggaccaggtcatcagtcatcaccaggacagtttttgttttccttctttcattccccttgttttcacttgcaacacctgtaaatcctactgctggtgttatccggcacggcacgatgaattattggggggatgtctccctcttcttgctacctttgacatgaggtcagataagacggtcacccaatgttatgtctgcaaaagatttatgcttttcccccctcttttacaagtgaatggaggccaaggttatgatgaaaatactttttttaaaaaaaaatcttggatcaaattccaaattaattgaggccaagaagtaagattcagtgactgcttggcagcagggcaggtaggacaacatatgcaggctctcctgatgcttttactttgctaccagttgctttaaatgatctagtttgcctctcatttctgcagccagtatggtttttgctccaactagtaaataaaagaaaaaaaaaggcaaggtcctcgaatttgtttatgattttattacaacctctatactttcagaaaaaaaaaacaggttagagctcttactcttgctaggtgtatcatataaagcagttcaaaaaagggaggaaaaaacaataaaaaccgtttaaaaaaactaagagaaaaaaccattccaaaaaacacagaaaaatacgggggagaaaagattgaactatgtccatcagatctggttctgttgaaatgtacagtcctgtgactagtgtactggtctaaactattaactattgtaagtattattgagcggatcagcaccttacaaggtactccctccgtttcacaatgtaaatcattctcgcatttcccatattcatattgttgttaatgtatggaaaatgctaaaatgacttacattatgaaacgcaggaagtattagactttcacaagcttctcccatcaatcagaccaaatctccctagaaaaacctaaattatgtcacgttttggatcccattaattccatcgtcgtcatcacgtcggatccaatgatcgttaattgcatcagctagcttaaccaaatgaatattatttgtccagccaaatggcccttgtacctgccggaaactgctgtcctatgtagcggtttcgcgtgcaatttgcaacgaaaaaggacgcccatttggcgatgtaagctgacatcgatgcccccaaaagagcccaataggaagctaatggaggattaattaatgaaaaaaaatccttgaattcatgtttgcctctctttttttaattcaaattatacatgtatgacgtatagagcagcatgcatgatgtaggtgtactgttagctgcaactggaattatccaattccagttaaagtggaaccctaacccaattatttgagatctaggacaagcaaaccgcacttttgccactctttttctttttttcatgccgctgctagctaatggagaacacatccataatcagtatctaaaatgggtgaggtacatctatatatcctttaggataataagattttttttctaattatttctataaaactttaaaagcaaagtcgatctccttccatcccctcctcacaccacgtgtgtataaccactgg

SEQ ID NO: 65560 - DNA, 5672 bp, Oryza sativa
taagtcaaaccttaggaatataaatcatgaataactctcaagttgttgagtttgaaaatgtaaaaattatatgaatagatttgtcttgaaaaatactttcataaaagtacacatatatcacttttcaataaatatttatagaaacaagaagtcaaagttgtgttttggagaccgtgtcgctgtccaaacgacttactttacgagtacggagggagtacctttgtttcattttgaccttttttagtcaaaacaaataaactatcaaaatacattcaatattagatgtaatgaaattaaattaatgctacaaatgttattatatttttctataaacttgattaaagtttagagaagtttgatgagaaaataaaaatgacttataatatgaaacgaattataaacggagggagtaatttttaaagtaatataataattaatatgatctaaaatagctaaaaatacacaagctatccgtgcccggtgacacatcaatgattggaattgggttaactaatgatctaaaaccttagaaagaaaatttagagaaaaaataccactaaaatacaagaaattggaaaatatagaattggcatgaactcatgggaaatgtttgcacgaggtatgtcgattcagctgctgtcctggtgttcttgtgttagataatcctacaacctgcttttttttttccctggccctctctctctctctctttttttaaacacctgggccctctctctctatctctctctctctcactctgatgattacttttcccaggcgtccttgttcttatcccctatccgcccggggatttgcagtacaaaacccaacacgctgtggctccccttttgtactgcgtccctgctgcctatgatctcattggtggccgaccgcggcatcgacggcttcgtcacggaaagaggagaggagaggctctccccgtcgcctgccaagtgcgaaagcggaggagaaagcgaagcatagcaaagagagagatcgctgccgtgccgtgacgcaaatcgaagggagggtcccgcgctggctgtcacgttgggagatcctatggtaggagtacggtggtggtggtggtgacaggatccgtccttctagggcgtcccgggagacgtcgctgttgggagtttggggacacttgtcgcctctgtggtgacccggcagattgggattgggatttggatccggtgcagtacctagtgtgactgcaacataagcagtcacattaggcaccttttgatgtaaatctgagggtccaaaatctatcaagtattgttcacacgaaaaaaaaactgtaaaactagcatcaacattgtagcatcagatctagaccgttcattgaaaaaatggatggctgagatgatgtgcagttcctaacttgcagtcacagttaggacttcactaaatctcaattcatcagattgagaggtcatcgctgcttggtgtggtaaaaccgtaaaattagcagtgctaggatcctaaaacctactccttctttaaaattaaccaatctaacattagattaaaagtttctttttccagatttataatagtagatttaggtaatgtctccaatcttaaattgatttattttaagatagaagtagcacgtgtgaggtttttttttttacatcagacagatataaagaaattctctatttctagaggaccattcacatggtaacaacatgacaactgacaagtagatttgtggtttcggcttaccacatctgagccatgcctccactttagtcaagcccatgccccacaacagagctacacgtgtcttgcaaaaggaatttgtgtctagttaagacgatctacttacaaaccgtattgagtgaggccgtaccctcgagttccaagcagtgaaggccaaatctggaactagggagaggcggagtatggttagatatgtcaaatatgaaagaaggcggcggtgctcactgccagggacaagtgaagagagggtgaggaagatggctgatgatgagggagggagaaaaggggcccaccaccatggatgttgcaccgatttacctctgcgccaccctaatcttattatttcgttgctccacgtcgcctcgatctgaccaaattcaacaagtttgtagctagcattggcacgctcatgaccagatttagcgaggtctttgcttgtttgatggttgacggtgaaaaatcgacctgacgataattcctcagccctaaccagccttgatctatgctgatggctagctcgtcggccgaagaagttgaggtcatatatgaggagaaatgaagcgatgacggtgcccaagagtgcttgttggcatgtgccaaggaggagcatgtcaggagagaaaggagaatatgggaaatggtgaggagggttatgctaataccccatctttagagtgtttaatgtaaaattatggacatagtgtatataaattgagataatatcgtgaactaaaatagaaattgatatgggcaacttgtaaaattaaagccactacgtgttattggagaggagtatagtctccgtctatgtgttcttatgagtggcttccactaccgttgctaccctattaaactttagtagttttcaaaatacatccactttaaactctatcaaaatttgataagcctacaaacaaatacatccataatcactaaaatttggtaacaacataatgccaaactttactaaggttatttctggcaacaattcacgtgcctataaacactagacctcggtcagctggtcaagaaacggcgatttctaaatccaaaagggatagtggagaagcgggtggacgagagacacgagacaacgcaagaggctgtagccagcatcaccagctagcaccaggaacaggaagcttctgcccggtttctccctacgtctacatccccggttgcccagttcagctcccctccacttctcaagctcttccaaccgagtagctttcatccaactgcgagagcttctagaagaccagaacaacccagagactgtgaaacatcaacctctcgaggcactcaactcttttcatcaagaagcttccttctaatcatactgcacacatggctgctcaagagtttatctgaattgggagtatccaatctacatgccacacagcagcacaaggcctctcatgagtgaccactgatgttctgataacaacaggtaaacaacaatggcagctgacagcacaccatctccttgctctgcacaaacgttggcagctattgaaacttccacaagtttctgagaatgccagttcagaaagtatggagcaagccacagtaccactgcttatggaacaagagaagactgccatgtaagcagtccagaaagggatcaacttctaacttctaagcacatatatatacatgtacacatacaatttgaggggcattttaccgtctttacactgctcaccgggtcatttgcgtattcatttaacagggtaaccataaggaagttatattggtaaagctggcagattattacatacagtaggcattgacttttttggcatgtagccaaggggcaatacaggcatgtataaccagcaccctttctgcagggcaatttcgtcgtcagtaaaggtcaagctcctctttaatttcaggagcacaaggaatggtaaattaagttaaagagtgttttcctgtgttttacagtttgactaacaaaactcaccccaggacaggggcaaaataagccttcaggaattcacgaggaccagctaactcggagcaaacgatgccttactgaaatgtcaaaagtaaaggaaatgagtcataaagaagagaatttgtccagatctgtgagaacatgagttacaagtttaaataactgaacaaattatcatgttcataaactaactcttgaattagaacagtatcataattcaccaaggatcaggccctccgtccacatataaggtattttgactatatacatggacaagtgctcccaggtgcatagctaaaatccccttatatttgtggacagagagagtaggtaacatagttcatttggagtggaattgaaactattggcaaacaatattgcagtaatgctatgaagttggctccaataatacaattagaacctgacacatgaaaagagccagctgtatattcgacagatttcaacaagcatatttgttatcagttgcatgaattgtatgggacaatgagtacaaactaagattcgttaaactctgggcatacttagtactagtttgccacggcaatgctcccaagtcctgaaatctggaatcaaggctcataacaaagaaaagataattaaattgttgtttttattcctattattttgaagtaccagggcatctagaacagaagtaccacttatacatacggttttcaaggagacaaaatagaccacaaatctcataacgtttcaagctaactattctatacaagttaataatgtttcttcattcaaagcaaacaacatttcatttcatcaccttataaagtcatatagagatcatgcttccaaacagaactgatcccattgatattccaggacatacaaatattattaacaggaaaaaaaaatatttagtcacttccacggcaggtgattccgtgattggcacatataatgaaattgaaatgtcctaatgtttagacgctctcttgtgtgcattaatgtaatagacaagatcggaggaggaggacgagcaagcagatttagctgcaaaaacagtatggaatggatttccgtctgtacctttcaggttctttggccattaacatatttgattccagatctagtatcagtcaaattcgatcttactttggccattaatatgcacacacatttaacttatactgggtccatactcatacctctgaatatcctgcagcttaactaaataataaactaaagtattaacatagtccttttcaagtctttcactttttttgaagtctattcatgataccaaggtgtattcagctatgatacaaaaaaaaagttatgcatacgatagctgtctcttacagtatgttccacttctagaagactaaagtattatagagtattaactatccatatgagcacagttaaactgtacaccaggatcagcaaattttaggcatttagcttccagtacccactgggtttctctgtcacaggatcaagggaaaaaaaggacaaaatgctcagttttcaagcttgctgattaagcataattacataagctaactcctaagaaacatcatcagctctagtcgctgtggctgctaatataagctatgttgttcactattcacttccaagtatgtgcagcagcataaagtagttgtgtatgtacaaaaaggagttgttataaagaacagaagggcatgtcaagtataactgttgtgatataacatgacagttaggaattgtaccagtacgccagcaaagatgtctcaatgatctgatggttatcgcttcatttctgggaaatgaaaattaagagagatgccaccatagcttcaaattctgtcctgaaggcaccgtcttgcacttcaaaaaagtagctacttaaccagtaaaatcatgtatcgtcattatctctacagtcagccatgtcaataaatgatggccgatttgccaaacagctccgtaattcaatcaagggagagatttt

SEQ ID NO: 65561 - DNA, 8319 bp, Oryza sativa
  unsure (1)..(8319): unsure at all n locations
agcactgttgtgtgttcaagaaaaccctgatgatagaccacttatgtcatccgttgtgttcttcctggacaatgggagtaatactgcacttccagccccaaatagccctgcctattttgcacaaaggagttctgaaatagagcaattgagagataatattcagaactcaatgaatacttttacgctaacagatatagaggggaggtagctaaggataattctttgacttaggatgtaacaatcactgtccaaagaaaaatgcagacagctgatgcatgatttgtggtttggaactcaatttgttgctattcttttctagccctttctttggtctttctcgttatatcacaaaaaaaaatctaaaaaaatctaaacaacacattatacttaaaaagtaaaagccaacatctgtacaagtgtaggatgtcactcagttgaacagacagaacgttgactgacacgaagggtatgcattcatatgaagctaagtcaccttcaactcgttcccgaatcccgacgcaccagtgcagcacgtacggcaactgcgacatcaccgacgggtgccgccgccacgcgcaagtgcctcgacggcttcgagccggcgagcggcgaggagtggagcaccggcaggttctcggggggttgccggcggaaggaggcgctgcccgtgcgacgccgccgatgatttcttggcgctgccgcggatgaaggtgccggacaagttctctatgctcgtcgctttgcaatgaaacagtagaccagtttaccaagctttgctcctgctttgagacttgccgggtcttcacctttcctatacataaaagctcgtcacgatctgtagcgatcagtctctttcagtacacaagatggggaacaactggatttaacggaccaaggttttcatagccgctgaggtaaagagttttccttttcatcccttgtcaatgagggattgaggggcaggaagtctattttatgatgtttcattgtgtgaagtggtaaaccaagtacggaaagttgccaacgttgccagggaagtgggccaagttgttgaggatggattctaatatctcgggtggacgtccacccgtgtgtttaaaacagtttccccaagttgttccaaaatctatatttcacacgcaggcaatgatatagcattgtagcctgctcacttcacttgctcagtgcaagctcatactgaaaaggaagaaggttctgatggatcgatcagctgcggctttagcctgcatcaccagtgttctcctcctcctgccgccgccatgtgcatccgacgaccggcttgtcaccggcaagccgctctcccctggcgccaccctcgtctccgacggcggtgccttcgccttgagctttttctccccctcaactgccactccggagaagatgtacctcggcatatggtacaacgacatcccccagcgcacggtggtgtgggtcgccgaccgaggaactccggtcacaaacactagttcgtctgcgccgacgctgtcgcttaccaactcctccaaccttgtcttgtctgacgctgacggccgcgttcgctggtcgaccaacatcaccgacgatgcagcgggctccggctccacggcggtgctcctgaacaccggcaacctcgtcatccggtcaccgaacggcaccatcctgtggaagagcttcgatcaccccaccgactcgttcctccctgggatgaagcttgggatgacgttcaagacgcgtgtctccgatcgcttggtgtcgtggaggggccccggtgacccgtcgccgggaagcttctcgttcggcggcgacccggacacgttcctccaggtgttcgtccggaaagggacgcgcccggtttcgagggacgcgccatggacgggctacatgatgttgagccggtacctgcaagtgaattccagcgacatcttctacttctctgttgtcgacaacgacgagaagagatacataacgttcagcgtctccgagggctcgccgcacaccaggtatgtgattacctacgccggcaggtaccagttccagcgctggaacatcagctcgtcagcgtgggcggtggtcgccgagttgcctagatgggactgcaactactacaactactgcggcccgaacggctactgtgcgacaacacggcgagggcgcctgccgtcccgacgtgcaagtgcctcgcagggttcgagccggcgagcgcggaggagtggaacagcggccggttctcgcgtggttgccggcggacggaggcggtgcagtgcagcgaccgtttcttggccgtgccggggatgaagtcgccggacaagttcgtgcacgtcccgaacaggacgctcgacgcgtgcgccgccgagtgcagcaacaactgctcctgcgtggcgtacgcctacgccaacctgagtagcagcatatcagagggcgacgtgacgaggtgcttggtgtggtcaggcgagctgattgacacagagaagataggcgaatggcctgaaagtgacacgatccaccttaggcttgccagcattgacgcggnnaatgtatgattacaattttcttctgcaaaaaaaaaagtggttacaatttcagtgattatatgagaagtggattcttgtcccttaagaggacatcttctcgttttatgcatgacatttaaaaagttatcaaaataattgaaaaaaaatgttaagatagatcaatatatgatatattgtttcgcaaacatgcaaattaaaattcgacttatacaattcaaaaaaataacaaatttgactgtgaattacacgttcttttcataatcaaatttattatattttttttctacttatataagttgaatttgaatatacatgttcgtgaagtgacatattacatgttgatccatcataataattttttgatgactttttaagtgaaatgtaaaaacgaggggatatccctttaagggatgaatatagttttccgattatatgctttagtactccactactcggtaccttttaataccacctttttagtttatttttattagcttaggtaccaaaatttacaatagaaaccgtgccaaggatcgctatgttacaatttactacttcctttctttcttaaaaaatacaattgctagttggatcgtaaaagtttgcagcgttttgtactgttgtaaaggtcggaggacgaagatcaatgccgtactcaaggttgttctgccagtgttaagcagcattattattgtcctatgcatgtcctttgcatggttaaaaattaaaggtatattcagtattcttttcttttcttagaagccccatggtacagtcatcagaaaattaacgttggatacttttgattttctgagcaggcaagaaaagaaaccgggaaaagcacaggaagctaattttcgatggtgcgaatacatctgaagagattgggcaagggaaccctgtccaagatcttgaacttccatttgtaagatttgaggatattgctctagcaacccacaatttctcagaagcaaataagattgggcaaggaggttttggcaaagtttacatggtaattcgttccctagctagtaaaacatcctcttatttattatagtttgttcactaattcattttctatgacacaagctcaaatttcttctcaacctttttaaggcaatgctaggtggtcaggaagttgctgttaagaggttaagtaaggattctcgacaagggacagaggaattcaggaatgaagttattcttatcgcaaaattgcagcacagaaatttggttcgccttcttagttgttgtgttgagagagatgaaaagctgctaatttatgagtatttacctaacaaaagcttagatgctaccctttttggtatgccctggtgacatatcaagcataagctactaaattgacttgacaatagattgcttacatttacttctttctatggatgtttcaaggaaatttaaactagactggagaacacggtttactataataaagggagtggcaagaggacttctttatctacaccaagactcaagattaaccataattcacagagatcttaaagctggcaatgttctactagatgcagagatgaaacccaagatagcagactttggtatggcaaggatctttggtgataatcaacaaaatgcaaatactcgacgtgttgttggaacatagtgagttgccatttgaattaatttctcaaagtaaacatgattaatttaaatcatgtttagtaactcttgcgattgaaatggtaacagtggttatatggctcctgagtatgcaattgaaggtatcttctctactaaatccgatgtctatagctttggtgtgttactactggaagttgtaactggtataaggagaagctctactagtaacatcatggactttccaaacctcatagtttacgtgagtatatatatcttttctgtagatttatctcagattaaaaccagaagatttgggatcttttttcttagttctataaccaaacattactttttattgtttcagtcatggaacatgtggaaggaagggaagatgaaggatttggcagactcatcaattatggatagttgcttactacatgaagttttgctatgtatccatgtagcactgttgtgtgttcaagaaaacccagatgacaggccacttatgtcatccgttgtgcccaccctggagagtgggagtaccactgcacttccaaccccgaattgccctgcttactttgcacaaaggagttctgaaatagagcaattgagagataatattcagaactcaatgaatacttttacgctaacagatatagaggggaggtagctaaggataattctttgactttagatgatgtaacaatcactgtccaaagaaaaaggcagacagctgatgcatgatttgtggtttggaactcaatttgttgctattcttttctagccctttctttggtctttctcgttatatcacaaaaaaaatctaaataacacattataattaaaaaaataaaagctcatatttgtacaaatgtaggatgtcactcagttgaatacacagaacattgactgacacgaagggtatgcattcatatgaagctaagtcaaatctagagtcgtcaacatgacggtaatcaatacaataccatcagaagtacgtctgcaataggataaattcaatattatttgtctaaggctggtttgagccgcctaatagtgtcgttgatcacgttttcctgcagctctctcctgatcctaataaaattcagccgacgatcttcacctgtccaaaataaagtcgatttcatcaatcatcagaagcaagtctggaaggtgactttcaggtttaagctctgaagtttcggtaaccaagacaaatgcaaaacgagtagagactttaaacatacctgaaaaattcacaacctacaactctggtttgatttcatattttcattgttctgactaggactgtacagaagagaacaccattggacggacattcacgcgcagtatgaacaacacgcacatgcaggaaaaaaaacacgcttccacaccaaatagtactagtatttacctaccgatcctcttgttcttggtcgcaccatcgtgttcacctcctaagaagaaaatcttcagttgttgttgaatattgcattgtgcgtaacagaggagactatttcttccgtccatttgttaggccttgtttagttccaaaaaatttgtctcgcaagacgaattctttaagtctaattagtccatgattagctataagtgctacagtaaccccatatatgctaatgacatattaattagacttaacaaatttgtcttgcggtttccaggtgagttacgaaattagttttttcattcgtgaccgaaaacttcaaccgacatccggtcaaacgtccgatgtgacacttaaaaattttatttcgcgaattaaacacgccgttaatctacctggcacaacgtcaccgtgtactagtaccaactgtcagacttagacgttgtctgaaactcttgatgctggaaaaaaaaaaaactcgcccaatgaaatttcattcagactgcaattttcagagtttatgtatctgattgtgcacttcgaagctgctcctcctgattctgtaatcctgtagagtacagaagggaatacaaatcttggtgatggatagtacagcttgtactaccatcgtcgtcttcctcctcctcttgccgcggttgtgttcgtcggccagcgacaagatagagcttggcgagcaactgttgccggggcaaacaagagcttcggatggcggggccttcgtgctaggcttcttctcgccgtccaattccacaccggagaggcagtacatcggcatatggtacaacatcaccgaccgcaccgtggtgtgggtggccaaccgggaagctccggcgatcgccgccggcaggtccatcgccccgaggcttgcgctgaccaacgactccaacctcgtcttgtccgacgccgacggccgcgttctttggtcgaccaatgtcaccgccggcgtcgcggctgggcgctcgacctcgccgccggtggccgagctcctcaacaatggcaacctcgtcatccggtcgaacggcgccatcctgtggcagagcttcgaccacccgaccgacacgctcatacctgagatgaagatccagctgaacaaacggacgcggcgtggcgcgcgccttgtgtcctggaaggacgccggcggcgacccctcgccggggagcttctcgtacggcatggacccggagacgtcgctccagctcgtcatgtggaacgggtccaggccgtactggcgcaccaccgtgtggacgggctacctcacctccggccagtacctcgccgccaccggcacgaccatctaccggacgtggtggacaacgacgatgagatctacgtgaagctcagggtctccgacggcgcctcgccgacgcggtacgtgatgaccagctccggcgagttccagctcctgggctgggacaagagctcgtcggagtggatcaccttcagctcgttcccgacgcaccactgcaccacgtacggctactgcgggcgaacggctaatgagacatcacgacgggcgccgccgccgcgtgcaagtgcctcgacggcttcgagccggcaagcggcggggagtggagcgccggcaggttctcggggggttgccggcggaaggaggcgccgccgtgcggtggcggggatggtttcttggcgctgccgcggatgaaggtgccggacaagttctcgacgctcgtcgggaacatgacgttcgacgagtgcgcggcgaggtgcgccatgaactgctcgtgcgaggcgtacgcccacgccgacctgagcagcagcagcgcccggggggacatcggccggtgcttggtgtgggccagtgagcttatcgacatggtgatgatcggccagacgacatggggccgcgccggcgagacgctctacctccgtgttcctgcaagttcaacaggtaagctaaattgataaattttgaaaccagatttcacaagcatatgcaggttgtatcatttgctgttggttaaaaatgagctgaaaactgtcaaagagacaaaattcaaaccagtttcgtattgcatttgttcataatacattgccctgttttggtgcaggtagcaggggaaggggaaatgttgtgaaaattgctgtgccaatactggccagcgctttagtgctcacctgcattttctttgtatatttctgcaagtccagaggtacagtagtacttctatccttgtttttatgtttagattatatgctctgatcagtcatgagagaagacaagaccttaacttaaactttacagagaatagaagaaaaagagatagccagaagacgttggttcctggaagtaggaatacttcaagtgaacttcttgaggaaaatcctactcaggatcttgaatttccatccatacgattcagtgatattgttgctgcaacagacaacttctccaaatcatgtttgatcggacgtggaggatttggaaaggtttacaaggtaatttattctgaattaaccttttgcagtttttttttctgaattgaattatactcaattcttacttactcttttataatttggaaggtaacattagaaaatggtcaagaagttgcaatcaaaaggctcagcaaggattctgaccaaggaatagaggagttcaaaaacgaggctattttgattgccaaattacagcataggaacttggttcgacttcttggctgttgcactgagggatctgaaaagttgttgatatatgaatacttagctaacaaaggcctagatggg

SEQ ID NO: 65562 - DNA, 6260 bp, Oryza sativa
caactgatgaaacatcaacatatccctacaaatcgaagtaagaaaaaatatgtaacatcaaaagaatttatacataaatattttgatataatacaaagaaacatgtaaaacatatatgggatgaaacatggaaaaaatgacaaaaaaatatgccaatccaaatctaggtccttcttactctccgatggctggatctaagattccttcgatgaactcgtgcctatgacgacccagtgctccttaccttcgatgatcttgccttcctcattgtcggagtccacagcaacggccatctccttcattgctggttcgccacgatggggtcatcccctcctcctctccactggtgacctcctagatgtcttcttactctgcccgccacaacagtcgttctccccgtcactatcgccaccaggcggccatggaaacaacaataccatcatcaccgcaaccttttcatgtatgtggtgtgaggtttagagagagaagagagagaataaggggatagagacctagaaagagagaaataaggacatataagtgagtggtgcgggtattcgattttttaaccaggatcggatgcccaacccagtgtttttaagaaagtgttccaattttaagaactagtgagcgtgcacgtgcaaggcacgtccatacatacatactctctcaggaattcatcttggctctagctgttgggcgcgtggctccagcgacaagttggaggcaatagcaacggtgattcacgacccatggcgcagctcaccctctgccgttgatcatgatccatcctgttcataaataatcgcacaggttactaatgcaatgaacaaagatatctaaaggaacaatatattcttgcagtgtgtgctatagtccttccataatttgtccagctcatatggcccaaagcaaagtatttgttcaaaatatatgtagttctgtgaaatttactttgaataaaattatgtctgactaccttcaaatgttttgcatgcctcttgttcaagcaaaattgggtgacgtaataagaaagtaggtctcaagcaccatagatgcttgcctgcaaaatagcaattgacataatattggaatatttcctgtgcgaaatttgttatctacggccagtagcccttatgtgaagaaatatcagattgatcttaaatataagaaaagaaaaatattgattttcagttgcttatccagtgtgtagcagcatggcagttactgaggatgacaatatgcattggttggcaggaaactacaaatgcattgcaagcaaccaacacaagtgctcaattcatagcaaatactgcccatacattgaaatgttaagaaaaacagagtggtctgttaaaccggcctgcatttgtaataaaatcattaatgaacagctaaagtttggactatcatagtacatgttgaacagtatgaaattcatatttgacaccacacatttatataggctcctagaacacaattcatataccgaataaatcaatcaaaatagattatacatgcaaaagaaattgcaattggcactaaatttagctgggtggcataattttcacagtactatattcactaattccaagcattcatatttgtacaggaccatctataattttgttttgaacatgtaacagcttcgtggattgcaaaaaacagaaaatgtgcagcacaaaaccacaaaaagttcaatgattaggagtaaatgagaaaaccaatcttaaaacgtgaatataattacacggaatgaagttgtgtatattgaaaatgcaaggaaaacgctgattaacttgatcattacctttatgtcttgttctaactccatcactaacagcatccccttcactgatcaaaacagtggatgagcacttccaagacccatagaagacctgctccaacagagaagaatataagcacaatagagctatgtgtttttccttcaattcagtgagtccaggtttcatcagtcaaaaaaaattaatgcaatgcatcacgtaaattgctacctacaacagtgtctcgaatcaaagctttggcactgcacagtaggcagcatgcatttttatcaggaaggctgaaattaagggaaataaacagctccaagcctccaaccaatctgaaaatgcatcatttagcataagtagtgatctatggccatttcatggtttgtcaacatgatttcttttgggcagcatcataggaggcataactctctttgttctaaataaacatgatgtctattttaatgtatatatccagaaattttaggaacaaacatgttacctttcagtatcacggttcctgaataggtttgggtagcaccaaagccagcataatttgtgatatctcttatgggcacccttcctatttaggaaaaagaatgaaacattaatagcatgcccaaacaatagttactaatgaagtaaatagcagtggcacctgaataggcttggtagcaccaaagccagcataatttgtgatatctcttatgggcacccttcctatttaggaaaaaggatgaaacattaatagcatgcccaaacaatagttactaattaagtaaatagcagtggcaaagaaagcagaatcattacatagcagtgatccctacctgtgacgattgtagagggagtgcagcatacctctctgtcacgctttctcctatccttggcagcagttaagtttgtaacatcgaccatggcaggtcgtcctctaatgtgtggcaggaaagagtcaaatcaaaccattttgtatcaataacatgttgtggctctgttaaaaaaaacatgtgaaagcctttttacgattaaacagataaaaaactttttaaatagagaagctaaataaatataggcacattaatctggaactgtaaaaattgaaaatgagagataggcactgaattactgcatgttagtagagaagaaaatgtccaggcacttgtgatgtccctgcaatgctgcaacagaaaaaaaaatgttcagagaacaaattgtccagctaatgataaatccctgcaatagttgaacaggcataaaatttcagatagttacccagcagaaaattaaaaatcaaatcaagtatgctcaagcatcaagttctgttttagtttgtaagtagatgagaaaatgtccaggtacttgtgatggtccctgcaatgctgcaacagacaaaaatgttcagatgaaaatgtctagctaattatgataaatccctgcaatagttgaacaggcaaaaaagttcagataggtacgcaggagcaaattacaaatcaaatcaagtatgctcatgcatcaaagttctgttttactttgcaagtcatatccacatgagaatggtagctgttgtaggtatatgtgtgcggatgactgcaggtcaatgggaacagtaacctgagaaagaattagatcgcaaacttttttgtttacagaaagagcaaattattcctcgggcttgctaggccgaaccatgatacagttatttacacaacctacactattaccttcagcagttgacattgcacgacacaaatgtaaatggaacatataaaggactggcagagatgcttctaattacacttagaatcagaatatgtgtagtctaacaccaaaatttgaaggttactcatgtccaatccttttgctcagtgctcaaggaactgtaccagttgtttgctctcttccttttaaggtcagtgctctttgaatctgttactatacgaagcgaaggtataagctgcgatgccagcaagtataaatacttgaagccatataacagagtaggtagggtaatatctcaattcatttctcaaattggatatttcctataataaaaataggaaattcgactaaaacagacttatctcagaagtaagacacatacatggtcagcagggagagccactgtgttggttgcaatagatccacttggagttgagaaagctcaagagtggtttatacagagacccctactacaactgcagcactttagagatatgtcaattgatcccaaagtcagacctacaggagatagaaaagcagacgaatcaattccatttaatttcagttcatcctatgtgtaaagatacttcttaattttcaaatagatttcagtaaaaaaaatgactgtctatactaccaaatgcaggggaatattttgttttaccgaggattggaatcagctcttcacaacttcgccgcccttttcaacccttcaatccaattttcatcaaatcagtcaaaattatgaatccaaccaaataaaaaaattgaatactatatattgaccgaaagcacctaacctaacctattgtgcattcaaatatagaggcaaagtaaaaggatatacatttcattagagaatctgataatctatcaataccaacataaacattcagaataacatttatgtttatacctctaatttactcgcacatcccgacatcaggcatgatccgcctctgccccacctctcacctggaaggaaggtctatggcaatcagggtggagagcagctgaaaacggcagccatcgtgaggaagacagacgaattgatccgtggcatttaacatctaaaataatacagattgcatcaacggggaattttacccctttccctctacctcttgcgcctaattagcttcattagtactacatgattcggtgctaaccaccacagagcaagttgcgcatcagcctgcttgtctggaggctccaaatctgtcatacactggaatatatataaatagaaatttaaaaacataaaaaatgttccaccttatgtagcaaaagaacaaaagtgaatcacttggtaacaaaatcaattgtctactgcttcttcaggctccatttctcggagagaccactcaaaactcaacatgatgttttcggttatctggcgtttaaagattaatagtatgattatgtgaaccatgttaacgaattatgtttgagtgaatggatgcaaattaacagacaaattaacagagagagaaccacacctgagaggagaggtcggtgccggtgatgatggcggcggcggccacgacgccgttagtcagcatgggagaaggtgcaagcaacctgaggccacgacggctgtgcgcggcgaaggagaatcggcgacgacgactgaacggcggcggcgcggaggagatcctgaggcagcggggagaggggaggtgggcgatgcgagggagaggggagtgcggcgaggggaggtgggcgacgcgagggagaggggagaggggagtgcggcgggtgaggcgggcggcggaggtacgacgtggggagggcggcgcggcgcgacgtggggatggcggaggttagcggcgcgcttttttttctatttttcttggtgcgtggttactttcttagggatgacaggtgggtcccacgcaacaacggatctgaaaggggattgcaggattaagaatgaactcgtactttatatatatatatacacacacgttaagctacttgttttatgtggggataaaatccagaatcaagagctaaaagaaattaaactgatcctaataaatggagcagaagagaaattaattctttccgtaaaatggacaacctctataatactagtactcacacctgtctgtagccatcaacgcggactcccctgacagagtggccccacccaggcgcgtacctccctagtaaaaacgccgcgccggaacccgtgagaaaataccggcgaaactcgaagaccaattaaattcgaccgttgccgttcccccgtttaaaaatcacttgcccaccgcgatcccttccatcgcctccccatccatccgaattccagtcaaaccaacaaaccaatcgaagacatcacgcgaggagagaaaaaactagccgttgcgctactcctccgccatggacgcgacggcgccgctgctcagccccgcctccgacgaccgcttctgggaccgcctccgcacccgcgtcgacaccatcctcgaggaccgccgcctcgtcgctccccccgccgccacggtgagccgcttttgctgtcccccgtttgtttgttggtttttcttcttgcgtggggagttggatcttgatgtggcgcgatctttgcagtgcggggtggaatccgagcgggggaagcggctcagggaggactcgctgatgctggtgcgtggcctcgactccgtcgccgcctcgctggcgcagctctccgacaccctcaccgccgcgcagaaggttcgggatccacgccgccggcgtcgcttgcttctt

SEQ ID NO: 65563 - DNA, 3069 bp, Oryza sativa
caatttttttataaaaaaagaaatctctaaatgctatacatctgggagaacctatggcaatgagcatagtgtttatattaggttccaatgttgtgattgcaatgtcccatttttcgaactttcttctagagttcacctacaaaaaaagatctgatcagtacttcaatcccagctgatgagttcttttagatggaatggatgcaggttctgtagaacatcataaacatggcaagattagggtctctcaaaatttcatcaccaacagtggcattagagcacctggtaaattggtataatagttaggttgctccattgcattaataaaaaaatgaaaatcactgtcaatgttgatgtgcaacaattcatggtgtataggggaaaaaacgagattaactattcctcatggcaaccttaaaagaacaactcacacaaacctgcacatcctttgtaagctcctgtgccaagagtttagtagtcaccgtcgccaccgccgtctctggtgccatgagttgctcgctgctggtcattggccttgtacattgacggcaacgcggctgccgatgaagcgactacctgtgacccagagggcacagatgggagggaaggggaaggcattggtgcggcgtacggtggatgcccctgctgctgctggtgtgaagtggcttcttaacgcagtctgttggcgacggcgacagtgagggcgacgccgacgaccatggcgacgccgatgagtggtgggctggggtgtccttgtggagatgagaagcagatctggcgccggaaggacgaagaccgcgcccgcctcaacccccactccctccgccgtctccccctcgagttgatgcgtccggaacctcgcggcagtcccgccgccaggattgggccctcagcttttcgcgccgcctgtgatgcagccgtcggcgctccgacctcgtcgttgacggatgccggaggcggagacggctgcactcggtgacggcggtcggagacggcgacgcaatggcgccagcggcgcagggcgacggggacgatgatggcgacgacgcgagggggatgcggaagcagaggcgcttggagacggtgacgcgacgacagcggctgcgtaggcggaggcaatggcgcgaggggaaggcggaggcgagggtgggggagcagacggcggagggagagggaaagggagaaggagagagtgggggaagagagggcggaggggagacggacggcggcagctcggccggcgatggggacggcgggaggcgaaggtggcagcgcgatgggtaggcgccggcgggggtgaaggcggcggcgcgaggcgacggggacggcgtgagggggaggcggaggcggcagtgcttggtagcggcgcgagagagggagagcaagcggctagggtttgaggggtctgcgctagtgggagtattttttcgaaaaagcccctcgtcttccacatatcacaacgaagcccctgtccgcgattttttctcttcaaacacaggacgcgaggggcctatacctgattacgaagaaccggagggctttttcgcaaaaatccaacctcgcactgtagctactgtagcaaaatccgacgtggacacgcccagcgtccgccccttccgccacacttaatagtttctaatgaaccatggcatatagaataatcaattcattatcagagacatggcaatccatttgtacataagcctaagagttagattatggatgtcattggttctgggtttcttataaatcggtgcaccagaaatatcttcacagaatatgtttttctcaaaaccggaagttgccttccaaaaatcgactctacaggattcggggaaaccgagaagtgtgctcaatccactacataaaagattaaactctttacggaaaagtcaaaaagtaacaccaccctctgcttctctaagtgtgcagagaaactgtatagttagtagacaagagcctaagtgtgcacagaaactgtatagttagtagacaagagccaagctcgtctaccgttgcaaaggcgtgccaacccatggttctccaaatgacactaaaatctacatccatacttgttttccggagtagctttggatcgtacgctcggttgtgagcgaatgatcggtccttcagcatctggtaggcttgtttctctcgtctgtcaacgatatcgaggtcgttgtcggtcaggagctgtggtacagcgtcagtgttctccattgacacgtcggcagatgcccgatcgctcgactggttggatcgggagccggatcccttgagcaagtgggagagccgtctcctcatgactgcacaaaggcaagaatacaaagcgaactcgagcaggggttagcacaagacaatatacccgccagttaactttgcaccaaaagcaacttgctaatgcgagaatggaggattttaactatgaggctgttggctgttgttaatgacagactttatgccaccaatacctgcataaatcaaggaaataaaacatccaacatagtgatagggttaaattctgacatattccacgagtgttggtgtatatttgtatgcaggtaataaaccaccaaagttggaccaaaaatagacttgagtgaagaataattcctatccataccaagagtgggccaaaaactaccagaaaacatcttcaaatgggctttccactcacagaaatggatagaggacgcagagaaggagcaacaggccgaagatgggctctgtgagccagacctgggtttggtcgaacccatggttcggccaaccactaccacagccgttcgaactggggcttcgcgtggatggtctagatgagctcctaaatgacggttggagggcagaagtgtcttttcgcgttccataaccatcatacctgttggtgataagccctagaggcaatcatagagatgattgtatcacatactatatttacatatttatccgatattgttccttgaaatagataactcattattggttaatgaatatgtgattctttcatgagactctttatgttgtatgctactattttggatgaagcacaaagaacaactcgcactaaggtaa

SEQ ID NO: 65564 - DNA, 1089 bp, Oryza sativa
tacgtatgttgttgccagcattgttgttgaagaactgacgctgcggacgaacaacggacgaagaacttccatgtggtatggactggggtcctaaagtaagacgcggcttctgattattcccctgttgtgtcttgaattgagcaatccggcgtttcttctgctccatgcaattgtacttgttctcctggcgaatagccttatccactagcttctggaaatcaggataatctccaatcatgagtgaataagaaagctcatcattaagtccttctaagaacttctcctgacgctcttcgtcattgcgcacatcttccggagcataacgagcaagacgattgaactcgtgcagatactccgtaacagagcgtgatccctgggtgagcgacctgaattccttcttcttgagagacaccactcccgatggtatatgcgtcttccggaaagcagcggtaaattcaagccaagtgataggttcagcagtagttctgttaaggcggaaatgatcccaccattcagaggcagggccatgcaactgatgcgatgcaaatgagaccttctcctgatcagtgcattgaagcaaatccaacttcttctctatggcatgcaaccaatcacctgcttccactgggttggtagtgctagaaaaggtaggtggcctcacacgaagaaaatcagttaacctgttctgcggaggtgcatggttatttccttggttctgctgattctgaagttgctgcatcatcatgttcataagttgcacctgttgagccaggacttgggcaagagttgggttcccttcattgttattattattgggattgttggggccattcccattgctgcgagtattcaccatcttgctggacagggcacaagaagagaaaccggggggggaaactacttaggacagagaattactttaacttttattgatcttaactgagttttattacaaaactgaaaactctcacaccactaaactcaccaacttcctaacactcaaaagcaaacaaacacatgcacttacatcccatcactgatgtaaattacatgcgaagcacacacaagcaacttaaagcaagcaaacta

SEQ ID NO: 65565 - DNA, 6113 bp, Oryza sativa
ctcacaacccacctttaatcagcttttaattatcaattaattatcataacaagattaaccatcgtgagctaccattagatataaccataattaataatgtagtatgattcatcccattaatgagctaatgtttctaagcatggctaagcaattatacatatagcatttagctgaaccaaaccaatatataaggttctagctaatcaaattataacccataggaaaaataaagtcattttcggccattaattaattgggaaaggctcaccacccgatgacattcgaaaataatgcataagttgaaataaaacattagctttaaacgggttcaacatgctcaaagggttgtttgggatctgtgtgacttgccttaagcttccgcaaacgcttctgaaccttcctcaacgtaaacgctctcctccggaacgtcggaaactaaagcaaataaacaaaatcaacaaaacagtacaaaaataagcataaacagtatatgtggatatttttaacatgtagatctcgattttagatgaatttagcaacttgaaccactcgaatccgagttacgatgatttagttatgaatttccgaagtttaatcgattttcatctaatacagaaaattattacgaattaaataaaggatttatgacgtcacgatgacgtcatcgccggcctagcactggacgacgctgccaccggtgatagtgagctcggccgggctatccgaggacaccaacacgaagaggacgacgacgcgaactcaccgtgcaaagaacaacgatggacgacgacgaacgacggccggcgacgaggtccgacgacggctcggctcgggtccccgacggcgacggcgctccggtggtctttggcagctgcgaaggggcggacggggtgctcctccaccgtgcgaacccggtggcggcgacggacggcgacggcgacgacgctagcggcggcgccacgcggatggagcggcgtcggcggcggcggcgctagagctactcggcggcggcgctacgggcgacggctcggcttgggacttgaggcaaacggaagaggacgacaaggggatgctttatataggcttggactagagagatcggactccaaatgagaggatttgagctggaaaatccgagggttagtttggagagataaactcgaaaacgaattcgattcggtttatccgggcaaaattaatctccgagactttaggggaaaggaagaggataaggaggagataatttcccctcaactaattttaggaaaacacaagagaggtcggatttggaggggaaaaaccgagcccactcggtctcagttcggctgtcctgaggttgaaaatgaacagtgcaaagggaagcaaattagactttcggatggactgagaacagaacagggaaagaaaagggcagctcgacttgggccggcttgggctgcacagcacgcgcgcgagggagagagatgttgggctgaaatcagcccaacggcttaggagacgattttaaaaacttttccaattaaaataattcgcgaaatgatgtttcatttattaaaaatactttccttgctcaaataattcccagaaaaatctagaaaatagataaacaagcaaagtatttaatgaaattttatctagctcaattttatgttgaaatttttcctaggttattagtgtttaacttgtaagcttttaaaataggcgattttcatagcgtgacactgcgggaggaggtgggtccctgtgtgcaagctgaatgcgtacgggtgtagtcgtcgacttgcggggcgtggtgcggatccggactcctcctggcgctgggagacccttcaactgagcgttctccttcttcaggcgtgctatctcatccttcagagctatgatcctcacaagcttcccatcattcaaggctttggatgccttgtgcaggtcagagtgcatcctgtccattcccctcatcacggcgcacatgtggccgaaggtggtgtcgttctcgccgactgtcgggcggaaggtgctgatatcgttgccacttgctcggcgagggtggaaacggtacgccgtgttgcagaagatgtagctgtggtgatcacgaagcctggccatcattaggtatgctgcctcctgataggcgtgatctgcggtgcctccagatgcctcaaccaccatgttagcgaggctggtgcccaaatagcaatgaacctccagacgaacacggtggggaagctcgccactgagcggcggaacggtcgagtactccggcgcgttggggtagcccaccaccaaggtcatgcgagccaactcagccacaaaatcatccatgccgtctccgcggtggttgggttggtggtcggccatctagagaagacaaaggggtaggatcaatgcatgctcaaatccaatttaaataaagcagtaaaaaaaactcaattaaaatgaacaaatgagagcagaattttgtcaattaaaactcaaatagatcatttttgcatgagagcgaataaataagacggacttacatagcgataaaataatgagaaattagatacatactaataataataataagagcataaatacctagcaacccatattcctgagttaggacctaatgcattcctcccatcaaatcccgactgactgtcgaataaatttcaaataattttactaaaaccctagactgacctaatttgacaaatctcacattaaatgagcgaccaagatttttcccttgaaccacaagaacagatcccaattttcccggaacaaatccaattgcaaagaacacatgcaatgaaaaggattgtcctacggtcaaggttggctctgataccaacttgtcacgcccagaaattcccgaatagaattccaagcagaatgtgcattaaaacccccgtctaggaccggccggggtacacaaacgataaagttgacatacagatcaacgtcttacaaacattataaaagtcttacataaatgcagcggaaaattaaaagataaatggagctaagccttaacttgaactgcagcgggaacaccactccacaggcatcctcgacggcacggacgaagcctactcctcggagaagccaccatctgacacgtactcaaactccggggttttggggaaaatagagtaaggctgagtacaaccaccgtactcagcaagtcataccaaaatagggggtatgatgcagggtataatcaaggtatggctagaaaggttcatttgcataaagcgggcatttaaagacggtagttcaaagcagtaaaacagttgtagtaattaatcagtattaaccaatcactgtccaacgctacaccacgttgcaacaggcccaaccaaccacctgaactacaccagttcattagctaactaggggtgagactaatcacggtgaatctggttgaccgcccgtaaccgcgggcacggctattcgaatagttttactctgatcagaggtgtacaactgtacccacaagacacagccccacgacatgttaccgtgcgctgacatgccaccacgacataccgaaaagaggccgtgacaggacccttcgcataaccccctctagccaagcacaccacacctcaggtttcacccccatccccagcgggcaacgggcagtcccctctcgtgcctaggtgaatccggaaggacagaggccgtcgcagggcccgtcccgctccatcatgcccacccttgcctggatgcgtcatctagaggaaagctacactacaagcccagccgttgcccacaatggcttgtggtaagtacgataagttcttccagggcatcccgcgaaccggtccttaattgctatgggcgcgaccatcaaaaccatgcacccacaacccaccatttaatatattttaattaaccaacaccggagcggtggcattaaccaacattattactagaatctgatatcaactcaataatgtattttccccattgtgtgttagttgaactaagcatggctaagcaatccctagtccaatatctagtcatgttatatccccaagctaacaaaggagcatggtacaaaaatagcatggctgtaacagtaggtaaagatcccatagtaacattataaaacgatgcagtttttaaaggaaaacgatagagcatttgcaatataggatcaacatgttcaagtgacaagcatgacttgcctcgctctgctgctggaggaacctcggcgactatttcaaagtacaccggagcgtgaggagagccggaatctaagcgacatacaaagcaaacaatacaaacatgctataagactactgaaacagagaacaaaatcatttttaatggattctatgcatttttcttgatttactgagacttgaatgggcttaaacggagctcggatgaattagatatgaattttagaagattcactgtgtttttactacaaacagaaaaaatccttaattgatttattgcgcaatatatcccagggctgacgtcaacaaaggggggcggcgccaacatgcgggccccacatggcagtgactcgggtggcggtccgcggtggaccgggtccacggaccgcggaaggaggcagcgcaccacgtggcgctgacgtggcgccgacgtggcgcacacgtggcggccacgtggcacgccacgcgggtggccgaaccgacggccccgatctacccgagggtagatcagatggcggaggggagcgcacgttcggcgcgcacgggcggctcaagccggcccggcggccatggcgcacggcggcgctccgcggggcggcggtggcagacgacggcgaccgacggctagcggcggcggcgcgacagcgcgggcggcgctagcggcggctaagtggctaggcggcggcgcagcggctaagcggtgcgggagagagagagagagagagagagaggaaggggaggaggtgtctcaccgacggcgattgacgacggcgagcgacagatggcgatgccggcgacgggacgagctcctgaaccacctagcgaacacggtgaaaggggttagagagggagaggaagatggaagaggcgaggacgccggccgaaggcggcggccatggcggtggcgcacggcgcggagtgggttccagcggcggaatccgacaggagaggggtggatagggtggcccgcacgacggcgaacgcgatggcgtctacggcgtggctcggtgcagcggctagagacggctagcggcggccagagcggtggcggcggcggcggaaaagagggcgacggtgctagggctatggagggcacgggaacggatggttgcaaaacgaaaaagagaggagggaatggggaacctttatataggcccacaggggtcgatcgtggccggggtgaccgcgatttcgccagcggagtggggagaggtggggaggagagagaggcgggattcaaaaattgaatcccggccgtctcgagcgcgggcgcgggagggagagagagggagtgggcgcggggaatgcgggcatgagcggcgacgtgggcgacgtggcctaggacacgtgggagcgaggggtggcggcggttgcggaatcggcggccgcggctggaggtggaatacgggcccgacaggtgggccccacctgtcggtgaccccgggagagaggaggggctcggccggccggctcagctgggtcgtggccttcggtcggcccagcggggagggggaggaggaagagaatgggccggcggcccattcgaaaaagaataaggggaaaaagaaaaagaaaaaggaggaaatgaattttcttgggattaaatattgcttgtgctcatttttgattggttaaaattatttctagagctatgaaaattccactaaaaatcttgttagcacatttcgacatgtagagctcaagaaaaattccacatgccaattccgattattatttgcattaatttatttagggtttcactcttgcttttacaccggtattttctcgagaccaattataaattcaattttggcttgggagaagaacttcagggtgtgacagttgcctcctgctcaaggacttaacaataagagccactatacagaggtaccacattgctaattaacataatgactaggtcagtccccattctagaaa

SEQ ID NO: 65566 - DNA, 5816 bp, Oryza sativa
aatgctttagaaaaccaaatagttgacctgttaattctttgatttgtatatatgagttctggaatcacatatccaaagtaacatgttctttgatcccgccatataggagctgcatcaatcgaagttagattgcttaagattggtcatgggtgtggttttttgaaactctaggaccataacactagaggttatctgccactgccacatgccaaaatccctatggtttcgagcaacttgaaatttactctagtaaaaaaaagaaattgctcactgttgtgggttaacatctagtggtgtctcctcttgatctgagctgccttgatctccaaagctaattctcccaataccatcacggctaaagcacattgcgaaggaattagatgtcagacctttttgtgctagaatgctaggaattgatatcatatctatcccaagtccaaatagaccgtttggagcagcagcatccagaaatgatcctgtctgaacctgtccacatctgataaatgtagagaagattttatcaaaatgctgaacacagtctccttcacccattatatgaaatgtaaaaattacccaaatagtatttgcgccttgagaatttgaggaatggcatcctctgttgacaagtagagcacatcctctactagaaaaccagaagaagatgtgtctgcagaaacataaaccatcttgtatggacactgtgatgttgtagagcattcctttctcagctcacaaaattggctgttgcaaggaactgcttggcttgttgacgacatactagggatgtaaaaggaagcctgaaacccaggggcagccagtgagtaactgagcaatatagttacccaaatcttatcttgagagagaacatacatgtagcaaaagtgccacttggaagaaaaataaattgtaatttttcagagtaccaacacaatcaatatgacaatagaaaatattactttgctatagaagttttaagtgtgagaaataaaaaaacaagcaggcaaaacttttgtccaaaaaggagatagactaaggtatgtatgagaagttgagaacagaaacaaaggaaataaaaacaaaaaaaaatcatagaaaaagacaatcaggtacactcaagctacatatatgcacaacaattatatcaagtggtacagttatggttggataaggctcaagcacttgagtctcggcctctactagcttccggcagagctccttccaacacggtaggaagtcttcagatcataagaagaaagtgagactagcaactttgttacatctagccaaggatgacaatgtcatactatatagagccactccctaaaagctcaatctaatatttccaaataggcaactgataagaatgattgccctaatttctaaatttcaaagtacaatcataaaaataacttggtagccaaccaagcttattctcatgacttaattatgccaggcagcaacgaagcttcatggctgctgtctggctggaggattacgaaccagccctactatagaggtattaaatccatcagaggaaggcctgaagtagaatggtttgaggtgaaagaatgcaccggtttggtgatggaaggatgtagaaaactggtccaggataagactttaggccctatacagtgtttattcataacatcaaggacagactatcagtatttatactcattggctacaacaaacacactagagtaacatccaaataatgagcatattatcattgtgtttatttgttacatgacagaatagtggcccatgcacaccagctatagtaacccaccacaagttacagcaaataacatcaaggacccttgaatgatatggtttaagagatataatgtataccttcaaatttttcctgatgtaatattaaagcatttctactcttggaagctaaaacaactaaacaagtattcatttactggaaaatttgaaatcgtgaaagtacacacacaacacaggcttttaatctagaaggcaacagctgcaacaaatgtacaggtactgacatatgttgcacaaatgtacaagttcgatggcattctcacaaaccaacatgtttcatgccttgcgttccacttagtctgatttctgtcttgctaagttgactcacccttgcaggattaaagagaggccttgtgattaagtattctgtacccacttgctgcatcagcccttgcatcgtagtcatcacaaacatgtacaatgagacacatatatctcattgtagatgccccattcaagggccagttgatgggggtgatacagaaatcaagctaataccgcacaaaacatgtaggtgtgtgagaatatccactgaacttgtattttgtgaaacatgtgtaaaaatgcttgcaatttgtgcaattcactcaaaagaatagaaaaagaaatgaaggtctatggcattgtagttatagcggacatatttggcaaccttcatgcccgctatatactctgcaaacttgactcttgatgctaccgaaaggatagaaaaaatggtttacagcctaaaacaataaatgtcatgtttccttggtaaatctctatattactgtttatgtgaaaagcatagcagtaaggtgaccacatttaggatctatgagaacggccaacaaggctttaaatgggtcattgtttagaacagtgggaagaagaaaataaaacagcagcaagaaacaacattgaagattgaactgaagtcaacaagatttcagaacggctgatctatgcagtcaatgttgttttatgcgttattgagacctgtcgattcataagattagatgatcactcagatattgtacttcaatttacaattttacaggacaatacataccatttaaacacctaattaggacttcattatgaaaggttacacaatttcccacaacattcgacactagttatagattatgaccaagcccatgcgtttttgacaaataaatcaagagcaaactaaaggccagaaagatcagatattttcatccaactgaacggcataatgccagacatcttagcgaatcgacatctcattcaatttttactaagctgtgtaattagtagcaaccatcttctggcaccataagtccattcccacatgcagcatatcaccaaatcataccgtatatcagcaaaaatcctaaaaagcattgcacagtttaaaagccactgaagcaacatgaaaattcttgcagcatggatcgttgtatagctctgaattatgcaccaacacctaaatgaacaaaggatctatcgaattgtcaagagaatagtgctcttaccgatccagaagcggccgaagccggcggcgtacacccatcacactggcacggcagccagaagaggtcactcccggtgtccagcgccaccatgaacgtctggcccggcgtgccgaccgtcacaagcgcatagtgcaagcttttacatatccacaaaaatgcgactcttcactaaaactctcaagcaccaaaccactacgaagagggagtgagagacggggagaggccttacaatccgaggttgctgaccttgagggtggcgtttccctcagaaaacgtgagcggcgggggcttgtctcctcctcctccaccgtcgccgccggctgctgagagcgcgcggcggcggtcgtgcccgttcagggccgcaacgtaatcggcgctgccgtgctccggccagcctccggggagcacgtgcccgcgcgcctccgcccaccgctgcaccggagaagagaaccggtggtggaattccagcgaaggcgccctcaggcgaccacctccgccgccgccgcccgcgacgccgccaacgacgagaagcaagagcaaggagtggaggagaagctggaaggatgacatcggggtagtggccgcatgtgatccggggccgaatcggggagaggaggcgtcgcgtccgcggcggcgggtggtcggcggcgtgcgctaccggccggaggaggcggcggaggattttgcggttttgtgggcgctgtgtcgatgaaatggttttgctttttaattttgagtattttttttctttcggctttggtttagtacgggaagctagttattgggtgtagcactgcactgttgggctttcgctttttactcgtgggttgttaaagactagttgggactttggtctgtccagtttccatctttaatctgctgctttttttctctcctttcgttaaagtggcacgatgtgcatgtgatatctgaaattggacggagaaatgagaattactgttttttttttctttcggttctgggaatcaattccaatcgctatcagtcataatgaccacaatataacattttgataccttggaaacaaataaagtacggtctagtaagcagaatattgctccgatgttcattctaaataattttgcggcttcatcttttcgcttatacttatgctcatcagctaaaatttaaattttcaaccttaaatttaaagttgattttgtgattttttttatcaaagtttatttttcagtccctgcttttagatagctaagaacacatattttattaacaaattatttttcatttgcaaatataccatttggtttaatccatgaataagccaaaataatagggcggtccatattattgtgaaaccactgcaaagttgtgatgaagataaagattttctaaaagttgcatgccgaaagttgaagactacggttatgcaactttgtagtagcgtgcaccacgcaaggcacctctgatcaagcgtcctctaagctccagcgtgtgccgagtgccgacgatcaccacctgtattaggccattcccaacccaatgactaggatagtgtccatagcattaaataagctgtcacctaggatgaaaaattatgtggcaagtgaataaatgaggaaagagaaggaaacatgtcttgcatgagacatggtttctacacaacatataagacatcatgtgatataagtagcattaaatttaagtatggaatagtagtatttgcattgaaagagtaatatctagtactagtttcttgatgatgtggagcttatggaaactatgtctagtgtcttggattgggaatggcctgatctccaccacgccgctagggtgtcacgccctgaaaatcgcctaatttaataattcatcttttaaatcatttttagaaattattttaaaagcctatgagttaaactagaataatctaggaaaaatttcaacgtaaaattccattaaatactttgcttgtttatctattttctatatttttctgagaattatttgagcaagaaaagtatttttaataaatgaaacatcatggcacgaattattttaattgaaaaattctttaaatcctcctctaagttgttgggccgtttccggcccaactctcctctcagccgcgcgtggccgagcggcccagccggctgtcacgccctgaagttcccctcccttgctctaaattcataaaataaatcgtccgaagaaattgtttaatttaacctagagatgaatccctagttaataaatgcaaataataatcggaattggcatgtggaatttttcttgagttctacatgtcaaaatatgctaacaggatttttagtggaattttcagagccttggaaataattttaaccaattaaaataagcaaagtgcaatattaaatccctgggaaaatcctttttcctttttatctttcctttttcccctctttttcctcctttgggccgccggcccatctctcccgccccctcccgaagtccaggtcgcctccccctcactccctcgggcgctgacaggtggggcccacctgtcag

SEQ ID NO: 65567 - DNA, 8175 bp, Oryza sativa
actgaattggttaaggtgtcgatttatatgttttcaactcgcatatagttctttcatgttagtttttaaaaagtttctttcttgtgacatgtctgtgacttaaaaatgatcacatgatgacaatgtgtttggatgaaagtaatcatagaggctcatattttgggtgactgcagcccaatgaatgttgtttctagaagtaattaaatattgactgcaaaaaatagagatatgaaactttcatgttgttattcaatatgtctgaaactcctgtgtgtccaatcaggataagcgtgttgttgccttgttggctgtgtgcatgattgtgtgtttgtagtggcgaattcatgtaaaatatgttcgcactcacttttacattttaatggataaataatagtcttgtatccaagtaatccaatacaatgagatgtggggtgctgttggacttcatatttatgtgctggaggcattggtgcaggtggattttgtatatctgttggcatggctgctcattgacattgtatgcaccctgttttaaacagctatagtaggcagctaggccacatacaaggaacagtcccttgttgttgtaaaattggctggtttggtcatataatcagttttagatggggtgattgaacaataataattgttcattgttcttaaaaatgagtgatgaatatgcatgccccaagagtgatagattcatacacaatttcacatgctttagagttacatcaaagcaatgccatttagacttggtgcagaagggcacaagctcacagcacaattatgacagttttgaatatttgcttatggaaggtcaaatgtcaattgaatagcttgaatatcatatagagttgatcatgccctctgcatatttgcatgtagttgttgcttttagttgcatgttacaccagccatttacctgttatattgtaagatactgtcgctaatgaattgatatttcaaaagatttgttttagacactctatttattttactgattcaggacagtctaggtgagataactcaacctgcacacatatataataatcccaatcatcaacaagcaactctgttgaggcatggaccttcccaatacggtatagaatacatggccctctagctagcttgtgtaatgatgtagcaccatgcatgacctgatcatatctgcaggatgcaactaggaacaattttcatcagtatgctcaagatccaaatgaccgaaatactggacagatgtaccatggatccaattatcatcagtatgccaaagttttgtttaagagatacttgtacgaattacagttattagctgtccaattaatctgtcatctgattgaaaagatccttcatctgatgtttaactacccttcctttcagggaaatagtagctgctacccctctaattattttgaagaaaataatggtcctagagaagtaagattacacgactcacagttctataggcaggataatcaagagtattcaactgatggtaaataaagagcaaatcaagcaactagaaaatattccacatcatattgattgaattttttgtatttattatctagatgatcctttgcctggtattgaggggtttcaaattgttggggagcctagatcatgatttacattaacagcatgtggttaccctaccaatggtactaccctttgtaatttccaggtttgttgtgttctgagttctgattccagattgcaattacttatcttctctattaattgttaacttctgcaaataaaacctctcattatgaaatgctgttgttttaatgggttagatatcttgagaatggcaccaggcagtcaattgaaagtaaatagagattattgctcattctatttgttgctgcttagaaataatttgattgtattgattagctctctatattttgcaattcaggtgctacgatgtatgactacgtggttactgctgatgatgttgacactcttttggctgtagactgcacgcctatggatgataatacctgtcaggttattcacttatctgctgtaaactgcagtacaatgtggttatttcatgtggtcaatcatataatagtggctaagtctaaagagtttggcaacattcattttgaaacttatctctttgctaattggagggagtgtaaacttttagacgtaaagctgggatcccagggaaggaaatccatcaactgacttgggagccatctctccttcagagggggttagaacttttttctgtgtctagctgttcaaattttggtcctgtgtcctgtacatggtattgcgtattaaccccattaactgctttagtctgaatgtgttcttttactgggagtgtgccatcctcaattttttgtgaggctttcagtggcttctcattattggtattctctagaggcttacatccattttgtctcttcaactacatgttaactatatggtttgaattattattttgggtattggaatcttcttggcattctgatagcctgatattgttctgttgcatcttttcatcctttactgcatcaattgggtagcttacagagtacaacccatttttggaagctatttctttattgcatcaaccagaaaaaaaagattaactgagtcataaataactgtccctttgtgtgtttgttggtattcgtttttatatatatctgatatatgtaataagcgtacataaaggttggcacatcggctttcctttttgagcaaagatgtgcttgtgcactgataacatgagtgtgcttgaaatctgttgttaattcatgggcctgaacttctaaacagaattatccacaccacagacacatgaatattttactatgtcagtaattacacctaggaactatgcatgttaatttgatgagccgctcttcttcattgtagggtgaattggttacagagtatactaacaatgggagcaagataacttgcggtgagtttatgatgcatgcgttgctggcttgctgccatttttgggccattaattgaatgaatttattatattggcagtccctgcttcaattttgtttatcaacatatgggaattgttatactttcagtggcacatttttttaaatttattaaacaatggttgtattttaatacaaagtagacaaaggcatcctgttggcaaaagggcaattgcaccttcacaagttgaatctttatgattttgtaggtttcactgattaacctttgacattatttaattgaaatttgaccatagtggaaatataattttttggggcatatttaccttctttgcggtaactttcttgatgtaaggcttgtcatgttgtagcaaaaagaacattttaatatataaaacatctggatttcttttttgcattgctcattttactttcaggactttatttgaaaaaacataaatgcttgtattattgtttcaagcacagtttgtggaaaaatacatgtttgcttacagcagtaaccttattgacactggactggagaacatgttaacctttgaaatctgaacctgggatgtgtgtgtgtggtggtggtggtcaggccaagaagaagatggtgaggctgatacagaggatcatctgggacaagagggcaaggagggccaccacgggacgccatcgacgttctcttcagagacaccagcgatgagctcaccgacgagctcatctccgacaccatgatcgacctcatgatacccgccggggactccgtcccggttctcatcacgctcaccgtcaagttcctcagcgagtgccttctcgcccttcaccaactggaagtaagcctgtaacctgaaacctcttacatgaaaatttttcagcttgatgacaacacaataagctgttactaactggatcaatagctgcataattagatgaatcctgaacagaaaaaaaaaacaaatcctaggaagcaattaaggatcctctgttgttgggcatgggcaggcagcaaaatgggtccagaactgaaaagaggttgattttctttctttttttgtctgacaggaacatgaccaactattcattctgtcagagccatgtgttgtgcatgataatactactaccactgtctactacacacaatggcagaggatctgtgtccccaaacaaaaactatatcataaaaaagcatacgaataagggagagatacgtaggtgggcagaagggatcagcagcacataaagggttgtgccaaccttggtccatacctttcttgttggcatcttagagctatcattattgtttgttatctatgtgccatctgaaaaaagatactactacttgtgtttggaccaatctttgcaagatgacatgcgttgcatcattgtcaatgtcaggtccatacatatcattggaacagagtcgccttctcacaaaagaaaaggcttactatcatgatgtatcatctacttagttttttttctacacgtgtgtaaggaatagttattttggttgaagtatagagggttttttatcaactggggaaaaagcaaggttacataatttgtctatttattcggtggagattagaaggcagcagtaatatttcctagctagcatgtcctgttacaccagtagcattgtgtcatatactagattccatttacatcactacagtgctaagaaattactcatgcgtcgaccgtgtttctgttttgatgccatgtgaacaacaaactcattgaaacctctgcatgtctgccacttttagagaacatgcatgcatattgcggctcaagataaaatccactcagtaattacttgttgtaacaatgatgaataataacaccaatcatattcttatgctaacaggaggagaacatgcagctcaaagaggcgaaaaaccagcatgggtgagaccttgcaatggacagacatgtcattgtcattcacacatgtaagtatagttcattaacactataacataaaatttctatagctctaaatctactggcaaaaatagcacttatccttatgatccatgtgattctttttcatgaccccgtttgatttggaacattggagtgtaggtgataacagagacgctgtggttgggcaacatcatcggtgggatcatgcacaaggcggtgcgcggcgtcgaggtgaatgggtacctcattcccaaggggtggtgtgatcggtccacctcgatgatatgctctacgatgagccctacaagttcaacccatgaaggtcgaaggtaagaaagagccccacatttggtagagatgttcgtcgaattgctagccctttaggcaactccagcatgataaggatttgatgagtggggtttcggtgggactcctaacatgtgggtttacttctatatcaataatctcatgatggatttgacattgccatgtactaacacttgtattgcagaaaataacagagattccctcaaagttgcattagtgatatatacacctaggcagaagtcagttgaatcccccaaaataaatggatttggtagttctttgatctggtaaattcagacaacataagcttaagctgtcaacgaaatgaatacacacctttttttccgttattgtatactttctgtaagctctgacaatgatatgcaaataattaatctaggcaaatgatggtgctgtactactgttgaggcatcctatcattattatttgatttgggaagtctaataatgtgctaattggtcaagaaatcaatcaatctcaacaggagaaggacatgagcaatggcagcttcactccatttggtggtgggcagaggctgtgcccaggcctggatctggccaggctggaagcttccatcttttttcaccacttggtcaccagcttcaggtatggatcaccacacctcaatcttggctattcttagcgcatccattgattccaactccttagctttgtttcgtgatcacttggcaacaatagcatttttttctctctctagataatggaataaaaactacaggctttacatcatttttcatgatcgctcagcaccgtcagcaattatttttctagataatggaataaaaatcacggcctctgcatcacataatgcacgcaatcgggcaccaatggcgtgcatctcatgtccctatcatttggcctaagatagcgctgtttgtgagtcacatccccatgatttcgccatgccctctttgcatgatttcagtttttactaatggtactattttacagggttataaaagaacaagttgggctaataacatgttatttaaacaattttgaaggatgtgtgaccttttcagtgaggctttgacatgctgccttttctgctgaaaaaacaagaaaaaaagattttgtagttaatagttcattagttagtatgttggtgctctcttcctgaataacatgagttgttttggagataatatcaagattgtattttcctgttatttgaatcacaatagagttgctgctgataaatattataaggttatcacattatttatcattccatttttcttaatatttttccaatgccaattaaattggatggagtgtgtactgaatggactgtgtatatatagctcattatacttcatactctttggcgcatataatatggcagctataccatttgatcaagctattgaataccctgtggatcagtcgttgccacttgacaccaattgttgtttttttttgtttgctatctgctgtttgttataggttagaacaaggtagcaaggactgaggctaatggtaagaggaggcagaagaggaaatgagctaggactgcggattccaaaaatgtaaagtttcttgaccttgttctgccttgttatctgtttattcattgcaaactctcgtggttgcagcggatgtatttatttaggacagatagtaactggcttttatatttccatgcatgtttcatctcatgggggttcatgttaatttaggatcatagtaataattagaatacacatgcattccaaaatcagtttaattgatttgacaacagaattctttttagagctttaatgaggaatgtaatgaatgtcccagcccttagtcatagaagagatgagttattttctgtttcccattttctaaggcctttgaatataatgatggatgcaaacctacaggcaagacattttagtttgtgacaaaagggaagtagagtttagttgggcactaggccaccaagatttgcggtataattggccatatggacatgtcacctaaattatagcagtttatttggatttattttattttatttattattattattatttgcatttggtgtatgtacatttttggagttacaaacaaatatggaattttggtacaagaatcctattactcttattcccaatagtatttctattgttggatcgcatgtgcacctgctgaacaccagactattccatgttccagtgattctgtggagtgaccaagttgcagctagagaacaagctccatacctcctcttccattgggtgcctcctcccccttgtctccctcctgtttgctgcctctatggcaatgcctaacggagtagtggctggtggacgagagaaaatggagttgggggcaagtgaggactgtgatggtatgaactattcctcatcatttttcaggtattgcctacttctctccaattgttaacttacatgtcattctttacatttagagtgtttcttatacatttatattaccttttccccttgggcaaatctttagcagcagaaaagggatcttttctttatattgtcgtttcatggtgaaataagacaactacttctaatttgcctaattcagccattgcttggttaaacaaaaaggcattaatgtgggagcatggcaaacagttataaagagaatatagatctttagaatctaaaataccatccattgttaatatttgaattgcttccttgcactgaaagtatgcatcgcatcaaggttagtagtctggctaatattgctcaattgataattcttgataattaatcgtgacgaccttatagaatcttgacttttgtttcagaatatggataaaacatcatgctgcaactttacctgctatttggaaacatagagactttggatatttcttcttattttaacaagaaagacatcaacttttttcccctgaattttttcatccagatctactcaaacctcaacattt

SEQ ID NO: 65568 - DNA, 14257 bp, Oryza sativa
ccccgccccgttgccatccctagagttcgccaccgttgacgcagcttgcctccgcaccgtcggtgctgccccgaaacatagggttatagcaaaggggatcgagtgtgtggggagtgggtcgggtctggttggaaccagtggcagtcatctttacaagccgaacgacccgtgggacaaaatggtactttcaacgttctttctctctccatctagacgtgatataataaaataatgcgaggtgtgtctagcagctaataccacatttttgcggtgtccacgaaaagatacgtgttctttggatgtctcatagcaaagaccacatacttttagtgtcctatagtaaattttgcctttaatatatctagcaattatgcccatacgttgcaaaaaaaaactaaaattatacggagtagtaaacattagatgatttgggtatattttctatgatatagatccatgtcaattctatgggttcaacataaccttcatcacaatctaacgcatagacatgagcaatgcaaataatcctaaagcaaatttcagcaaaaggaatagctaaaacggagatacaacaaaagaaaacggataaactgaaaaccgaatagagattcatatgacaacaaatcatttataatgttagaaaattggaagtgagaaaaagcttgtatttatttttatttaaaggggcgcgataaaaatattggcaggggtaggtagacaaaagtgctaggggcttggacttgtagagtcactgtcacaggcagacgatagagtgtgaacgacgaacgaacgttcatgcgcgagaaaactgcctatctaccattccaaaagaatggattcgttgaaataccatcgctaaaacaggcttcaataaaataccactcttaaccacgatgtattagctgaaatgccatcttggactattttaccattggggttcttcttcctcccccaactcctcatcttctagttcgacgccctcggtggggcggccatggatgaaacgacggcgctcgctacttacagccagccgacgcggtggaggcagtggacggcgacggtgacgcccgttacttgcgcacttgcccgacgtccttggcggtggtggtggacggggatgggggacggcgacgcctgtttcttccaccggtgcttgtttagcgccctcgcgaaggcggaggtggacggcgacgacgccctcggtggcggtggtgacgatgatgacagcgcccgttaatgttgctacttctgctcttgcctggcccctcggtggtggcggtggatggcgacggcggcggcgaccgctactcccatgccagcccggcgcaatggcaacggtggatagcaacggcgccctcaactagcggcctcggtggcagtggtggacagcgacgatgacgcccgatactctcgcgcctatgcccaccactactagttgcaaaactcttctcctcgtcaactcagctcttctcgcagccatgggcaccagtgatgtgtatggaggaatacgagcgaggaagaagtccaggggtaaaaatggtctaaggcctgtttagttggagggactaaaactttagtccctaaagtaaaactttagtccattcactttagtccctaaagtcccaaacaggggtgactaaaagagaataaaagtgtattagtcaattagtctctatgggaggagcgtatagagactaaagttgcttctttccacccactgccccacgcacaaccctctctttgcatgattttagaggtaacatggtccttgtacagtgtaattaatgacctttagttccttttaatccctacatccaaacaggtatggactaaaggatccaaacaccctctaagatggtatttcggccaagtagtcctaattgagagtggtattccatcgaaacccattttagtaatggtattcgagcgaacacattcttttgcaatgacaaatatgcaattttctcatcatgcgcatagcgagtcaaacaaaggacgaaagattgacgaatgtacgatgaaatcgatctggacttgcgaatcacaatgatgatgttcatgaagtcacttgatgctatatgcattttatctccaacaaaacatggacttttctactgtatgttctatatagcatacaattaagaaaaccaaataaaatatagtactctgtttttatcaccatgcatatcaaagtaacatcagtgtaattaacaatacacgtttgcttacaaaaaaacatgcacgctagaggtttcataagaaagtcttaattaaaagtcatagttataatgataatagcggcagtcgatgcatggttctcttatctagctgtttcaatcctgacaaagaaaaacgcccatcacaacagtaccaacaacgcatccagaagcagccgccgcaatcacaatcctgttttgcctcctccgaaatgccaccatcggttccgctaccactctttggatttagaaagagtaacaaaaaaaaagaaaacagatgttatttcaataaaatatacagtaaaagacaattacaatgcttttatatagcctcttaccgtgctctctcattgatgttctcaaacataatgcgagcgtcctcctcagcattatggaaagtaaggggcttaatcttaggatttgtgttgccactcaacttatcctacagttccacacatgaagagtaaatataagttagacagtggcttatcctacagttccacacatgaagagtaaatataagttagacagtggcgaatccaagatgaaaatggaggatagactcaaaattagtgaaaatactttataaataaacaataggagtgttaaaagtatatagtgttatgcaaatcaaacttaacatatactacacgattggatgggccggagaaaaaaaagaacctcaccgatacatggtgtatccactttgccattaatcaaatacttttcaaaatacgcagaacaaatcactaaatagcctcatttgatcactactatactttttattgactgcctctgttcaatcgctgtggcctgtggataaaaagcatagctcatcgttgttgtcatcattctctccagcgcaactccaagccgaatggaccatcgttctcacaagagatgggccaaattgggccacctgctgggcattaattttccccaaccagcaggcaacatggcagcaatcaaaattgaaaacccaaaccctataaccaatttgagctgcctgctagcgtcataaaaggggggccaattaactgattaatcagtatccccgcaaaaaaaaaaaaactgattaatcagtagataatgagaaacaatttttttgttgggatagggcgatgcctacgctcgcccctcatgtggctcctccactgcaactcatgctcatgcagagcacacctttggcataaacaaacggaacatggctgtgtatatacacctttcttggtgtagagtctgggttttaatccattatcagaaaacgaaataagttaccttcagaagagacaatctaataagatcctagaacaattaatagcccaacattgtatggcccgggtgaatcactaaagccgcagctatctctccccaaccctctacagcccaaccatataccaggttagagcagctaccaaactttcagtattccacccctgtttatatctcttgtaaatccacccccatccctccctctctatatctgtctctctcaatccttctttctttttataaccttgcaaccttaaaaaactctgtaaacctcatttctatcaattgaatgactacaaggtagagccggctctaccttcttacgtcaaaagaatttgaaaagttcatattttttttctcgcagggtgcagaaataactctacagggatacgttgcagtcacatatggttgattataatcattctcaagacaaattaattatttttgaaaaaaaagactgatttttttctcgaaactaaaaactcggcgaatcggggtctaattaaactgcatggggtgattgaatagggaagacaaagataattagggaggaggaggaggaggaggagggagggggagaaggggagggaagacgaagaacacctcggggtggagggagcgcgacgccggcgcccggcggagggtggatgcgaccagcggcctgagcttcccggcgagagagcgcagcgccttagccatgccgacggcttccggttgcgggcgtcaagatctcgggagggagcgaggctagggtttcgctcgctttcatcttctcctttctccttctccttccccttcccctcccttccccttccgctcgctgtcgtctgtcgcgcacgcaccaatcaacaaaacttacggctataagcccggtctatagaccgtggtcccaccagtcagtccccagtctatacaagttgattagagaaaattgcttttttaagcctccaaagttaacgtttttagatacttttccctctgttttgtttatatttttttaaaaaactagcaaaagtgcccgtgcgttgcaacgggtgattacggagtgtgtatattaaccaaaagtgttgtttggtttatcaaaagtgtctgtgcgttgcaacgggaagcgtacagatcagaaaaatatgcaattaattaaaatacaaattcgctgaaatatttggtatttttaagtaggtatgtgtataattaaataaatttacaagtaaagcaattgtgacaaataaaatgacatggttaaatttaattttattaaattctccatgattagttaacgctcttagaaattctattggaattttcagagcttaattgttaattttcatttaacaattatttaattggaaaaagaaagaaaatacttccttttaggtttgcttcgaaataaacacattcaacaactataattgtaatgcttctgaaaaaataaagtactaaaaatgaacttcttctctttttcttcggcccgagagacctaaaatagacttatttccgtcccttgccggtcggcccatggccttttgtgcacgcgcaggcgcagttcccctctccaagccgcaacctgggcttgggccggaaaagtggcctcgctctcaatccctcttgggccgatttcggcccggccgacaccggccgtccaatctctagggtttagatcggacggccgagcgtcgagatcggggaaacaaaaccctctccctctcctcagtcgccgaaaaaaccctagcccattctctccccccccccaatcgacccagccgccacccccgcgcccgacgccgcctctccccaccggcgacaccgctccctctccccatctcccgcctctccccctcacccaagccggtcacctcccccgtcaccggcgccgtctctcccaccaccggcgccgcttctcttcccttctccctcccttctcgccggcatggcgcacaatggcggggtacggcgtcagcggcgtccgcgctccctctcccgctctccttcccgtctcgccggcacggcgcagctgcggcggagacggcggcgacggccgtccctccccctctccctctccccgtcggcctagacagcgacgacgccttctcaacggcggcgtcgacggcatcggcttcgttcgcgggtggatccgtcggcggcgtcggccactgtgggtggatccagcagcggcggctccctccaccgcctctcttctccctccggcggcggtggtggcgtcggcggccgccgattttttttttttttttgcaatttttttccatggctattgctaaccgaatcggattgcgtacgaacgagacgaaaaatagatgtgacgaaaggaaaaatacgaatatttatattagttattatagatatagatttgtataatactattgtcttatatcctatttgtataataccatggaggttgaacttgcatgtttgtatagtgatatatcacatgttaatacatcttcttaattttttttaatttttacccagtgctaagtgctataaggctgcatatgattctttgttatgtgccgtgattctttatactatgtatgtatatatgcacttgttatcttggtgatgccaaccgaataggacttggacttgtataattcaaaccaattcctattcggccaaaacagaaacaaagtcctagtcagcccaaacggaaatggattggagtttgtttcctatttttatggaatcagacagattttttttcccgatttttcttttaccgcatcgatggaattagattcgatttgttttttttatcacgtcgcttttttttaaaccgtgccacatataatatgatttgattttttttaccgccacatataattcctttttctttggaatcagactgtttttttaaaaaaatttcgccctttttctactgcgttgacagagtcggattcgtttttcttttcccttatttttgccatttttctggatcggacagatttagtttttctttttttttccggttttttcgtccggtttttttgactggacagatttggttatttgatttgatttttttaccgcgtcacatgtaaatccttctttggaatcagacatattttttatttatttcgccctttttttaccacgtcgacggagtcggattcatttttctttttcgcctttttattctggatcgggcagatttggttattcttttcttttccggttttttttcgccccggtttttgggatcggactgatttgttttttttctttttttcgcccggttttctccgtttggtttttcttttctttttccggtttttcttcgcccgttttttttgatcgaacagatttggttttttttctttcttctgtccggtttttttcgctcggttttcttgatggacgatggaagtacctcttattttttaagtagtagagagatatccgtgtgttagtaaactaaaattataataaatataaaaatattatccgattagggtttagttttacattatatgcgccctttaataaaatatattcgtaaagaaagaaagaaattttataaaaagaaaagaaaaaaaacgaaaggtaaaaaaaaaaaactagttgtacctcaccaaccagctagggcatcgcgcagcctatgaagcacgcgtggctgccaagggtggaggttcgcagcgaagatgctgtggtggtggtggcttcctcacgagatagggtgtgatggtagcttgacggaggctgtggaataaactgactaaaattgagggggtgtttatatccaaatttttgacatgtcatatcatatattatatggggtgtcgcatgggatatttgggcactaataaactaattatagaatctgtcgataaaccgcgaaacaaatttattaagcctaattaatccgttattagcaaatgtttattgtagcaccccattgtcaaatcatagagcaattaaacttaaaagattcgtctcgcaaattagtcgcaatcagtgcaattagttgttttttagcctatatttaatactttatgcagatgtttatgtttaatgtgacatagtgaaaaattttgggtgggagcaagacagagcctgagtgccagtaaacaaaattgacgagcaacgtttcttgagtctataagagctcagttgtagagtacatccccggttaacatctacttccaacaaccttgtgtaccggttcagaaacaggtcacatacacatctacttacaacctgtgtatcagctcataaacagatcacaatacagggaacgctgattatattttacggagatccctgcagacgataatggatcaccaaactagcaaattaattcaatgctcaatgaaaattcccattttctaaagaactaaaattgattttcatgtcaatttttcactccagaaaccatgagatgcgctgttcattgtaaggcaccacacagcgcgtatatatatacagtacacatgtatattccttccttccacttccagaagttgtgcctatcaatggcaataggaaaataccatacacacacgaagctcccttcagaggtttagaggattgctttctgcactgaaatcaaggaaagttgtcggtaccatattatcaccacaagaaagcataccgtatccaaagttcagacctgatattcatcagaagtttaagaagtgttgctattctcaacagaaatgggatctgctccagaaggaacggcaatagctgacccatcatcagaagttcccatttgtttggaccatgttgcttaacagcttgacactgaaacagaccaaaaaaaataagctactaggttctagtaatatgacaaaaagaaaaagaacaatgctatacgtacgactgttccatccgaccggcgtacaacagaatggcgtgaggcttcatatgacgttctacttcttgttgacgccgtgcacttcatagtcgtccaaaaatcagacactacaggtcgtgtgtgtagcatttttgaaagaaaaattgccatacctcacacatatagtgccttgcaagcctgctggatgcatttattggagcgaaggacatgcaatcggcaagatgtgtggatgtggaacattttgtccacagaatgtctagaaagagatcaagaaaatcagtccaaagctcagttgacccttaacaaccatccttagtcgacattcacatgccctcaaaaaaattaattataccaggaaagagttaaataccttggcgttgacttgtgtcaccaattgctcacatttctcatatcagcatctctttcttcagaagccatggtttgaagctccaactcaaaggccgcattagccatgctgtctgctgttgagttctctttggctcatttcatgtagagaagagaaaataatgcttattggtataacttaaactcttggggaaacatatcctaattatatcacttaagctccattggaaaagacacgccaaaaaaaagagtacattgatggtgctctcttgctttccagtacaacaccatgattatcaatagactcagcctctcattcactgtttggttgctccctcataagcacgtgagaaagagcccctcattgtctcattgacttctccctctttaccagagagagatagtgcccctccttctcttcttggccgtgccttcaccaactgagatagaggcattctctatgacaacctcatggtcatcagagatagaccccctcattttcttttctgcaacttgagtttgtcagtactagatctctttctcttcctgactccacaagaacagttagaagagttgttgacatcatctgatacagctagactttcatcactttgctttttagatccacttctgtaaaacaagcacaaaagaaactcgtgagatatgagaacaggacatgtataaggaaaatgaaaaaaattcattagagccaagcaatgtaacgttgtaatgtcagtcatacctagacgatttcctccttgaacttgttgtggctgtgttaactagtctcaccatcaatagattcagaaagagagattcatagaagctgaagaatttaatgtcactaggcaatatattgtccccacatggtattctagaacgttttttggggctttctcacttgaacaacgttaaattcctcaagatctatatctggattccccaagatctatatctggatcacgaacactaggccacctgtttaacgataacaaacaactaccattatcatccaaccctaaactgtgtagtaaaatattaaaattactaatttacctttcattgcattgactctgtgcgaccaggaatgaactgagcaaaatcttattccagctgccagacccaaacaacttcacaggtaccatgaggcgtttgtcctcatcgagagaccaactccccacttttgaactttcaggattcaaggtttctctccacctaccaagtttgatgacatgtgaaatactagctaaaattctgtacgttagaactacctaaagacatgtgaaatactccgatagcacatatagacagaagcaaaaatgtgcaaatttgtaaatgatactccgtattattctactggcctgtcgggtattcccagtcaggtccctgtcaaggactatttccctgtcggctgtcccaatatccctgatggtttttggccgtcacgaaagatacagtttcaggtagtggatggataatttagccagatgcccatcagagcaaacaccaaacattgattttacaggccacgtcattgggacacagaagcattacaatctttggttatattttcacatccttaaagcatataaagttgtcaatatcatcaacaaaaatatttactagcaactaataaaggataaggaacactaattaagaaactaattatcaaaataaaatatcaaccaaaactaatgagaaataccccaacagtgcaaacaattaagcaactcaacatcaccttcctcatcgagtccagaatcattgcttcttggtattgttgctttattcctttaggctagtttgtctttctcatcatctgaccactgttgcttctgaagtaacatggggaatacaagggtaattgcttcagtacatttttgtactttgaaacatgagggttattggcaaggccaagaaataatgcagggacttcttatttttattctgcaccaaaggttgcttctttgtaagtacatatgcttcttgacagggaaaatatctaaagcaattagttaacataactattaactaagaggactgtcgatcttaaaattgaaattccacaagtttctaatacaactcactatgtaaactggaaagtgtacttcctaaagaccagagatccaccataacaagtatactgatacaagtttcgattcatatagaactaagtgaaactgatgatcaagggagattaaaacagatgaagggcatatattgtcattaaagtggcttgaacaaagatatgctctctttcagctcgtcgaatttacaagaccctttttgtggggccaaaacatataactttgctccatttttattaataaattcttctctacattacttccatgtaggcatgccataaaatgctatttcacatgaatggggaacctataacaatatctaaaaacatttccatgacaacagtgaacatatcaaacatttcaattatagggtaaattctaactatgttacagatttataggacaaaatagtacctgcaccaccagcaaacaccaaaacgagccttgttatcacatgttgctctaattccaagctcactaacttgttcatataggagtatacaaataccttcgtgaagtaggagaatcacttctgctatgtcaatctcgtactttggtggctttcaggttgaaggcttgtttaagtataaagtgataaccagaggtacctgtattaagcaaatcaaaatactaagggctcaattgagtataataattcaacactcttttgctggatcaggaatgcgacaaatattgtattcgaacaagtatagtagtttgtactttgtacaggttttattcacgtgttagaactaaggtctcatgataacagcatatgtagggaagcacattccgtagcatatgatataatcgagcatatccgcaccgcccatggaatggcctggacatacctgtctggctgtctccaagcaggtctgcaaccttgtcgtggcttcaacaatctgccatttgggtgatggaaagacgatgctgttctgggaggataaatggctgcatggtgcaaacatccaggagctggctcctgccatgtgggagcatgtgccctgtgccgaagtgcacacgaaagagaactgacgcagaggcgctacataattgccaattggggcgcctagagctcccctgatgtatctcaagtatctcaacctttgggctcgagtgaactcaatcgttcttgagcaagaacaggacaacattcttgagcaagaacgggacaacaccttcagctggaagtgggagcactcggggcagtactcacctgaatcagtttatgccacacctgttccttgggaggtacaatttcccacatgcactgatctggaagaaccatgtgccacccaaatgcaggtacttcttatggctagttgctcacaggagatgctgcatggcggacagattaagaaaacagggtcagccaaacccagcgaaatgtgtcctctgtgatcagcaagacgagacgatcaaccacatcctagtcggttgcgcagaatcatgccaaatctggtggctcatcctcagcgtcaacaagcagccatagtgcttcccttccaacccgcagccctttctctggtggtggtgcgacagcaggaaatccatcaacaaggcggacaaagaaggcttcgacacggtggtcatcctagcagcttgggacatctggaaggaggaaaaatagggtgttcaacaatctgtcaataagcttaggtgaagtagctcatgatgctgcggaagaagctgtgctctggagctcaatcagaacaccaacatagtgtagctgcgcactggtcaagaggtcgctaaatttgttgcgagagatagccctatgatcctcgtttgttcctttcttttcacacttttacagaagttgaaatgatgtataaactatcctagctaaatacaaaaggtacgcaaatgttatgcatattccaaaaatatagtttactccatgttgttggtctttttaaaatttcttactacactagtcctacacaattcagaagagtaaaccctagagatgtcatgagaacaatatcccgatgccttagcatattatatagaagacgagttgaatagggtaatttatgttttgatcaaaaatcaactgccttggaagtttattccagtaattcagattgccaggtcatatcataccaatattcacggcctaagatataatttgattagtacaccacatggtacctatcttcgagcaagagcatgccacaaacaaatggacagaaattaactcactggagtgttagtgcgagaagaggcgctgtatcacgcggagcgtcatgaggtttgcatcctcgtcgcgctgtatcacgcggagcgtcacgaggtttacatcctcatcccccaagtcgaagggctattgcttgatggtgctctgtattgcttgtacaatgcagttatcagtagcgactgaacccctcattcgttgtttggttgctcccttctgaacaccagagatagatcccctcattctcttgttgacttctccctcattaccagagagagagagcccctcattctcttggccgtgccttccccctcattctcttgttgacttctccctcattaccagagagagagagcccctcattctcttcttggccgtgccttctacaccaacagagggagagccagtcttctgtttcatggctacctcattatagacactgatagaacaacccattgtctccacgatggccttattattaccagtggtagacaccccccatatttaaagatgcacttcataatgtagtggcaagaggtgtgtggtttcaaccccgaggtcctgtgttcaatccccaacacactcacaatttcttcttaacaaaatgtttggagggacgtctctcccctcccaatatcgtttttgaccccccgccccctcatttttcttttgcacaacgaacagattgctttctcttcctggctccactagaacaatcagaaaagttgttgatgtcataagatgaagctagatctacttctgtaaaacaagttctgtaaaacaacaaaagaaactagtgagatttggaaacataacatgcacattcattagagccaaactttgtaaagttttaatgttatgaatcatacctagatgattttatccttgaatttgctgtagttgtgtttagagaagcctcggcatcttcagaaagtatattctatctcgtcaaaaaaaaagtatattctagaatgttttcggggcttcctgacttgagcactgataaattgagattgatgaaaaacagaacataaattatcgttttttttgtgctacacactcaactattagatagatttgaaaaatgaaactaaataaaagctgtgcctcacagcgttctcatcacttccatcaacttcggagtgaataagtgacattaagtaactggatataggatttaggcctttagggttcagcaggtcgctctgtttctctatcaaaaagttggattgaaaaatggctttctttatttgttgagccgccttaactgaaggcaatttatcttgac

SEQ ID NO: 65569 - DNA, 29766 bp, Oryza sativa
cccgcccctttgtgggtccacctggccccgtcctcggactggtggccaggtcgaaatcaaaccccgtcctcggcccctccggggccccgccacccgagcgggggcccgctgtgacgggaggaggcagcaggtggaggcgtcgccgtgcgccagcaggaggaggcgtggctaggcggacgtcgtgcggcgacggacggaggtggtgcagcgatgggtggaggtggaattgagacggcaacgggcggagacggagcaaagacggcaaggggcagaggcggtgcagggacggcggcggcgtggcaacgaatggaggcggcgacaggcagtggcatggcgatgagcgaagtcagaggcggcgcgggtgcgcggcgactagcggatgcggaggcgatgcggtggtggctgtggaggatgggtgaggggagtgggagtaagggatgtggggattgagaaattagggtttagattttacatgactcacttattgggccaactgggcttgtattgttggaataggctacattttgacgcttatcttatactccggggacccgctgggtcacccgcgagtggctgacgatagatctccgcccccgtccccgaaaacatgcggggccttgtccccgctcacccgcgggtgaaaattggcccccggccccaacggagaaattgccacccctagcaagctctagtcagggcagtggtggattgaagcggtacggggtcagcattgatagagatgtgagctcagggtcgcaggcgatgtcgctggaatgtcgtttcccaggaggaagtcgcccgaaaagtggtgacctagggtgaagaaaacggtgggcactctatcttgctgcttgattcttccccgctgcctgaatagccgtttgattctgccgccccgctctcctcgaatatgaaagcgccaattgaatccgccgtcaccacagccgccctcactagtgctcgccaccctcgatgcagctcgttgcaacactgtcatcaacgcacctaaacttacagtttggaggagaggggatcatgagactgaacgggcgaatgggtctgcttcaaccttcaaacatgtcgcgattgggttaaacaacattggcccaagggcaaacttgccttttacttaagtttctctctccatctagcccgaatataataaaataatgtgaggggtgtccagcggctaattatcatatttttatgatgtccacgaaaagatatgcgttttttgggtgtctcgtagcaaaagccatagatttttcagtgtcctatagcaaattttgccaagatcaactccaattaaagttatccaggaagttctagtgatatatatatatggccaaattggtcgctcagcatggcctgaccgacacgccatgtcgtgctgttcccacacgcgggttgcacctattgccaaaaggcatgatgggcccaacgtgcttgtccttggaaaaagtctattttacctccctcatctctttgcaccttacatatggctagaataaagtctatattgcctccctcatctctctgggccggccactgacaagctatggcctacaggagtggaggatgtcgggtcgcggttatgcttatcgttgggccatgctgggccgggccggcaagtcataccgaggaagaggcctaggcacgacccaacgattaggtcgaaccgacatggcccggacaacagttaggccataccgtgcttaggccgggctaaatctccataccatgggccgggccatcgggctgtgggccttttggccaactatatgtctgtaaatctaaaagtaataagttcactttgggtccctctatttgttgccagtccgattttcgtcctttgaccgcaaaaccaggtatgacccgtcctccaacttacgaaaaccggtcaatcctcgtcctatggcagtatggagggcagtttcagctgagctggcgtattgagcatccgacgtggcacgctgaccactgtgggccttgttgactgggagtggcagttggtgtggggttaaatgagacggaaaaaagggcgcgtgtatttatcacttctcctgttctcctcagccgaaaaccctagatcgagcttgagcgaaacggcgggcgacctcgagggcggggaaggcgtgaggcggcggagggctcggggaagggcggtgcagcgatggcgagctcaaggagcgacgggtcgtcttcttcgtctcgacggcctgctcctgtcccgtatcgggtaggtccaatggagtatcaacccccggtgttctgtcgttgcaaggcgaaagcagcgagatggatatcctggagcgtagataatcctggccggcggtattttaagtgtcgcaatgctcaggtaagcagtcgatttggagtgatttggtttttttggttcgattttggttggatttggtgagttcaatgttaggttttactgttccaggatgggggatgtgatttttttgattggtgcgacaagttgacgagcagttttcttagagagttgttgaatgacctgagagatgctgtgatgtcgcttaggatggagaaggaccagctgcggcaggaggtagaggagtgcagggagcgtctggtagaggatacgaataggattgaagaaacaagggctgagcttgcagcagttaggcaaaactgctttgaaatttggaaagaattgtgttgtgtgaaagataggaatagaaaggtggagagagagagagagagagaaatattatggtaatatgtagtgtggcatgtgtgtttgtgttgtttgttgtcatgtttgggaagagtataatgtaggaaagctggaaatgtatgaatgttgtatgagcacattttgtatgctgtccatgtatgtatggatgaaccccccctggcaatgtatgaatgcttggaccttaatgttgtcttttgatgaaatgctaaattgtgtgaggtgaaagtggcattgtgtacgctggacttgtatgtcaccatttgcaatcttgtgaagtgatgaaaagaaatggctgaatggttgctattggacgaaagtcacaatttgcaatcttgtggtcctaatgaaaagaaatggttgaatggttgaatggttgctgttgttgttgacgggggatacccgtagacaggatatagagggtattgggggtacgttggaacgaggatctacgtagtacgacatcaagcaaaataaaagacagggattatactggttcaagcccctttgtaggtaatagccctaatccagttgatatgggattatatgatggaaatcacagattacaaagggaatagtgggattcgatgatatcgacgagatcgtagtcgagttggttcgactagatcacccggcgacttggctcctgtaggctccggctttgtaggctgtggtggatgtgttggcagtgatattcgatgacttaggtcctacccggggggtcccttttataccgcggatcaattgatctccaagtagaactcggagatatcggacccctcacgatatggtaacgacccagttttatccgagtaggattctttctatctgtggacttcgtttctattacgtgatagatttccttaccgcatacaggaactatccgtatacgcgcgggtataccgtctcggtatacaacgtatatccaaggatagagggtataccttatctgtaaccttgacagttgtggtcctaaaggaaatagttttgacagatggaactcaaaatttgtcaaatgaaatgaaatgatatatatttgacaaatattaggatggaacttaaaatttgacaaatatcaggatggaactcaaaatttgacaagtatgaagcaaaaatctgcatggaaccgaaatgtttcacatatagcagcatagtagcaatttgacaagtatgaagcaaaagtctggcaataagcacataaatatgtctgacaggggttcatacaggttcctaaatggaagccaaacaatacaaaagacagagtacttgatacatggccaaacatcacagccaaacagcacataaggttgcataacatctggactaaacaatagtactactggatacaagggctgcatgccctgcaacacacatgttgcataacatcacaaggttacaatcttcatcaaagtttgtcagactcccatggcaatagcagcaaggcaccgcttgtcttcctccttgatttggcatatgcaggttcctcagctgacacgcagatagaagcactccctgaagtgactctcactgatgcactggtagaactctgtgaataaggaacaattgcttgtagatcaatcctagctgaaccaccatgttgggcagaaaccttggccttggcattcaccctcaccttgttctaggaatccataggagtctgcaaaaaaaccagtacaacacatattgaagtaagacagtatgacacacagcagcagtaatggtatttttcatgcatatggaagtaaaatcagtgcaacacaattacctttgtcttagcttttttgggcatggtttgaaggcttgaactctgtccacttagtgcaactgacttcctcttctactttgagcatagctttgagttgtgttagacagaaccaggttctgattctaaatggatggtggctgattctgagttgttggtggcttagaacctcctgtgctaggacccgtcccactattttgtttcccacagcgggacttattgtgcccaactaatttgcatttgctgcatctcagccttgtgccaaacctggacatttttgtgggctttgctggctcatgcatctctctccttctctctatctttggctttccaagcattctgatatacccatgagcagtaaggggctccctatcatcctcaggccaggcagacatcccttctactggctctaggcaatgtgcatatgtggctttgaatgattccacagagtagctagtggcaatgtaatcatctaggttgtttgttctgtagtagatgcatgcaatcgcatgaaggcatggcaacctagccaactgccaatatctacaagaacagtctctcatgtctagttggactgtgaatctattgtcatgatgtttgatctcaaatttattgtcaccattgcagattgcatgacagaaagcagactcaatgatgtacacattcagtttttttagtatgcctggacaaatcacagtggtccatctagttagcttcttcctctgatcatttatcctaaccattactttccttctaatggtttctagcattgtgattatggggaaaaaaaccttgcttccaatatccatttgttaaatgattcacacatattattgtcaacagaatcacaattggaacctaacctgaaccaggctcggctccagtgctgtggatgggtgttgaggatggcctgggctccagcctgtgtaacttgaactagcttggctcttgcaagattgaaaagcattctacatggggcctttgcacatctccagaacttcttctggtactgcttatcagggaaatgtctcttccagtttgcatagatatgcctagcacaattcctatgctcagcttcaggggcacatttctcaatagcatttagaattccctacataaacataaaagttagtccaatagaaaacaccactgtgctcccagggttacttcttaacaactcaagctggtagttgaacagcttctgatactgtccttttgtggcatccatctgtttcttcatcacaatagactttgctctcttcagcttggaaatagaggcctcagcaaacatctcttcttgtactgtggccttcatgtgtgacaagttccatgaagggatggcagctatgaattccagtatttctcagctatcctgccagttgtgacaattttattatccctccttggtggaccatgcatgcaaactctcataagtcacaatctgccaactatctgaccttgagttcttggacaataaacacacccatggatagctatcccagtcacatgtgaccctaaccctcttgtgatcatctttcataaaattaaccaccttcttttcagcaaggacataccttgtcatggctttcttaaattgcttcttgccattgaacttcatgcctagttcaaatacaagcaccccttctctcttcttgtacctagggtgctttgtcacgcccagaaatttaacccaaatttccagactattttgcgtattaaatccctgtccaggaccagccagggtacacaaaacgacaagtaatatacagttccaaacgtaaataaagcgtaaaatacttacggaagaggcacttagtcctcacaccgaaacagaacgacagcagcggaaaaaggcgatcctagcggagcttcagctccactccacaggcaaaactcaactggggtctgagccttggtcctctaactccatcttcagctcagaagcactacacttctgaaaagggggaaataatagcaagactgagtacaaccaccgtactcagcaagccacaccaacgatgcagatgtgcaaggggatacaaggatggtttgtggctatttgcataaaggcggttgtaaaacattttattgagcaaaacagtaaaactgttgagtaattaaagtaacattaaatctccactgatcaacgctacaccacgttgaacaggcccaaccaacccacctgaactacaatgtattgggtcgatttattaagatgggactaatcacggtgaatctggttgaccgcccataaccgcgggctcggctattcgaatagttttactctgatcagaggtgtacaactgtacccataagacacagccccacgacacgtttccgtgcgccgacatgccaccacgacataccggaaagaggccgtgacaggacccttcgcataaccccctctagccaagcacaccacacctcaggtttcacccccatccccagcgggcaacgggcagtcccctctcgtgcctaggtgaatccggaagcgacagaggccgtcgcagggcccgccccactccattacgcccacccttgcctggatgcgtcgactagaggaaagctacactacaagcccagccgttgcccacgctggcttgtggtaagtatgataagttctccagggcatcccgcgaaccggtccttaactgccatgggtgcgaccagcaaaaccatgcacccacagcccaccattcagtcgcattttagttggataattacgaccatgaagcatggccagatgtctcgagcacgcagctcatttagatactaaaaggtctaatacgataattaccccatcaactgagctagtggtaattaagcatggctaagcatatagttctagctaggtcacataagtaacatgagctagtcgatttattacccaaggttgacaaagaacagatatcaagtaaacatggcacaagcgagcagataggtaatacccggatcccatgtaattagcaaaacatgcatatttatttgtaaacggtaaaacatttataaattgggatcaacatgctcaaggggaatgtgtgacttgccttgcttcttcaaacaatcttccgaactcttatccttgcgaccgtgatcttccgaaacgacggattctacacgcaggcacgcaaaacgaggaaaaactctaataaaaaccaaggaaacagtacataaaaagtaaacaaacatgtagagctcaattttagatgaattttgcaagttgaatggctcaattcggagttcgaatgaattagatatgaattttagaagttttgagccatttaaatgaatttctagaattattaacgaattatgacgcaattattatttatttttccaaaggaaaagagggttgctgacgtcatcaaaggggaggggcggcgccggcaagcgggccccaccggtcagcggcacaagggcgccggtccaccgtggaccgggaccaccgaggcagtccaccaccggtccacgggaaccgacggtccggatcggcccaagccgatcgggcggccaggggcggcgcggctggggcacagcacggcacaaagccggcctagctgagccatggcgcggcggtagcgcggtctccggcgacggcgaccgacgggcggcgcgggagaggtggcacgcatgggcggcggcggcgcacgagatcgacgcggtgcgacaaggggggtccgggcggcccagacgagcggggcggcggtgcacggccaggtggtcgccggcggcagccaccggcgcggcagcgcgcacgggagacagaggagggaggcaaggagggagaggaggagctcaccaaggacgcggcgacgaggggcggggaaaggcagggagctcggcgtcggcgctcctcgggacgagggcggaacggcggcccggcggcgttccgcgagcgggaaccggcggacggcggctggaaggaccggcgcgaggggaaccgtgtcccggcgggatcctggccgtgaaaagcggcggccgaggtgctcctcggcgctgcgaagcgagcggcggtggcggcgctgcttggggtggttaggagcggcgccaagcggcggctggaggtggtaaaaacggtggagagaggtggtgcgcgtggcgacggtgtttcagaggcggggaggggaaatggagcggatgccggggtgcggtgggacgctgcgatgctataggtggcagcggcgcagtgcgggggcgacggaagcggcgacggcgcgcgactggagggtcgtcggcgtgtggcggcacacgggagtggcgtggggagctcgagagagcgcgcgggagggggcagtgagttggggaaacggatgaggggaggtcggggtgcatttttataggccccggagggggagatcgtggccgtggcaggcggcaacggccgacggatggagctccggcgacgtgggcgagtggggctcgaacggcgccgatttttgggggggaaatggggaagaaagtggaggaaggggaggacgtggggtggaccacgtctgcacgcgcgcgggagcgtggaggcgcgcggaggaagcggcgtcgtggggtggctcaagcggccatggcggcagttggagctggaggaaagggatgacaggtggggtccacgggtcccacctgtcggagagagagggagggagaggccggctggggacgcagaacggacttgagggagagagagagccgagcgggccgagggaggaggccggcccgagagggagagaaagggggcgcgcgggccgcgggagagaaaggagggattgggccgaaaggggcccaaagagaggaaggaggattttatttgttttctttttattttaattgatgcaatgatctttgtgctattaaaactatttctcgagctccgaaaattcacggaaaatttcggagtacattagggcacaaagaaaattacagaatattcccggccaataatttttaaaggaaatttttaattccctcaataattcacttgattaagttgatttaacttttatttaatttctagaaaatgtattaattgatttttattcccgaacgaaaatcggggcgttacagtgcttgtctctccttatcctaacctctccatcactgccaatttcttcaattgagtcatcatattgactgtcaacataaggggtttcatccccctcatctgcagctggtctgtcactagggttggacctctctaccacaaagaacacatcatccaagatgtctaactgtgctgtcttaaccttcttcttcacctctttaaaatgcttctctatttcaactgtttcttcatcatcatcagagggcagtcatctcctgggatgtaatcactgtcagtttcactttcagagggtggcacactagcaagggggcagaatcagggtgataaaccacaagcatcctctcatcttcatcacattcttgcacagctttaccctttagtgcacttgtatcaccctgagcttcttgggttactgtttattgcacacaattgccttttatttgctctggctcaacatctgcagcaatttcttcacaatcctcttccttttcaccgtccacctccatgtcagcttcataatcactatccttgtctgaatcatcacataagtccactatttcaggctcctcaacgtacacttatgcaacccctccctcacaaatgcagtctgatatgaattggcacaccttgtcactcagtagagcacgcatcccagtttggatatctttccctagaaaaagccagtgcaaaagtgtgccctctaacaccctgcagtgctcacgcaaatgtgcaaaaatcccactcaatgtcaccttctacctagctacataaaacaatgcctccgcaccacctacatagctcttttcccttccttctgtcacaaaatcacccttcatatggaacctcaccacaagagtatcaagcacgtccatgccttcaatagccttatcctaacatgcaaaatgcaataaaaaaatgacttagctccacccacaattgtcctaaacatgcaaaaaaaacaaagcacacatcttttctgcaagcaaacgaataaaatagccccaatctgcacagatccagcaaaagcactaactaaactactcctaatatacaccgactccaacacatcatcctcctccaccaaacttaaataacggaatcctcaatcccaatactaccagcaccaaaaggcaaagaaatttacctggccactcattgatttgtcagctgccccatgtcggccgaggttatgcaccgccgtgccctgcaccgatgcctccgcaccgcccctagcctagccggcatccgccgtgccctgcgagcgggcctcggccgcgccctgcgccggagccggtggcgtgctcccctcgagccctccgccgccgccagctcgcccttcgccgagcccaatgtcgtgccccccgtcgagccctccgccgccgccagctcgccctcgaggtcgcccgccggttcgcttaagctcgatctagggttttcgactgaggagaatgggagaagtgataatacacgcgcccttttttccgtctcatttaaccccacaccaactgtcgctcccagtcagcgtgccacgtcagacggtcaatgtgccagctcagctaaaaccgccctccatactgctataggacgagaattgactggttttcgtaagttggaggatgggtcatacccggttttgcggtcaaaggacgaaaatcggagtgggcaacaaatagagggacccgagggacccaaagtgaacttattccaatcttaaaaacgtcaacgttgcaggcttcaaaagcaaattttctccaatcaacttgcatagactggctggtggggccacggtctatagaccgggcttagctaataagtactcggtttgttgattggttcgtgcgcgacagcaaggggaaggattaggaaggagaagacgaaggggaaaggaggagaggagcgaaaccctagggccaggcaggcatctccctcccgggatctcgacgcccagcaaccggaagccatcggcatggctatggcgctgcgctctctcgccgggaagctcaggccgccggtggcagccaccctccgccgggcgccggcgtcgagctccttccaccccgaggtgttcttcgtcttccctccccttctccccctccctcctcctccgtaattatcttcatcttcccgattcaatcaccgcacgctgttcaattagtccccgattcgcgagcttttagtttcgagggaaaaaaaagtccagccttttttttttcaaaaatgtttaatttgtcttgagaatgattataatcaaccactgaaaatagacacatcggttggcgcgacgggctattttatttttatagtacgtgtttacagactttcagaacgtatctatgttagttttcaagtttttatataacattttggacctctaacatagaggctgacatgtaatatctaataacaaatattattttctacatattctacataatgatcatctaagatggttttggggttttgtggtttacttttaggacgtcataaacagggcagtaatattcttaatttattttttcattttatcttttctaacacatgaaaatttgcatgcatatgcttcctgtgttctgtttagaacgtaatatttttcacaatttttacgcagcacatagtttaattctcataatatttattcacttttttaattccctatttaacttctagaagatcaacagatttctaattatcttattatagaaatttattttggtagaatcggatattttcttttctcctctgcataatttttactcgggatgtgtaaaaatcacataatttacctaatagaggtgcatacacatttgatttagcacaatttagtttgatatatgcacatgaattacatagaaagttttactttgatgcccacaaacctcatgacatagcaaaatttagtacttgataaaattagttgcgggtgacctatcaagcagaaggcaaccctcttgctgttttttgttctttcctcggttcattttatttctttttggttcacatttttaatcttatttttagctttccttcgctttgatctctaagtatagaggctgtgcatagatggaaaatttggtttttcttcttcgagggtgaatctttattttctctcttttttctacaacattctaatagttggcactaaagaagactatttttatgcaaaggaaataatagatctatttcaatcccaccagaatgggaagctctggaagttgttaatgtacttgctttttttttttgccttttttaccttgcttccagattgtggaatataatagagggaatagacacatgtcaacatattattgcacaccaaatcaaccaatcagcttgcagtgtttctgccagcgtttgatagatagatagatagattgattgattcaatgtgactgtagtgcatacgtatacctgtagagttatttatgcatcctgcgaaaaagaatatatcttttaatttgctaaaaaaaattatgaactttttaaattcacggtgaaatactaacaggcaatttgattttgtttcttactttgatggtattgtaggagaagctgagcagcatgacatcttctaagactaaaactcctgttgatgacaactgttttgaattgcttggggacaagtattttgaagagcggtctcggatttttgcccaattggttaaggaagatgcacggtactatataacaggcaacctaattccttatactttcgtgtgcgatatactcccaactagtggcatccatgtgctaactaacacctattcacatcttctttttgcaaggcgcacggaggagcagatcgctgcatacaagaagctgaagagggcaatggttgcttctagcttgggcgcagcgattggaatttttgcccttctcatcagatataacgagtagtatatctgatactgttgtctagtactagtctcttgagttttagatgatcaccagctggcctagtgcctttatctattttagagcactctgtttatctgattatgcagttaattttggtgttgcacactggtactgctatatcgctgtcccagaatattggaggaacttaattaagagccctctttgcttgtgtatcattgaacatggtaagtatccctgtcatgtattttcttcttcaagacaaatttcatcctttgtatgctactgtcgttcatgcgtgcctatgcaacagttatgagcgtgatttatacaatgtttagttgcatcactgtatgattcactgtaccagcgtatcacttataagcttgatccttcatatccactgtattaggggacgtgactagagctccgatgtccaatcggatttctgacgttggacacaacgccagtccatagatcagcgtaaggcggtccatctcgttctttgaatttccctttttaaaaaaaatagaaatatattctttgatattaatagagtgacaaagtttgctatgtgacactagcatttgctgaaagataatgaaaaatgtggctttgttacatatgagtgacgctcttattatgtccatgtacattataaattagacactccaggcagtaggcaccagaatatgatagactacaacaaggtgacgaaaaaaacagcatgagatgtcctttttagctccctctacctctgtctcccatcttcttttgggtttttctttttgatttcatgtcattctcccggatgatgtattctcaaatatcactctctcggaaaactctgatttttcaccattgaagattgggtatttcttatgccatcgttaagcatgcaaggtgtcatgttaccacatctaaggggaaatgaccatcgtgtccttcctctaactcggggacatctctcttcctccaacctccctttctgatgacaagtaagtgatgccaccaccacaaacattgagtcatcaagctgatcggtcgtcgagagaggaggacgacgaggaggccagggctacgtgggggcgattaggtgtggggacactggctaaccatgggttcccgccgccaaaggccaagatgcggcggggttatggcttttcgctccttgccctcgattccatacggtgtggtgaggacgagagaggagatagtgttggtccacactacaacgcatgcgatcttctcttgacgaatttctcgtgccatgaaagttatttgttactacctccatcccagaatgtttgacgccattgacttttttaaaaatgtttgatcgttcgtcttatttaaaaaatttaagtaattgttaattcttattctttttctatcatttgatttattgttaaatatatttttatgtatacatatagttttacacatatcacaaaagcttttgaataaaacgaacggtcaaacatgtttaaaaaagtcaacggtgtcaaacatttagggaaggagggagtattatgttatttagttttacgacggttggtagggagcgatgtggcgcttagtgatgaaaatgaggtgtccgtcactgaaactaaggacaaatcgtcataagctagtttaacattgtatcgtgatgaatgttattttgtttcatcataaatatcttttttttcattgaaaacactatcatatctttttttttcattgaaacacaatagtctgaatttgcaagaattttaaaattacataatatgtttggagttctatagtaatgtgtaaatcaattaagtttaatgaagtaaacaagggaataaaatcttcttaataaatcaaggtgtgagttttttttctaaatactccatgaactaaaataggtttcagagctacattactaatgttaataaaacaaggattgtttcagcaattactactttaaaaacataaaaggaaagaaaatctctcaatcagtattgggctaatttcagtccttctcaaggagtgggaagaaaaggaaaaagtacaccgaaggtccctcaacctgtcatcgaattacaaaatcgtcccacaaccacaaaaccagatatatgacgtcccttaacttacaaaaccgttcgttttacatccttcggtggttttgaccccggttttgtcctacatggcgggtgagtcagcgtgggatccacgtgggccccacatgtcaggacgccacgtcatcatctctcttcccccccccctcccttcctcctctctctctctctctctcactcatctccctctgggcaagccggccggcggtggggaggtcaccgggacaaggaggtcggacggccggccagcgatgcggcggcggcgacatgggagaaggggagggaggtggcggcaggagcatgaggtgctaaagcagcctccattaaaatcgatcagacgaagccgaggcggatttcgcatgagctagcgcaagcgtcggccatagaggaggtcgtcgtcggcaaggagcgcaagctcctgcgctgcgcgctcgtcggcgttggcgtcggcggccacggcggcgcgcgtggcgggcgagccgggtggcgcgcgcagcggcgggcgagaaggacaagcacagcaaagtggtgacgtcacgggggctccccgaccgccgcgtcaggctgtcggtgccgacagccatcgcgttctacgacatccaggaccgcctcggcgtcgaccaaccaagcaaggccatcgagtggctcatccgcgccgccgctgccgccatcgacgcactcccatcgctcgactgctccttcgtcctccccaacgccgcccagctcctcacccgccggaggcggaggccgtcgagcaggcggccttcgacggagcaggcgcgcacgaggaaggctacaatggcggcgtcgcctaggaagtcgggggagaagaggcggaagacgaggtcaaggtgcgcggcacggagggcggagcgcatcgcgaagttgagggcacggagggaggggtggatgccgaggcgcgaggcgagcacctcggcggcgtcgggcggccaaagctggatcaggaagccgtcgacgccgaggagcggcggcttgtgctccggcacgggagaaggagaggaaggtggcggcaggagcatgggggagataaaagaggacgagctcaagcatggcggcgagaggagtggggcgacggcgggcggagaaggccggcaaggcggtggcgcggagcgaggtggtggcggacgacgatgatggcagctcgcgcgcgcagctcctcccccgcacactcgccggctcccatctcctctaccgccacccagttcttccgtgctgccgctgcccagctcctcccccgccgccgacgccgcccagttcctcccccgccgccggcacctcgccgcctcgaccatcgctcgagctcgcttgcacctttgccacccccaccctcgattgagagacgccggtcgctggggcactggacgacgaggcgccccgcggccggcggcggcggcggtggtgtggtgccggcggtgttcttcgcagtgctggagaaaagtgaagagagagagaggagagtgagtgatgacgtggcatgctgatagatgggtcccacgctgactcagccgccacgtagaccaaaaccggagtcaaaaccactaaaggacctcgggtgaccggttttatatagttaagggaccccatatatctggttttgcggtttgaggacgttttcgtatctcggtgacaagttcagggacctccggtgtactttttccggaagaaaacagtccacccatctgatctctagtcttgggcttattttggcccatttcattatcccccaaatctctttagggagggagggagatacaggaggaaaagtaatgggctgaaatcggcccaacactgatacagtgattttttttccatttaaattaccgaatttgctatatatacggcgagaagttagccggtgtagccgccgcaggacaacgccgctgaagaccacgacgcaattctgccctgcagccactgtcgacctcctgcattgctgctacctccttttatcacctttaagatccaatcacactcgatatcagagaaatcttttgctttcagcatattataaacacatggtcattttgttatatgccttttcaaagttaatttttgggaaaatagctactttagtccctaaagtttgtctataggatcagtttagtccctaatcttttaaatggtcgaaagaaatccttaacctttgtcataagacctagaatagtccttgggtccaccaaaattatcatatgaatatgccatgtcatcattcatgtaaaatctatgatgagctgtccaatttacccttacatatatcatagaaaaataaatataatggtgaattagacataaccataggaaaaaaatacttttttttcacccttttgaggtatatttttgctcttacatataccatatatttttttaaatttttccttttgttttttattttcctatgcgtaagggtaaattggacaaatcatatagattttgcataggaaggtgacatggcatgtccatgtggcgattttggtgagaccaaggactatgttagcctacatgacaaatttaaaggacttatttgaataatataaaagattaagaaataaaatgatccaggagcgaaactttagggaccatattagctattctccattaattttttaagattgcttcttccggtacattgcgtttaatgtttcatgcagaatcaacaccccctccattatataaatcttttttcaataaaagctatctgattgacaccttctatttacttctcgtagtctccccattagacagatgagcctgaaaatctgaatcattttttgcatattttcgtttgggctactactaagtcacgcaatatatatctagctcaaaattgaaatgtcagataacactgtcaaggtaactaatgacaactacagaattttagctgcctttgtttctatagtattgaaatacttatcacaaataaagaattatagtatatatactagcagtaaagaacaccggagcatcgctctagttaattaccggtgagctttacgccactggttatcatgctcgccggaagacgcgttgtcgccggcgctgctggccggcgacgggcatccgtaaccctggtactcgctgctgtagtactccgggctggccggcgacgccgccgtccgcctgacccgctccatctgcgccgtgtacgatcccgaccccgagctggagtcgccgctgctggacgacatggcgctctgcccgggccgcgcgccgtcgccgagctcctccggcgacacgtccccctcgagcaccttcaccacctggctcatcttggggcgcctcctgccggcgtggcggacgcaggcgacggcgcaggcggcgacgcgcgccgcctccgcccggtcgtactcgccgcgcagccgcgggtcgacgatgtcgtcgtagccgccgccgccgccggcggccatcgcgcggggcagcgcctggcgcgcccagtcgacgaggcagtcggcgccgtaggagctccggtcggcggggcggcggccggtgagaagctccagcagcatgacgccgtaggagaacacgtcggacttgtccgtcagcttcccgctcgacgcgtactccggcgccaggtacccgaacgtccccatcaccctcgtcgacacgtgcgtcacgttctcgctcgtcagcttcgccatcccaaaatccgcaacctaaacacgatgatccaaattggtctcagagtcagcgatccatcgagacaatgttgcagaacacagcatatgatcgattgattgatcgatgatttgatttaccagtggctcgaagttgttgtccaggagaatgtttgccgacttgatgtcacggtgaatgatccgaggattaccttcaacagaaaaaaaaaaaggagattatcacagactgaaccaaagccaccattgatcgatgaactgatcaaaattcggagttcaacttacattcctcgtgcaggtaggcgagcccctttgctgatccgaccgcgatgcgcaacctcgtcgtccacttcatcaccggtaaccccttttctgtacacgttgaagtataaatgaattgtccgtcttttatcatgttcatagtggagtaagtaactatgtaccgtgttataatgttaaggtataagtgaattgtccatcttttatcatgttcacgatgaagtaagtaaccatgtacggtattgaagtataagtgaattacccgtcttttatcatgttaactatttaccatggaggtggtgttcgagagtgcggttggggacgaagtcgtagacgaggaggcgttgcgcgccagcgatgcagtagccgacgagggggacgaggtggcggtggtgcacgcggctgatcatgtccacctccgcctggaactcccgctccccctgcccgcccccggcgctgagctgcttcaccgccacctccttcccgtcgccgagcacgccgcggtacacgtacccgaacccgccctgccccagcatgttcccctccgagaacccgcccgtcgccgccgccagctcgtcgtacccgaacgcgttctcgtccaggcccgccggaacaggcggcggcgggggcggcacgagcggcggccgcacgacgacgtgcgggccggtcatgttcgtcgggtgcatcatcatgttcggcggcgtcgacggggcgccggtcttggtcgccgcccactgcggcctcgcgccgccggtgtggtggtagtagtacgccgtggtgttgcctgcgtcgtcgtcgcgccgtcgacgtcgccatggtcaggaacacgacgagcaatggcaagtcacagcaatggcgtgcgcgacgtgtgcctcaccttggtacccgaaggcggcggcgtggtgattctgccaccgctgcgtcgccgacctcctcctgcagcaccaggagcagcaggcgcaggcggcgaacaggaggacgaggagcagcgccgccgcgacggcggcgatgacgagctccgacgtcacgtcgagcccgccggcaaatgtgatcgacgtcgacagccgtctcgaggcgtgcgacggcgagtagaaatccgccatcgacgtcgacggcgaatcggtgcccctcggcgacgacggcgagggatcggaagacatgatcatgaattggacgcgcggccagaggattcacgatagaacatcacaaatttttttttgaagattgttgacccaattttgtttgattccaattccaaacttcaacacgaatcaatcgatctgaaaaaccaaagaggaagcacattttcatgcatgtccgatgcaagaacgatcgagcaaaattaattgcgaaattaatgcgaactgtaacctacatgcaaaattttggcaacaacatctaggagaggacgcactggatcgatcgacccaaacgcgcaactaattaattgaacaaatttgatcaagaggggggtaattaattaatcaaagatcgagcagttagttaattacccccaatgtaatgtacctgaggcgaaaggccatggcgcgagatgtgccattttggcgcgcttgctattcttgcacgatctgtactgcaatctgttcggtttggaagttgcctgcagcgagcggcagtttgcatgtcaaaaagctgacgtggaggaggaggagaattaaagggcggttacacttctgtgtgcgtgatacggggacacctagcgtcagttttctgaccggccgtgctactactcctcaggtcattacgcaggccattttactggaaggccctttgatttgtatagatattacctagagatttttttttaagtttcttgtgttttttttagagaagtagagatattacctagagatttttttttaagtttcttgtgttttttttagagaagggtattttttacccggcctctacatacaaccggatatatacggccattgaaatagggaacttagccccgcaaacaactcaatctaaaattcgctccataggagatttgaactcagaaccttggtgtactactcaggtcactgtaaccactaggctacatgccctttcgtaagtttcttgtgtatgcaggcaagtatggtttacgccctctctatttctttaaatctgttatgtgcagctgctgaaactgaaaaggtaataaattatgctttcacccacgatctctttgagtcctcttgagttagcattccaaaaatcatgtgtcctgaaacaaaatggatgataatggaaagcatgaaagctcgagagttcattacatgatcacatatggaatttgaaagcatcgagtctcataatattgtatgtctatatattgtctagggaagtaggttaatgggttgcacatttgcgattattagcttgtaatgatactatctgatcatgcaaggacatccttgaaaaaatctaaactgtcaacgacggtgcgccataaaaaaatatttcaaatgttggtcgcctacagtcagttagtacttcctagttcacttgttgcttgctagctttaatctatcgcaatggattaggtttttcattcacatgtgcatatatcaagcattaacatggtttgaaaaatcgaacttagtgggccaacacatcgtgagaggtttgaaaaatcgaactcagtgggccaacacatcatgagattttaaactaacacatattaggcgagatgccatagttggattggatctgggcctgggcctaagcggatgaattgccaacccctaaaacatgctaaagtagctaggggtttctcatgggccaactatacattcacacgcggccgcttaaagcggttggaccgtctaatgtgtttggcgctactctttatccatatctaaatctacgcattaatgagtcatcctaacatacatataaatctacacacgatacatatctcaaagatagacatcattaaagctacaaataaatgttacaaacaacccaacgtatccgtgaaaatatatcgatatgggagatggaccgatataaaaagttacacagaggagttaggaattcatctcccatcttgaacatttgtaaaggataattctacaaaagtaaggggcttaggcgaaaaagagcccctcctcgaggaaacgcggcacgctgtgcgtgcggctggcttttttatccgggcttgaggcaacagactcttccccttcgctcgctcgcctcctctttccttcctctcgctcacaaacctcccaactagggttttccccgccgccgccgccgccgccatggccgccactccggaccgcgccaatgccgacctccgccgccgcctcgccgtcgacgcccctccaccaccgccgcagatcgccaaaggtccctccccaactcagccccccgccgtctcccctcccctccctctcgatccgttcccccgggccggaaccctagctgttccgtggttgctcgggccggtccgatttggttccagttcggtcgttcgatccgccccgccgttcccggagttttggggtttttgggcggttgggaaatggtggttgtcccccccccccctcccctcacttggacttggtggtgaggcaggtgttgggggcgtgttaagggcgggtaccttgggtggttgagtgaaatcggtttgggatttgggtggattatatgcaatggtcctagtttaacctccgtctgatttgtggggttttgtgcggttgatttggctgggatggattctcttccctgcattttattactttgatttctgctgtgtatgcttgcagatttatatttttttctatgtgcatatgctgttgttggtaacttatgctttgatgttgttagcatgtgccatgtcatgtcacacccgttgttgtgtgagaaatttggatttgatgtagctatgtgtagaggatgacagcttgtttcactgattactcaacatgtggaaaaaacctacgtgttgttgtagaaacccgtttgatttaaatttgcatcctgtgccaattggcctgttcggcaagcaagggctgcagccgctgctgtcttcgtgcttgcgggactgttccagttggctacggtttgcgtcgcagccctggcagccgaacaggcccaatattgtggtaaaaagttgtagaactaatgtccaaaaccctgatctagttgtgttgatttgaggtatattattctagcctttcattttatcaagtcaaccattggtcctttatttggttaattatttgtttgttacaaacatatgagaggaatggttgtgttggtaatatcacatattaatggcgcaatctgtgttctatacattttctttgtcagcagaacatgttccatgcctcattcatgatactattttttttttgcagacaagcaaggactggatactgagatgcctctttctcctcaatggcttatgaaggtgggagaaaacaaggttagacattgagaagctaggttaataactagacttagggaactggtcatgctaatactatacatgatggttgtaacagtaggataccttttaagtgtataataacctctcttattagttattttttgcttgtctatactgaagatcgttgattgcttgtggcaggaacccagtttactgggtgttcgttcagatggttcaaagataccaggaaatgatgaggacacaagcttcagtgtgaaaagaaaggatgttttcagggcctctgtgcttgatggtgaaactgggtgtcgtgaacgctggcgtgatgatgaaagagaaccaaattcagcccctcggtggaatcgctggagggagacagacaaggaacatggtgatacacgcaaactggaaaggtggtcagatgactcctccaagtactctgtggatggtcgtcgtcctccacaggaacgttggagtgactccggtaacaaggagggaaactatgatcaacgccgtgataacaaatggagtgctcgtaggggccctaatgataaggagtctgagaattggcgtgacagatggggtgattcaggcaaagatggtgatgctgcccgtgaaaaaggtttctctcactacatagctcatggaaaagacggcaacagtcatgagaaggatgctgaaagagatgataatatttctagatcatggaaatctagttatcctgtgggccgtggacggggagattcatctcatcatccctcacagaatacacaaaaatcatctgcaacatatggatatggtagagggaagccagacaatgaaattgcaagttttccaggttctcgtggaaaatttacatctggaagtacaaacacagccagttcaggatcatcacgtccattccatcttggcctactttctgacaggcctggtggtacatcaggagatcgcacagcatttagatatagtagaatgaaactgcttgacatatacagaacttctcatgttactgacttcaagatgccccttggtggctgtgaggaactctctgcatttatgcaagaagaaactttggaacctttagcattgtctgctcctactactgatgaagcggtaattttatgctataattttctcaagtgggatgatctcattattgcagtacagtttcttatctcacagttctatttatgtttttaggccatcttaaaagcaattgataaaggggatatcataaacagtggcgtccatcaggcttccaaagatggcccggttggaaaaagtaatcctgaatttccccattaaaacaaccaaaatcatgttttcagcagtttgtttatgttgttgtgtactactaacatatgaaaatatttttttatcttactgattgaattctcactctttaattagatggtagagaagatcaacaaggaggcatggaagatgtcaagggagaaacagctgcaagtctcaggggtaccttgtttatttctgtctttacaattttgttgtacactgcattgcatttatttgaataggcatcaagtgattaactgattacacagagatgatagtgtattcactcatccttgaacattattttttgaagtaaatttcacaaaaccacatgatttatgggtaagttgcataaaaccctagatattttgattggtggcaaataaacctcaggtattatggttataaagtttcacaaaaccccagccctatgaatgttgagtatggttttacttaaaattttaaaacatagcatgtatgcaaaatttttaattattgacttcttgattaaggttgatagtttaactcttcagtcttcactactctgaaaaatattgttttagatcgagatttgaataaaggttgggtatgtgccacaagtcatattacatgtggttttccgcaaccttgaccataaaacatggggttttctgaaatttactctcttattttttttagtcaccaccaactctctgatgactaggggactttccaggtttttgttagtataattttgttttcttaaatatgtggagttgtgtacattgaccttgtttacaatcagtcaatttgacatgcgctttgaagcatttccttttctattttagtgcctctacatttaaccaaattttatatttgctgtagatgttatagcaagtttcctgtttgctcctgtatgtaaatttggttggacaagacaaagtttgcagctgcaagcattctatgtttttcttttggacaggaaaacgtttttaacttcttgtagacattcaataaaactatgctataaggtttgcaaactaatccatcaatatgatctctttgttttaaattcgtaggccatgttgaagtccttactgttttttgtattttttaaaagatatgttggaaggctgtcaaaccagctcactttgtgctgttattattctactactattctttcgtaagttcttgcagtgtctgttaaatcattttcccatgctaaaggttgccactgttggtttataataggttttcctggtaatactgatttgccggccagagcggattccttgcggccagaaacatctgcttatgttgttccacaaagatctaggctcattggagaacataggcctggaccaactgctgactatatacagcaaatgccctttgcattagatcaggaaagtaaagtcgctgttattacaggtgttgatggatttgccactccaacttatcctaatccagaaagcttatctttatattacaaagatccacaaggtcaggttcaaggccctttttctggagctgacatcattggctggttcgaggctggttactttggtatcgatttgttagttcgtgttgcaaatgcaccccctgatgcgcctttcttattgcttggggatgttatgcctcatctacgagcaaaggcaagaccacctccagggttcgctgcaacaaaacccagtgacatgctaatgccagaaactctatcaactgggaattttgtcagctcgagtaacacacatgcaggatcagccagtgttggagcatttgacagtgggctaagcaggaaagatggtgcagttgaagctcaaaatcgctttttggagtcgcttatgtctaatagtgttcgtgatccttcagctgaaatgcttgctatgactgcaggtttgttttcttagcaagaatagcggccgtttcattccatttattgttttttataaccataattctaatcttgcatgcatcctggtttaacataaaatccttttttcctttaattaggtatgactgaatatggcagcagtggcattggtaacattactgtgtctggaggagagactgggaacagcatgacttaccttttggtacagaaaagattgttggagaggcaaaaatctttgcaaaatcctggttcattttggtcaggagacagtattccagctgcacaagtgcaaaacaaagatatagaagcatctgctctacacactaaattgcaccctcccatggctgatccacctcgccaagctttgcaatctcagaatgttgatttgcttgcgatgctgcattctgcagagaaacctcaagcacctgcttctaattctggattgccagcatggtcaaactaccctgaagctaagaatcttgatcctcgtgggcatggtgtggatctcactcaagggtcacttaacatgcatggtgcaagtgtgcagagttcccaacaagccactactgctattcaacagcaaaacttcatgccactgaacatgtcacaaatagctcatttgggacctgagaagttacgtgctgaaatatcccaagacccacagcttttaactaggttgcagcaccagtatctactgtcacagctacaattgcaaccacagctacctgtgacgcctcagcctcaacctcaacctcaactctctatgttggacaagatgatgttgctcaaacagcagcagcagcagcaaatgcaacaacagatgcaacagcaacaacaaatgcaacaacaaatgcaacaacaacagaagcaacgattgcaactgctgcaacttgagcagcagcagcagcagcagctgttgttgcagcaacagcacctgctttctcaagttatacctcatgggcattccagtcagcaacctgatgatctttatgggtcacaacgtacttcattgccaactggtgattcttcgaatcttggccttcagaaaatgaaagaggttcttgaggcagaccgcgttttgactgcccatggtacacaggaggggcagcaacctagtgatccaagtattatgaataagaagggtatggagggtgtaggtccatctcaaagctctgtaccttctttattgccccatgaaatttttggtggtgtaccttcaaaagatcgctactctcacccccagaagttggaagataaggtcaatgtcaatacacaattaaaagccagtatagtgaacccgatgctaacagaagttgcaaataggcgtgaagatgattctgatcaacaggaggttagatctcatgaaaggggcattggaataggaaaaacaggaatcatgtctgaaaatattttgggctctggatcttctgaggtcataggggcagctccaagtgcacctaaggagtttcctgaggcaccgtttgatccaaaacctgaaacattgtcatctcatatttccaatcaggtgcaagatttgaaaatatcttcagaaaatatcctcggtggtagtgaaccaactgtggcaactgaagttaaagcctctgatacacaggacacaaaaaaatcagaaaagaaaaagaagcagaagaagaaacaggcaggtgcggatgtagccaaaggagctacaaagacggttacttctcaacagccaaggcaggaaactctagttggttcagatcagggtggagctaagcatgacttgcaagatgatgcagaggagctattttggggttcccccatccaagtggaaagttcttctaaatctgctgacccaccgctaggattggaatcatctctggttctacctgcgaaaagtttttccgaggattatgatactaacaaaggtgaatgggaacctaatgctgccgcagtaaaccagcgtgggtggaaacctactcagggacctagacctaaatcacttctggaaattcaagctgaggaacagcttagagcacagaggggattagcaatggagaatgctaagccagctgtttctgcagcttcagtgccatcaattccttggaatggcatgctgaccacttcggaccagcagttgatggctgtaagtaaatcagtggatggcctggaaagtgttggcgactcaaggaataggagaagccagttgcatgatttattagcagaagaagttttagcaaggtccagtaacacagataatgaggacatgggcaatactaatgatatggcttttccacctctctcttctgctgttgttcagcctgatgctcctgcttttgatgatactgacttcattgaggccaaggactctaagaagagcaagaaaaaggcgacaaaagcaaaaggatctgcagtcaaagccccagcacctgttgtttcctttgattcatcgactgtatctgtacctactgaaaagggaaagccttcaaagcaatcacatcaagagaaagaaatactaccggctccaccaagtggtccgtcttttggagattttgttccctggaagagtgatcaggcaagtgcagtacctgctccagcatggtctagtgagtcagcaaaggtgcaaaggcctctgtctttgagagatatccaaagagagcaagaaagaagatctgctgttgcccagcagcaaccaccctcgccaaccccagcaaaggtatctatcaaccaaaggaatcatgcaaatgttccttcctg

SEQ ID NO: 65570 - DNA, 12052 bp, Oryza sativa
acacgctgtaaatgaacggaatgaagatcaatagatcatccgttaggtcgccttcggttttgaacaagccctacaaggtggtcaaagaaattctattcttttatttaccattgattggctatctgttgatgcttttattattcaaccaaactggtggaggagccaaggtcacagtaatcttattaaaggtggtacttatagaacttccatttttatcggtacatgtgagtgtgagctaatgtattccatgatgaaatgcattccatagcattaggattggatgctacagggaggtagatctcggctgtgtcatgtattccatgatgcaaagtcgatgttggctattgtctcggagttttaaatagatcgaagattattagaatagaatgtaatggtgtagcttctttgggcatgatgtacaagaacttttaactcaactgatttaagcgaaggatgtatatcttttactccattaaatgtatgttaacgtgccttgcacgtgcacgctaactagtgaatttgaaatgtgccactacataccccttctaaccattataaaaattttcttgaccaaaataccccttctgctttcttcttccttccctcaccataggagtaacttgcttgctgccttgccatggtcgagctcaggctgcccaacttgcttgcttgattacgttgacaacgacgacgttggcagtagcttagttagagctagtagctagctaggcaatgagcgtgaggagcccgtcgctagatgtcgacggcagcggcgctgagagtatatttgggtcgggtggcatcggcgggttcgcggctatagtgttggagcctccgtcggcgtgctcctcattgtctccaccgccgcactcaccatctacttatgtagcagcacgtccatgccgtggccgccactagcccacccatctccgagacttgtcctcctcgatcacgccgcggcgatgacgtcgaggccggcatcgacgacgcgacgttggaggcgttcacggccgtggtctacagtgaggctagaaaggctgcaacagcattgcggcggcgacgcagacatgctgcctcgtatgcctagagaactacggcgatgctgacgttctctgcgtgctgccgaacagcggcaacctgttccagctgacgccgctcgtcaaggtgacgccgctgtctcttggcattgctctatcgtgaatggaaaagagagatgaggggaaggaagaaggaagaaaaagggtattttggtcaagacaattttgataatgcttcgaaggggtatgcaatggcacatatcaaatttctgtaaaatcgcaatggtatggtttaaatttcatgaatagtattgacatatttctaaacggataaattaataatggcatggatccaattaacccttcattcaagtactggtttatatctctatttaatatcttttcggatgaaagaaatcgttagaattgcttgctgacatattggtaaagttaaaaaatatggaaaaggaaatttgacttgcctaaaattctgttttattgttaagtcacgaaacatatcacagcaagagtacataaaagacacgaaacagaataacatatgaaaacactagttcaggatggcttttgcgggaaaggcagatcacctcgttctatgtcatagcctgaaaataatttttgttttgcgaactttttttattttgggaactaaacatcgttctatatgatagcataaatttttattttgggactaaacaatgtatttttattttgaactaacaaggcatttgccatccatttttactattctactgtatgatgctttcttataactttaggacattttctttcaatttttattagaactttagggccttttctcgccaggttacctttaataaaaaagattagtttactttgttatccatttttactattatactgttgtaaattctgaagaatcatgaagataaaattaatactgtttttctctattcagttcaaagggaaatattcagttcaatgtttttctctattaagttcaaagggcaatattcagttcaatgtttgttattttttaagtctgatgtgaatgaaaacatactcaagagcattacattatctctctttatagtttttttatttttttataaataattatagcaattaacattatttttttcgttatttatatcctcttttctatactaagtcattttaatattttcctaatttaaatttttgtatcattaaccaatttcaatgaaaaatatattgatatccacaataacaaacaaaatactatactcatatgataaattaaagttatataacataacataagacatatgctctcgtatatagtaaaaccacaactcatttgagagcaatgtttatagtgcattatgatcattagattcattacacatgtctattttatgactttagctagcattgaatattatctatatttattatcagttaagagatttatatattatgttagggagaaaatatctcttttctaaaaactagttaagcaacatcgatgtcatggtaattactcatctaaaaattattactaactaatatttttactatgtttcagcaagtaatactaactcatgtaaaattaataaataatacttcagcatgtgcagatgaactagctagtagtgtttagttgcaacatatggtggctagtgctggcaataacattatcgaaaatagaggaatttaatgtgtgaggtattattcatgacaatgtttattttttagataaatgataaaaagtttggtgttcatttatttttaaaaaagagtatatgtagaatattcctttcaatgctacgcatcaaacttcactcttcacctcctccttcaatccaccctgccactcgcctacataccaccctctcatctaccgcgatcatccgttcgagatgcccgttgtcgagagctctaccgactacactgtctccatagctgtagcgtttgtggtggccaagggggcaccgactagcaggagatgctggaactggagtacatggctttcaaactcaaccccatggtagaggatgtcacgccctgataaatccatcccgaattaagaatcactttttaaaaggaataatattaaagagagaatctattctataccactgagtttgttcgagttcaacaattcgccattgacattatctttttctataacataccgacgactttatcaattgttctacaatacaccattagtttaggccttctttttaaaaatacccacaatacctctagtgagatataagattaacaattgatttatcttattagaagtttaaaaaattatgaaaattttaatgtggacccactacacaacatggaactttgtatacatgtttcaagttttttctggtatatttagtttttagaaaaaaaatatcttatgtggtatatgagagaaaatttgcttatacgagagatgtagtatatgaaagatgatttatattaaaaacatcaataaaaatattttatatagcatataacagataagttatattttctaatatatatatatatatatatatatatatatatatatatatatatatatataaaaacttgaaacttctatacaaacttccatgttgtgtaaggatgctacataaaagttttcatatttttttaaaacttctaattggataaatcaattgttgaacttgtatgtccataagggtattttaggtatttttaaaaagaatgtccagcctaatggcgtagtgtagaacaattgataaagtcatcgatatattatagaaggagacaatgtcgatggaaaatcgttgaactcgaacaatatagaatagattctctcattcattgttaaaagtctaagagaaatctcaaacactaaaatacatctaagaaaaattggaattctgcttggagtatttttagtaaattctccttcttctaaaatatctcctcaatttttacttgaattttcagagcacaagaaataatttaaatgcaacaaaaaccaatttcagagttaattaaaaatgaaaaacctaaaaataattctctcttctcttagggccatttttggcccaaagtccttgtctccctcagcccgtgggcgaagtcttcttctctctctcgggccgacctcctctcctccggcccatccttttcctcaagccggcccaccctccttccctctctcccttgggccgcctcggtccagctcctcccctcctcgctcggcccagctggccacgtcgtcttcctccagttgccgcctgtcccatcccggccgaaccctaccgccggcatgccgatctccctccccactcattctcctcctaattgaataccaaaaatcagttcctatcctcctcatcaattcccccacgttctccctcttaattcggccttgattcctgaatttactcttcgatgaactgccgccattgatggcagcccggcgagtactccggccgttcctctcctctccccggtcaatcccctcctcctccccggactataaaaaggagtcccgaccccctcctctctccccacataccactgccctcccccacctctctctagggatgtaagtggatagtcttgctacccgtataaaaacctatttgttagttcatttttcatatggtagtacaaaatttagaaaaaaaaatgaactagaagtgagataagcgggctaaaaaaaacccgcttgcccgccccgcttgcatccctacctctctccctggccgccgcgccgccttcttttcacgtcgctaccgttgcgcaactctgaccgcccctcgccggcggtcgggacgtcctcggagcccggcgtcgccaccatccgcttcgcagcgacctcctcttccccggcctcgcctccgttccgcccgaggccagctggtgcgccggggacgccgacgtccaaaacatcgttatcctccagctttggcaagccctccccgtcgagctgggcgctgccagcccgtgctgtcgctgccgacggtctcgcctcactgtgcttgtccccggcatccccttccctaagcccgaagctcgctggaagcctgttctcgccggcgaacagtgaggacaccatcgtcttcttcctccagcagccccctcccttctcaccggagcgcggcctcactgcgcccgctgctgtcagctgaacctcgtcgccctctccctcggctgcaccttctcttcaagcgaagacccttggaacgtcaccccgtcactgtcgccttcctccggtcgccgttcctgcccagatgaagtgttgcccgtcatcatcgtcgtcaagtccgcagcaccaagtcctccagcgtccgcctcttcgtcaagcccgaagatcattggagccatcccctcgtcgtcgacccgttcgtctccgtcaccctcctccgttcgtcgtcgccgtgccatggtcgtcgccggttgtcatcgttgttcccttcccatgtcgtgcccgtggtgagaacctcttcccttgctaccttatcctcgtcctccccatgtggtcgccgcgtggattgcccacgtgtgtagctcacgtggtagtcccggctgccaattgctcgatcatttctttcttcgagcgatattccattgcgcataatttaatagtataataataataataattaaataactcagaaatatccactttaattgcacttaaaattcggatggttgtttctcggccatgcgagctcctaattgacccgtttaaattgtttaatttttgttataacttaaaagaacccatgtttgttgtttttttgtgttgtcttcatttctttcttagagttgtagccctgctttgttgttttgttgttcgtgtagttgtcgtcgtttcggaagttctcgaagtgcagatcaagtcgtcagtagaccttctcttcgagcaaggcaagtcataccatattcgttgaatatattgaatcccattattgcaaaaacttatgttgttttacttctatatgcatcattaaaatgagattcgctcgaattctactctcacgcagcgggtattcgctacaatgccattttggctatttgttgcatttacaaatcatttttaaggcaaccatgctgacgccgctgccgaccggcaaacgtgccgccgcctccccaacctagcacgcgacctctccacgaaccgagctgcacctcctcccctgaccgcgccacccaaaccttaggccacaccggctgcgccgccacccgcggctcgtctcctcgctaagccgcgctgtagcaaccggctgccgcctgctcaacattttaaggagggggaagggcaggggcgcaaatggcgggggtagagaggtggcgcaccgcgctaggaggcggcggcggcaccttagcctagtcgccttctctcctctcgctcgctcgtgagtgcgtgttgttggtccagagagtgagatgcgtggatatgtggtttggttcaaccacaaccaggggcaaaactgttcgagaaataattgttttgatgaaaaatgttttgcaaatacaacaaacaaccaaaatagtatagtagcgaatgcgcactgcttgagagtggcattcgagtaaaacctattttaacgatggtattctagcgaagtcggttcttaaggatcacccatatacaaaattctctagtggcagtcgaatacagtttgggcgtttcctgattcagtcgtcatgtaatggcattatggcagctacaccccttttcatgttcggatcggcgtagaaatagattcaattttcgctggagttccgatcagcgtggagacgaaccggaatctgatgcagttcttgctcgcgtcggcgtggaggttggatccataaataccggaaggtcagattgtttgcaagcctaatattcccttgccgatttatagaagaacaagtattctgaacaagtattaatggaaacggccgcaggagcaggccctggttggcctgagctgccgatggacatgttgttggagattctgcggctgctcgagtgcccagatgtgatgcgctgtgccgccgtttgcacggcttggcgcgcggcgtaccgcgacttgcgtcgccgtggcattgcagccagccgccagaccccctgcttaatctatagatcggctgctgctggcctgaacgccattggcatgtacagcctttctgaccagaggccctacacgatccccatccctgaccccatcagcgagcagcactggttcggctcctccaacggttggctgataacagctgactgccggtctgacatcatactgctcaaccccatcaccggccgccggatcgctcttcctccggcgaccaccatgcagcatgtcacgctggtcctgaacgaggagggattcttgacaagtacgaggtctccttctacgattggagggatccaagcaaagagcacagcgagcccgacacatactccctggaagaataccgtcgctatatgtacactaagttagtgttgtcttcagatccgtcttcagatgatgactgcatcgccatgctcatccatcagccatatgatcagctctcttttgccaaggtcggaggcaatagttggaattggctcgcagtcgattatactttcgttgactgtatctaccatgacggatggttctacgcggtaacttccatgggagtaattcatgccttcaatcttcatgggccttccgttgtgcacaaaacaatctttccgaggatccaagacaataatatgcaccaggaatacatcgttcaggctccatgggggggccttcttcggatctacagaacagtagacatccttgaaaaagagcaacgacacaaccaagtagttcgtacattggggttcagagtgtacagggtcagtttggatgagcagaagcttgtgaggatgacaggaattggtgaacacgctctctttgttgggcacaatgcttcggtttgcctttctgttaaggaccatcccactttgatgccgaatcatgtttacttcactgatgacgattttgaaacagttttttctttcaaaagttctcgtcgtgatgtaggagtgtgcaacatagagaataacactgtcacaaaagtggtatatcctgaactttggatatattcactgcctcccatttggtttactcctagtctcataggataagtgtgcattcagttatcttaataaatacagatgtttaccaagctttcattgatatagtctctataaaccaccctttcttatgatttcacattttgttattcgaattgttattatcagtgtgacagtgttatcaacggtgttataaactaccttttgattactaactccgctcatcttagttttctaatgtaatacaaacccatctgtaataggtttgtcactaacttctccagctttgctgtgcattttttatgccagcatgcttttccagctattttggtatgtgtgaattacttcggttaatttatctatggttgtgactccgtcatgtttgatgaacccaaaagagttttgttaataactattgaaaattacatggatcattctaatttttgcctagtatgttagttgcaagatatgcttcatgagatcccagtcatagttattaattgttctgaaagaagctctcacatattaaaagatgatgacattattttcttttctgaagacaagcctcttgttttaggaaaaaatatgaattatccctccaaactatcacggtcgatcgaattacctccatgaactcgacagcgtggcaaaaaaatattttacaaaataatggacccacatgtaagtctctatatctcctctctttctcttctactccctctgtttcacaatgtaagtcattctagcatttcccatattcatattgatgtcaatgaatatatatatatatatatatatatatagattcattaatatcaatatgaatgtgggaaatgctagaataacttatattgtgaaacggaggaagtacctccatctctacctacacagggcggcggcggagagtggaaaccttgtcgccgtccgccctgacatcgtcaggggaggcgtcgactgctcgctagtgaccgccgaacttccaggtccatgacaaccacatgtccatgtcgtgggaccacatcaaggcgtcccagctcgccggcttcgacgtcgtggtcaacaccttcaccgcgctatagaaacgctacggcgacaagttcagccatgtcgatgcgcgccttgcctacttcatcggcctcgttagccagccatcgcacgttgcagccgtgcaccgcagcaacgagggtggagatggagacgttgagaaaaactgcctccacagcgctaccgcgcaggcccaagcatcatacggcggaggtgtttatctccaccgtgcaagtgaagtcattgtcggagaagagggaggagaacccacccgcgacctggacagggaagcggtccctgccatggcatgcgcacgcgcgtggtacgctgcgacgttgccgctcctgacggctagctcagaaagctgatccgggccgttgtacacccgcctgagctgacctggcgcggcggacggccagcagaaaagcgcgagtgccccaacttgcaacgcgtcgatgaacgcccctcccccgctagacacctgggagaacctcacgaacggcgcgaagcgacagcggcagcagaggagttggttgcgagggcgcagtacacggtggagatcccctccgtgacggtgtaggccgtggggctggcagcgacgacaagtgtggaggatgaggcgtgggcgatgaggtggagcggcgcaaggaggagacaggtcattggatgaggtgggcggcgacggcgatggtagggaggctggtggagacgaggcgtcagcggcaaggagatcgatgggggccgggcgacgagtcctttagatccgccctccgtgccctcgcctcgcacgtcgcccaccgccgtggccttccgcccacctctcccgccgtcgacggcgtcctctacttcaccagtgcccatgtgacgaggtcggggaagaggggaaagagagaggcgagagagtctcatgggtaggccccactatgttttttaaagaaaaatgctgaccgaattgccagcgtacgccgtgtaggacaaaactactccggattgggttgagggggcttattcgtccggtacagactgttcagggtttaaaatgtctggttttatggtttaaggggtaattcggactgatatgatagtttatggggtaattcatactttttcccttgttttattacttcttatgcagctttgcgcacatgtgaaagcattgtgattttcgtcacgcctttaacttgcacttccagtacattcttgttccattgtgttcagtcaatacctcactcagcatatggcagcatgcaggatatgcataattattcaactaaacttcagagacatctcaaattttacaacatgttttcagcatgattttgaagaccataaactaatctcccccattattttggtcctgaaaacctatcaggaagaaagatgtaagcaacaaattattaactaaaaaagatttacgatgtcacaggtaagaaatcagtaagtagagttgagaaatgtgagatacactataactggttaagggcatctcagggaacgaaattgataatacaaacaaaagctttataggtcaggtgaactccataactggttgcatcatggacatgcatatgtagttaaaagagttgcagatttagaatcaactgttatgtattcataatgaaatggggctagaaaaggcgaactctgaagaaacttgacaaaattacaaagaaaacaagaaagaggctggagtagttcaatatgcaaaagctaaaggatgaaccgtgtttacttatagatctggctggatactccgtccattaagatggtaggttctaacagtactctctcttattcatatataccagcataaatggaagtaatagatgactaaatgttttacatttcctaattcccatgcttaaagtaattgattaacttgcattccgaactgtacctgttttcatgagattgggcatcatccatataggaggcaaccaacttttccaaggttcagggctaaccacatttgatagagagttattttccaagctgtaaattccaacatcccgtcgcttatgtctaaactcaagtagccatagatactcatcgtcggtaatatagacatgatttggcatcaacatatggcaatccttcacaggaaggcaggaggaagtattatgcccaataaacagcgcataatcacctatgcctgtcagtttgacaagcttctgttcaccaatatcagccttgtatactacaatgtcagatgtatatagctctgtttcttctatttcaggattcccattgcgcggaattattgtcatcctgtttactattaggatatcgccccatggagattgaactatatacatctgttcataccctagtgttagcatatctttaagaattcttttgtgtacgacagatggcccattcagattgaaggcatccactgctcctaaaacactgacggtgtaaaaccatcccttatgatagatgcaatcagtataaaacaaaccaataggaatccaattccaatgatcttctcctactcttgcaaacgagagctgtgaatacggttgatggatgagcatgacaatgcagtcacctgaagatggattggacgacaacattgccttgtaatagacttcacgatactcaggcaaatcaaattcatatggtgtttcctccactcttggaatcttgccattatagtatggcatctcatacttgtcgagaaccccatcttgattgaatataggcttgatatgctccatggtcgtcaccggcggcaatgcaatctgttcgccagtgattggattaagaaggatcagattagacttatcatcagcagtgacaatctagccatgagatgagccgatccaggtccggttgctgatgggagggtcagggagcgggattgtgtactccctccgctccaagagac

SEQ ID NO: 65571 - DNA, 13234 bp, Oryza sativa
cccctcggtgagaatcggtctccctctcttcctctctctccctttgctgcgccgcccgccgtgtagcgccgccgctagggtcgctcgcgccgccgcttcggccgccgccgcggtctttgcgccgtccgccgccgcctcccgtcgccggttgccgtcgctggcaaccgtgcgcgcgcgccgccgccctcgccataaccggccggccggcttgaagccgagccgagccaccagccgcgcccctcccgccttgtgccactgcccggtgggccccgcctgccagtacccctccctctccccttgtgccgctgaccagtggggcccgcatgtcggcgccgccccaccccttgctgacgtcagccctgggatgaattattgcgcaataaattgattaagggtttttctttattagtaaaaacacagataatcttctaaaaatcataactaattcatccgagctccgattaaatccattcaagtctcagtaaattcataaaaatgtgtagaatccattaaaaatggttttgttctctgtttcagtagtcttatagcatgttttgcttgtgtgctttgtttgtcgcgtagatttcggccgtttcgtcgattcgtggtttctcgaagacgttgctgtgggtccatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccattgataacttgggtattaaaatgactagaggttggtttaggagatgcttagccatgcttagttcaactagtacacaaaaggggccacattaaagcatagactttgattattggcaatagctttggattagtgccaccgcaatggtgttggttaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagagggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactggttagttcaggtggtggtttgggcctgttgcaacgtggtgtaacgttggacagtgattggttaatatggattaattactataactgttttactgctttcaactactgcttgaaatgccggctttatgcaaaagaacctttagcatcccttggatatatcttgcatcatacctcctcttccggtgtgacttgctgagtacagtgggtagtactcagtcttgctctcttttccccctcaccagagttgaagttcttcccagttggagatgtcttgaagaggttggtttcgtcgctgccgtcaagggttgcctgtggaatggagtcgcccgctgcaggagtcaagtcttcaggcttagctcgctttaccttttccgctgcatttgtaatcttttatatttttgtaagacgtggatctgtatgtcaacaattgtcgtttgtgtaccctggctggtcctggacaggggtttaatacacattcagcttagaaattctggttcgtgaatttctgggcgtgacaccggcccaagccgccgccccgcccccccacctctctagccgccgacatgtggggtccacatgtcggggcctttccctacctccagccggccggccgagccgagtccgagcgccgctgcctttccgccaaattcgcctcacccggtcgcccccgagtccgattgcttgagggtaaatcatctcctccttatcctctccctttcccctaaagtctcggaggccaattttgctcggataaaccaaatcgagttcgttttgagtttatccatccaaactaactttagatttttccggcttcgattcctctcggttggagtccgatctctctaatccgagcctataaatagcatcccctaatcgtcctcttccgtttgccccaagtcccgagctccctcgttgcccgtagcgccgccgccgctttgccctagccgccgccgccgccggcgaccgtccagccgcgccgcgccgctgcggtagccgtcgccgttgccgtccgtcgccgccgtcgggtgcgcacggaggtgaggaacctcggccgcccctttgccgccatcgccagccgccggagagctgccgccgccgccgacccgagccgagtagccgtcggagctcgtcgccggtcgccgttcgtcatcgtccgtcgtgttttcttgtaccggtgagttcgcgtcgtcgttccctacgtctagatgtccttagattgcccggccgacccctctagagccggtggtcgcgtcgcccgcgccatggccggtgatgatgacgtcatcatgacgtcataaatccctttttcttagtttctttattagatgaaaatcgattaaacttcggaaattcataactaaatcatcgtaactcggattcgagtggttcaagtcgctaaatttttctaaaatcaagatctacatgttaaaaatatccacatgtactgtttatgcttgttttttactgttttgttgattttgttcttttgctttagtttccgacgttccggaggagagcgttttcgttgaggaaggttcggaagcgtttgcggaagctcaaggcaagtcacacagatcccaaagaaccttttgagcatgttgaacccgtttaaagctaatgttttatttcaacttatgcattattttcgaatgtcatcgggtggtgagcctttcccaattaattatggccaaagatgactttattttcctatgggttataatttgattagcttggaccttatatattggattggttcagctaaatgctatatatatatatatatatataattgcttagccctgcttagaaacattagctcattaatgggatgaattatattacattgttaattatggttatatttaatggtagctcacgatggttaatcgtgtatgataattaattgataattaaaacctgattaaaggtgggttgtgagcatatggtttcgatggttgtgctcatgacaattaaggaccggttcgcgagctactattgtgaaacatttaccgtgccaaccacaagccagcgtgggcaacggctttactttttgtatagcatgattcattacggagtgccagactgtgaagcgacgagaagtccgtgggggtcgctggggagtccattgcctctggttttgagggggagattatgatctaggaacggagcactgtggtgagttatgttgtgtaaagggtattgtcacagttcctttccgaggtaccgtggtggtattgaggcgcatggtgacatgttgtggagctgtgtcttgtgggtacagtggtacatctctgatcagagtaaaactattcgaatagccgtgcccgcggttatgggtgagtttaacaatgtttttcgtgattagtctcacaccactcattaatgataatattgtgttaattaatttgactcctggtttggaatggtatattccaggtatggaggtttgatttgtacaaccgggggttgattgtgcagatgaggttgggcctatgcaacacaggtgtgttgtatagtgtttatttaatactgattaattattcaattgttttattattctctaaaatgtttattgtttatgcaaatgagctttactatgccatcctttgttatcctgtgcacttgcatatttgctgtgtggcttgttgagtatgtcatatgctcattcttgcaatattcattcatcagaggaggggtatttcagtgaaggtgatgatctggaggactaggctttgtccgggttaagttgcttttggagtggagtcgctatagctgttccgtattcgttttattttcgctacgtagaattttattctttgagaggaactatccacctctgtaataatttactattttgcgaatattaattagctgtttaagagtactctattatcaattcgttattgtgtgcctcggctgattcctggacgaggatttaacacacatgtaagcgtttggaattttggatagaaattccgggcgtgacatggggccacgtgctgatgtggcaaaggcgtgtgatccaatacgacaatacatatatggagacttcaataagcatcatgaacctgctagtatacgctatgcaatcgcatatgcagatgagctaactttacaaaatgagataagttatcgattccatctattctaatttttaagtaatagcgagattaacaagctagatcatgtctctaattgtttttaatttggaaaaagtacgaattaccccctgaacaattgcggtcgaccgaattaccccctgaaccacaaaaccggacattcttcaccccgaactttgcaaaccggacaaataacccctggctcaatccgcggtggttttaatcctacgtggcagtccagtcagcaatttttctaattaaaaaatggtgggccccacctgttagttctcacccctctctgtctcttttccattcactttctctctctctcttctcatcttctcagatgaacgacggcggaggcagctggcgacggaggggagccgaggactccgacagctacggcggtcccagctaggggtgtcggagccgaggatagcgacgcgcctctgccttcgctgcgggccgaacgagccaagcgaccttcgcctctgccaccggcgcccgaccgagatccgcctcgtcggcgctcgtgcgacctctggctctaacgctgctgccagcgcccgagcgagcccgacctccgccgccgctgccagcgccctagcgagttctgcctgcccccaccctcacccgtcgccatccgtgaggtggtgttcgtcggagatgcggcggccgttcacgacgctggagggggagagtcgcgggaggacctccaccgccggtcgcggagaagaaggaagaaggagggtcgcgagggagctcaagacgtggtgggttcgtcgattgaccgcggaaacgaaggcgatgcggtcaaggatgagcggcacaccagtggttgcgagcctcctcgcggcggacgtggaggcagggaagatggtcgaagagccttcgtgtcctcctcctcctccgtctccggtgcacgtgacaacagcacggcgacgacacacaccaccatgttgaggatgacgaatcacgccgcggttgatcccagcatcacccatgccggcagcggccaccaccaccaccatcgcggagtgggcggtggctggcgccagtggagggcacgacggatgttggcacggctcctcgtgtgcaactggtgctccctccgccggcgccagaacatagctctggtcgtcgtcctccacgaactcgcccgctgccacattgctatcctctccccctggatgggcctcgctgccggcactatctgctctgctcaccacgagaggcagagaaggggagagagaaaaaaagcagcagtggcaagtggggcccaccgattttatttgtttttgctgactgtatcgccacatgtgtgccacgtaagcttgaaactgctccagatcaagctagggggggtaattagtctggttttaaaagtttggggtgtcaaatatctggtattgcagtttaggggggtaattcgtactttttccttttaatttcacacacgattagatgtattagtccagcatgttagcatgctcttcttgtgtttgttgttggcacgaagaccggcattatgccatcccagaacaatggttataggtgattactactagagaattgatctttttggtcggccgaaaaccataataaccgcggttctaaaatgaactgggactaaagatcatcgttagccccggttgaaatgctcataaccattttatgataccaaccaggactaaagatcatttttagtcccagttgaaaaagtgtccgccctcctaatctttttattcctggttggaaacaccaaccggattttcagtcccagttgaaaaagtgtccgccctcctaatatttttattcccggttggaaacaccaactgggactaaaaatcgacgcatatatagtatataattccttgcactaatcctctagcaaccacctcttcccttatcctcctcctctctttttcttatcctctccctttcctctctctattcttttcctctcaagcaagcacagcagagtgtgagcgagcgagtagggcggacttgcggtgatagagggaggcgcagcgggcagcggcgggtggccagcacaaggaggtaggaggcggcagcggcattgccggattgtttttgttctttctctttttttttttgagaatttatgattcattgcatggatctgagatatataatctgtgatgtatttgatttgtgtgtgatgtataatgtatttgcgatgttttttttttagaatctgtgatgtaatttttttagaacttgtgatgtatttagagatgatccttttgttctgtgatgatcgatttggggatttcacgatttggggatgtagtgaaggatttcacaatttgagaattatttggggatgtagtgaaatcaatattcaaagttgaaaacaatgaaaattcaaaaaccaactggacctagcttggctccatctttagtcccatttggtaacaccaaccgggacttaaaatggatttttaatcccggttattttaaccatctttagtcccagaattcgtagtcctagttgtataaccggtactacagggggttacaaaccggggttaaaaaccctttctccagcagtggattgtgtcgcatatagtgcctccgcctgaatggagacacgttgtcgacactgccctgaacggcgacatcactacctcggtacttacgagacgccactcaaagaatgatcgacatatacctggcctaaagcggttgcagactccgaacgaatcagctcgcacaccctccaccgcacgatatggtcaacgctagcatgaccatgacttgccaagcacatcattttcctaaagtcgatgttgatgagatcgagaacatgacgcctgtatgcgccagagactccttgctgccgcctccacacattggcacctcgatgatgccacacacattgtttacgtgacccactggatttccattgttggtctgccatctgaaacgccaaacgatgggtccttcgtgatcacccgctcttgcaatcgacagctgcagcctggagtgacgacgtggagctcacgccagcctaccctcgctgttggtacgcccgacatgcctcctacgcaactgcacgcggccgggacgcaggtcaaagccgccgtgagcacccgccgccgacccgtatggcaatccgagtttctttggcacgtagcatggagctacaaactgccggacaccgatcatggactgatgccaacgaatgccaatatcggtgttgcccgatgtcgcaccgccactccacctttgacctcaacaccttgtctttgttgtccgtctccgctggtaggttgcttacatgcttgccattggttctatccttcgcctctaccaaaaaaacggaattggagcggatcttgctctccatttgtggaacaagaccgtaatggctcatcgagcgagcacataagatgggccaactggtttttcaatctggtaagtataaggaggtgggctacgaatcttaatttgtcctcacattggcaaatggcatgaagatctacctcagtgccggggtacaggaacgtaccttggaagttggccacgaattggtggcaatggtcctcctatgagtacagagagccctcaggtaggtttgtcttccaggatcaagcctgggccttgaggatgatggggaaatagtttgccatcatattatcatcgcctttgtctgcctggatcgcaatggtgtagatctggaggaactccactaggttgacaaagacatcatatttctctgttaagctcggtaggaacttggcataccactgcacttgatagaggcccaaagagagagcatgacacccagaaccataagggcgacctcccaagggcacctcagcgagccctcgatattcctccttaggacaattcgtgcctgaggacgactagacctcctcgcgtcgtacattgttctcacgcctctcgcgctggtcctcgaggttgacaggggcatccttgtgcagccacagttcgttggggcaagcacaaatatacccatgctcgttccactctcggggcaaaccgcctcgtacaatgccctgatgaggggccggacgagccgcatgcgatcgcgatgagctcagggcagcgtgagacatggacccaaagcgagaagcgaggcctgcggccactgcctggaggtgggtagcacccatcaagtcggtaatcttcttgagccaacagcgctcgggagcaccactgtcagcttgacgttggggaaggcaaagcaacgcttctgtcatgaatagcgcagccttggtgtagtagagtcgaagttgagacaacgccacatcgtaagacagcgcgccttctctcgtcaaatggtcgaggccgccgcagaactagctcctaaacccccttggtgatagagggagtagaggttgcacgctttgcccgcctgtggtgaagatccgcccatcaagtgcaagcagtgcacctcgatggagattgtggagggtgcgatgtggtgtgaatggggtcgataaactcctccgctggcagttctgccactgcatgggagttgaagtcatctcgatggtgacccgccaagcgcgggaacacaaactcataaatgtgcacccctacctagatcgccagctgtcggcgtaggaaacccctatagcaggaaggcaaggtatccccactttgaagtttggccaaggtgttcaggccacttggaagtgtaataccctactccggtgtccttactatatgagatcaagtgtacaaagtggttttacagttgttctaagtattagatcatgaacacttcttcgatgtatgtggctagagcctaactcagtccagagcatgtgaactcaaacttttccaacccttttctcagtggcattggtcttccgtttaggtgctaaggaaataccacagcgcctatgcacgcacacaatggttggggcgagctaattggagttggtaaactggtcttgtcgatgtccttccaaacttgttagctggatgtgacaggctcaccaattggctaacatgtggatcagggtagacgaagtccttgttctagctatcaacggggccaccagtcggtctctaaagccaataaagagggggcccttgggtgtcagcagagtacgtgccacatcacccaccatttctctagggtgacatgggcaaacaaggggtgacatgaacagccacatcccccacatcgtccgtgacctgtccctagtaatcatatcacgccgcatttaacgtggattgaaagggtaaagcaacatacaggcctaagtaaaatagcctgaataaagcagattcgcccgttaagacctcatggcataacgtctatctcgaacccctagcccaaaaggagcaatagtcatagtctcgagcctgagctagctcagtcccgagctaacattgacgtcaagtcatcttcctcggcttcgaggtagcattcgcgactatttactattcttgctttaactatcatgggccccacagtgcaccaagaacctgataaagaggggaccatcattcccactttaccgacagtagccccctaccgcatcattgtgccatgttctgcctaagggaaacgaagaagactaagggggaattttggtgaaacaaattttgataatgcttggaaggggtatgtagtggcacgtctcaaattcctgtaaaatcataatggcatggttccaatttgaatgagggaatgtaatcttaacacatagttttatgcaaccagccctgtttcttaaacaaatattcttttaagggacaatttgaaccatgccacataaattgttttaaagcagaaattataactttaggctatactaggaactatctccatagagatatgaaagcatagcctaaaatttcagttacagcttctaggataagaacacatacatttgtattttatccgatcatcttagctatgattacggtattgaattgatgccttatctatacacaccttaaattgattccaaaattgtgctggcaccaatgctataaaaacccatgtgttgccaagtaagcatcttcatcaaacatcaatattacccaccagtcatctagtatttgatgtttgtaaggaaaaagatgaagaccaatcaccttgcactgattgcaatttccctcctggtgctatgtttaggtatttgagtacttctcagacataaggaagcaaacttccgtgcttacattgtctttacgatatctatttaatttgttatgtaagagaatttcatacctccaacacatactaaacccgtatattttccatctacatgtccagacatatcagggaaggtttcagctactgaagagtgtcatgctgcaccaatcacagaagtaccaaaaccttgcgttgatgcaacctgcaaagcgatatgctcagataagtaccaaagcaaaggcgagtgcttcagtactgatgggctttgttactgcaacttttgtgcgaatagccctccacttccacaaattgggctgaattgaagtactgagtctcgttaacacaaaatggtgtgatgtgcagctcattccaagtgcttaatcaataattacagaagatttgtaatttgtcttatcagcggaactgtttgaggcatatataagggtgataattggttgcagttcattttcttcgatttcattgggaccagaaatgcacctatgtgttctgactattgccagatgaataaactacaatatctaaattgtatgattcagaaaattcttactactgcttctaaaaaaacacatgcatcactattctaggtcaataaaaaacatacacattggaattttaagacactgccgtcgttggcttgtcaacgtataagccatcgccaagcttaattttagtgttgattttgagttttgcatcatagttaattcagtattggtttttaaatagctaaggacacatataaaaagttttactcgtaatttttttgtcgttcataagccattatggcttataatcagcttatgccaaactaagtatggcacacattggggaggtatgtatggacatatataatgaccaagttgcggaagaacaacttcactcaacaagatctaaaacttagaatatatgattttatatattgctatgaagttagtttgataatcgatttatgacagacctccatctcaagaacatgtcccgagctgagtataggtatttcttaacgacattaataaaaataataatcctagcaatggcgctggaaatggtcctggtatatggtttactgaagcaatccgcaagcgcacagaaatagcattctagcatttcacctgggagtattccaaggtttcgtatttatttaatcccaagagaagattgtaagagagaactatgctaataatttatacatgccacttgtataatcaaagtctgtgcagggttaagatatttatatcggtagcgtgacacgaagcacatcactcatgtatctcatttaatcattcctaaactaagtggaagaagaaatagaaaaacaatcaattcctataattctaatatacactaaactttagtctacatctgctagtatacaaccatatagccaataccccctaacagttccatcctggtgcatcgagatattgggaaaattgatctctcggtttgaaaaaccgggaggagatcatgcttcgaatgcagatcattgcttagattgttttaagggaacattcactaagaaaattaagaaatgggctaataggagcatgtgtccattagaataatccacacggatatatgtggaccattcccagtaacatctgttgatggatatgactcgttcattaccttcacagatgatttctcccgttatggatatgttttccccattaaagatatatctgaatcactcgataagtttaaaatattcaaagccgatgttgaaaatcagcataatgcaaaaattaaggtagtgagatcagatcgaggaggagaatattatgggagagatactccttatgggcaatgtcctggtccatttgtccaataccttcagatacatggaataattgcccaatattccatgcctggagaacaaaaaaaaatggagtggctgagcgtcgcaaccgtacacttatggatatggtacggagtatgcttagtcattctactttgtctatgaatattgttggtatttgatacggttacagataaaatccgcaagcgcacggatataccgatgtagcacttcccctatggagtattccaagggtatcgaatccaagggaacgtgtgtgatcagagcttcctccagttcatccaaggacaccaagcaaatgataggccaggatagagaggatttactagtcagaaacaatgcctaggaaaagcttaattttaatcctaacgcaatacttcaggcactggcatcccgttgttcccagatgtcgctctactacgtacccggacagggaggacttaagtgatctcgagggctgtcaccacctctacacccacctcaaacgtactatgggatatgcagcaattactggataataattatctaaacaccacctctaagcaactaatatctactttagtgtttataactcaccaaagtaatcacggatgcctccggttggggttcattagactgcgtcatgaaggaagtgttttccagaatgcgatcc

SEQ ID NO: 65572 - DNA, 1178 bp, Oryza sativa
aaagtgcgttggtatagagagagatgaggaggaggatttgggtaaggatgctcaccagaatgcggcggaagcatagggacaaccgacggcgccattactcgcgggagggatggatggggatcggcgcaggcagctgcgggcgtcggagtcggagccgacgccgagcggaacgggaaaaagaaacaccgcccgcactcgatttcctctattttttttttctttttttcgactactagagaaaaaaggttgataaaagagagcatatggtcaataaaagctgagtgagacagtattgtggaaaatctgaaaagcaaaatataacaaaaacaaaaaggcgtgtatgtgtgttggtatttctacagatagaagaatccataagtacatggatgtaccgatgtagcacttcctctacggagtattccaaggttatcgaatcatagggaacgtgtgtggtcaaatcttccttcggtttatcgaggacaccaagcagatgataggccaggatatagaggattttctagtgagaaacagactttaatcctaatgcaatacttcatgcactagcaacccgctgttcccagatgtcgctctactacgtacccggacagggaggacttgggtgatcttgaggcctgtcaccacctctatacctacctcaaacacatactgtgggatacgcagcaattactggataacaattgactaaacaccacgtctaaacaattaatatctactttaatgtttataactcaccaaaacaatcactatatttcagttgattatagtgaacaataatcccgtatgttacttaggaactaaccaagagataattctcacaagataaatctaaattactcaagaagaatattatattgaattcagagtaataatcagaataaaagaaataggagaagattaccgacaactctggaattcttctgacttcttctactctactctcttcctattctagtatacaatatagtacaatagagcctcttataattcatctcaagcttggaagtgtgtgagtgaagtgagggagtgatgtctttatatagaggtaggtatgacggttggcgaaggagaaatgtccaaagtgccctccaaccgtcattagggatgcatctggaacgtccacgccaaaccccacatccaacggtcgagatggtggttcg

SEQ ID NO: 65573 - DNA, 49795 bp, Oryza sativa
ggtattttgggctgcttctctgatgttttgatgaagtttataacccatccttgtatgtatacataattctcctcactttagtctagatttcctcccaacatcggggtttatcacctgcatacaaatatacaccaacacttatggaatttgtgagattaagcatctatcactatgttggatgttttattatctgaactttatgtagatgttggcggtatagaatcgacatttaacagttgccaacaatgtgaagattggaaaaatatatatatgaatttttaagtagatactccctcatgtattttatatacgtatggcctttcgtcttattaaaaaattaattattatttattttgttataaattgatttatcatcaaagattcttcaagcattactttatatatttattttagtttatatttgtttaaataatactatgggattaactatatatttatcgtcaatttttttttaaaaaaatgacagatataaatatagtacaatcgtgatgtaattacatataagttgtatgtaacttttaaaaatcccgaggtaatatgttgccaaatcccctaacacgtgcgtggggtgtacttttctgctacctccctggcatgaattttaaagcaaatagaacggttcaaaattatattatagttacatgctagttatagttacactagaatggtactatatttacagttgtcaaatttttaattatcgacaaatatatagtaaaatagtaagaggaatgattaaaatatgtctaaagttaatggcgtcgtatattaaaaaccggggagagtgtatttaaaaccatatataagaatatatagggataaggaagagatagatatttatcccaagttgacagatgaagctgtagataaacattactatatatcaaatattaattcacataaataaaggaaataaaaacaaaaaaaatattaactcaaggttatacgctgttccgatcaatataataatataatatggtggtttcaaaatatttctagatttgatcacttacattttgatcaaatttattctgctttagtatcatgttgctcactttgcatagtgccagtccatgtttttcttctaatttattagtttccgttttttccgtggagtatatttttttactttgccagagcctacagtaaaaataaaagaaacagaaaaattaatagaaaaataaaaagaataggaataggaaaggtcggtttccatgttttggaattcatctctgatccgctgaggaagtgtgcagggtttacgcctgcttttggtaatcgtcttgatcgttatgatcctttggagttaagactagggttttgtcgtacacctggtctctttcaatcttgggaagtctggaaatcaaagaggaagtttagtccgggtcggtttccttgggatgcaaaagggatatttccaatctcgtttgatctccgctataaagttgtggtattcggcaggccagtaatacaatacaaagttctccaaggttttcccctcctggttgcaatttagggtttctacctcataagctcaaaggacgatccatggcggttgctgacggtgggggtgataaagggattgtcactttgatgatcacccacccgaagctgatcggcggtgacgtgggtgtacctgtgggatcggtagatttgggggaacaagagtcgatgcaagcgtcggtggttaaaacagggcttgtgatggattctgataccggggtgtccatgggaccagagatttttacagaaggagaggtgcttgaagaggaggaagatgtgattgaggtggttctggaggaagatgaagttcagaaagcaggatagtggacagttctcgcaaggttccgaatcaggtggctttgttcgaggatatgcggagggcgtcgagattccattcggacatgagctacaagtcgctaagggataacatgtttatcataacctttactgtagaaggtgattatgagtttgtcatccaaggggggccatggatacacagaggagatgctcttctagtggccagttttgatggattaacaagcctatcgtctgttccactagagtttgtacctatttgggtcaggatttatgacttcccacttgtgctgatgacaaaagccagggtgaatcgtatggtagcaaactggggcgtgttcgtgaggtggatgttggtgacgatgggaggaataggcatgacatcttcagaataagggtggatcttttggttaagcgacctttaaagttgaagctggccataaaaatctctgtccaaggcaaggaggtaacacgaaagtttgatctccgttatgagagggttccacacttctgttttatctgtggtttcattggtcactcggataaagagtgtgtgaaacgtactgcaaatgaagatcacccttttcagttttatgcggaactgcgttactcccctctaaaaccttttgagaggaaggtgtgcaggtgttatgaaaatagatgcacaacggagacacagatttttacgtggaaaacccttgcgtgaaaaaactacgggcgccgaccggcaatgatcactatagaggagttgattataaacgtaggggaataacaatgggaacgtcaccccttcccgtacggtttacaagagtatatataggagataatagaaagacacctaataggatagacatgaagtcctagtaggaaattcatccgaatatattgtgggcccaaaattcagatcaaatatttaacaatctccaccttgagacgaattttctcttgtagcataaaaacatcaatcaccgaacatacctcatgtaggtaaaatcaccgcgcgtcaaatagtctctaggactatactgtaacaccaaccaagcttgagcaaagttcaaacttagtagcaggaattggctttgtcatcatatcagttggattatcattagtacttattttgcataccttgacatcaccttcagtaatcacacttcgaataaagtgatatctcatatcaatgtgctttgttctctcatggaaaatttgatcctttgtaaggcatgttgcactttaactatcacaaaatatatcaatgcaagacgtaactccacaaagctcggtgtacaaacctttaagccaaatagcttctttacaagcttcagaaatagccatatactctgcttcagtagtagataaggcaacagttgcttgcaaacttgccttctaactaacaacacatcccccaatagtgaaaacataacctgtgagcgatcttctcctatccaaatctctagcaaaatctgaatccacataatcaacaagtccatctctagatcttccaaactccaaacaagcactagatgtaccacgtaggtatatgaaaatacactgaacagctttccaatgctctttgtcaggattagccatgtatctactgacaacactcaatgtgtcgacgggggatacccgtagaccggatatagagggtattggggtccgttggtacgaggatctacgtagtacggcatcaagcaaacaaaagacaaggattatactggttcaggccctttggtaggtaatagccctaatccagttgatatgggattatatgatggaaaccacagattacaatgggaatagcagaactccatgataccgatgagaccgtagtcgagttggtccgactagatctcccggtgacttggctcccgcgggctccggctccataggctgtggtgggtgtgttggcggtgatattcgatgccttaggtcctgcccagggggtcccttatataccgcgggtcagttgatctccaagtagtactcggagatatcggacctctcacgatatggtaaagacctagtcttgtccgagtagaactccttccatccgtagataccatccctatcacgtgatagatttccttaatgtatacggaaactatccatatacgcgcgggtataccgtatcagtatacaacgtacatccaaggatagagggtataccatatccgtaaccctgacacaatgcatgtgataagtcaggacgagaacataccatggcatacataagtgaaccaaatgcaattgaatatggaaatctagacatgtactcaatatcataatctgactatggaaatctgaagataatctggaatgtgcagctcaaggagtactcactggttttgcatcatgcatattgaaacgacaaagaactttttcaatataacctttctgactaagatataacttgctagaatgtctttctctagtaatttccataccgagaattttcttcgctgcacccaaatccttcatctcaaattcactactcaattgtgccttcaactttgctatctctgatttgtcttttgcagcaatcaacatatcatcaacataaagaagcaaatatatagctgaaccatcaacaattttgagacaaacacagctatcataattggatcttctaaacttttgagaaagcatgaaagagtcaaatctcttataccactgtctaggtggctgcttcaacccataaagagatttcttcaacctacagactatgttctcttttccaggaacaacaaaaccttcaggttgctccatataaatgtcctcttctaactccccatgtaaaaatgtagtcttaacatccatttgctttagttcataatcatgcattgtaacaatattgagtaaagtgcgaattgaattatgcttcacaacaggggaaaagacatcattgaaatcaattcctgaaatctggctataacctttagcaactaacattgctttgtatcttgcctaatcacttggagatataccttcctttcttgtgaagatccacttgcaacagataggtttcttctcctttggcaacttcaccaattcccaagtatgattcttttcaagttatccatctattgtaatcatcagaaacaatagcctcagaatatgtagaatgttttgcattaccttcaatttattctgccacactcaaagtataagcaactatgttcacttctttaatataaacttacgaggagacacaaattaacatgctcagaatttcagatagaacattgagaggcattttgtagcattaatacaaaccacataatgctagcagtgaacatgtacaccgtggtgattttcatcatcacaaaatttagaagagccaccttacaatccgactggatgagtgtcaagcatgcaaggaatgtcaaaagcaagaaacattgtaggcatcaagatgtttgactccgtcagaagcacttagttggcagaggtgatcctatcaggattcaggacatacaccaaactgaacgaactatattttcttttgattaatatattttcaaacactcaatcaaactctgtagtacgttccagaaatatttggtttgcacttcttcatcatttaagcagcaaatgctacactacaaccaaaccaagtagtaccaaattaaacaacatttgctcacctggtgaggggggaaacgatgagctcgacattggggaggtagagatttggactgaggggaagcatcacctgtatgtagaagaggagttgccctggattggggagaccgtgcactggacggatggccggtggtgccctgaacggaggacggcgaggtgggcgatgatttgcggcggccccgagcggtggagacggcggagagagacccgagagacggcggaggcgagggatccgggtggagggcgcggtgatttgccggtgggtggggaggcggtgctcgttcctgacgcggaggggagggatgcagacgaggcgcagcgattgcggaagagagggagatgcgggagaggatgcggatcctgacgcactgtcgcgccgatgcggaggaggcgcggtgattgcggcgagagagacagagagaggggggctgtgggagaggatgaggagcgacatgcgcgcatccgggacgttggatccaaattcttccgatgagtttcgaccgttggatatgtgatatgatgaatgatgaatgagtaaaaccatttattcaactatagggtagatatattttccggttctcttgtctttgtcctgtagtttccaacactcagagatatcatgtccatctctcttgcaatatttgcatgacttatacctgcctctggactttgatctcccatgatagatacttgaacttttatctcttgatttgctgtttgtgttcttctcctgttgcctacgccaaacaaccaagccttctgcttgtgaatttgaatcttcagagggtaccatcttcttcatcttttctttggcatgcaaagcaccataaacttctttcaaagttagattatcacggctataaagaatagtatccctgaagtttgcatatgagctaggcaatgaacacaatagaataaggccaaaatcctcttcatcatactttacctccatagactcaaggtcagcaacaatttccttgaatgtggagagatggtccatcacagacccatcatcttgcgacttgtgcaaaaataatttttgcttcaggtgcatcttactggtcagatccttagtcatgcatatctattctagcttcaaccacagcctagcggctgtcttctccttaagcacctcctgcaaaatattgttagatagatgaagatgaatatataacatagccttacgatcccttttcttcttatcatcagaccaatcctgtgtccttttgttatatccagaaagcgcatcatcgaggtcttgttgtgcaagaatggctcgcatcttcacttgccaaagtgagaatcttgtgtcttggtccagaagtggtagatcatatttcaaactcaccatgagaattaatcctgaatttactggtaagaaatttaggtaaaccttgcaaaaacgtgaacctctggtgcactttccgtgtgcacgtagcgaagtatgtagatcaactaggtacacaagcttggtagccatagaaattttcctctggaaaaatcaagctctcggttgatttgtttttttcacctcaggaaccatgcgctggtagagatggccttcttctgctgctgctttaaccctgcgctgcttctgtccgactccgatggcaatttcgacgagaccgacgaacgatatgcgccgccgccaccgcgaatcaaattgatctcccctattggaaaaacatgccggtgactgggattagcagattgatctccaatgctctgataccacttgttataaaaatagatgcacaacggagacatgaatttttatgtggaaaacccttgcgggaaaaaaccatgggcgccgactggcaatgatcactatagaagagttgattacaaacgtaggggaataacaataggaacgtcaccccttctcgtacggcttacaagagtatattaggagataatagaaagacacctaataggatagacatggagtcctactaggaaattaatctgaatatattgtgggcccgaaattcggatcacatatttaacagcagggtcaaggctaccccatctgaagggcccgtaacttgttcttttgggggagctgggagcgctagttcttcgtcttcaaggaggaagcaaggagatcatggggctaaggagatcccggctagagtggatgctcatgatggttttgatgtaagagaaagtgcaggagataagaagatagatgaacaattggctaaacatactcagaacctcaaggtagatacaaagcagaagcaaccgagttcgacacatggggaggaacctgtacttcagggtgaaggggttgtgaaatcaactactgctatatcggaatctgagatgattccaactataaagaacattgaccagcaggtttcctctggcgatgggtcatcagaggatatgattagggataaccgtaaaagaagtcaagtgcaaggggtgcgcagaaggctggccgtgtcaagcaagcgctgctagagtatcagcaaacggtggagagtggtggcaactcctctttagaaccggtgagcgcttctcgggctttgaagcggatcaggaaatcggttgaggggacaggtaggagtgatatggaggcaaccagccctggggctgctggtcaactgacgggacctgtgagagggtttcgtcaggagcaatgagttgcctagtttggaactgtcgtggtatagggaacgctacaatagttcgtgatctttgtgccttggtgaaagaggcgggttcccacattgtgtccttaagagaaactagacaaaaagtggaaaaggttagatgtttgcgttcaagattgggacttaaaggttttgtgggtgtcaatagtgaggggatgagtggggggcttgctttgttttggcataagtcagtttgtatggaagttaatgttttgaacgaaaggtttattgatgcttatgtgcgattggtcagtgatggtccggtgtggcatgtaacttttgtatatggtgaaccgagagtggaacatagacattgcatgtgggatttgttgaaggcaattaaacaatcatctcctctgccatggttagttttgggagattttaatgtggcactctggcaatttgagcacttttctgctaagaggaggggtgaatctcatatgcaagcgtttcaggatgttttgcaaacttgtcaattgtttgaccatggtttttcaagagttccctttacttatgataatagaagagaaggacgtagtaatgttcgggtgcgccttgatcgtgccctggctgatgagagctggagggacatctttagcgattcccaggttgttcacttgacatcaccgtgttcagaccgtaaccccatattgttaaggttctcctcggaacaagacaaggcctaccggaagaagtgcttgcattatgagatttgctaggaacgagaagctacatcagaggaaataatcaaggagtcttgggacgacacaggccaaaaattacatccaggtgatattaacgttactctgtctaaggtcatggggacccttcggacatggagtaaggtgaagtttaagaatgttggaaaggaacttgaaaaaacaaggaagcaacttgcagggttgatagagaggaatgcagacaggaaggaaattagacaagctactgatcgtatgaatgaattgttatatagagaagagatgctgtggttgcaaagatcctgaattaattggttaaaggaaggagaccgtaatacaaatttcttcaatagtagaatggtctggagggctaagaagaatagaatcacaaaaatccgagttaatgatggtactgtttacagtacgacaaaagaaatggagcaacttgctacagaatatttaaaaacatctatactgcagacccgtctttggaccattccagggtttcacggttatttcaacagaaggttacttctgaaatgaatgtagcgttgtgtaaagattttactgaggatgaaatatcagatgtgctatttcagattggccctttgaaggctcctggaccggatggttccctataagattctatcggagaaactgggcacatatcaaggctgatgtggtgaatgctgtgaaggagttgtttcaatcgggacatatgccggaggggatcaatgagacttctattgttctaataccaacggtaaatcaaccagtcgacttgaaagatttcaggccaattagtttgtgtaatgttatctacaaaattgtttcaaaatgcttggtgaacagacttaggccgattctggatgagttgatttcagtgaatcaaagcgcctttgtgccgggacggatgatcacgaacaatgcacttcttgccttcgaatgctttcaccgcatccagaagaatagacaacctaataaggcaacatgcgcttacaagctggatctatcgaaagcttatgatcgtgtagattggaagttcttggagcaggcaatgtacaagttgtgttttgctcaccggtgggtaagttggattatgacgtgtatatccacggtgaggtttgcagtcaaatttcatggaacccttctgaacacatttgctccaactcgagggttgcggcaaggagatccgttgtcaccctttctcttccttttcttttcatggttgataggttgtctttactgatggatgaaaaaatttatcaaggagcgatcactccggtgaaggtctgccggagtgcgccaggcatttcacatctgctttttgcagacgacacaattctgtttttccaagcagagaatggacaagcaaagattataaaggaggtgctagctaactatgctacaggaactggataactcattaatccggctaagtgctctattatgtttggtgattcttgccctttagattgccaagaggctatcataacaaccctgcaaattgggagaaggggttttgaggataaatatttggggtttcttacacctgaaggaagaatgcacaaagggaaattttaaagtttgcaagagaaaatctggaagaggattatgttgtggggagagaacttcttgtccagcggtaggaaggaaatcatgcttaaaaatgccattcaagcaattccagtgtatgtgatgagtctcttcaagctgcctgcttctgtttgtgatgatcttaacaaaatttcacgtaattgttcgtggggagtcgataaagggaaaaggagaacccattagaaattttggaatcatgtcacgagacccaaacaatctggtggtttaggcttaaaggattttagattgttcaattaggctctattagctagacaggcttggcgactgatagactgtctagacagcttatgtgtgagagtgttaaaagcaaagtatctccttaatagatacaagcttcggtggtaatgtttcgccagggtggagatcaataattcatggtttggagttgcttaagaaaggaattgtctggcgagtcggtgatgggcgttcaatccgtatctagcgagattcgtggttaccgcagaatcacacacgaagtcatataatagtgaaaaggaactacagagagagatggatgttcggatttgatttccgaaacagggacctaggatgagcaactagtgaatcataccattctaccagttgatgctgaattgatcctgaaaatctggttgtcatctcgtactgaaaaggattttttggcctggcatccagataaatgaggcatcttctcggtgagaagtgcttatagcctagctctgttgttggcaagcgaggagtgtagctctagctcttcggaagtgagtgttaacaaagtgtggaaccaaatctggagctgcaatgttcctcaaaaggtcaaaatattttatgaagagcagccactaattgtttctaaagagacggtaagcaacactgcataaagctaaatggtatgcaatttatgctcaattccctcatatggttttattgtttctctacgatggtggaaagattgatggccaagctcaactccctcatttattgtttctttatgatggtggaaagattgatggccagtgaagggccaggctaggagtggtaagtttttgtgagatacatgaccatttaatgttgttcaatgtttgttatctttaaactctgatgtgaatgaagacatactcaagagcattaccttatctctctctatagttttttattatgatttttttataaataattatagcaattaacattgttttttcgttatttatatcatcttttctatactaagtcattttaatatttttctaatttaaatttctgtaacattaaccgatttcaaagaaaaatacattcatatccacaataacaaacaaaatgttatactcatatgataaatttgaagtcatgtaacataacataagacatatgctctcgtatgtactaaaaccacatctcatttgagagcaatgtttatagtgcattatgttcattagattcataacaaatgtctattttatgactttatgtagcattgaatattatcaacctgaggccaacaatggaagaaaatttggaggacaaagatgcatcaatttgccagcctgtgctaggttcatctgcatctgatgggtgtatttccatctcaggtaatgctggaaattaggattacttctctattactacctggaaattaggattacttctctatccaaaacattgaagtcgtctgactccggaacttatttaatttttcataccctttttttgcgccttgcatgctttctataagctgatgatatttctatgtactgctttttatttaaacagttcagaaaaaaagtgggcgaaatatttatttagtttataccatgctaaatggttcttcaaacagttcacagcaaaaatgctcagcacactctaccatgtgcatataccatgatttgttttttttccgtgtacatgttccaccaattccgtaaattgggcaacctatgctacttagatagatcttaataaatcccttggtttgaatgcctacttttttttttgtttctcacgtgccatgcatggatgcgaaatgtgcagatggttttgctgccggctgataaaccattgcagcattaggagaggctatctactatcaaatctgcataacatatatagtacatgctaaactgctcatgggccaacgatgactcatatatatatttgacggaagtttacatgaagatttgaaaattttctttcccattcatttttcaaagcttaggcactcatgaggtgcggctttagctttggactgcgcaatatggagcccagtctatttggagaatgagcttgggccaccttatttgagaacttttagggtataatatattaccagtatatactggcagtatataaaagggcatattagaaatttgatagaaaataaaacaacaaatttttggttcaaattgaatctaattgagagtacccggtcctggatcttattgtgcactaggggaggagcatcctgagcgctatttgatgacaaagcacgtgacgatagcacaatttgatgatagaataacgaagaaaagacaaaattaccctttcaaactttatactgcaatctaattaaataaaaaattaaatcaatctacaccgttagatcatatatacttgcagtatatactatgagtatattgtaccctaaaaatcctcccttatttaggccagctcttttgtctacctgaggcaaattaaatgtgttttggctaatttttggttccggatggtatttgcatctcgtcagtgattgtgatgatactgaccaaaatgtattcgccaagagattaattgtagtgcaatgttttacgttatacgagttgttcaatcaaaatgagtcctatgaacactactgatatacttcctccattccaaaatgttttaaaaaaagaaatagagggagtattaggctctcgaaaggctctcattttgttgaatcgttgttcgtcgtagatagtactcctatataacaacttatgtggtactgttctgaataaaaatgtgcttctggtgatgtttcatttggactttggacttttctcaatcttaaggttggactttaggaagttgaggcccaagacatattttcagtcttcagtttggactatctagagctggccagcagcggtcagagaaattcctgttcatgcctgccaaccagttatcgttatttttctgaacacgatcagtcagctccataattaagcacatcgtcctcgtcgttttgcataattttttttcaaaaagattagtacttggtcaattatgtcatcttatattctatatagtagcggcaggcataatgcttcatctgatctgacaaaggcagccatgctgacaaaggccatctgatctagagatcgcagcggccatggacccatcacccatggttacagttcgcctccttttgcgatcattgattcttctgttctcaggaaggaattctttattttcctataagactttatttgtttaatctcttgtctaaagatatttgagtgagatttgttgagaataatttcacgcagtgtgaaattaatccctcaacattttaatccctcttataagaaataaccgaacaagacataagtaaaagacataagtaagttaaggaataatggttgattccatttagagcctattcgttttggacgaatttcaacaaaaggaaatagaaaaagtggaggaatagaaatgcattcacgcttcaatccatacgaatttttccataaggtttgtggatgaaaaatttcctttgttttctcttgacaacttgtacgaaatgaaaattttcctgtggttttcttatatctacattcctatgaaccgaatgatattcataggaattaattcttagggatccaaatcctttgtaattcctccaaaatgaatagggcctaaagtagcatatgatcaaaacaccccccacctatacaagctctgtttacgaaggatatgaagctacgtctactctgttcgtgaaaggatgccttagctttgcccctcattcgtgaaaataattttcatcttttcgaaggccaacaaaaacaggggcaatgcaagtttctagtagcctcaattgatgtccgcaacggtgctagactgctagccatgtggagcggtggacctagaaactgcgttttgcatttcataggaacatgcggataaatttaggaatgatagagctgagaccttgagtaatgacttggttttcacaggattatttatcaaaactttgtctagaaaatctaaaacatcaaagttccactacgatgctctttactgctagtagaaagcaatttgaaccattaatcctattccatcgaagggttcacatctatttatattaccaccttagtttacggtagtagaagtatgaagggtattattataaaaaaagtgcaaaaagctataatcgtcatttagcagtgactaaacattgtttttctttctttttttgattttttaggtggaatatgagtgatgccaatacaatggataaccacatatattgatctagccatgaaaaaaaatatgaataaccaaattacccctaatcactgtcttagtaaattactgatttaccctggataaccacgtatattgatctagccatgaaaaaaatatgaataaccaaattacccctaatcactgtcttagtaaattactgatttacccttaatagtgagcaattcagatcatttttactggtagtggtagtataatactagcaatagagagaaccagaagcatcgctcaacatcatctatttaagaacaaaatcaacattgtaaaacattataaaaaaaagaatggaagtagcagtttatttatgaacactgttataactactagtctaaatgaatatctacactgtttggggtagctgaaaaattgttagaaaaattgtagctataataaactccctcaaacatggctagaatatgtcggtacccacttagacaattccagacccaattaatgatttggcattctaattccatctcttttccggtgtcatttcccaccatatcgttgataataatctacgagaagcgcttgggcttaaccagtaaattttgagtttcgaaacgtgaccacctgtaatcctctccttcattcttcttccctcttctctgtctttatttttcacccatccccgtgtgcagccgcgcagcacaaagagcccacaatgcctattgggcgggtgccagcaaggggtggaactcagcgaagcgctgaggacttgatgaggacatcctctactattacccgttagcaaaaacacaaaagtcggacggcaaccgtgtgagcctctgaataatcccaccttacttagcttgggaggaggaagccaccttaaaagggagagcgacccttcctctattggactagtcttttagggagattgggcctttccccgagtgggtgtgtctaagaactgttggggtccgggcaaccttaatttgttaggcctcggccaaccccacctgggccggattgttatcatttggtatcagagcgcagttgtaggtaatttatcttcccataaccagaaaattgccacacaaaaaatatttattctttacctagacaatttgagccgttgcattgttctattagattttgctttattgaattctagattgcatcgtcatgttgagtgctggtttagttttagatttaatttttagttttgagtattgcatctgttcatcacttaggtctagtgttcatcactcgtgtcgagtgctggtttagttttagatttaatttttagttttgagtattgcatctgttcatcacttatgtctagggttcatcattcgtgtcgagtgctggtttagttttagatttattttttagttttgagtattgcttctgttcatcacttaggtgtagggttcatcactcaagtcggtgtgagttgtgcgtcagttttgggtccagtttttcatctcgtcgattgttgtcgggaccttgaaaaattaaatcgtcttgtcgttgggtttccgtttttgtggtttggagaagtttacatcgagtggttttggacttgttcagttgttagggtttcctgttgacttagccttaacatgattgccattggccgagaagagtattaagcgattgattttggagatgatagatcggtttagctgttgtagtgggactatcgtttggtcaaatcgatctgtacttatcccctataaaaaaaaggaacgagatcaacagccaaagccgactcgaagtcctggggcatgttggatctccacgccacttttgctttgatgaagagaagattctgttgtctgcaagagagagaatttgcataaggttaaaaccgatacatcagtttgcagttaatagaattgacaaaggaaatattcttacttgagggacagcttcagggaaaaggtttgtcaagtacatggaagccgattgatggaataaatgtttcttccactctatccacgatcggtcaaaagctgcacttctcaacatcctaaatttgatattgttgatgctgcaaaggtggtcctggtagatttagcagctgatccatcataagcaatgatgtgatctctcctctactttggatcttgtcggcaaagaataggctgatcggcagctgacctatgccgaattgtcttgcagcacatgttggatgataaaattcataggtcatcttgatgttcttgccctgatgaatgccgacaggaatgatgcaaggtctgatagctgctgaaaatacctccctggatttgtcatatttttcggagttgacctcatcaaaccaaaaatcttctggtagctcaaaaacactatgtccttcatatgcaaaccagattcttgcattcttggggaacccatcatagaagttgttgaaccactctccaaagggctcagccgatagtttggatgcaatattaaccgatgctgcttctccgaaggacctacatcggcgtgtggtgctggtttctccatcatcatcagtgatcggctcgaatcttggaaattctgcattggctaatggcggccgatcgataaccttcctagtgtgcaagtttagccaaatttgcaataaccaccatggaccccctgtgccgatttactttccagaagctatcttggttacgacagtgttcaaggtttggtacagatatcctagcaaatactttccaagaggaaattgtttcttatctatcaggtttcggctacccgttgccagtttgtagttggaccacagtttggactacagaataggaattttttgagccacatcataaggaaagctgcatgttcccttgaagaaactggcccagttcccatgttcttcgcgtcataacctaaccaaccacctatggtcctagtcttgaactcatgattaagttgggcatccaagcaagacaggttagccgatgaggtgacatctagactagtgatcatgatgatatctaagaagattggggtcatcggtccttgagagaaaaggaaagtattcatggctgtagaccagaagtaagtggcggctgatatcataggttcatccttcgccatatttgttgcagttagggcttaggcctgggatatgctgatttcttcccagtgagttgatttgctagccgataccctcttgtaccaagcaggccaactgttttcagccgatagccaagacttgaaggtgtttttccaacaactgagatctgggttggcaaatcggaagggaatgtggttggtctcaccattaatgaactctgtgggatctaagtcaccgattggtccgaggaaaaactgaaacttatcggttatgctagggattgcaacttggtgggtgagatgctataaaggaggaaaatcagggattgagtgagagaagaaccaaatctgcgaggtaaagaagggatttagcctatggatacttacctcaacgtattcggcggccgatgagctcggtggactagcggaagttgacattgtcattggcggaagttggagtcgccggaaatcatctctggatcgctgaaactatcgagggtgttgccgaagagctcgaggaagaagattggggaaagttttggctagagcggttaaaacggaaatgacgctgtgaaacgagaagagcggtggttactatttaaaagggagcacggtaacggtcaaaacggaatcggttttggaaaccctagatcggctcggaaaaggaaattgagcaaatccgccactttacaaatatagcggacttgggggcatgtgttaacgaccaaatttggtaatgtatgaatcaggtttgatattggaatcaacgcagatttgacaaagagatggattcgaagaacagagtatgcatcggctgcgatgacgtcggctggagtttgcatcggctgagatggattggacagaggacagccgatagaggtgatgcagccgattccgattgcggtggcttgagagttgtttctagaatcgatcaaagtgcttcacgaggattgccacgatagatataaagctctcagataggcaattatatctattaattaggatattttgtatggtttcgtcagagatatgtttgggcaaaagtctgccgcaaagacttatggtattttagagtttgttagagataagagtcgtgtcctgcaaggaaatattttgtaatctcgggtataaatagaacccgaacacatgtaatcaagtatcacacgatcaatacactttcggcgcatcaccaccctttttactttcgttttatttcgatgatttcttgctttcgagttgagctgcatcgattcgatcttcaactagaggtaaacttgtcatggcggcttgcgttctcaggattagtgcttccatctttatgacactctaatcttgttatgtaattcgtcgagttatcatatatttataatctttgttagtttcgctatataactcgccatcagctggtttttactgttagaaagtagccgatagagttagatctcgttattgatttagattatatcgtatatctaccatctttcagaggttttcatcatgttgtttagatcttacggttatctttatgcttaatgttgcatcggttgagttcgatctagtaagttctatttataattgtgatatctagcttgttttatgaatgtcaatagagatagcatcggagtttcagccgatcttacctgatttagctatttatatcctatgtctttacttatcatgctaaatctgccctttatattaagatcccgttgcattaaagttatattaggtttattatttgatatattttatttgtctcgatatcttgatatagagtggtatcggagtattaaccgatacacgctagatctatttgatcggctatgctataaacatccatataatctttgttttaatatatatttcgacttaagtggtttataatgtctcggcatggcgaccgatctatcccaatcacttagtttaaatatatatcgaagtaaaggactatatgatgttgatatctacagccgatcgaatagatttagttttatcttatttattaatcactgccgatcgattcaaacctgacatcggctcaaggataaatgatatgtcatcggcaactagtcgatcggctatcgtttttggatttaactgtgttttcttatcttttatcttgttgattgcaggatcaaatcaactggcacgctgacgaacctaaaggcgggattttggacctgcacagaagttaagcagatcttccaggtcagtgtgtgtttttcgcatcaacagttatcaaccgtactctaaacccggttgatctcgccgagaaggctaatccctacatgcgaatcaaaaaacacaagcaagaacaagatagattgcaacacaattgcatatgaatgattaagcactcgaatttggggttccacaaaccgatctagcggtgaaattgttcttgacagaataatctaagcaaaacccgactctaaacgatgacagctactgaataaatgcaattaaggacatcctagggttgccctagggcgcacaccgccttgggctaagcccacgacacaattacaaggcccaaaacccaaatcagattcggactggataagatacgtggcttgttttgcagattcctgacagctcggtaggaattttgacatgggaccaaaaccatctgaaagtagactctataagctttccaacaagtactcaagggccctgaaatttcttctatatcagcggctaggtccgtttgaagttgatgctgtcaagaggcccgaatccgaatacaaaacgtgtagaactttatctcttgtcttctatggaccaaaagtgacatggtgagatgaaataagacttagagaaggtcttggtttggtccccaatcaacttcttcaatcattcatgcattccttacgctcggtctcttttctttcgcccaagcaagtaactgtacaaacaaaaacacaggaaacttattgtgtagcaacgtttgttcaaatatataataagtaaatctaatgtagaacatatgtacctttgattgattaatacataaggtagtcatggttatatccgagctagttatatcctcatcaggactgatcatgggagtgtgctggtgagaggcggagcttggttagggttctagacggcaagagcgaggcttgaaagacaattccggtgagagcggagctcggggaggcttctcggacaagtaccaggtgagaggtagagctccaggaggcttcaaagggtgtcggatctcaacggaaatcagtgagttcgctctcaatgggatctcacaaaatcgccacggagctctgtgtctacagcctcatcctccactgcctccaccaagttacgccattgtcatgagccccgagatccgctgcctccactgtttcactccttgttgagcttgtggaggccacgagtgagctcaagacagcactggatgagctcaagttggtgaggctctcctcatcgagctttccgctgcaatgatgggctacttcgacatccaggagctcgtggagatatagggcgacggcggcagcgctctgaggaggcgaaggaggtctgtgggggcggcggcggcgtgatgcggttagtttctggcttaaatgtgtacatggtttgacataatagggtcaaacaagcaaacaagcaagatataacagggtcaaataagtaagggcaaaatggactatttaccccaaaattaacaccgttaactcacccaaacggaatagggtcagaccggagctttgtttttgaaaaggaaggtcaactaagcaaacttcaaaaagtatagtcaaattggtagttacagttcaaaatggggtcaaataagcaattgccccctataaaaaaacaactacgtaagtgtgacatgagacggtgcaagcctcagactaagaattctagattaattgatgaattagaccattgaatgaaccaacttatgttatatgcaatatatagagtggctacatgtattgataatttcggattatccggaaaacgacctatcggataatccgacagaaatattgaataatccgtatccgccggattttagagacaccatatctgtatccacatccgcatcatactattcgccagatttctaaaagctcattccatatccttgttttggacggattcggagcggatcagatcggatattatacgatccgttttcacccctattaagggtctcattaaatttatctcacatcttagagggaacgccgtcctatagatttcctgtaaaatttgtaatctgtacgtccacaagcacataacacattctcacatgtggacatcacctcgtccatcagttcagaaaaaaaaaacccttcgatcagccgcgcgaccccgtggacatacgacccacgcatacgtactgctactcattaatttttcttttagccttgatgctgaaaacgccaagcgatcgagacgtacaccagcacaagagcccacacaaactcccaagtcaagcgtgggggcacgctgccggcaaaccggtcgacgcccgcgcgctcccgccgcgagcaggcccagtgcgcgcgggcgatcgagctagcgccgcgctctcatctgcaaactctctagctcgttcccgcggatgtgtcccgtaatatttaggccattcacagtacatcatgagccatgattaaacttgtgatgccacataggatgaagctcctataaggtattgctcggtttagagggggttgaatgggatcggaggggtttgaggaggaacaattccacaccacaataggtgtcgaaaaaatcccctccaattcctctctcttgggaattaaacatggcctaaagcaacttgcttcacagtgcaactatttttaatgggtcccacccccactcgcttttcacctccctctctctcttccactctgtctccccaccggtggaggaacacacgaggcgtctgcccatcttccgccaccgccacgacccacctttgcgccgttggccacgtcaacgccggcgcccctctcactctcccccttccgtcggcgcccctctccctcccccctcccccttccaccggcgcccctcttcccccccttctgccggcacccctctctgcccctaagagttatcacaaccggcgtggagcgggacagcgcaaagctcaccagtgtggagtaggatggcgtggaactcgtcggcatggatctggtggtagatgacctcgagctcctctctgtaaaatcaatgtgtgtttgattcttattctatgatgaacaattggcatatgaaattattggttttgatatttggagattattggcgaagtagttttggagatgattggatttgtaggtgatggacaggtactgctgaatgtttggtccggtcaaaccggctgggtaaggccggtcagaccagtggtatgcggccagcccgcggtctgaccggccgactctgtcggtttcggttacgggttgtttcattggatatccatggataatttgtgtttatgacttctagatggatactatgcgtatgtaagactgctgtttgttaacaatgagtcaagttagagatagctttgtctcggagtatggtttcttgtttgattcacgtgtaggtatgttgacgaccaaattcaacaaggtaatcttgacgcctcgggagagtgttgccggtgatggatcggaagtcaacttggagataaggtgacgtccggacggttagatatcatgtgggacacttaggctaaagatgaatgcacgtggttggtgaagattccgtatggcatacgatggagatattatgtgcatatgagacgcggagtcaaatttggaaggagtccaaatttggtaattggagtttgtaaagttggtttcttgtacgggaaggtttcctagagggattataacttcttgtatgagttttgtttgtggctttaggctgtctacctcatgtataaatagagagagagggtgtggcctcccgatatcgttttagaaagcattgagttgagagaaaagttagagtttcgagtttagttgagattttcatgaggagtgctattgttgcactttgtaaacacagagagaagtaataaagttgtcatctattttgagagttctttgatttgtatttgctcgggttcgacagtccaactgacgagtcaccgacggtcagaccgacgggttcgcaccggtcagaccggcggcggtgataagaggaagaggcaatttcggcaaggttagaatgggcaatctatactggtcagaccggcggcataggcacagccagaccagcagatctatttcggttagaccgattgacatcgattcaagggtatattttaattccactaaaagttttggtttttaagtactacaaccattcaccaccctggttggcttagttcttgttgttcaatcctacactctccggcagcgtggatctggcgcgcagtcgctcaccccaccgctgtcgtggctctccctccccactgtcagcgccgctctctcccccaccaacggcgcctctctcatcctctctccccaacaaatctggcgatggcgggtgggagaatgatggaataggagccgtcggctggcgctggcaccgccggatgggacggtgggagctcggactcgacgcggatgcagtttctccagtgagcttcccctctccacactctctctccggctttctcaccatcgatgtggatgcgattccttttttatgagaaaagttgttttcttactgacgaggctctcgcagcccaagaaggatgcacgaacatttctcctccacacatgcattttatcaacatggacagggattgccacacactacatatacgcacagtgaatagccttagaattattgatccatcgatcatctctggcatggtgccagaccaccggccggcctgcgcgcatgtcgtagcagatcgagcagctcgcgcgcaccgcgccgtccgatccgctgcatgcgcgcgaccctcgtaagctgacaagaaaccgaaattaattcggaagcagcagcccatgtcactgcatcgcgatgcatgcatattgtactcctatgtgcgagcgagggtgtcccagctcgctggatcgatcagcaacaacaatgacagcaaggggaaagggtcaaggtttctcagcggctagcggtgacacggacgtacggcaacctgccgttgcgagcagcgtcgtcgctagcagctagctgcatgcacacacatacagtatggcccctgcaatgcattggtcagatcaggggtgtcacctctcggctgctgcaccggccctccggtggttaatgctccacagtgtgtcccctcgtcgacatctcgagcttgcatcggatcactccaaattctctagtaccagtactactactagcaatgcatgcaagtctctgctactagctggctgctactgtaccgactgctactctcgcctgacctacacacacaagctgctgaaaagtccagcccggcctgtgtgtgttcgattttaatctggatattgcatgcatggttgaaaactttcatgtacattcttcaaacaggaggctactcctgattgctcacagtcgccacagtagcctctcacagccgtaacagtggcctccattttttgtgttattctggaggagggatcgcaggtgacaggtcagtggatgggggaacagtgcttactactgttaccaatcctcaaatcaaggggaaatagggtaggcgagtagcagcatgccattgcaaagaaggtcgtcgaaattgacgcctgcgcgtgctgaccagtgccctagcctataatatatagcagcttgattgatctcttcagtttatgcagtttctatttccttttctactgttttcgaaggggattggaattggtttggtagtattttgcaacgtgtgtggttttcctgaactgatcatcggtcaatgacagaatgaagagcttcagctagctactactccctttatggggataattcaaaaaaaaaaggaatatatatcaaaagagaggggttgggggtcgggttgaatgcatgaacacttgacttatattcatgcaagtatgaccagaccaagtaaagctaagacaaataacatgtgtagaaagtaaggccacagctatgcggttacgatgtgccatgcaataggtttctgaacttgagaaataatttataaggtccccacacttctccatttcgtcaaagaatgatattttcgccattaattaatagaaaaaacacacaataaagaatgatatctttattttcgctgcctctgcagcttttgtaacttcttcttccatgtcttgcagaccttccttttgtacagttttctcccttttcttttggaaaattttattcagtttggggttatatgaacaatatgttataaagttcagtgggctatatgtcctgttccaaagtttaggattctagatagactttcaatcaaagtttacgggtaccttttcctatataatatactccctccgttttagattgtaagactttctagtattgctcatattcatttagaagttaatgaatctatacacatataaatgtctagattcattaacatttatatgaatataagcaatgctagaaagttttacattgtgaaatggaggaagtagtatagaaagtatcaagattcaaaacaacacgttcaacttagaaagtaatgcagttttgaaaagtaatggagttattcactgattgaatataatgagggcatagagaaggccctgaagttgaatataatggtgccatccatgtccttaatcaccataaaaatcacgctgttgcacaatttttttgatcttgtctatagtaattgtgttgactaacttggctacatataatagggaatactaatctatctctaatcatttgacaaagacctttagtatagttttctctaagctaatctatagtgtgtttaccagctgaacactagctagctactcgggcaggaaagaagtgcatgcttagcgcctgattgggaaaatcttatcatgcatgcatcttttgttcaaaacctataaacttacaggacaaaccaatgatagtatagctatagctatctctagctagctaactatttcattcatgatatctcttcagtaatacaatattgataccaaatatgattttaaagtaccctgtattaattgttatgaaggataaatggttttttttttgcacataaaagtaatatatttgctatgattgatgctaatgtactgccacaaacaagtgcgagcaaatggtaattaatagtaaaaactacatataggcccattcttttctccaacaaaagttgaatgaaaatttggatattcatggcacgcttttcaaagtgctaaatggtgcagtccgtgcgaaaactttctaaaatattagataaatatatttttcaagtttataataattaaaactcaattaatcatatgttaataccacctcattttgcgtaaaatatttaatcttcatcttcatctgcatgagtttcaaacaccaccatatattaccccgtgttgtgaaacatttagccaaataatgcaagcttacgtataatgatataaatgaatttattttattaggttaagttgtcatggttatattcattttaatatataatatccacatatgcaaattatctactacatatatatgaccgtttgaaaaattattcatatattgtttagaagacaatgcaaatatacgaattttaattgttgtacatgctcattgtaggcttagttatatctacgcctggaaaataaaatctgcaaactaataacgtgcatgactatggctttattaagttacatttatatatcaaggtattaaacttactgaagtaatgtgacattatatcttcaaacactgtatcctaaatcagatgtttctgtaaatttgggcaattttagttagaatctggccacatgaaaatttatctatatatgattcacattgatgtccaacgaccatgtgttaatatgttagtaactgaaaatgcaattactattgcagtttaatttttagttagttcatactacaaattaatcctatttaattaattaaactctgacgattgccattcatttttgtataagcataacgcttcctttgaaacaaaggaattgaactactaattaattcgtttcaaactagtataacgtttccaaaagaggactaaattgtgggaggaaacaatatactaactataactgctatacggacaactgacgctcgttctgttaacttttttatttttaaaaaaacttcaatactgttattgagcaatatattgggtagattataactttagaaaaataaatgatgaaataatatggacctacataatacattatgttgacacataaaaagaaaaggtgcacatgtgaatttgggatggcttcctatagacatcagtgctcatgaaataagctatgtaaaatgtacattcttcatgtttatatttgtttttttttccttttcgtttgcagaaagaaaaataaacctgtttatatgagaactcaagaaattatgcaaattaactaaaatattgattatgaccaacatgctcacagtataaaaagtatcagacagataatttgcatgattaacagacttactactaatgtggattttaaatttgcatttcatataataagatatacttcccaatgataccaagacaaaaaatgggtctgatcatgcatgtgaccatatgaatagaaagttagctagaaccagtcccacacccagctaatgcatgtcactctgaacataagatatatatgtattatatatggtctggaagcatggttaaacaaaattaacagtcttattaataattaatctcatggtgcagtgtgcatgtcttggaaggccttgggacaagtacttgaaagatctcactccaatgccttgatcgacatggtcagatccaaagtactcagccccagagcggccttcttgctactgctgctacctgtcatctcttcctctaacctcccggcggcttctgcgccgccgccgccgccattgtcgccaccaccccggagcgacagggaaagcgtgagtggcagctgctgcttgtcactgtccacctcctgctcactcaagaacttcctcttctcgccggctgatctgtgatctcccgcgttcgggctcaaactcagctgcaagtccggcgtcctgccgttgatctcctccgccgccaccgccgccgccgtcatcttcaccggcgtctcgaggcgcatcgcctcggtcgctttcgtctttgccctctgcagcgtacacaacgccattgttgtgagttggtgtgacgaactgaacgtgtcagtgtgacagtggtcatcacgtgcgtaagcgtacctcgagcagggaacctagggcagcttcgcttgcgaccaccggatccgacgacgccgtcgtgttcccgctgccggcggcgccgcctcgccaccgaagatggtggtggtcgcccatggtagccgccgccgccgctgacattgtcctcgtgagcggccgggaggagctgctcccgatccaatcaaagttgccggccttcccggcgccgtctagccggtggtcggcggcggcggccgtggtcgccgaggtcacccgggtggaggcgatggcgtccctcacgtcgaacagatgcgacgtcggctttccttccttccggaagatcatctcgtggatgagccctttcgccgggccgtggccgttgacggcgccggcggccctcgccgccgcgtgctgctggttgaacgcccactcctggttcctactacgcgtgcaaacgagacaccgattagggtttcgacatgatctcgcagcatcaccaccaccatcgctactactactagctgatcgatcgatcgggcttgtcctttatttcgctttggttaattacctgaagctattgcagttcttgaagtcgaatttttgcatgggagcttgctgccggcgttggaagagaccgtagagccggctggactccggcaagccgggattcctcgaagcgaagaacccgccgccgttctcgtgcagcatcctggaggagaacggcgagacgccagcggcggcggctcgctggaagaacatgtcgtggtggtggaaacgatggtcccctctcctcatgtggaactccatgggcgaaaacactgaaaaaaaaaattcaagcagctaacaaagcttaagaaaatggattccatggcttactctctgtatgcatgctagtcctgtggaggagagcaatgaattaaaaatttaagggagataattgagattgagacaagaacctgatgagatggctcctctctcgtggccagactcgtggtctagctttttgcttctgtacatctgaaaaaagtggacaagaatgaagaaggaaaaagtttaggcacaggaaatcttctgtgtgaagatgaaaagaaacaaaaccagcatgtacacagcttctgctaactgctaagtaagtagtcatgactcatgagaagtaggctggtttttttcatcctaatctgctttagttttacctgcaaatggcttttgacatgagcaatgctgagccccctcacattcatcatctgaagcacaagctttggtgttgctcctgccaacaattattttgacacacgaaattttagatgtcgacgaatcaaactaatattcaaattagaaattttaatttaggatgaaattaacacagcacaagaagaaaaggctagcctacgaggttgtactcactttcttggccgcccaacctctcgacggcgtggacgaacgccatgtggaggtcgggcgtccaccggagccgggggagcttagaccggttgtactgccgcaccgtcggcaccctgtcgccgccgccgtcggccttgctgctgctgctgttcatgtcatggtccttgtcgctcccggaattgtggttggtgctgctgttgttgctggagctcctccctcctccggcaacttcgcttgtgctaccgccatcgtcatcgtcgtcgtcgtcgtcgtcctcatcatcgtcttcttcatctccgtcttcgccaactcccccttcctcgctgccctcgccgaagccctcgttgaggtccagcaccatggctggtggcacagagttttcaggagatctgatcttgttgtcatgatcatgctcaaaaatctctaccacctcattctccttcacctcccccatagtaacaacccttctaattaagctagaaatcttctctcttctcttccccttctagctctctctatatttctctaccaccaccatgataggattggaatgatgtggggtagaggagttaggaaccagggaggaagaagaggaggagagtgtgatgggagaataagggaggggaagaagcataagcaagagctaatgatgtgggggataaaataaggggaggagcttaggagcagaaatggacaagtattccactacattgactagttttcaagactgatatatactcccatttctcccctttttctatagtgtcaaggaattggaaagctatgcaattgctgtgctgtgagagggtggtgtggggtacatatgctaaggagggtgtgtatataattggatgtagtggccctggaaggggctgattgtcaattagcaactggaggtgggaaaggaagcaaaatggggttgacacttgcttaggatgataacaactgtttgtgtccaggattttatcatattaatttgtgttcctaatccatgtacggtgtaagatttgaaaaccgtgcatacctaaagggggtgaaatgagggataattaatccttgaggtgtgtaatgaattgaatttccccatatatataactatactaatttgtgctgttaaaccaaaattttctgttcaaaaaggttcaaaccaaaatttatgcgtgcattactttttttccaaatattatagtactaccgcttccattcataaaacaaatatcatatcgatcggaccctacatttaccaaccttctcttcattaacttaaccaactagttcaaactttggttctgccatttgtcatgcatatgcaagatattaagggcatgttctatggtatagacgagtatgatatcctagataatacaaaattatttagagaccgtgtctctacaatagttgagacaacaaatgctctaattaatcattaacttaaaaatattattttattgtcattatttccttttttttttctcatgcaaccattttccagaggctttgttgttacaccatcattacccatagcaattatgttttatctcttcactttctctctcttccatgtcagccaatatacctaattagcaatattaagagacacatattaataaccatcgtacatgctagggtttatcatgttctctctctgtttttttttactgaaagttggttataattcttttaaatgtttctcattgcgaaaagtcggtttttaagaatattcattttctactaatgcatttatttattttttggctagttagatatttttggagcactaaatatgtgcatgaatagtatgtttctacaagtcaataactgcattggtggtagtatggactatatattatttctttttaggagatcaatagtagtatgaaattatataattaagaagagttggtggaactgatcgtaataatcaagtgtattctgcttgtgttgaagttatatagcttactggctctcgctgacttggactcggcagtagaaatggaataaacaaaaacaaaaaaagcacatttttcaaactagagttagctacctagattcagctgctattaattataaaacaattaattaaagtaaaatattttttataaaagtacgcagagtaagatatataccgtgagcatgcaaaccttataaagaacatacatgtacttttataaaaaaatattttactttaattaattgttttttaattaaatagcagctgaatctagtagctaactcctagtttgaaaaatgtacttttttttacctgttgacgcaaaatatatcgcaacacacaatggtctaagagattgcgggtcctaaaatcttgatgagattcgaacatgccagttagtttgatcatgcgactaacaagatgaaaacaggtcgatgatcaagaatccgaccatcaacttagagagccgaacatcaacttagtgaggttagccaatgttgatagggttttgattaatcagctatagatctaaggtggattcaaacaattagataaacaattatataaagatatgatagaaagaatatgaccaatgaaccaatcgaccgatattaatatagtgatagatgtagatccgatggttgaagcatacatcggcaaaaaaatctgacgcttgcagattttgaatgtatatcagctaactaaacaatacatatgatagctgaagctcacaattatgataactagttagctagaactccgatgaacgttgtataaaaatctattggcttactagaattaaacttattagcaataatctaatagatcggatctaaccgacacagtacaagattgaagataataagaaaaatctatttagccaatagatatggatatattgatcaatctaaaacagcagtgtgatgagaaaaatatcaacttagtcagaatgtcatacctaatcaaggaagtcctaactaagccgatgcaaatctaaacaatgttgcagttaaagataaaatcaatatatctgataggcaattcttgcatcaacttagttagaatatcggacctaaccgatgaaattctaaccaagctgatgcaaacgaaattgacggaacttacttcctcgctggagatcgaatttaaccgatgcagcccaacttgatagcaagatagtatatctgataggcaatgtttgcattaacatagttagaataccggatctagctgagtaagttctagccaagctaatacaagtgaagttgatggaacttacttcctcgctcgagatcgaatttaaccgttgcagcccaactcgatagcaagacgtcgaacttaatttctcacctaagattgaacttaatcgatgcagccctaatcgaaaattaagaacccgtcgaaaggttggtgatgcgccgaaatataattgtattgacctatggatgatattatagagaccttatgtgtacatatacctagggttggtacaagtccatattggacacgagataagatttcctaataaaaaaaactaaccctacttatttaagagatatactgaggaaatacgaaactacattaccatgaccttcacaactccttattaaattcagtttttatctagacaaacttttatttaccaatcagtttcttttcttaactgaatttactaagaaaccgtaccaaatttttgcgctaacaataccataacctcaacatataaatattattttttccctttctcaaaatataacaacttttagctataaatatgaataaaagcatgtttggatatatagttataaattaatatattttgagacggagacagtgtaacggatgaaaggaaaaaaaaggcttgagctttacaaattgatgtcacgggcaatcacaagtcatgcagccacattcacacgcattcctgtacgacaagaaatataaattaattatggctgattcagcaaaagaaaaaaaaatgcatcaatcaagtagaatgaaatgggagttgactagggtctgcaaaaattacagggtcaaagacgcactttaatacaatttgtttgcttttggatttcctgatggatcgatttgctgattgacgtcgaaagatacacattttctacgtacactttgtctcttggtcatctatatgacacgccaggcttgtgtatgaacggattgtgctgacgcgtctgattccattgcttaatttttaacacagctctataactgttactttcactagctggaatgttttataccctattattatttgattaactgcgcgatcaaactaattccagtggtgcattcattaataaccactcaactcgcgatttacctttttttgtttgaattaaaaactaagacatttaccttaatatttactctggctaataaatgcctgtagtttctttttcaattacacggaaaacatacacaccactagaaaatacaacaccacgtttatatatacacccgcaaatgccccctgcccccctaacacacggcaaaagagatggaaaccagcgacgtatgacttttcttactaaattccgattaaaatttgcatgcacacaatatttatgggcaccaggatttaaacacgagtgaaaagagttatatatgcatccactattctaccacgacaccaccggttgctaccccgcggtcaacttaattaattaattaattttaaccacacacgaaatctagtaatactcatgtagtccatcaattcttgggccatttggaacacacgaatttcaggcaaaatcgattccaagctgtcaaatgttctttttcttagtgcagaagcaactactgtattggaaccaacataaattagctaaagatataaagaaaacgagatagttatttatttctcaaattggattgatttatggtgccaaacttttataaaatagtaagataagttcaacaacatgcattttacactataaattatctatatttacggataaatacccactagtgcaaaatcgatcatttgtatcgagttccgacacccatctatatcggcagaggccagagggcttggtcatcgataaggcgtgttcgattggcttgtgtggatagaaatttttagcgcacgcaaaatgagaaagcacaatggcatagcacataattaattaaatattaataattataaaattgaaaaatagatttatttgaatttttaaacaacttctacatagaattttttttttgcaaaaaacacattatttaacagtttgaaaagcatgctcatggaaaccaggaaattgaagtttgaagttggaaaaaagaaatgggcctaagtaatcagtgatgtgaaaactcatatgtttcaggcgagcgaccatcaccgttgtcatacatcttaaacgagtttcaatatcaacccgtcatcgatatggttcacccgcgcgagcgagtagattacaacttgtcacggatgactcaattgtgatgggttacaactctaacccgttaaaggtgactggtgaccattgacaaggtactttagagcccgtctcggacgagtcatcggtgatggggttcagttgtaacctgacaatgatgttgctcactcatgacggggttattggctagcttcaggaaattactagccatgcccattacaaaatgatagaaacacagatatattcccagaatccccaaaatatcccgtacatttcatgtacacacattcatttacatactacgtactcacaatcacatgattttcaagtctccgttatttgtaagtctcaagaattggattcctcacataattatattaattctcacattcagtaaaactttaagttgcaagcctcaagaacttacaaaaccgcccatacatcttccaaagagaaaccttcacaatctgcgaattcagttacaatttgaaagaagtaatagaatttgtaaaccaaatgttaccaacatacacagcatgtacacaagaattagaaattgttttacgtacagtatataaacaaatatcacttagtcaactatttttacaccatcatttaaaattgtgcctctatctcgaacgttgttgagtttatcaagcacaaaggcaactatttcttctccaatgttgttgaagttgtgatgaggaatgttataaatggttgcctctaaggaggttttcttacctctctaagtggtggagaggtataggaggtatatatctcctagggatgcaagtgggtagtcccgctatctgcataataacccacttgctagtttattttttacatggtagtacaaaatttagaagaaaaaatgaactagaagtgagataagcgggacaaaaaaaatccgcttgcccgtcccgcttgcatccctattatctccaaggatataagaaaacctcctaagagagacgtggagttagaatcgtatgtaccacatcttatactgtaaattttctaatgcttaggccgtgtttagttcacccccaacttccaactttccatcacatcacatcacatccaaaacttttctacacacataaactttcaactttttttccaaacttctaactttcaccaaacttccaacttttttcaggaactaaacacagccttactcattgactaaacaaatatttatatatactagtacaaattaaatcacaagtaaaatgcgacaaaaacaaaagtttaaaaaattatcagagaatatgaacacagacttacacataagggagagttagcagttaaataataaaaaatgagtgaaatgaagctaatatatggcaccacctttttttagcaaaaccatttttaaggaacattaatagaaaacatagctagatcagtcccatatatataatgattctctcttttccgagttccaaccactagctagctaggatttgaaaaaatcatggtactagctaattaaggaagttgcttatgtactatatacaatattattggtagattcagatgtcaaattacatgattgatgaacaacttgggatgtagttagggtttggtttcgagtccatttttgcaagaacccacatatggattctatatataggttgtttggttaaccacttcggaatttcgtaataccactgagaatcatgaaataatcatcagcatggtaggaattaagatgtgcaaagcgctatttgttaattaatattgcgcatggtcatcactaaacgatactatggtaaagtagtattattcctcttacctgaaaccgtgccaaatatatattgaaatttgtagatataaacatcccatctgccaggtttagttgagctatttttgggaatttgatggtacgtacaataattaagctagtactgaggagaacacatcagatcactcctcttgagccagtcatgtgaagcgtgtgcaatataatagactaaaaaaaattgttttttgagggaaagagtataggagagcctcctacacatttcactactcaaaattagtagagaaaattcccaatctagcataaaaaaaattgctcttccctatatagcacccaaacttcaaaagttctctatcaatgcaccctcaaaatttttgttccctatctagcacttccgttagttttgaggatgacggtgttaattagcatgagaaaagatggttttgcccttatgtattttatactttttttccctttctctattcacagttttttttgttctttattttttcatttagtgtccagccgtgttcaagtctgtgcatacttcttttttggccaatataatatgagaacattagattaacaacgtacgtacttcttttttttagaaatttgacagaacaaatttaagagaacttacatgcaacaatagcatgtatgcaacacaataatgaaccaaataaattttagagagcatccaaattcacatccataggcctgtaacatcaagaacgacatgcatgcataagagctacatctaatcctactgccattgagtgctacaaaattttcaagaaactcagttgttgagttcgtcgccatgccagcctgtttgcccgcaccatccagggggttgctgcccgtgcccacctgggagctgcctgcctgtgccgccgtagccgtgagccgcctgtcctgcgccctcctgggattagccggccgagcaggcctggggctggccgcccaggttggcagggcgctagcctcccgtgccgccggccctgccctcttgtgccaccggcgctgccctcccgtgccgcgacggcctggtctcccgcgccaccggcgctggccgttcgggggagcccgccggcgccaatccttacaggggcgcgcctgattcgccgtcctcgccgcccggggggtcaccatccacgctgtcggccatgggggcggcgatctagggttgcggcgacatggagttggggagaggcgcggtcgcgctcggtcctgggactgatccagaaaaaacgacgacagaaatttctgagggtgggtccatgcttgttttgatagtggagactaacgggagtaactgaagtgctagatagggaaaaaaattttgagggtgcatagatagggaatttttgaagtttggatgctatagagagaaaagtaattttttctgatgctacatacggaattttctcaaattagtaagcaaaacttactgattcatgagataccatgtttgcggtcatattaatttactcagacacactaattaagaatatccaatgaaaaatattaaacttcatcaagaaattgaacttcattttttttcttttctacaaattaataatcttgaataatgttgctgcgggcatgcatatgtgtacagaacacatatttcgggtgaaatagcataattaatttttcacgggattaattcctgcaaatttcacttctcgagaaagatgtagtttaaataatgcatatttttcaatagttgtaaatttgttcatctatgtacaagagactatctttttccccaaaaattaaattgcaacacattatacgactgcagttaatctacataaaaaaacactactccctccatccctaaaaaaccaacctactccctccgtcctataatataagggattttgaatttttacttgtactgtttgaccactcatcttattcaaaaaaaaaattagaattattgtaaattttttgtgacttactttattatccaaagtactttaagcacaacttttcgttttttatatttgcacaaattttttgaataagacgagtggtcaaacaatgcaaacaaaaactcaaaatcccttatattatgggatggagggagtagctagtactggatgtgacacatcataatatactacgaatctggacatacctctacccagatacgttgtattagaatgtgtcacacgctgttggggaatgcctcattagtcccggtttacaaattgcaacccctttagtcccgggttgcaagccgggaccccaaatccgggactaaagatcataaagtctcgttgtattttttaaccgggactaaaaattgatctttagtcctagttaaaccggggctaatgtggtttttgcatcacccagcaaagatcacttctccggtagtgacatcttctgtgagacggagggagtatacgatatagctagtaagctagatatccattcttcatatagcactgtgttagaaactagtcaccaatctagtgtggggacaatacatatcaccgaagaattaattgttcgttctgctgctgtccatatacagtccattactattgaaatgcagaaactaacgctatatgtgtatatccatcaatccaatcgttaaatgaaaactgtcgatttcatctacgaaatgattaggcgtgtttggacgccacaatatataacagggaaaaagaaaaggaaattatatagaagactaattaataatgcacgcagttgcaaaaacatgcattcagaggagaccaattaatctttgaacaaaagaaagaactccgactaattcttgcatgatttgtaagggtattcacaaaatcacaatgcaatgactagataatatctatataattaaatgagttatcatataggataaaatgtaatgtggcatatgggtaaaatgaagaaagaggaagaaacaatgttttacattagatatacatggtttctacataatatctaagatttggtgggataagaataacattaaattcgaatatgaattagtagtgttaaaaatagtttaggatgaggatatgaaaactattggcttgcatcgtgattgccctgttccagtacaggcaagctcgatcaatcgatccagccagcaatttaattcagtgccagttaataacacctgatggctttgtacgattgagagggtaaatgattaactgagatggataaaaattaaatattaattccatgccgcagtagctggtaggccatatgcatacatgcatgctgcattgccagcttcgaagctgctactcttgaactgctcaacttcgtcgaagctggagacacgattggtctctttcagaaagcgacgctggctgtgctcacgggccaggattgggttccggtccttcaggccgaccggaccacgtagtagctcatatattcagtcaggcctctacacaaaggcatatatatagtagagttcattaacctgactagctcgacccatgtaatctgcacttgattcgtttgaaaaataatatatatgcacctccattaattagtccaaatacaaaaaaataatctagattagtattagcatgcatggacacatgtatttctggtgtgtatatatatatacaaattaaactgtgtgcatgtcagcactgtgcagttctgaccagctttgccaatgcaattatctttttctttaggaatctacattaacagcttcttcttaacgagcttttagctaggaatagaatctctacttgcagccctgcctgagtgacttaagatgcatgagaatacgtagcatgttttttttaagcaaatatagcatggttaatgtttaaggatgattgtgcattgcctttgacctagctagctgaaaatcaaaagatgctcgaaatatagctcatctttagatagctgtccaaaggtatgcatgtctagaagttgcttgtactttttctcctgaaaccacaatcctacctagcaactttaattgtatatttatatacctaactaactatatgacccattcttttttttatatatgaggtcttgctagaaaaaaaagtttccacggatccatttatactccctccgtcccaaaatataagagatttgggtcggatgtgatatatcatactattatgaatataaacagactcctagtctaaattcacatatagtactaggatgtatcccatccaacctaaatcccttatattttgagacagagggagtatcatccttttcatatgaatgtagataaatctaggatttttttttcttgtgtgcaggggcagggaaaaatctacttaattaccagccattaggaactaacagaagatcactagctatagtactggcattaattaatctggtgggtagctagctagcaagatgcacgtcgtcatgaggtgaatgtgcaatatagtactttacacagcactaagatcttttttctaggctgtgtgtatgcacgagatgggagctcacactatagtagctagctcagctgagctgatcgatcagctcatgtgacccaaacggccaatctggctcgaatccaaaagcaatttgtttttctaagctagccacgcttcgattgggtcgctgacccccttgtcgtgtggatctgagtgtcttctccgtgacacaatgaaaaaactaacctttgttagttgacctctgcctgcaagcctgcacacaaatacatgagaaagccttctttctttttatcagcaacttgttcagaaagagctagatatatagagaggagaaagcaatttaaatttgcaattgggttggtcacttcatgacatgcatggctatatatttatttgtcagaatcatgtctacatctatcgaagatattctctttgcttgtagagaatgagcccccttggacattccaaggagattaattcaacaagagctaattaataagcttaaaatgtaattgttcttctaacgtttccaagcctccaagctctttttttttccttctatacgatcagcatatatatgatggctttaggagattactgactagaacctacgtgatttgttttagccttcaatttaggtgctcttttccatcaccccattctgtttttctttcttcttaactctaaaactcattgatctattgtgtgtttgctaatcatttctattatctaacaaaaatatatataatatctagcattgacaacttaatggctaactgttttagtacttgtggccactaatggtaatattatagtatcagtattatctccagtagagccgccgtagaagtaattcgaaccattgatttataagttcaactaccattttttttttgaaaatgttgtaggaaagattattcatacagtacatatattaacatcactgtaaaaaacaatcatttacaatactaccaatattaaggcattagtataaatatgtatgattctggattagaaaatatggacgatttagattgttttctactactaattaatatagatcattgtaaattaaatatctctaactttaatttttacaccagaatattgttaatattttcaattttgaccccattcattttaatacttataagttatatttatattagatgaataatcgatgttgtactatatgtgtcttgttttccataatatctggattaattttgaagtggccttgttttcatgttccaagatactactaaattcatacatatattttttacaatactagtagcagtggcatgtctaaaatctttttggaactcagacataaacccagccacgccggtatcatgaaacaactagtagtgcggcttaaccgtctcttaccaccatggcttacctgtctcttaccttagcgagcctgagcagatggtgactgcccacggtagtccaaccctatgtccaatatatcctgccctatgtccaaccctgattgttattgtatcaaatatattgatggtgcacagcatgatgagcttgaagcagacacaaccagctcatagaaagacatatttgcttagtttccttcatatagaccatgtaaaatcaaggtgttgattaagtcttggtgatgaaaattgtcaaaggtaatgaagaagttattatgttgatattcatgaagtggtgatgaatttggagaagtgtcggaacatgcaaagttagaccggcagggtaaggtaggtcagatcagtagtatttgcacagtcaaactttttgggtaactgaggtctgaccgagctatatgagcggtcagaccgacagactctagggggagtcggttcttttgttgttttgatggaatatgcggggtataaatgctatcgaacaatatgcgtggttgtgaagattccgtatggcatacaaaagggattgtatacgtataggaagcgaagtcaaatttggatggagtctaagtttgggagtttggaatttaaatttctaaaaaataagtttgatatgtgtaagggtgagtttttctaagggattaggagtatttgtccttgttggattcatgacgtctcttgtgcagccacctcaaggtataaatagacgagatgttgaggctctcggcatcaattttggagagaatagttttagagaaaattagggatccaacctaggtttcgatttaagtttagaagttaagagaggagtgttatagttgtactttgtagacacaattagatgcaacaaagtcgatatactttcaagagctccttcgagttgtgtttttctaggtctcggcagacagatagaggttatcaggcagtcggactgatgtgcggtgcaacaggcggcgtgtagtagattggatcggcagcagaaagtcggttggactggcagtaggaagccagttggactgatgacatctgtacggtcagaccagcgcatacatgataatcagatcagaactcaggtttgataattaatgagttattacatgtcaaatactcattaattatcacttgtacatgtcaaatactcagagttaaattaagtcaatacttcctataaaaaaaaaggaagaaaagaaaataggtttctcagctctcatgatctgtgctgcttcctaaaaggggagaaactactcacacgaacgctggtccatgcatgcatcgttgcatcacggcttacatgccgatctccaactaacacacaccatggtggattattgctggaaagccaaaactaaaggaattaatggcccggccacccgtgtgcgtgcatgagcgtgacaatgacgagtttagtcgtccattaatacggcagcacactgtcttgtgaatttaaccacataaagttgcaattcctaggctagctagacagtggcgtggtatagtttctttctggttgatcttttctttccttttcatggcatggagaaactgttgggtcattcggttgggaggttattatatatgagaaaagaaagctgagtatgtctcaagtaccttttctagttacctcaaaaatattcatatagtttagaaatactaacaatattcataaagtattgttatattgccagggataatttttatgtactaacaattctttcatgtaatatatgccctataaacaaagtaatgtaggcctagtcaacaaataatcaatgaaaatgatgcatatttactactctctccgtctcataatataagggattttgagtttttgtttgtactgtttgaccactcgtcttattcaaaaaaatttagaattattattcattttttgtgacttactttattatccaaagtattttaagcacaacttttcgttttttatatttgcacaaattttttaaataagagagtggtcaaatagtgcaagtaaaaattcaaaatcccttatattagagacggagggagtagaatactatagatggaatatagccatctagtaaattgatcctagatcaatttactctacatatctacgtattctaaactagctgggctagctaagcactatatatataaaaaatcaaacttaaaatatgtgtccaatttcttccataattgattggaagtaggagagaaacattacaccaggccgatcgatgctgctcatctagtaaattaattatctagacctatttcgataattaaatttcaacatgcgctgctcatgttggtccagtttcatttttacatggaaatttaattagaacaaggtgagtagcatgcatgttgaatttcctttgtttcgtttctggtctaaattaatactccctccgtcattctagccactggtggagaaaccctttgtagtcccggttcgtaacccccctttagtcccggtttccaaaccgggagtaccaatccgggactaaagatcgctatctttagtcccgggtgaaataaccgggactaaagatagagctgatcttttttttttgcatgcccctgttgctgcatggtttatatatatatatatatatatatatatatatatatatatatatataaaccatgcatatatatctttcaatacatatatatgcatacatatatatatgtatttatacatatatatgttatgcaaatgcatatgtatatagatatatatatgaacaaaatatatttacattatagaaaatgtgtacacatgcatatataaacatatgtagtcatgtattaattacaatccattatatgtcctagctagctacgatttcgacgtagtagtactcgctgctaactcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaagaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgcaaaattcgatgacctcctctgttccataacccttggcgatgcttgcctctggacgagcacggttacgaacatacttctttagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaatccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacaaggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcat

SEQ ID NO: 65574 - DNA, 21242 bp, Oryza sativa
  unsure (1)..(21242): unsure at all n locations
cacaatcttggccacctaaatttttccaacaaccagttatcaggccaaattccttcttcactcatacagtgtgctgttctattgtcccttaacttggaaaacaacaacctaagtgggagtataccagagtcattaagccaactgccggcaattcaacaaattgatctctcggaaaacaatttatccggtgttgttcccaccggaggtatctttggaaaaccaaattctgtaaacctgaaaggaaataaagggttgtgtgcacttacatccatatttgcattgccgatttgccccacctcacctgctaaaaggaagaagaacaatacacgatggctactgatagtgattctcattccaaccgttactgttgctttattctcaattctatgcataatgttcactcttagaaaggaaagtacaacccaacaatcttcaaactacaaagaaacaatgaagagggtatcatatggggacattcttaaagccaccaattggttctccccagtcaataaaatcagctcaagtcacacaggatcagtctacatcggacgattcgagtttgatacagacctagttgccatcaaggtatttcatcttgatgagcaaggtgcacataacagcttctttagagagtgtgaagtactaaaatgcactcgccatcgcaacctggtcaaagcaataaccttgtgctcaacggtggattttgacaataatgaattcaaagctctaatatatgagttcatggcaaatggcaacctggaaatgtttgtacacccaaagctgtaccaaggcagcccaaagagggtgctaacgttaggtcaaaggataagcatagcggcagatattgcttctgctctagattatctccacaaccaattggtacctcctctgatccactgtgacttgaaaccgagtaatattcttttggattatgacatgacctcacgcattggtgattttgggtcagctaagtttctatcatcaaattttactaagccagaaggatttgttggttttggaggaaccattggatatatcccacctggtcagtttttccattccaacaactggttatttgttcagctttacatctatctttttgttgtttttagcatactttcattaatattgtcttacagaatatgggatgggatgcaaaatctcaactgctggtgatgtgtacagttttggggtgcttctacttgaaatgttcacagcgaagcggccaactgacacacaattcggcagcgacctcagccttcataagtatgtggactctgctttcccaaacacaattggtgaggttttagatccccatatgccccgagatgaaaaggtggtacatgatctgtggatgcaaagtttcatcctaccgatgattgaaattggccttctgtgttccaaggaatcaccaaatgataggccaggaatgagggaagtttgtgccaaaattgcatccatcaaacaggaatttgacaaaaccatgtgatacagcgatttgggaaaaatgggagatgcattctatgtacgctcatcaatgttccaaaaaactgtgcactgatcaatgatgtagcttcctgggcatccgcagaaaagcataagccctcattgtacagagaagccaaaaacacttctctaccagcttcttcctggatacctaattctaaaaacatgctaaaccaatgtaaataaagcatagcttttattagactaatagctcctcagaacattgttttttcttgaatatgcaagagagttgcatatcattgcattaatagaagaagaaaggcgtccaaaacacgcctcagaacatagctactttatggttaattgaaaagtgatgaaaacgaacggctgttgtatacgcttaattgagaagaaatccatattcagttgaatatttgagtggtatatacctctcgaatattagttttgctatgggctaattaatgaagagaaatttcttgatatgccttaccacttactttgcttgcccccttgtggaagtgaccttaccttcaatgcctcatctttctttctccttcctcactctgcacgacacctccacattcatggaaaaccatcagttctggcacaggcacaggttgccatcaatgagacatggcgagcacattaccggtcagaggagcgatggcgggaggagcccaaggccatggcgacgacgacgacctggggacagtgttgtcgggggcaagtgggcaacaacctggggcgagggagagatcagatattcagattggccatggcgacgaactcctgggtgctccaggatgctccatcggcgagaaatcgacctggactgcagcgtgcagcaaatggcggctacggcggcgcggttttggccggatccagggaagacgacgtctccgacgagctcttaacttcctttttcacacagacctcagcactgaaacgaacaagactaggagagagatctccgcgggcggatccggcagcggcggcgatgcttttgagaggaggaggtcacccgcggcggtagctcgcggaaggaggttgcgccggcagcagcggcggcgccccacgcggaggtgcacggatccgacggcagcgctcgcgggaggaggtcgcgggcgatggcggcggcgcttgcgggcggactccgacggtaggtggggcgacgcttgccggcgaaactccggcatccggcaacgtcagctcagagcatccccagcagatacggtaaccaatcctccatcccggttttagcgtatagaggccaaaaaacgccctccagcggatacgctaacccacacgccaattttggcggatacgccatagtaggagagagaagcggtaaaaatagcgtatctctctcctcacgccatttcgcccgagcgcctctggatcgagatcccgcccccatccggacatcgtcaaccacctcccctccggcgcgagctcaccgctggcgtgccaccccctccatcaccgtcgtccccagagttccccgtgcccgtattttgccatttttcaacgatttgtggagcgggacttaccagatctggggcgctgtcgccgtgcgcccgccgccttcctcctccgtctccctgcacgtggccgccgcccggcgccccttgcccgtgagccgccgccgcccctcgcttgccgccgtcgccccttgcccgtgagccgccgccggccctagccagccgccgccacccctccgcatctcgcgccaacgccgcccctgagcagccagcggccggcgcccctcaccagccgccgccgccccttgccagccgccgccgcccctcagcttgccgccgtcgcccagcgccgccctgagcatcccgccgccgccgccgcccctcaccatctcccccgtccctctgcctgcggctgtttgaagagaagagctcagagcagagaaagcagataatgagaagatctcatttttgtatacacaatgtaattgatttatacaccacacacttgaatagagaaatataaatatagtatgttgatttttgtgaatttatgtttattgagcagatatatacaataggaattgagtacaaactagatttatattgctatattgcttgcttttatgttcgttttatttaataaaatgtaaggttagttgtaagatattaataaaatataggatgatggtatatggatgatgtagtatggataatctgttggagttggaagggatatggatgaggaatcttttttggatgatactccatatggacatttggaggaccaaatatagatgagctgccggggatgctctcagggccgtcccgtcaaattcgggggccctgttcaaagtttaaggggccatgtgcaaagtttaagtttaaggataaaaacttaattgataaaatactataaaataatttatactccgtaatatattttatagtaatctagaatggtctaaaataataatccaaaattagggattaccggattagaaattatcagaaagaattaggtcaggggcgcagcaggcattaggcggcacgaccgcacgagagaaagaggtgaggcgtcgtttactcctctcgtttgttgcaattggcgattggcgaggtccacagtgggaggcgattaaagattgcgaaccggcgcaactatgcgaaccggcaaaggcgtaatcgaagccgaaacgataagaaaaataacagattctcgagactagttagactacctaattacttattgagttgtatatccagtgttgaagttttgggcctaggggcccctgaaaattgggggtccctgtgcgggtgcgctggccgcacgcccctagggacgcccctgcgtcagcttcgtgtcctctccttcgacggtggccagcaacagtgtgtattgaagagagagagtagcgatgaaaatgtagcggatacagacgacggatattcgcccatagcatatttgttgttatattttctgtcagatattaaaacaaatatgaatagtacggaaacaaatacgaattatcttgaatgcgaataaggatcgaatatgatcggacatgaataaatttttttctcagaacacgaaaatcacctcaactttttatagaaacaaatatcatcatatatataattagcttgttttatatggaatatagtataatttataaaaacatataaatgttcaaataatattaaaatctaaaaagatatatgaaaggtcgtagagttataaaaaaaatggagtgtgtctcatggtctcagcgaatatccgaatatccgtattattatccacatacccatcagaaactctgataccatattcgtattccgggataaaatatcagtatccgtatccaaactatccaagaattatccgctcccaaagatatccatattcgtttttttagagcggacgaaaactatcgcttcgttttcatccctaaaagagagatgaagaatatgtttttttaaaaaaaaaattgaccagtcctcaagtagggagaaaaataccattataccatcgtcataacggggttgcgctataataccattctacaattgggttcgcccgatcgaataccaccttaaaatggaaccaaccctctgtgataccattccacatcgttttcatctaaatcaaaagaatttagtactaccgctggaatctttttcatcatctaaattagtcttagttggctcggaggctagggtgtccggttcccgtcgcgccaatctgggcaccaccctcctctcgcaccgtcgggctgtgccaccctccccttgcaccgccgcgccacacctgggcactcgcctcgcgccgaccaggtcaccgccctcccctctcactatcgcacaacgccgcagccctcccctcgcgccgacccggccgccgcccttcccttgcaccacctggccatggccgtcctctcgcgctgacccggctgctgcccatttcccaagtgcagacaacgaggaggagaccagccacgtcgccttcccttcacgccgccatggcgtgctacggcccttccgtcgcgctgtctaggtcgtcgccctcccctcgcgccaccgagccgcagccgtcctctcgcgccgacccggtcactgcccgttcccctcgtggtagaagacgaggaggagagcagccatgctactacccctctccacatgccggtccgttgccgccctggtactctagctcgctggctagcttcttcgatggtgccacctctcacttcacgctagttgaggtgaagttttgtcatcaaagttgggagaaaatggacaaaattattttgatttactagaaaggaagaaaatggcatttcatcagcgaactcctccatgttaagagtggtattcggatgaatcccaattgtaacatggtattcgagcgaagccccgttttgacgatggtataatggccattttctcttacgtaggagtataccactagcttaacctcaagacctttataagaaccaccacttatatttcggaagaatcttcccatcaggcgtctgatgcctgccaaaaaaaattgtcagtcaaatgttcaagttgacaaacgaatgaaacatcaagttatatatgataaaacaaaaaaaccggcaactgaaatatttaaaaattttgtgaaacatggtgaagatacacattgaaacatgttgtgatcgcatatgaaacaacaagtgttaacaaattgaaatgtatgtttttctttcaacatatcttgttataaagatttaattataacgaatacaacgatgttatcggattatagattggataagtaatttaggagaaaaatcattttgaagctcaataaaatgtatgcatgcatggatgaatgaggtggagagagagagagcagtaacaagtagtttcgggaattttcgaaacacgttgaagacatacattgaaatatatcactatcacatataaagcattgagatttaacggtttgaaacccatgtttttcttttaacataataaaatcaaatgatattttgttgtaaagatttaattgtaacgaatataatgatgtgatcggataaatattttaatagaaaaaatatttaaaaagaggaagaaggaagcagaagaaataactagctgcctactttggatgcatgcgacagggcgtccgatccatcggtagcctgatttacaacattctcgcaatatttctacatattagtgagcatgcccctactagcaaccagtggcaaacctacatataccttcctggatcacaagaccccggatatattactcggacaaacacttgttcaaatttattactataagttgttatattctcggaacaaggaagcaatttttttaatttgtttaatcactgctaacaacaacatatgcttcgttggttagcagagggaccttactatggccctgtattgatgggattaaaagttttgatactaattataaatattaaacgtagactattaataaaacccatccataatcttggactaattcacgagacgaatcttttgagcctaattaatccatgattagcctatgtgatgctacagtaaatattctctaattatggattaattaggcttaaaaaaattgtctcgcgaattagctttcatttatgtaattagtttttgtaagtaatctatatttaatactctaaattagtgtctaaatatatggactaaagttaagtcactggatccaaacaccacctatgacagggtgaggtcatgagatcgattctccatctatgtttacacgcctaaggccctgtttagttcgtgaaaagaaattttttttgtcacatcgaaggtttgatcggatgtcggaaggagttttcagacacgaatgaaaaaactaatttcataactcgcatggaaaccgcaagacaaatcttttgagcctaattaagctgttattaggacatgtgggttactgtagcacttatggctaatcatggactaattaggcttaaaaatttgtctcgcaattttccatgcaaactgtgcaattaatttttgtttttatctatatttaatgttccatgcacatgtgtaaagattcgatgtgatgtttttgggaaaaaaattaggaactaaacctggccttaatgtttaccggtcctaatgcaaattgaacacataggcgtacgtgccaagccattgactaattatagcaagtttaatagtatagccaagtattagcttcaaatcatttatagtcaatttatacaatagttacctataaacatattctacataattaatgtttggtcccacctgtcatacacacatacatcttggaatctatgctacagctggctacaaatttatagtccgttgctcttatctcttttcttttatctccttaaaatatgtttatagttgacttatagggcttgtttgggaagcagttggtggtagctagcttctgagaatctggaaaagttgggttttctagcttttggcttctaggtcattttttggattctgcagctacattttctcagaatctgtactaaaagctacactatttgggaagcttctgatcctgagaaaagctgcagcagctagaagctcccctaaataagctcattgtctactattgtagctgctcttagtcgattgctttgctctcctagcacttcctcacttctagttgtataaaaatttgatgtcaccagtatatgctaatttttgcctattgtatttgctcttatgcccacctaggtaggtcttaagaaccgttgttctcctagcctacggcgcgccatcatcatcatacattgccgtgggttgtttgtgcagtagccactcctatgaacgctccaaaaattagaatcactggcacgctttaattatgctacgttcgtttgatcttaattatatacatgtctaaatcatacacgtataaaatgattttggtcgtttaagtatttaatgtcatgattaacactgccggagaaacccacgtcactcccggttcgcaacctcctttagtcccaggttgcaaaccgaaagggagaatccggtactaaaaatggcgatatttagtcccggttggtaaagatggctgagccacatgatctcaaatgtctttagtcccggtttctatcactaattggaactaaagaggtgatctttagtccctgttggtgttaccaaccaagactaagttcctgatgaggacatcaacaccatcgatacatccacgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctaacggccgccacgacttcatgcgaactccgatttgggcgtgcaagtacttcatggaaagcttatcaagtctactttcaaatggatccagccacatgtccatatctgttctggagcggccgcaattgtcattttactcccgactattttttgtccatggtgctgcgtcacctcttttggcccaatgggctgtgtatccatgttgggcccattaggggcgcgtcctagggttggagcacgaccctatggtcgttcttcccctctttttatacctctagtcgccgccaagaacaggcgggttttgatgatagagatagcttcttgctaccggctcgcagcgcgcgtgttggctaaaccgcccgtctgcctgtaattggaaccccaccatattgtgtttgatagtgaaactttcatctttatctagcaatctcagtgcttgtcctacttgttcttgcttgttcttcgattgcttgcaggacgagtgccctcgtggctaggttgacgcgcaccacaagttcgcggctaccattggagacggtgtatcggttgctaaggtgcagcgtctttagacagttgtagtcgggccgtgaatgtcgacttcatctaatcgagttatcccttacctctcatcgaaagatcgggccacaaaccctagcgggttcgcatcagttccccagccccctgataggggtttgacatgccctgtcaaggggcgaaccgagactaaagatcacttagtcccgtttgagttataaaccaggactaaaaaaacctctttagtcccggttctttatggaaccgggactattgtgcttttcgtccgacccaataaagatcagttctccagtagtgttactaaaaagagtgaagtatccctaaactagtgcgagtgtgtcatgtaggtacctgaactcttaaaatgtttttttttcaaacttgtcgtgatcgatatcatataggtccaaacgaactcaaacccactctatgcgctgacgtggcatgccacggtgacgcctacatgttagtcgggcccacgttttatatcacatagaaaaaaataaaattagaaaaatatgttttcttctctctactttagaattattttttttaattttatattttttcctctctacctaagagggaaaaaatatgttttagttttttttatatatgactaacatgtgggttccactgacaccatggcatgccacgtcagcccatatagcgggttagaaataacgtctaagattagttcataaacccaaagatgcaatttttaaagtttagagatctagataacacacccttacaagtttagagactactaatgtattttactcaagaacaaattaaatctatgtgcgtttgcttatgctttaaacgcatacgagaatcagaattttgaccacgagttatagcatttttcttctagaaactagtatgcctcttgcgggagttgcttattaactgtttgacactactaagatcaaactcatcttttatcctcaaaccacgaatacaacggatgtattaagaaccggtacttattatcggttctaaaagctcgagaccaaaaaaatatctttagtcctagttagtgttaccaaccgctattaaaaatacatccttagttcctgttggtaacaccaaccaagactgaagatcgaggatctttagtccttggtggtgttaccaaccggtgttaaagatacacttttagtaatgcttggtaataccaactggtgctaaagatacttaccaaccagtactaaaaatgcctctagagttagttaaaaagaaaacatatctattcaaatcacatgtgtgtagtaggtgggatggtaacacgcatgagggttgaggtgagagatcttgagttcaaatcccacatattttatgacttagtatatatctttagtaccgattccttcaaccgaatcaagaaattcagtctcagtttcttcgtctcggttgctacaaccggattaaataggagtttagtaaagatcatatctctactagtgtgatgaacccacgaacaatatagaaagaaacatattttagcaacatctcctcctagtataacgatggtccagattaggttagcttttttttttttaaggacggagggagtactattttttttattgcttccttccattcactgggaaagcctagaaacaggctggggttacaccgttctgcgtggaactatagatgcccaaatgggccgtccggcccgacatggcccaggcacaaccaggcctgagccgaggtcgggctgggcctacccaggggctgcatccatggcccaggcatgacaacccatcgtgcttctccatacaataagtatatttttccttcctcatctctctagacattgccttataaggctaggttatgtctattttgggtcccgtaattattttttctttgaccgtgtcgtgccggctaaccgtgccaagacatcggcccaactatcaggccaggccggataggtctaacacccggcacaggtataagaccagtagtgccacgccgtgcttgggcctggccaaatggctgtgccatgggccaggtcgtcgggcctcgggcctcatggcaatcgaacctcgtcgctatttcgatgccgttgtcacaatgtcctggttagtcagtctgttggcttctttggaaggttctgaatgacaaacaaaccgtgttgtcgttcctccaaatttgtaccgttttccctcttcttaacaaaaaattgggtgttctaaaaaaaaattgggcggcaaatttgttcgccggcggccggcccgaagcggcgaaaaaagaaaccgagactgttttcccctctgctggacgacgacgacgatttgatcatgtcgaacttccatgtgatgtcatcaacacgtactcacctggctaccttcggtgatcaccatcacaacagcatccagcactttgccgcgccggaatacccatgaagtcgttgggaggtagccgtcagcacccaccctcactttcggcgaattgtccaggcactcatcaggcatttcagctaacaagctgcatatacaccattatatatcatcctcatctgcttattgtaatctacaagcttattatgcacattcgaattgctagctagctcgtcgaagaaaccaaagtgcgagcgatcggctagctgctgcaagaagccttgaccatggaggccagacaccgtgtgatgtcgctgctgctggtgctggtgatcggctgctgcgcctggggctgccgccctggcgcggcgcaggtgcccgtcccggcgaggacggacgggttcgtgtacggtgggaaggcgccggcgctgggggagacggtggtggtggaggcgtacttcgaccccgtctgcccggacagccgcgacgcgtggccggagctgaagaaggcggtcgagcactacgcctcgcgggtgaccgtcgtcgtgcacctcttcccactaccgtgagtatacctatatgttgatatatactaccgttcactatatgctatatgcaaaattcttgtgggacaaaatctcaaattagtgcgaataatgtttagtatttataaatatcttagtctctaacaacataagttgttagtatcctgaattccttgttcatagtatcaggtactacgtacgatcctaccgaatcaaaacgatactaattatgtctaatatactaattttctctatatccaatcttagtttcatatgatcctaacggatcatacacatgtcgtatcttggtcactatgatcactatttaaaataatatggattgaaaataatgtcaaaattaatgttgtaggatttaatttatacaacatattacaaatgttttatacaaatatgtaatttttaaaatttgataggaaattttttttacgttttatcccaatactaattactagcatcccgtttttgaagcatcaatatatggtagagttgtaattttcagacttaactgaactatgacgtacggtaaatcttttcaaaatcgcgttgtaactatgtgaaatttagctgaaacttcatataggggaggagtgaagcgagtggaagaagagtctgtgcatgaatgtcatccgagacttgaccaagttgtggttatccatgtattaaggacatccgaaaaactaaagttagtcttgctggtttcattatcaagaaagctactcttgtgacttctcctttttgaaacgggccagatggagacacgttaacattcaaacaccacttattgtttcgtttgaaaattaagaactccatagcagtgattgataacaatctgcaactaaacttttacacagaataatcaagctgaactgagctgtagttacctgagtatattatcctaagggtaattttaccatctttagacaaaattacccttaggagaaattatctggaggtatcatgtttttttagtgtaaaactttggcacctctaagtactaggtagtagcctagtaggtgtctcaaggtaccaaattttagtgtaaaatttagttaccttagatattttatcaaggaccataaaaattctcttatcctatccaaacgggctattagtatttcctttcctttttcaaatgcctgagatacagccagagaacagataacactattggaaaattcataataatatgtaaaacagaaacatgggaaactagcaaaatatattgttttgtcaccgccatgtaatggcaaattaattttgtggattaatttccatcgttgagaaaaacggataccattggaaataaattaaatgcccgaatatatgctccctccataaaaaaaaaacttaatcaatatcctaggattaggtttttttttatggagagagtaaggcacaagcaaaggtagcaaaattgtttcctcgccttgtaaatggcagttttttttgacaggccttttgtattttaaatgtgaaattatcccatcttatctttttaaagttacagcgcccaatccatttttattatcaacatgaatagactaattacaatcgaattgctttatgtcagttgccgatctttataattggagattacacaattctaacaatgagaaactcaactcaaagtaaaattgacgataagaaaatcttacaatcaagaacgattgccaaccaaaaagttgcctgcggatgggggaaaaaaataaaagcaacaaaacaagtagcgctttgggcttggtattagtctattcgttcggcccacttcttttctatttgcacaccgcactcaacaaattgtattggctcctctagaaaacctaattatttaggcaaaagaaacagagagataaagaattggttctgctttttcctagcacaaagcgcctttaatcttttgtaaggaatatattatataggaatatatatgttatgaagaatcattcggcggcaaacttatgaagccacaatttggtttcatttttattttagataaacaaaatttcatctggaaatatcccgtcaagtaacatgtaataatctaaacgtttcagccattaaactaggctttgttctacacctatattcaattttgaactcacagaagtacaatttactgaagtgatacgctattatattattcaacgaatgtggaccactatatctagacatgataataattctaaatgaaattccaattttcatcttttacgagaaagaaaaaatgtttagtgcaccctgcaccaggcattttgtccctcgttttactacgcatcaagtttaatcaatatttttattttacaccactcttgacgcactgtgttgtttgacaatagctatttaattaggccatgtctgctaccatttgtatgtattttcagcttgaataacagttaatcgttgagtagcatagcatgcccaagacacattgccatggtaaattcatcacaagtcattatttcgtaattattttctggttcgttttgctctttgcaatgtgcagttatcacagcaatgccttcatttcctgccggtcaattcatgccgtgaacaagataaatccgtcgtttgtgtatcccctgctcgagagattcttcaagtaccaggttatgtcctctccattcatcattccgatagtgtcattacggatttacataatgccgagagattgaacagttaaatgtcagaaagaaagacatttaaacagttaagttgagatattaaaataggtaaggtaacataaatatttatgtggagaatagatcaataccagactcgatagcagtttggttacagtcccggccgatattaatttcctatccagccacaattaaacttccacaagatagtaattttggtaactattatcttaaaactacaggagaagtaatatttccaagacggttgtgatagttatcagagctaatcttggtccgatcaattccattttatatctgttttttttttcttgttaacagcagaattttttttgaatgtttaattagtttattacgtagaaaaaccgccaaatgatcgatcagacagcatgattactgaatatcacaacaaaatataatcgtggacttcttgtctccttgcaaactatagcatgcttaacttggtgacccacaatctcacaagagatcaattggaaaagaaatatgtccgcactcttccttttgtaattttacatttaagttatctcaaaatagaatattgatttcctcatagttttcttttatttcggaagtcactacttccaattaacgtcagattattattgatcaggagggttattacaaccagccaacgtatgggaaaacaagagctacagtggatgcagaggtagctaaaaaccttgttgcccccgtcattggggaagccaatttggcagcatacaaagcaggtttcaatgattcaaaatcagatcaagccacacgaatttctttcaaggttagaatccatgtgctcccagagaaaactaatttcattcaatcagattgttcatatatactccctccatctctaaatatttgacgccgttgattttttttttaaaatgtttgaccgttcattttattcaaaaaatttaagcaattattaattcttttcctaccatttgattcattgttaaatatacttttatatatacatgtagttttatatatttcacaaaagtttttgaataagacgaacggacaaacatgttaaaaaaagtcgacggcgtcaaacatttagggaaggagggagtattatttatcctggtttaattatgtaccttttccattttatcttcttgttagtatggttgcgcacgaggtgttacgggaacaccgtacttctttgtgaatggcatcccccttattagtgactctggttccccactggaatacaacaagtggaaatcaatccttgatccattggttggcaagatgtagagagtgtttcaactaaagtcctctgcctggtgttaaatacaagactcaagacaaataagcttggcgcaaaaacagtatgatttcgccaagatatagatggaacgatattgatcacaaagatcaagtttagttaggcaaataaaagggcaaccctactctaatgacatatattgtctttaccttgtattatgagacagaaaagaatttctataatacaaaagagatgtagctctcacatacaatggtatcccagtgtgctaccaacaagacttgtatgaaatatagtatgcattttaagatttcggatgttatgccaaactacattgataaggaagcagtgttacattccttggttttcattatccatatatcttttagccaaaaaaagtaattatcagaacaacacaaagaatataatctgaggtgagcccacgccagtacagaaatgggccagtagggaaattggcaccgatatgggcaaagctgcaaaactggcagtattctgattttttgttttacaggcaccaaaaaagctctaagtatattctgaagggctatccctgctcgctcttaatgagaaggggctagttacaaacccatttatatacttgtgatagccaaagacaaaacgtactatagggcaagccaaagacaaaacaagagagtttgggaagaaggtagtcctgtctgacatgaaaacgcactattagttatctacttcctccgccctaaaatatcgctaggatgggatttgaaatgggcggaggtagtaattcataagcctttctagaatttaccttcaaatccgtgtgtctttcaaaattttccactaaagatacgaattgttttattccgtaccattccatcaggttgatagggccaaccgtcatccatctactaccaccgtcatcctagctgccaattccaccatagctgtggacaagccaatgggccgactagctcctggtgttaggaggatgaggttgtcgccgtcatcttcaagcccaacattaagtggctgacctccgtctccgtgtacgccgatccctttctatcgccttcaactagttcaaggtcgaaatctcctcccctctcaagtgctttgtcagactcccgcacggtgctgtgcagccactttcctccacatcgatccctccgcatcatgctcctgcagcagcatgctctcctgtctcccacactcccacaagcgaccacttcctcatgctctcctccttctctgttgtgcacctctactccgcatggcactagacgtcggggatggtaggacttcgcaacagccacacctcctgccattctagagcttgagcaggtggtcctcgacggtgcaaagctctaggtgatactgcacgccacggttccaaggggaagactgctctgcacatggcagccacagtggggaaggtataggtttggggggggggggcactggtcgatgcagatgggtgacaatgccacgactaatgattcagtaggaccactcatcccctctcaacgccacatgtgtcatgacgagtgtcctgagccatgtcatggagctgactataagatcaatgtgtgttttgattcttattctgtgatgaacaattggcatctgtgattattggttttgatatttggagattactatcgaagtggtttttggatatagctgttttgtcggttttgttgggactggtcagaccgggcggttgttgccggtcagaccggctcatgtgtagcggtcagaccggccggcccgcggtctgactagccgacgctgtgtcgatttcggttttgggttgtttctttggatatccgtgattgtttcatggttatggcttctagatggatgctatacgtatgtaatactattgtttgctaacaatgagtcaagttggggatagcttggtctcggaatatggtttctttgtttgtttcatatgtaggtgactcgatgcctcgggagagtatttgcagtgatggaccgggagtcggcttggtggtaagacgatgtctgtggtggtcagatatcatgcgggatactaaggctagagttgatgcacgtggttggtgaagattccatatggcatatgatggaggtattgtgtgcgtatgggatgcggagtcgaatttgaaaggagtccaaattaggtatgattggttatgtaaagtttatgtcttgtactagagggtttcctaaggtgtttaggactcttagtatagtntggttcgggcttaaggctgcctacctcatgtataaatagagggggagcgtgaggcttcccggtatcgcttttgtatcgcttttgagagcaattgagttgctagtttagttagggtttcgagtttagtcgagatttttgtaaggagtgctgttggtgcactttgtaaacacagagagaagcaataaagttgtcatctacttttagagatcttcgatttgtgtttcaccgggtttcggcggtctaaccagcaactcaccggcggtcagaccggcggcaaggcggcggtcagaccggcgggagcacggcggtcaaaccggtggctgcaacaggcgcggcaggcgacatcggcggtcagaccgggtgatctatactggtcagtccgggggcatccactcggtcagaccggcagatcaatctcggtcagaccgacttccgtcgaattcgagggtaacttttatttccactaaaagttttcggtttttggatataccaaccattcacccccccttctggttggcttagttcttgtgattcaatcctacaagtggtattagagtcttgttttcttctttggattttaatcgatctagagtttttgccatggctactcccactaggttttcaactaagcctcatgttttcgatggaacggatttttctcattggtgtagtaggatgcaatcttatattatggctgaagattatgatatttggagaaaagtttctcatccttatgtgattcctgaagctattaatactgatgctgaaaaaactgcttttgaataaaattgcaaagctcgcaatattcttttgagtggtatttctcgttcagattatgatcgtgttgctcatcttcaaactgctcatgagatttggactgctttgagtaattttcatcaaggaacaaataatattaaagaacttcgtcgtgatctttttcaaaaaggagtatattaaatttgagatgaaacctggagaagctttggatgactatctttctcggtttaataaaattttgagtgatcttagatctgttgattcttcttacgatgctaattatccacaatctgagatttctcgtcactttttgaatggtcttgacatgtctatttgggagatgaaagttacatctattcaggagtctgttaacatgtctactttgactttggattcgctttacacaaaatagaaaactcatgagatgaatattcttgctcgtaaagttgattctaagtcaagtgctttggtttcttcctcgacttctttggatgttggtggttcttcatcgaagtcttctgttcttgctttatttaatgccatgtccgatgaacaacttgaacaattataggaggaggacttggttttgttatctaacaaattttctcgacctatgaaaaatgttaggaataggaaaagaggtgaaccaaatcgttgttttgagtgtggtgcacttgatcatcttcgctcgcattgtcctaagcttgggagaggcaagaaagaagatgatggtagagtcaaagatgatgaattgaacaagaagaagaacatgaaggagaaggagaagaagaagcattgcatgcagtggttaatccaagaactcataaaagtttttgatgaaccggaatatgaagatgagggcaaaggtaagcaagttgttgatttagcttttattgctcgtaatgcaagttctgatgttgatgaatctgatgatgataatgaagaaaagcttagttatgatcaattagaatatgctgcttacatatttgctaggaaacttcaaacatgttctattgagcttgatgagaaggatcatactactgagattcttaatgctgaaattgctagattaaattctttgattcctaatgatgataattgtcaatcttgtgaagttttattttctgaaattaatgctttgcgagatgtcaattctcttaattgcaaaaaattggaatttgagattgaaaaatctaaaaagttggaatcttcttttgctcttggatttgctttacatgcttgtgttgttgatgagttgattttgacaaagaacattttgaaaaaaatacaaagttgctttttgtgcaagttctttggtcaatgcttcatgtgcaaataaggcaaaacaaaataatggtgttttgatttctcaagattgttcaaagtgtgttttgaatgagttaaagttgaaagatgctttagagcatgttaaacacatggaagtaattgttaaacaagatgaggtgttttcttgctcaacttgtagaaaacaaaaatgtcttttggatgcttgcaaaaattgtgctattcttactcaggaggtttcttatttgaaaagttctttgcaaagattttctgatggtaaaaagaacctcaacatgattcttgatcaatctaaggttagcatacataatcgtggtttaggttttgattcttatgcttatcatgctagacatcctcctaatgttttgggtgttgctaggagaggtgaaattttgattgaaactgagcctaagaacactgtgtttaaatctgctggcatcatgtcttctttgaatgcatcttcttcaaaatcaaatgttgtgaatgcaaaaccttctgttgctgcaaaaccatcaatttcaaaaccatctacttcacaagtttgtcgtgagaagtacacttgttctttttgtggaaaagatggacatttggttggtttttgttttaga

SEQ ID NO: 65575 - DNA, 28518 bp, Oryza sativa
tactacctcaaacaccttcctttttgccttctcagccactgacttcttcccaggactcatcactttgggaagctggcaaatagggggagaaactacatcatcccagtctacacgagcaattgtatcatcctgatcaaaataaatcacaaatttgtttgccctgttaacaacctttgccattacttcaaagtctgcctgtgtttctatcaccctaagaccatcttcaagagttttgcctggtagcaaccaatatgccttgaagcctagactcttatcatacccaagcatttctaagaaaccatctaaactaacagcacaccaagtttttgcctcaacattatcaaaccaatccatgttctcatcttgtatgccctgttgctaccatagccaacaaagaaacccccatggtgtatctcagcagtgaatgtacccgaatccttagctgcattacaaaattggtcttcctaattagcaaagattactgctatgatggctgtcaccaaaaccctaaataatcaacaaaattcgaccacagcttccacactcgaaatcatcaaataaatagaccacagctagcataactaccacccatctgcaatcaaccaaaaaaaagctcaaattttgggtccattgtacataccgtacaccggcggcggctctcctgttagccggaacaacatgcctcctcgccggcttcaacacctccgggaggccagtgtctctgcaccctccccgcaacctctcaatccctatctcaccagtgatcacagcccgcaatttctccggcgatcgcctctgcttcgctgtccaggggagaagagagtagagaagagagggctaaggtttggagaattcgagggaactgaggggcttagatttaaaaagtgcacggtgcggggcggtgcggtgtggcatcacacgtgtcgcaacacgttgctgtccacgtatgcacgaaacgggtcaaagcgttctctagaccggattgatacaataaaacaagattagtgaccttgaccccgtgtttgtaagttcatggacctggatgaaacctcctcacaagtttaaggaccgccagtgcaatttactcctaaaagaaaatggggggagacaaacattattctttctgctatgtacaagagacaatccaatattttttctttgagtatcgtgttgcttagtttgtttagagatgcgtgttttttgcttttaatatccccgcaccccgtaacgccaaaaacattttcggtaattagcttagaggggtatctaagtccattaagaagttgattctaatcggagctagtgctgtatgtaggtccaaaaacattttcggtaattagcttagaggggtatctaggtccattaagaagatgattctaattagagctagtgctgtatgttggtcaatttggcgttgtcacaatgataaagtttttaatggtaaacaattatctaaccctatgtaggttatcttcatgtcttcctactggctccacttttggtctacaatgctaccacaggaggagcaggatactatgcgcaatggtgctacactcttggaatcggtagccaagggtctcttattccactatgggtggcgttgttccataagaattgctagctaaaatattttatatggttgaacgctagtcaataataaaggggagttggggatttgtcccatcaccttatttctcattttgatttacttttatcttacctttttattactattaaacttatggctgtgtgtcttatgacagaagccggagatataatccatttccattatctaaaaaattcatccacttcatcgatcctgcaatgttgtaggtgggtcattactctctcatccctgtcatgctgatcaattatctcttgtctcactgtctcagctatatatatgaacccctcccgatcattattcacttcccttaaattggcacaaaaaaaaagacacaggggttggagaacacaaaagtcttgagacgctattttttttaatcgcaatcttttgctgatcatccccataggacagcataaactattcctgctttggaatgggtggcatcaggaattcagaatcttgccattgcctggtgaatcctgcaagagggagcttcaagtaacctgccacgttgagtgtcctctggaatacacatggcgacaacaaggagcccgtgtcgccataggcgatggtccgccatgtcctctcgagtgacgtcgtgtacactccgtttcttgctgatgcagctgctggttcaccatgaggccgcaggctcgcctgcaaccagatcagattagtactcctaccccgttctttctttgtgttaattaccaggaggagatatttcttttatgggtggattgggctcaatcggagattataatgcgacaagcaaccccacctgaacaacaaagtttttcagcccaacttataacttttcagccctgtaatttacactgattttcgttccaaaacttgtgttccaagaaggtcctgagggttgttttgtttccaagatattagttactatatttgttaaattctgtagtaagtacttcaggatagaaataactgctagattaaccaacattgcaggtatctgcatggaagtacaatgtgcgggactgaacaatctagggtttaattgaccctatcctatcaattaaacctaaggttttggtttaccagcccagatggtctgccatgtgagctgcctgtcatttcgttcagcctttccgtctcacaagcaatccctcatctccattaattcattgatccattaaacttaaaggttttggtataccagtccggatgatctcccacggagatcgcccagtccagacattgctacgttcgcattgtagaaactacatgtggagattacgggtttcatatatccacacagacggcttattcgactgcgagcgcttaagccgtctgcacgtgctaatagaaaatcgcaaaaaaaaaattccagaaatcaaaaccctagccacagaacagtaacctagaaaccgtcgccacaaccaccatgtcgtcgcccctcccaccgccactactgccgtcatcacccctcccgtcgtcggcggatccatgtgcgggagggggagggggttccccgattttgtcagcggctgatccgccctccccgcggtcgccgacgatgaatccgtctgtcctgcggtctccggcgacagatcggccctccctgcggttgccggcgacggagccacccgtcccacaatcgctgtcgacagatccgcgcaccgttgtcgctctcgtggatgggaccggccgaatccgcgtgctgtcaccacccgcccctgaggctgcctccgccgcctgccaaagagaccttcgtctctgcatgccgccagagcccgcctgcgaggccgtcatctccgccttagccaccggtggtggagaagagaacgaggagaggaaaggaaaagatatgaggtggagtgggaaaggaagggtgagaggagatgtggagtgagagttgaacgggaagagagaaaataaaaaggagtgaaatgtgtggtagagacgaggaggagaaaaagggatgcggggacacgtgtggcccacttatctccgagttgcccgcatgcgaaaatgattttcacatgtggttctttgataggcccgtctaaaaaatatccccatttttgcatacggctccttaagatgtttgtatgtgaaaatagtcttttccatgtaggccacttaacgagttgtgtgtaaaaataaaaataaaggtcgatttttccagacgtggacacttatgacccgtttacaatatattagggtgctcttataggaaaatcatttgtgtagtagtgtatgtaactatataaggaaatccatgttatgtccgattgggtttccctttgtaactttgcccccaacctatataaggagagcacgaagccctccaaggacataacataattaggtcatcagattaatatacatccggtggatacaatagccaaacaggagtagggtattgccattaatcaagacggtttgaacctatctaaatccttattttttttatccatttaattttaagtctcgtgcgttaccacttttattattgctgattttcagaatcgacttaccgttctctaaaccgctagatttgtgataatttgtgcctgcccatatccatgtgccaatgagcgtcctgtttgatgtacggttggtctggctagacatcgctcactgtgctctggaaacatcgtaggtgcctgtgacctgcctatgatttcgttcttccatctcacacgcaatcccgcgtctccattcattcatctttcgatcgcgcctctacacctgaccttttacggatttccgtcttcgtctgtgctcctccaccggcgtctacctgcgttattcttgcttctcgattatgtagctaggctctagaaccttattgtcaagctatcctgaaccttattgtcatgccatcatgccggccgtttgaatataccagcacatggcagggtcctcatccttgcaatttctagataagtatagacattcatgatgtgactttgcagtagtagcagcaaagtcacatcagcgttcagtagctattcctgcggcagtgcttgtgttgtgcagctgcagaacatgccagctgaacaatagaagagtagcaatgtatagtagtactactagtttcaagggttatcctcctataaaagcagaagatctctgttgttgtctacttctgcacaccggctgccgtagcagcggaccccccctcccctcgaagggggcgactacgactggcgcatcactctcctccaatgccacgccctcgtccctcatacttcttaggtagcaagacaatcaatatttcatgcaaaattaaaacatgtcgtcttcaccttcactattggcatgggacatgataatgacccatcaatgtgatattcaagcataaattggattgggatatctcttcattcattaaactgcagatcaaaatattttgagtaaattgtgctttgcacaaggtagagtatcctggtttactttgcaccggatcaggatatactttcactctacatttgggtatcttgaaataattatcactctgtaaagaggttcaccatataattgaagggaaattttagaaatcaagattgaatctcctggaactttctgaccttcgacttgtttcatgaaatttcattcagattttatgagaaatttctatatgctaaacttgatacaaagtgaaacatggtgagcttcatccaaggcaaagttcaatttaaatcaattcacttcaactggcagtatatatgttcaaaatttctctccgtttttttgttctggcagtgcttgatattatctttgttagatataatttaaaattttccattacaatatgaaacaaactaatggttcttttcatattttggttagaaaaatacaatatgttcagagaaattaaaataaaaggaatcaaggaagcaaaatatctacaaattgaaatcaggtaaggaaaagccagagaatgggactgatgaactccaagatttgttgctatgaagttccaggttcaggatcgtaacgtccactaattgcaattactccagaaaacagggaaactaaggtagggatgcatctacaatcgccacaataaatctacaatattatgcgattgtggccaaattcggcattgtcacccctaatgacaaaaggtggtcagttctttgcccaactttcctaactcacctccatcattttccgtgcgcattcttttcaaactgctacatggtatatttttttgcaaaaagtttctataggaaagatgctttaaaaaatcatattaatccatttttaaaaaatagtaaatacttaattaatcataagaaaatgcgttactccattttccgtgcggagaaatgagttcccaactcgacataacgatctagcaaagtagtactctctccatttttcaatatatgacgccgttaacattttaagatacgtttgaccattcatcttattaaaaaaataatataattattatttattttattgtgacttaatttattgtcaaatgttctttaagcctgacttaattttttttatattcactcaaaaattttgaataagatgaatgatcaaacatttgtcaaaaaaaaaagtcaataacgtaatatattaaaatacagtggtagtagttgctaaaagttacacattttcgtgcaatctgattacaacattatatgacccaaagcaaacaacatgttaatgactacctagctatatataggatcaagacccataattatttttcagtgaaaagcatgttgacatattcttattatccactaagccttaatcaaagttgtttacttattgtaggttgatagttctaagtgcattgacgccatattggcatacatgcaaagttgtttacttatgcacatgaacaattagaatatttatgcattgaagcttaaatatatctacctacaaccacattatttcttttagaaaagttataacttgaagttacaacaaatatgtgggtttcacaacaactattttataagttttcttatgattggcgtgaaaagggggaggaatatgtgtattttgcaaattaatttcagaatatttgcaataaagaagcagaagaaattgtagatatgtggcaggcaaattggtgtgttataggtcaaatgctagaagcaaaaatagcacaaactattagcgaatcttatttgggataattatgaattattgtcacacaacgaagtgtgttatttattggccattgaaaattgcatattcatcgaggaagtatgaaattgcatatagctatttgaaagctattggtttacttgtagtaaacaatatcctaaataattaatgaccctttggattcgaatgattctgaatgatcaaatgacaccacatttactttggcgtaatgaataaaagttagacatgtcacccaattaatttattggcatattcaagaagaataaatattctcgtagaataatgtttgggtgatttgaaaagttccatgatggttaaactatgttcatagattaatgttttagtgttatagttatgttcttgaagacatcatgaagttatataatactaacacatccatcttatgatcatatctatgttgcatgaatataaacatgaagtgtattgatccaacttaattagagaattgaatatagtatgagtaattggatcaagtcttgggcaaataagaaaaaagctagaaaatagaggaattttgtcgactagtggatatttgtttgggcttcattgtcgcagaataataaccctctatgacttgggataacctacaatattagggatgtgcaatttttcatgccattgcattaatttttatgttagctcactgcatataatatctttaccccctttattttgtataagtgcatgttcaatgaatgaacatttccctcatatatcaccaccatagcatacatatatgggcctccacatgaagttggggatacaaatggaccgaattccattaatccagtgcctatgataggggatttttgtgatatgctattagataaagatcgaatatcagcatcagggggagaaaagcccatgtgttaaagatgccttatattttcaagaagaaaaagatctttataagtaagaataacgtacaagccaaactaaactagaaggtttagtttattctcgtgtaagccagaagcggaagcttgctagataattatgaattaaaggagtaatcagaagttatgtttacttgtagtaaactttctgctaacagtggtataccccgggttttgaatagtatatccacaaatgcagagtgacatgttagtcaatgttctaaaatctacgggaacacgtgcggattctaagatctaatgactattttcaatgtacccattaataactccttacaactcttgtagagtaatcaccatgaaggtgaattgcctcatgaagaggttcatcatgaagatgaaaacccagaacgcacatctatctaattctggggtgcggaacaaccatacatcttatgtttggaaatgactaagatattgtttataatgaattaacttcacggaatgagtatgtggagaaaataatagttgtcgacaacatcgcctctatgattactaatatttctctaatgagaatccggatccggaaccaaagtccatggcagagttgcatagtagcactcatatcaggtctattgaagaaagcaatgaggttgaaccatagtcgctaaataagtctatgtgaacatggaagttcagacttaataggaaatgaagtggtgaaaagcgacggctcatttggtcatggaaaagaccgatattctcctactatgaatgtattaaattccactatatatatcgctggcaaaagtcatgaatgaataaatgatatgcagtttatgggttatgaaaatccatatgaagttttcactagaaagaaaacaattccgcaacatatatgtaaatctcatactaattagtatcatgaagcacactatattttcatgaagagaattgcaagactcgtagaagagtttacgatgactcacgaagagtttttctcctagaagcgagaatatttctcatagtagagaaaatgacttccggaagaataagttgatccccgtaggattatggtaatgtatgaattaccggttaatctccatataacaccgataactcgtactcccatgaagtggacagacccgttcaaacgaatgaataggaaaatcacatccactagcttgcaagtggattggtagttttctacatactataaaggtgtaagaatttatatatcatgaagatatacttattgatggtatttggcattcttattaattcccctaataccaaaatatagaccgttttatgtcactctaagtggtttaagctaattgttgaagattagtgaaacaatcaaattggtaatgatgactgataaatccaccaagagaaagttgcataatatttaacctcttgtattgagctaattattttatacataccgcatatgtgtatcgttgcatcttattttcccataatcctccataaggattaaactttgtttgtattgcacatttgaataagtgattatacatattgctcctatacgttgatttatttcttatgttcatagtagaacttatgaaataagtaaacgaaagattaaacattgtggtaattttattatcattgttttacacattaataaaaatatggttatgacattggaacatggaagtttcaacggatgtcttattgagggggagcatatatgctaaacattgattatcatacttaagacttggaagtcctatatttgatttacaaagaattaatcaaattaatcattattttgataatttaccttgaaggttactaccactatattgttgtgttaatccaagttgattaatataataaatcatatagatcattagctatttatgaagaatagtcgatattaaagattatgcgatcaagaagatcgtgtgttgtactctttttcccttagtgagtttttactagaatatttctcacgcaaggtttttaacgaggcaacaagtgcaatataactagcgtgtacgatgtactcttttctcctatctttttctcccactgggtttttggacggagtttttaatgagacatgtgtatagcgcggtattcgcccaaggagtgttatgaaactattatctcctgccagagataaatatgggctcataccaaatatatggaaacgtatcctaataggactcttcctaatatgggtatatatactgagagagagggcttgagtggttggttgatgtatccgcatatggttaaagcaataaagctgtggtgcccctccctatatccgtgttcatctactatatgattgtgtgcatgagacgtcgtctactactctgaatcagcgaataggccactagttatttaacaagtagctactcccatgaaaccattcatcacttcatcgatcgtgcaatggtacagggtgggtcattactctctcgtccctgtaatgttcatcgcatctggtctcactatcttagttatatatatgaacccctcccaatcatttttcagttcccttcaatttggttacaacatgccctcggctgcaaaagagactttagggttaagcacacaaaagtcttgagagatgactttttgtaatttcagtgttatgaacatcccaataggacaacacaaacagccccggctttggaatgagtggcatcagcaattcagaaccttgccatggactgatggatcctacgaaaggattgtgatggcctccatgaagcttatggttcacgacacagggtggatttgcccttgacaactcctgtcttttctttgtggcattaggagatatttactttttaggtaggctaggatcaactggggttgtaattatagaaattaccatctaaaaaacgttctttagcccaactggggctgtcatgtacgttgaatttaggtccaagacgccttccaagcagataccaaggttttttttttaagtaagacatatatattgaccacattatcatataactagatttaagatgatgcatcacaaaactataaatttaacatcaaatttataaaaaaaacatatacatttaaggtgaaatatgacaaaactacatatttcaaatgatcggctcttcctagaggaggcgcgggaaggggaagatttcttcggtgctgacgagttcacgttctaggtcgatccgctctcaggcaacacctgtgttgttttgttattttatcttatgttgggtatggtttttctatttgtagggagtgtgtcgttgtaagtttggtctatcggcccctaaaacctactctaatatactcatatgtaatgtttttatgtaaaatctcaaatatatgtaccgaaagatattttgtttatcaatctgtacacgatcaaaatcctggacgatcatgggtgatttcaagataccgtactcaaaccgagtatccctacagttttgtactccctccgtttcatattataatccgtttgactttttcattagacaaatttctttaggtttgactaagtttattggaaaatttagtagcatctataacatcaaattagcttcattaaatttaatattgaatatattttgataatatatttgtttggtattgaaaatattaatatgtttttctacaaatttgatcgaatttaaataagtttgactaagaaaaaattcaaacgatttataatatgaaatggagcgagtacaattgtagcactaaaattacattaataaactttcatattgcattcatcgttcacccctacagttgcagtcattgttgcgtggaagatagatgtagtataagggttgcagtggcagtcattgtccagtaaatccccgtgatcacgcagtagtaccattaaattgcttcaaccaatcatcctattcatattcatcttttctactgtacataagaactgcgcagaaacatcccaaaggacattgatgctctttgttagacaatctcgttagcttggcctgcatctgggcatgactaaggaatgagaggcatagagaagagaagcatcggtatccacccgttaaagcaggaagcaaatgatgtctagctccaaccatggatggcgggctggctgctggggacaaaccggctgggaatttgattcatggcaagctgaagctgaagacggaagacaagcagatgtggctaatgaacgaacaacagtgctgtctgctgtgaggagatgttcgttgatgcaagaaaacctgaggctgctggtggctatcacacttgctgttgctaattctttcatcaatattttggttgctagttggtacaaaagatatcgcactacctgaaaaatataaatacatgctagctagcttagagaactgggggtctggaaaacattatgatcgtctccagtactgccactcttcatatttcaccaacatatgagctcttataaactatagcatgatgaagagtggaggtgctgtacacttgagttctaataaaggtcgaggcccccatcatttggcttattaagtgaataagaaacggcatatttacaaataaaaattaatctgtaacctttctttcgtcttctccgacgagaagaaaagtcgtgcagtcctcaaattatcccaacacgattgatatttgttcatttctaatagattcttgattagtttttgggacaattgcttatttgaccctattttaaagcccaactaccaatttgaccttactttttcaggtttgcttatttgaccctcttttttgaaattgaagtttccgtttgactctgtttagacttcaccgttggaacaacatttagaaaaaagaaaaaaaaaacatactaccccaaagtgacaaaaatacccccatattactaattaaccctatccccacctctccatcccaaattcccaatccccacatcttcagtttttagtcgccggcgatggcgagtgctgcggccgacggaggaagcggtggcatcggcgcgcaggaggaaggagcggtgtcggcggcagctgccgtgcttgaagcggacagagggagcggcggcgccggtggctgccgggctcggagcagagggagggagtggcgacggtggcgcgagggccctcctcatcgccgacccaacgcttccccttgttaacgaccaaatttggtaatatcagcatcggaaaagaggattagatcgaagtggagtcgaaggcggagatcgattcgagaatagagcaagaatcggctggagtccagatcggctacgattaggatcggctggatccgagtcggactgagtaagttgatatagccgattctgataatacgacttggtatacgatatcaggttgaattaagatgcttcaagatggttgccgcacatggatagagtcttgagaaggcaattgtatctattaattaggacattttatgtaatttccttagagatatgtttagggaaaaagtctgccgcaaagacttatggtatcttagagtttgttagagataagagtcgtgtccgatatggacatagtttgtaattttcgggtataaatagaccccgaactatcacgcccagaaattcccgaatagaattctaagtagaatgtgcattaaaatccccgtccattaccggccggggtacacaaacgacaaagttaacatatagatccacgtcttacaaatattataaaagtcttacataaatgcagcggaaaattaaaagataactggagctaagccttgacttggactgcagcgggaacaccactccacaggcattctcgacggcacggacgaagcctactcctcagagaaaccaccatctgatgcatactcaaactctgggggtttggggaaaataaagcaagactaagtacaaccaccgtactcagcaagtcataccggaacagggggtatgatgcaggatattaccaaaggatagctagagaggttcttttgtataaagcgagcatttataaacagtagttgaaagcaggaaaatcaggtgtaataattaatcaatattaaccatccactgtccaacgctataccacgttgcaacaggcccaaccaaccacctgaactaatcagttccatcagactaaactagggtgagactaatcacggtgaatctcgttgaccgcccataactgcggacacggctattcgaatagttttactctgatcagaggtgtacaactgtacccacaagacacagccccacgacatgtttccatacgccgacatgccaccacgacataccggaaagaggccgtgacaggactcttcgcataaccccatctagccaagcacaccacacctcaggtttcacccccgtccccagcgggcaacgggcagtcccctctcgtgcctaggagaatccggaagcaacagaggccgtcgcagggcccgcccggctccatcacgcccacccttgcctggatgcgtcagctagaggaaagctacactacaagcccagccgttgcccacgctagcttgtgataagtacgtggaattcttccaggggtttcccgcgaaccgatccttaagtgccatgggcgcgaccatcgaagccaagcacccacagcccatcgtttaatatattttaattaaccagcaccggagcggtggtattaaccaacatcattactagaatcagatatctatgctttaatgtattttccccactgtgtgctagttgaactaagcatggctaagcaatccctagtctaatatcaagtcatgttatatccccaagctaacaacggagcatgatacaaaactagtatggctgtaacagtaggtaaacatcccatggtgacattataaaacgatgcagcatttaaagtaaaacggtagagcatttgtaatataggatcaacatgttcaagtgacaagcatgacttgctttgctctactgctggaggaacctcggcgactatttcaaagtacaccggagcatccggagagccggaatctaagcgacatacaaagcaaacaatacaaacaggctataagactactgaaacaaagaacaaaaccatttttaatggattcttcacattcttcttgatttactgagacttgaatgggcttaaacggagctcggatgaattagatatgaattttagaagattcaatgtgcttttactataaacagaaaaatccttaattgatttattgcgtaataaataaaatcccggggagagagagggtggcgccgacatgcgggccccacatggcagtgactcggggagggcggtccacggtggaccgtgtccatggaccggggaggagcggcgcaccacgtggtgcacacgtggtgccgacgcggcgcacacgcggcggccacgtggcagccacgcgggcagccggaccgatggccccgatatacccggcggcagggagctcgcggccagcgcgcgcgggctgctcaagccgacccggggccatggcgcggcggcggcgcggcaccggcggcaaccagcggacagcggtggcgattcggcagacggcgacggcgcgacgatggctaagcggcggcgctactagggaaaagagaggaggaagaaggaaggggaaggagggatgtcctcaccgaaggggtccgaccggcctggagggagacgacggtgaccggcgacgaggaatgacagagggaggtcgacaagcggcggacggggtctgggacgacctaaggaacgaaatggagaggattagtgagggagagagaccatagagggcgggaatgccggccgaagacggcggccatggcgtttcttaccggcgcacgacggggatgaggctccggcggctaacctcgacggaggaggggtggacgaggtggacctcggccgcgcgaacccaacggtggcgatggcgcggtgcggcggcggccctagcagcggctagaggcggccggagtagaggaagaggcggcggctggtgggtgcacggtgcgggagcgatggagagctctggagaggccggcgcaaaaaggaaaaatgagaaggacgcggggatggattatataggggcggagaggtcgggaacggcctggagtggcccgatttcgccggccgacgtggggaggtggaggtggagagagaggcgggattcgaaattcgaatctcggccatctcgggggcgcgggcgagcgggagaggggttgaggggtgcgggaggggcggacgcacacgcgggtgtggccgacgtggcgcggggaaggcgggcgcgggcggttgcgaggcggcggctgcagacggtgggcggccaaaggttagggatgggcctaacaggtgggccctacctgtcagcgcccgagggagagggaggctcgggcgagcggatgggctgtggccttcggtcggcccagcaacggcgcgggaggtggaggaaatgggccggcggcccatttgggaaaaaggaggggacaaaggaagaagaaaaaaagaaaagaatttccaaggattaaataatgctggtgctcatttttaattggttaaaattatttctagagctctaaaaattccactaaaaatcttgttagcatatttcgacatatagaactcaagaaaaatcccacatgccaattccgattattatttgcattaatttattagggtttgtcttgctttgacaccggtattttctctaggtgatttataattttcatttaggcttgggaaagaaacttcagggtgtgacacgaaccccatgtaatcagttaacacactcgttcaatacaatttcggtgcatcaccacccttttgcttttgttttatttcgacgagtccttgctttcgggttgagctgcatcggtttcgatcttcaacaagaggtaaaacttgttatgatggcttgcgttctcgggattagtgcttccatctttatgatactctaatcatgtttatgtaattcatcgagttatcatatatcttacataatctctggcaatatcattatctaacctacaatcgactaacatctgtcagtagagggcagccgattaggttagattttgatgttgatttagattatataagatctccaccactctatgaaacttccagcggcttgattgtctagatattgttcttcttttcatacttaatgctgcatcacttgagtttgatctattaagtcgtgcttagaatatcagtctctagcctgccttctagttgccgattagggtagtattggagtttcagccgatcttatctggtttaactacatttgctctatatgcttcgttgacatgttaaatctgccctttatgtcaagatattattgcatctacgtatattaaactttggtttggtatattctgcttgttttaatatcttaacatagaactgtatcagagtattagccgatacatgctagatctatctgatcagctatgctgtaaacatatatagttcggttattaatatatatttcgatctaagtgatttatattgtctcggcatagcgaccgatctatcccaatcacttgatttaaatatatatcgatgtaaaaattatatattgttaatatctacagccgatcgaatagatttagtcctttattatctatttccagctgccgatcaaatcgactggtacgctagcatacccgaaggcgagttttggacctgcactggagttaaacagatctcccaggcctcgtgttttacgtcaacactcttttggcatgcccgatgggaccgataagaagtcagacaagcaattccttctcatggccgagaaaccaccgctatcaccatcttcggctagttcaggcactgtcaaggagaagatccagaagttaggtttgaccgacgtcaatgaagggaacgtcgtacccatcgatccagaaaaattcacacctgatcaaaagaaagattttgaagcgatgatgcaggcagcacgtgatcaattcttgaactcattcatgcagactcgcaaggggacacttgttcagaagtataaaataaaggtggttcttgacgatcccgagactggttcctctaaggatggagaaggaaaacaaactcaagatggctcggctcaactgaatgacaaaggtgctacagatggttttccaccaaatcaaggtgacaactctcaaggggtacatggggttcaaggtgatggttttagggggttcaaggtgatggttcacagggagttcaaggtggaggtgttaatcaagacgacaatgcaacgcagttgcagttcaacaacattcaagatcaggttgactatgctgtaagtcacgcccggaaattcactagtaatttccaaacttatttgtgcataaaatcctcgtccaggaatcagccgaggtacacaaactgacaatttaatatacaaatccatcttaataataatgttacacgcttacaaaagaaaagaaaatagcagcggaataacggtctagcgatggcttcagctccaatcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaatagcacacccatgctgcacaggcccaaccatcctgaacaaccatacccggctgtacagatctaactccaaaccaggagctaaacaaattattaccagatatagtatccataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtgcccgaatagaggctgtgacaataccctctgcacaacacaactcaccacaatgcaccattcctggatcataatcacccccttataaaacaaggcatggcctccccagcgacccccgtgggcttatctccgccacttctcagtctggtgctccgcaatgaatcatattatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtggcttgccttgcaataatcggtcttcaattaatcttcttgaatacctccagcacactcgcgaaccttcgcaacgacggaaacgacaagctaacacgcaaaacgaagaaaaagactaataaaaaccaaataaacagtaatataaagtaaacaaacatgtagatcatgattttagatgaattatgagacttgaacggcctcattctgacttcaaatgaatttattacgaattttacaagattaaatctaattaaagcccatttaaaaagaattaaataaatttaattctatttatggataattttaatatgtagatctttattttacacaacctttgcaacttgaaccacattaaactgagttacaaagaattagttatgaatttttaaagattaaatcggattaaaacatttatatagattttaattgaattatgacgcaataatgaattatttttgaaaaggaaaagaggattattgcgtcaacgggctcgggttcacggtggaccgggtgcacggcggcggctcacggaaacgaacggccgagatctaccctatccacaacgaacggccaagatctaaacggtctacgaccggtctatggcggacggcaacgatgacgtcagcgatgacgtcatcaccggcgacggctcgggcggcgcatgctcgccggcgaacgatggcgcgacgacgcaaacggaggacaccaacgggtagagggtgacgcggcgaactcaccggtgaccaaaacaacggcggaagagcaacagacggcgccggcgacgaggaagaagcggcgacggtcttcgggtcgacggtgacggcggcgctccggcggtcttcggcggcggcgaagcggtggacggggatggcgacgacctcgcgatcccgatggtggcgacggcgaccgacgacggcggctgcaacggcggcgcggcgcggctgaaccgatggcaacgacggcgacggctagggctacgcggaggcggtgctagacgcgacggcgggctaaggcaaaggtggcggcggatagaggagagctcgggggtgcttataaaggggctagcgagcggcgatggaggccctcggcgatcggcggcgagaaggaaagctagggttctgaggagagaagtcgatccaaatcgaactcgaatccttggatttccaaacgaaagtagccgacgattccataagagaaaaggaagcggagatcgagaagatcattttccctctattgatttcaccggatcgggaaaggatagaccggattggaaagcggcggcggcgcggctcggctagggttcggccgggcgacggctggaggaggaagacaagtccgacaggtgggacccacctatcagcgactgagagagaggaggaaggagcgcggcgggctgcggctcggctgcgggccgacttgggccggggaggagagagagagcggttttgggccggctttcggcccaaagccaaaagagacttttaaaaacctttttcaatttaaattattcatgaaatgatattccattgattaaaaatacttccttggctcaaataaatcctagaaaaatctaggaactatagaatcaagtaaagtatttaatgaaattttatctggccccattttatattggaatttattaattaaaattagatcttctcttttaggcttttaagatcatttctaataattccttttaaacaacaatttataatttaaggatttttaaacaagaaaagctcttaacaattataattagatcattaatgatcaaataattactgaactgttctttgtatcatttaggaattgagctccgaaaaatccgagaaaatttcagagagtatacttaatcatggagaatttaataaaaattaaatccatccatgctttatatttaggaaattttattttccacatttaacttcacttgtaaattaaagaacatttaatataaattctaataataatttattaaataatttataaatcctgaaacaaaaatcaggatgtgacactgtacaccatgctttgatcaatcaatctgagaaatatggtgaagtcaatgattgatggttcaatggccgagtatcaggttacaggaccagtttacctacaaggaggggtgttcccgaattatcggccgttaatcaccgataatctaccagtcgccagtcagtccctcttaatgcaccatcagctcagccgacgataccagcatcggctcccgcacctactgcaccaccttcagccccaggccaattaattaatccccgattgttggtgagagaacagccacagcacactggacagaatgtgaatcggctaacgcaagaccaggttgcatctatgttcttacgtcctcaacacaccattgatccagcccagcagcagccgattcagcagacactaccaaggcagcaggttgtgcaaccagttcagcaaacacctccaatccaacatgttgtgcaactagttcagccaaacacctccaatccaacaggttgtgcaaccagttcagcagacgccaccaagacgacaggtcttgcagctgattcagcagacactgttgaggcaacaggttgtccagccgattcagcagcaaggtccgatgaatgcatcggctgggtttgcaacacctggtggtcaacccatgcagcatgccgcaaatcaggttgtcccagaacacttggttcatcatgtgcagccagatggcacggttgttcctcaagttattcctgaacatttggtgtgcaatattcagccagaccttcaaaattaccaggggggcaacttgaattatcaatatcacccaccatcacctcatgttcagtaccagcaagcaggatcggctcagccccaatttgttcctcaatacaatcaatttgagcctatgccacaacaacttcaaggaacacctcaacagcggccatgggccgatttgattgtagatgtcatgaaggagcagttcgggcttaggccgaaagacgctggaaacctatatcgacagccatatcctgaatagtttgagagagttcctctgcctaaccgatttaaagtttcagatttttcaaagttctcagggcaagatagtacatcaacttatgagcacattagccgatttttagctcaatgcggtgaagcatcggctgtagatgccttgagggttcggttattccggttgtctttggctggatcggcctttacttggttttcttctttaccgtatggatcaattaatagttgggctaatttagaaaagcagtttcatagctatttctatagtgggattcatgagatgaaattgtctgatctaacatcgatcaagcaaaagcatgatgaaccagtgcatgagtatattcagagattcagggagatgggaaataagtgttacagcttgagtttgactgatgcccagttagccgatttggctttttagggtatgattgctctaattaaggagaagttctcatatgaagactttgaaagcttgtcacaccttacacagaaggtagccttgcatgaacaaaggtatgcagaggctaggaaaaattctagaaaggttaatcatgtttgcccttatatatatggatcggacgatgaggatgatgattatgagatagctgcagctgagtgggtaaggagtaaaaaggttataccatgccaatgggtaaagagctcaggaaaaaaggagaggtatgactttgatatcactaaggctgacaaaattttcgacttgctactccgagagaagcagattcaacttcctgccagtcacacaattccatcggctgaagaattaggtaagaaaaggtattgcaagtggcataattctgggtctcatatgactaatgattgcaaggtcttcaggcagcagatccaagcggctatcgaaggaggcaaaatcaagtttgatgactctaagaggccgatgaaggttgatggcaatccttttcctgttaatatggtgcatacagctggccgaacagccgatcggggtcgtgcaaggggttttcaggtgaattcggctaagattatcaacaaatatcagaggaagtatgacaagcagcaggagaagcatcatgaagaagacgacgatggctttgatcctcattgggttgtgagttctttagatgttgttggaatgaaggtatgaggttgcaatctattgaagactgtcctaggtgcggtgatattgccgagagctcaagccgatcatatagtaggggcaatcggctaaggcagacaagagttcctgttcatcaaagattgggtccagtgaatcaagatcgtggctaagaggacaatgaaaacaagaaaaatcaatggtgtccttctggtatctttacgaagaatcaaaagagaagggttcaaagattgaggaacagggagcgctttcaggaggtcgagcaggaaattaaccatttgctgaagaaaacgaagccgaggcgggtgtggcgtgttaagaatcaggttcctgtagccgatgaagccacagctgatgaagcaaaaaggttagctaaaggaaaaagcgtcgtaactgcttcggtcaacatggttttcactttgcctgccgagtttgggatcaagtaagccgatatcgatgaagttgaagaagaatcggctaaattgattttgtcgccagggcaggtagtttttgagaagccagaggggacagagaattgacatcttcagccattgtatataaatggttatgtcaatgggaagccgatgtccaagatgatggtcgacggtggggctacaatgaacttgatgccttacgctacattcagaaagttgggcagaaacgctgaagatctcatcaagacaaacatggtgcttaaagactttggcggcaatccatcagaaaccgaaggagttttgaacgtggaactgacagtcggcaacaaaaccatccccacaacattttttgtcattgatgggaagggttcttatagcttgttgtttggaagggatgggattcatgctaattgttgcattccttcaactatgcatcaatgcttgattcagtggcaaggcgacaagattgaaattgtgccagccgacaggtcagtcaatgttacacgtgccgatttagctctttgggagatggatggtcttgattgtttatctggaaaagtttgggatggagattttctaaaagtgtccgattctgatatacagccaattgaagatggagagcccaagctattattttgagggcgccgtggaggattcacatgtctacaacaaggacacggtagatgatctcgatgacaacaaaggtagggttttatgtcggctgatgatttggaaaaattgatataggtctaggtgaccgccaaggccgacgtttattagtaaaaatttatctgcagaatttagaaccaagttgatagagctgttaaaagaattcagagattgcttcgcttgggagtattatgatcaaatctttatggctgaagaagatattcataagacaactttcaggtgtcctggtgcaatcggcttgttcatatgggttgtgatgactttcggcttgaagagtgctggagctacatatcaaagagccatgaattacatataccatgatctaatcggctggttggttgaggtttacattgatgatgtggttattaagtctaaagaaatagaggaccacatagccgatttgaggaaggttttcgagagaaccagaaaatatggcctgaagatgaatccgacaaaatgtgcttttggcgtatcggctggccagtttttgggatttcttgttcacgagagggggatcgaggtgactcagaggagtgttaatgcgatcaagaagattcagcctccagagaacaagacagagctgcaagagatgatcggcaagataaattttgttagaagatttattactaatttatccggtaggttagagcctttcacaccattgttcaggttgaaagccgatcagcagtttacttggggggcagagcagcagaaagctttggataatattaaggaatatcttagttctcctcccgttttaattcctccatagaaaggaataccttttagattgtatctatctgccggtgagaagtcaatcggctcagtcttgattcaggagctatattgaaaggaatgagttgtattctatcttagtcgtcggctcttggatgctgaaactagatatttccctgtcgagaagttatgcttgtgcctatatttttcatgtacaagattgaggcattatctactatccaatgagtgtactgtcatatgcaaggctggtgttgtcaaatagatgttatcggctccaattttgaaaggaagggttggaaagtagatattctctttaactgagtttgatcttcggtatgagtcgccgaaggcaattaagggacaagctatagccgattttattgtggaacatcctgatgattcaatcggctcggtcgagattggccatggactttattctttgataggtcggtatgtactaatggttgtggcattggcttggttataatttcccctcgaggggcatgtttcgagtttgcttatactattaaaccttatgcgactaataatcaagctgagtatgaggcggtgctcaaagggttgtaattactcaaggtagttgaagccgatgctattgaaatcatgggggattctttgcttgtaatcagtcaattggcaggagaatatgaatgcaagaatgatacattaatggtttataatgagaagtgccaagaactgatgaaggaatttcggctggttactttaaagcatgtgtctcgagaacaaaatattgaacctaatgatttggcccagggggcatcgaggtataagccgatgatcaaagatgctaaggttgaaattgcagcaataacagccgatgattggaggtatgatgtgcatcaatatttacataatccatctcaatcggcttctaggaaattgagatataaggcgttgaagtacagtctattggatgatgagctttactatcggacgattgatggggtgttgcttaagtgtttgagtaccgatcaggctaaagttgcaatcggcgaagttcatgaaggaatttgtggtactcatcaatcggctcataagatgaagtggttacttcggcgtgcagggtatttttggctgacaatgctggaagattgtttcagatattacaaagggtgtcaagattgtcagaagtttggagcaattcagcgagtgccggcgtcggctatgaatcctattattaagccatggccattcaaaggttgaggaattgatatgatcgatatgataagtccaccatcgagtaaaggacataagtttatattggtggcgacccgattatttcaccaagtgggtagaggcgattcctttaaagaaagttgattctggggatgcaattcagtttgttcaagagcatataatctaccagttttgtattcctcaaactattacaaccgatcgaggcttaattttcgtgtccgatgagtttgttcagtttgctgatagcatgggtatcaaattgttgaattcttccccatattatgcacaagctaatgggcaagctgaggcatctagcaaaagcatgatcaagttgattaagaggaaaatttctgattatcctcggcattggcatactcgtttagccgaagcattgtggtcttatcggatggcttgtcatggatcgattcaagttcctccttataagcttgtttatgggcatgcggctgtattaccatgggaagttaaaatcggttcgagaagaatagaattgcaagatggtttgacagccgatgagtattataaccttatggccgatgagagggaggacttagttcagtcgcgtttgcgagcccttgcaaaagttaccaaagataaggaacgagttgctcgacactataacaagcaagtggtacccaagactttttcggaaggtgaacttgtatggaagttgattttgccgattggaactcgggataacaaattcggcaaatggtcaccgaattgggaacgaccgttccaaatctataaggttgtgtctaagggggcatatatgttgcaagggcttcatggcgaagtctatggacgagcgctcaatggtaagtacttgcagaaatattacccaagtgtttgggttaatgcatgatcggttagtgttgccgatacatgatagccgatgggtttgcatcgccttgggatgggcgatattgttatatcgcccttagttgtttttatgttgtaatcagttgaggtttgccgatttacaatggccgatattgttatatcgcccttagttgtttttatgttataatcgggcccttagttgtttttatgttgtaatcggttgaggtttgccgatttacaatggccgatattgttatatcgcccttagttgtttttatgttataatcgggcccttagttgtttttatgttgtaatcggttgaggtttgccgatttacaatggccgatattgttatatcgtccttagttgtttttatgttgtaatcggttgtggtttgccgatatacaatggcggatattgctatatcgccctaagttttaaactataattaaatcaatgcttttgacattgtaaaattaggggggcacatatatacaccagttacaaattttgacaatttttgagcaaatttggaagttatattaatcggcacaaaggattatcaagataaacatcagtagtatcttagccgattacaaaaatttctaaggtctattacacagaaagttaccgagacaaatagcgctggatagccgatatagctctttgcctaatttgttctacttcttcgatggcttgggcatcttgagcatcggttccagggatgacttttaaagacttggttagatcagcaacattttttatagccgattttagtcttgctttctgcttttcaacagattttgggagatcggctagctttttatgttccatgtccagattggcactgcattcttgaagttgtgccaggagctcaatctttcgagcttcaagccgatcaatattagacttgatcggaccttcagataactgatcaagcttggccttctcttcatgaacaagctgccgattggcctaaattgtggcctcgatgtctttgcgctcccgacgctcgactagtctcagcttggccttctccagcttgaattgatgctgctcgagatagacagctggagttaggacatcggctagctcatctgggatcagagcttgaatctcatgtagccgagtcctaattgagccac

SEQ ID NO: 65576 - DNA, 14707 bp, Oryza sativa
attcctgcagcccctactggagaaaccatctttaatgggttgtccaaaaaccataatagtctcggttgcttaaaaaaaccagggctaaaaaaatttttagtcgcagttaaaaagggtagcggtattttttctatctcctccctagcgcgtagatcaacaaaaatcaaacagagcaagcgtgtcgatcaattctcaaaaaaaataaagaacaaaaaaaatcagaggcgcccagctcccttatctgttctcctcctccactcctccccatccatctcttcttttcttcctctcctccttctcaactcctcctccagatgcacttctcatttagttttctccttcttctccttctccactcctcccctccccttatctttgacctagctggcaggcgggagggccgcggcggctgcgtcgggggcggccggcgccgggcgggaggccgcggccggcgccggttgggaggcggcggccgacggacaacatgtttttttttcttctcttctctgttctctgtgatgaatgctgacgatgttgtagatgtgaactttttttttctctgttgtctatgatgaatgcttgttgtcctggagatattgtagatgtgaataaatgcaaagaatattgatgctttgatgttgattttattcatttgatttgtgatgatttgggcttttttttattttattcattcgatctatgatgatttgggcgatatgcaaagagtaaaagaacaatgaaaaagaaaaaagaccaaccggataaaaggaaaagaaaaaaaattttttaatcctggttggtaacaccaccggtacagactgttgcacctcccaggatcagcctgatgccgcgcattccaaataaaaacgcaaaataaaagatcatcgggcgcaaccaataaaaaatcgccgcttcattgatttcaatataccaggtactaaatattttcacatatcaaagaacgttgtagttatgttagaactgaaaaaaaatatcggaagaatgggagcataaattaagtgggtcacgttgtatatggagtgtatggtccgatgaacgtgctttgctggatgatggtcttttatattgaatttttacggtataatttattggtagtataaacaatccaatgacgaattagtttcctaccctactgcataaatggttttttcagggcgagaccctctcctctcctttctcactctctcacctcttcttctcactcttctctcctctgcgcagctctcctatctcactctcctcttgcagccagcggtgggcggcgcggccggtagtgggcagcgtggcaagcggcaggcaaggggcactgctggtggcaggtggagggctcgaccggtggcatcaggcggctctgcctccgccggcctcgtgacgggcggcaggcggtgctatcaacggtgggcttccccgcgcatcgacggaggcttcgatagctgatctggcaactgcggcgaatgcaggcgccggcaacggaaaaggcggcaactccctcggcccttccacgcgcggatcgagcgacgggctcgagcgggaggccgggagcggctctcccctgcccttccccatgcggatccggcggtgggctcaagcgggagggtaaatttgtctttccatgttacacatgacgggcagttccgtaaaaacccattcttcactccggtcgaaaggaaaataatcgttagctgtttcgcgatgcccagagaaaagcaggaaagtagcttgtattataccgttttcctctccctgttttgcggttgcaatcttgtggatttatcaccacgtagtatgtacctatgccgaatgtcgatgatcaggaacaagattaattatgcatagctagattaaagtgtgtttaattagagaaaataatcgccaatttgtttattactagtatttattaatgtattagatcgtcgttattctttggttgcgatctatagtgggactaaaaattaaatagtcctgttgtaaccaccaaccgagactaaaaatccatttttagttcttcgggtttttttttaaggttgggtttaaaaaaccaccggggggggggaaaaccccttttaaaatttttttttaaaattggggggaaaaatttttttctcgccagactgatcaaatatggtttcttcactagttaataaagaacgtctgcacctggacatacgcactcgcgcactgtgcggagtgaggataaccggctcgatgaaacagagcaaagcaaatagataggggaaaatagaggaagtagagaagggcaaatctgtatatggtaactcaataaaattcagcagaccaagcatgatttcacgttatcaacaaaccatatatgatttctccaggaatttcacaacaaaaccatcgtgaccttctctataattatcattgatggtttttatgcacaaagcaatcatcaacgcaaattatacagaaggtcacatagatgtagtggtggatctagagtcctaacgtgtctatcgttatcatagcatgctaattatatttagaatatagtgttataatatatagacaagcaatttaaacatagcttttgtcgaatgtcatcgctgtcttctgacaccagtggtaacactgtagatccgcctgatagatggtaagcgctaacaaaatattatgttcatgttatcggatattatgataaaatagtaaccaaatttatcccataccttttagtaagttttaactctccaacaaagccatgatagtaatttcatcaaataacaattatcccttgtatatctaatctttatctttatttactacgtagtaaaaaatacatagtagtggtggtgagtcctggataatctaagggccgatattacccttaggatcctcgtgcagatcaaaaggctcagatacccctcatgctgtcccgcaccgcccccacctccgtatcacaccgtccgcccgcatcacaccgcctgcccttggacgcccccgttacctcctccttcatgccacttggcgctgcctccgtggcgcccccggtggctccttcgttgtgctgctgccacctcctccgccgcaatgctactccatcgcttcatagcccctctcctcctccagccctatgctccctgctccgtccggtgcaccgccacttcctatccccatcatgtattccaactttatatctccctactgctgtcatcctccaacttcatatctccctactgctgtcatcctccaggtaattgattctatattggtttggtttatcggatagtccgtggaagatcgagctgctgctaagtcaggatacatacatgtcacagcttaatttttgtttcaggatttataaattatttaataaattattaatagaatttatattaaatgttcattaatttataagtgaagttaaatgtgggaaataaaatttcctaaatataaagcatggatggatttaatttgtattaaattctccatgattaattatactctggaattttcttggatttttcagagctcaattattaattttaataatacaaagaatatttcagtaattattcacatattaaattaatcattaaatgagctggtttcaattttgttaaatactttgagtgttcaagtatattcaagatttttcttggaattacaattgaaagatcatttcagtgattaatttaattgggaaaagtaattaaaatccccttttcctttttgggccgaaacaggaaagttcacctttagtcctcggcccattcttctttctattcggccggccttatcccttccaatagtctagtttgcatccctgcttctatcgggctgtgcaatagaagcccagacaaaagtctgttttgcctccctgacactgttcatcttccagctcggacagagtccgagccagccatgcccgtgtcctgttgccgccgcctcctccttccaaaatccggcctcctcgttgctcctttttccaaattagttgagggaatggaatcctctcaatctcctctacaatttcccaagaaatcccaaaaagtttctatggaaatcctttccaatttcgcggatcaatctttccttttccggcgaagatccttaacattcccgcagtttttcccgtcgatatgggcttggacccgagctcccggtcctatataaaggaccccctagtcgtcctctacctatcccctcaaatcccgtcttccgccgtcgccggaaacgctctccccgcgctcgccttctctctccacctccggccgctgctccagccgccgtgcgccgtcgctgtggtcgtcgccttcggtcgccactgccgccattgggttcacgaggaggagaagaagatcgtcctccacttccccgaagccgaaatccacctgatgaggacataattagctcggatataaccatgactaccttatgtattaatcaaataaaggtgcatatgttctacattagatatatttgttatatatttgaacaaacgctgccacacaatgagtttcgtgtgtttttgtttgcagaggtacttgcttgggcgaaagaaaagagaccgagcgtaaggaatgcatggatgattgaagaagttgattggggaccaaaccaagaccttctgcaagtcttcttttttttttgaaggttttctttcatcttaacacgtcacttttggtccataaaagaaaagagataaagttctacacgttttgatttcggattcaggcctcctgacagcatcaactttaaatggacctagcctctgatctagaaggaattttgaggcctatgagtacttgttggaaagcttatgggtctactttcagatggttttgtccccatgtcaaaattcctaccgagctgccggaaatctgcaaaacaagccacatatctcatccagtccgaatctgatttgggttttgggccttgtaattgtgtcgtgggcttagcccaagggatgtgcgccatagggaaaccctaggacatccctaatcatattaattcagtagccgtcatcgtttagagttgggttttgcttagattatcctgtcaagaacagtttcgccgctagatcggtttgtggaaccccaaattcgagtgcttaattattcatatgcaatttggttacaatctatcttgttcttgcttgtgttctttaattcgcatgcagggattagccttctcggcgaggtaaaccgggtttcggcacttttgataaccagaggagacgtggtgctgcgattacggggctcagtagcgtgttcgttcagaagccggatcgagttgtgtcacgactccacccaaatctttgtttatcaataccaatcggaagatcgggacctaacatccctcatcaccaccggagctccatcagcgccgtcaacccgaagttcaccgtcgcgttttgatatccagcgaggccctgcagcacctcccattgtcgccaagttttgtcaccgcctcctttgggttcgcagctgcgaggtgaaggccgtccactcctccattgtcgctgctcatcgccggaaagtcgtcgctgccgtggaccagtacatcgccaccattcggatctcgtcaccgccatcttccgtcgctctccgtcatcacgtaagtgttggtaaggaccgtcgtctcgtgctctttctcccggtgtgctccctttttgccgctgctccgtagttcaccggtgatcgtcgctcccgtgtctgccgtccagtgatcccgcgtggttgtattatctttgccacgtcgttgcatctctgctgtcacttcaccgccacctagccacttcgttgtctctgctgtgccatgtctaactaaaccctagaatggattcaatctaatccgttggatctcagtcaactctcggttaagattaatctcagccatccaaaatcaatataaatccgttctctcttttcaatggcatattattcatttttaatatatgtcaactaccaaatataatctaattttttccagagattgttttaatcttttatctcagttataaatcatttgtatattgtttaattaatttggaatagtcttttctctaataggattaactggaattaaatcttgtaaaattcataactaattcatataaaatcggaatgaggtcgttctagtctcataattcatctacaatcatgatctacatgtttgtttactttatatgttctgtttatttggtttttattagtctttttcctcgttttgcatgttagcttgtcgttttcgtcgtttcgaaggttcgcgtgtgtgtcgtaagagttcaagaagataattgaagaccaattattgcaaggcaagccacacagatcctaatatacaattcctttgagcatgttgatcctatatttaaagtctctatttatttcaactgtgcatttattttcgaatgtcaccgggtggtgtgaacttattcctttgttatggccaatttgcgttcattactctattccttgataccttgtgttattataattttactagttgagctttgtatatttgttcagctagatgttagacataattgcttagccatgcttagaaacattagcacacaattgggataactaatgttttactattacttaatgatggatatttaattgtagctcacaatggttaatcgtgattggttaattaattaatatgccattaaaacttgataatggtgggttgtgagcacatggttttgatggttgtgctcatgacaattaaggactggttcacgagtttcggttgtgaaacattaaccgtgccaaccacaagccagcatgcgcaacgcctttaccttttgtatagcatggttcattgcggggcaccagattgagaagtggtggagataagcccacgggggtcgctggggagtccatgccttgtttataagggggtgattatgatccaggaacggtgtgctgtggtggattgtattatgcgaggggtactgtcacagctcctttccgaggtaccgtggtggtattgaggcgcatggtaacatgttgtggggctgtgtcttgtgggtacagtggtacacctctggctagagtaaaactattcgaatagccgtgcccgcggtcatgagcggctctaacaatgtctgtcgtgattagtctcacacttttcaccataataaataatgctataactggtaataatttgattagctcctggtttggaatgatacattcctggtttggagatagatctgtacagccgggtatggttgtttagtatggttgggtctgtgtagtatgggtgtgctgttcagtgttgattaatattgatgattaattactctactattttacaattctcgaatgtttgttaaatgctgcttttgtaaatgagccctatattatgccattctttggtatccttgtgcatttgcatatttgctgtgtggcttacggagtattccatgtactcaccttgcaataaacaatcaaacctcagttcaagaaaagttgcgaaggagaagacgtttggcttataccccaattgagctgcctgtgggagtgttgccggagcttcgctagaccgtaattccgctgctattttctcttttcttttgtaagtatgtaatgctgtattattgatgaatctgtatattaaattgtcagtttgtgtaccttgtctgattcctggacgaggatttgacacacaaattagttcagaaattactagtgaatttatgggcgtgacaagttagtatcagagccatctcaactgtaggataagccaaatggtcaaactttaaggactaattttcaaaaaacatgattttgtgaaaatgtttcctttcttccttctccagaattctttgcaaattgctttatcatcctttcctcttcctctttcagcttgagtagttctgaaactagttgttgaaacttgaagaagccaatgtggtctacttatcaagtggatcgaggaatatgaaggtgatgatcgatctgaagtgtccagttgtcaagaaggaatgaagtttggatcctaccttagaacttaaaccgccaaagtgactttgaagtatagttagtagggtagaacgcttttgtttgcttgtgtgtaggtatggttgcattctcatcattgaggaagttcattgatgagtgtgtaattgtactaggttgctcgtttaatcaacttgaacaatataatggtctacacacaccagatcagtgataacctagttaaggtctttatctttagtgtaacccctctccttctatcttctccaaatctgcaacgaatggtgaacactcatgctagtggaagtggaaacaataacaatgaagagaacccaacccttgctcaagttctggctcaacagactcagttaataaacatgatgatgcagcagatgcagaaccatctcaaccaagggaacaacaatgctccaccgccccagaacaagttagctgatttcctttgtgtgaagccgcctaccttttctagcactatcaacctagtggaagcaggtgattggctacacactattgagaagaagttggaattgctccagtgcacagatcaagagaaagttgtgttcgcttcacatcagttgcatggatatgcttcagaatggtgggatcacttccggatgaacagagcagaaggacaaccaatcacttgggaagagtttaccgaaggattgaagaagacacacatacctgcaggagttgttgctttgaagaagcgtgagttcaggacattgaagcaaaaggatcgtaccgtgactaagtttctttatgagttcaaccgtctagcacgttatgctccagaagatgtctgtactgacgaggaaaggcaggagaagatcttggaaggcctgaaggatgaactgtcagttacgttgatctctcatgactatgctgattttcatgagctggttgacaaagcaattcaactggaagataagaagaacaggatggacaaccgtaagagaagaatgactgttttccaggaggcacagggcagtagccagaggcagcatatcaagccatcccaagttggtgaatcaagtctaacatctcaagaacaatcgcaacagttgaacatcggtggtgagatcaattcagagactaatgcaagcaatgaagttaacatcaagcaagctactctatcggagccagttcagcaggatcagtctcaagaaaataacagtagtggaagggagcagcaagtatgtttcaactgttatgagccaggtcacttcgcaagaaagtgtccgaagccgaagcatcagcagccgcaaggtcaagtcaacaacattgtcgtcacaggagccaatgcagtgccagttgcgtcctcaagtgttacagctcagccaccagtttcaaagcagcagtagtcttctttaaagccttagaataattatcggagttatggaataagatagactgcagttgacctatgcccttttctttctagccgttccgaatctcgggacgagattctttgtaaggggggtagatttgtcacagcctgatttttgtttcaggatttataaattttttaataaatttttaatagaatttatattaaatgttcattaatttataagtgaagttaaatgtgggaaataaaatttcctaaatataaagcatggatggatttaatttgtattaaattctccatgattaattatactctggaattttcttggatgtttcagagctcaattattaattttaataatacaaagaatatttcagtaattattcacatattaaattaatcattaaatgagctggtttcaattttgttaaattctttgagtgttcaagtatgttcaagatttttcttggaattatttgagcattggaagtatttttaacaattgaaagatcatttcagtgattaatttaattgggaaaagttggcaatacaccgacgtataattgtattgacgtggatttccttacaaaaaccctaggtatacatatttaattataccctaaggttgatacaagtcctgattcgacacaatatagggccccatcatttggctttttcccaaataagccaaaacggcttattagggaataaaaaaatgaatttgtaggtaaaaattttatatatgtgttcttggtgacttaaaagccaatgcagaaaaaaaaactacgttgaaaatatctcaaaatcaatctcaaaattaattttaaaaatttaaaatttagctttttctttggctgattaggccatccgatgggagccataatatttcctaacaagaaaagaaataactaatcatgtctatttaagagatatactaaggaaaatataaagcagtattgtcgtagttttcaggattcctcattgaactcggcttaatctggataaatttccatctaccaatcagtttctttcattaaccaattccacaaaataatcgtaacaaattttggtgttaacaagaagtcaatgtgatttggaggatatatgaagatcttgtttcgtcgatcaccttaatggatggttcattccaccggtgctcatcgtctagttccatgaacaggcataatgacaatggtttcattgtctaatcagatctctttggttcccatttcttgattctccctttttgctaggaaccatttagttccaagaaaaactatcttagccaaagcaatgtactccctttgtcccgaattataagatctatatatttttttcacgatcttcaatgacttaagttaaccaataatttatttcatattgtatcatcaacaaatatacaattagcattacatggaagtattttataatacgaatgtaatgacataacatatataatacttggtgtagatattgttagtgtaattattaatcaaaagttatcgagtttgattttacttaaaaattaaggctccctataattcaggacagagggagtaagatgaagatgggctattatattgtattgcaaagttccaaaaaaaatctagtttattataacatgagtgatgtcagctatgaaacatgcgaaagtgaataaagccaaaatttaccgcagaagaaaataaaaatgccattttgtaacaacacaagcaagagagaaaaagaaaacctttcatgggtttgtggatcactggtttgcatgctagaaaataggcactgctgatgacaatgcaggaagttgatatctctggtacaggtcattgaactcatgaaaatttcagaacacataaaaaaactaaggggcaattgcttatttgaccctgttttgaactgtaactaccaatttaaccctgctttttaaaatgtgcttatttgaccctccttttaaaaaacgaagcactggtctgaccatattccgtttggatgagttaacggtgttaatttaggcgtaaatagtccattttacccatacttatttaacccagttgcttgtttgacctgcttcttatcctctctctctaatctctctctatctccctcgagcgctgcggcgacggtggcggcagttgcggcggaggaaagagcgacggcggcggcagctgcggagggccgacggctgcggaggagcagcggcgctgggagcgaaggggcggtggcggctcagcgacaccagcggtggtggtagaggggtgttgacgtaaaacacgaggcctgggagatctgctgaactccagtgcaggtccaaaactcgcgttcgggtatgctagcgtggcagttgatttgatcctgcaatcaacaagaaataaagacaaagaaaccgcagttaaacctataaatgatagctgatcggctagatgccgatgacatatcatttatctctgagccgatgtcatatgtaaatcaatcggcagttggaactagataataaaggactaaatctattcgatcggctatacatattaacaatatataattcttatatcgatatatatttaaatcaagtgattgggatagatcagtccctatgccgagacagtataaatcacttagatcgaaatatatattaataatagaactatatatgtttacagcaaatccgatcagatagatctagcatgtatcggctaatactccgatacagctctatgttaagatattaaaacaagcagaatataccaaaccgaagcttaatatacgtagatgcaataatatcttgacataaagagcagatttaacatgtcaacgaagcatatagagcaaatatagttaaaccagataagatcggctgaaactccgattctaccctaatcggcaaccagaaggcaggctagagactaatattctaagcacgacttaatagatcaaactcaactgatgcagcattaagtatgaaaagaagaacaatatgtagacaatcaagctgctggaagtttcatagagtggtggagatcttatataatctaaatcaacgtcaaaatctaacctaattggctgccctctattaacagatgttagccgattgtaggttagatagtgatattgccagagattatgtaagatatatcataactcgatgaattacataaacaagattagagtatcataaagatggaagcactaatcccgagaatgcaagccatcataacaagttttacctcttgttgaagatcgaaaccgatgcagctcaacccaaaagcaagaattcgtcgaaataaaacaaaagcaaaagggtggcgatgcgccgaaattgtattgaacgtgtgtgttaattgattacatggggttcggggtttatttatacacaaaaattacaaactatgtccatatcaaacatgactcgtatctctaacaaactctaagatacaataagtctttatggcagacttttgccctaaacatatctctaagaaaattacataaaatatcctaattaatagatacaattgccttctcaggactctatccaagtgcggcaaccatcttgaagcaccttaattcaacctgatatcgtatacgaagttgtattgtcagaatcggctatatcaacttactcagtccgattcggatccagccgatcctaatcgtagctgatttggactcctgccgattcttgctctgttctcgaatcgatctccgccttcgactccacttcaatctaatcctcttttccgatgctgatattaccaaatttggtcgttaacatatgccccccaagtctggaatatttggtaatgttccggatttgctgtatatcaactccgagcaagtttcgcactttgccgttttccgactgttacagttgtgctttaaatactaaccgtcaccctcgaaaaatttcacaccgtcctcctccgttttcaccgctaaaaccaactttgttctctctctctccagcgatctctccaacacacaaggcgatcccaggcgatttcatttccgatcagatctccgcctatggtgatgtcgtcttccgctagcccgtctaccgcgccatcggcagagtacgctgaggtaagttctcatcggatagatcccttttcctcgcatgaaatcgatttcctcttttctcatcgtgctttctgcttcccgattcctttggatttgcagcacctttccaacctagtcgcgattcccagccggtcgcacgaaaaccactattttcttggcccaatcggcaatattgaccccattgatttcatcattggtgaaaccaacagaatcccctttagactagtgtcacgaccggaaataacccaacgggcgttccttacgtgcgtgtattattccttgttccaggaggcaaggtacaccgaaagttgatacatttcagagtttatcaagcggaagcataaatagttacattattacatgggcggcgaaggcccagcacacaagaagacaaacgggaaacagcggaagacaagggcgacgaccacaggcgcttgactgcaggcacgagctaaacaccaaagccttcatcatcaaggggctccttttctgggtttggcaaaattgagcaagactgagtacaaccaccgtactcaacaagacacacccataagtgcagaataaatgcaagggagtacaagggggttataatataaagggttagggtttgcagtaaacagcattaaaagacacttagttgctcaaagctattttgtaaatacgatcctagagctatacaagattattaatcaaggccgtgaacccacacgaacctgccttaacccaaggcctacgatgattcagaccgaactggcaacccgaccctgggtcccagctcgtcccaagctaacccaggccaactatttccacatttcagttgttaagcaggttttaagaattaaaacactaacttgggtacattgctcggcttgcctataaccgagggcgcggctattcgaataggttatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccctgggacaggtaggcaggactgagcccctatcagcaggacaccggccctatgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgcttt

SEQ ID NO: 65577 - DNA, 1660 bp, Oryza sativa
tcctgcagcccgatgatgatgatgatgcatgagatgacttcgatttggtttggttaatttcttcatcagctggccggccggtagcacgagcggcctcggcgagagagagagaagataggggttgtgtttggacaacccaccgatccggtgctggatccaacggaaaccgggccattttttacaccgatcacgatgagatctggggggagtgcacgcacgcagatgagtgcatcataaatcaccgaaaaatctctctctgagatgggagtttggttgacctcgacattggcctgccttcctgtgagctggctcccgtgcaacatttggcctttttttttcttctttgttgcaattgatctagacttcggaccagcacacgggcatgtgttgtagattgtttcgccaacctacaggttgcacggattatgattatagatactataaatattaaaattttaatattatactatatgtttactaactttgaaatcatagcttcttatagtgaaagaagagctcatatcagttacaatttggtaaccgttaatcttaatttttagaactaagttaataaaaatcattaattgaaagtccgagatagatacgatttcgtatttattgattaaggattcgagagttatcaaattagagccatgtcattttcagttacgttatttgacactcaacacgatctacggccacgataatataatcatttagaacatatgaattttatatgattttttataaggttttagtgtctagtttctagctccgaagaaggtctaagatgtcttatcatccggactactccctccgttttaaaatgtttgacaccgttgactttttggtacatgtttagccattcgtcttattcaaaaaatttaagtaattatttattctttttatgtcatttgattcattgttaaatatactctcatgtaaacatatagttttacatatttcacaattttttttaaataagacgaacggtcaaacatatgctaaaaagtcaacggtgtcaaacattttgaaacggatggagtatataataaataaatgcatgtttacttttattatggtgcttatttatactaaatattttaaagtacatatgtagaagacaaaactacatatgttgttctagtttatttatactaaatatttttaaagttatggatggtcaaattataaaagtttgaccttaaccttctttaaaacatcaattattatagaatcggagggagtactatacgggatcaaaccgcggttttgcaaaacaatgcacaaagttgccgcactcccgcatcgcaaatgaccaggaacactaatgactgctacaaattactgtaaaatcgtttgttactccgtactaagcatgtataagagcacaccgtatactaccagtagagattgatcgagatcacagtaaaataactccaactcaaatctactttcccggcacagtttacggccatactcagtgtcctgtgtccgtatacaagtatacaacagataggtgcagtgacaaattctgaggctctctttagttcccacgcaaaaatttttcaccctgtcacatcgaatatttaaacacatgtatggagtattaaatatagataaaaaaatctaattacacatattgcgtgtaaattgtgag

SEQ ID NO: 65578 - DNA, 18998 bp, Oryza sativa
tgtattgcaatttgcatatatcttatgaattatgtcgatcgtcggttgagaatgtgagacggagaaagaaaaacacaactgatgcaaccgtgagagaaacattggtcaggcctagctagaggaagagatcccatcttttcatttatgattatacttattagccaaaatttaaattttcaaccttaaacttagagttgattttggggggttttttttcatcgcagtttattttccagagtttgcttttcgtttgcaatgttgtttggcttattccctaaataagccaaacgatagccccgcaaatctgctgtaattcacaaaagatttgcgcatcactgcgcccccgagcttcaaattgagtaatttttgtgaatggaattcaaatcgagcaattgccaagtctaggccattgagatgccaaaacctttgtttggtgacacaaagtgcctgcctgaccgctagcaaagctaacgcaaatgccaatggcattgaaatggtgagcgagatcattccatctggttatctacagcattttaaaagtttaaattgcaggaatccacttcaaaaccgaagaacccttcaacttgcacgttttataaatacaggaatggatcgatggtaagcctataccaaacagaaagcaacgtgtatgacgcacggatgtgtccaaaagaaaatgtgcttgtgtcctatcacctttaggcaacatatgttgacactcgactgaacatttggaccagaagctttggatgtgcaaaattccgtagccgattgattagcataacacaaaacattgttttcaacattggtccatctggcagcctaactgcaatgccaaactttgatgagggacagtacatgttcaaatgtttaaacctaactagcagccaccaagatgacaaaatttgcattgtttcctaaggtcaaatcaaaagaacaaaatcgtacttcatgctagagtttattgaaacctcataaaacagttttccacaattccaaggtctcgctgcactttgattcttattgattccactacgtgtaatgatacaacagcagcgaccaattctggtatgtacacttctcttatgagtgggaaagaatatattgaaaagatgatttttcaaggactgcaaatttcaaggtggtgttccatcttgcttattcttttggtacacattctctaggcattcctttgctcggtggaccttcgactgaagataaaagctcccagattttgcatttctttcaaataaattatcatagcgctgcaatttttaaaatatatttgttaggatagtcgaatcataatcaaatgatttttttaggagcgctgcgaccacccccccccccccccaaaaaaaaaaagaagaagaagccaagtagcagacctgtgcaatctcttcccaagttgactgctcagatacaccgagtatctgcctagcttcttgctcagtcattgttttgctggctctacgaatgttattaattgtttcatgggccacaccagttttatttgcatctggcagaatataggaggaaaactaacataagtcatccttctttcaaaaaagaataataacaattctcctacagtcaaagatttggcaggaaaatattaagaaaggtcatatttgtcttgtggtggctattaataagtactaacgtatttccattttctgatattcagaagttagttgtgaacatgtttttagagttgtaaaactttagatacaagctaatcagatatatagttggcctgatctcataattatgcaaatcagagttcttagataacacagaggtgagttctgtatcattgtattgcagaggacatttatgttcaaattaggtaaataaaatccaggcaaacaagtaccattaaaactagtaaaatagagtttgtgcctttatggtacttctttaaaatctaccataagttaggcaaaaaaacaaagatatccatttcttcataaaatcataaaaccgaagaactgacttaactgcaggtaccaaattgttaaaacataagtggacccaacttgtaagtagctagcacagaatgatattagtaaacaatgaaagttcaaacttgttatgacagttttaagcccctagatgctagacatccatgtatcataaatatgtctcgcatgtgagaagaaatcaaacaacaaatctcatgagcaacaggcaacataaaaccaaattgatattgagggagatagcgttatatgtgtaagtaataccaaaaaagttatagtccaaatgcaagcatctataaaacagggtcatatcttacttggacaatgacaatatgaggaattttaattaataattatttgacaagacaatgtcaatataaggaattttaattactaagtatttgataacatcgtttatggttcattttatagaacttggtgcagtatataacaaaatgcaaaattaccgtccattttagtttttgagcgattgttgctccacgtaagcggtcttttcacaaaagtttgctgatatcaatccacatctcatgtttctatctactcagtcaaggaacaaagaggtagcctctatatacagactgcaatggatgaaaaaacttactatcaagtgctttccggtatgcttggagcatagctcttcctataatcccagagcccatgacaatcaagtttgcaataagcttccctgcctgtaaatcaaaaagcaaaactatgtaaataagtggcacaactcaaaatagcagtagttcatgcatttggattttttttggatatgtatgctttcaacactggtccttggaagggggaggacatttcgcaacatatccaatgccaaatcaaccatgaagcaaagccaatccattccaatcaaacctacgggcacgataccacgccacagcggtcgcagaaactagttaccacaaaataattgaagagcgaagtctctaattatcacaacgcgatgccgtaattcggcagcttgcacagaccaaatcatttgctgatgcggtttgacttcgtttgtactgccaaatctaacaaacgaaagcaaggtgcgatccaagtataaaaacaggcaaatccctgtgccggtttatattcgaaaattatttttcccctggagaaatctggcaaactgagcccccgggatcgcatgctgttcttccactcccctaccccgcgaaaccgcgatccattccctcatgcgtatcgaatcgagcgattacaccaaccacacgaggaaatttaacccgtgatcttacacaggcggcgtgtcgcccatcgaggagccccgaatcaagccaatcgaatccggcctcagcatccacccatccacgggtctctacttctcccaaaacaacacaaaaaaaaaacaaaaaaacaaaaaacaaaatcagagcagcatcgcgcgcgcgccgagcgggatgggggcgaggaggaaggggtgagggatgcgaggggaactcaccatggcggacaggcggcggcggcggcggcggccgtgggattgcgcagctgagggggaggggagcaatggagggagggagacgtggaggaggaggaggggtggacacgcgtggtgatgctttcgcttccccgggctgagcctcgcgtcgcgcttggatcgtccagttgggttgggccggctagcttgttctgggaggttctagagatgaaaggagcggaggctcggaccgggcagggctcaatagcctgtctctgggctcttcgttcggcctagtccattttttccttgctagtatgggcctacaagcccgtggttcagctgaggatggaaaaacaccattttgactctctcaagtactatatataaaatataaaaaatctgaaggcctcatttctttttcgcttatgcttatatttattagccaaaatttaatttttcaatcttaaatttagattgattttgaggattttttatcgtagttttatttttcagcctttgtttttagatcgttaaaaaacgtatataaaaattttattcacaaattatttttcatttgtaaatatgccgttttgttttttttctccaaatagccaaacaatggggctgtgattcgctcaaccacagaaaccatgtatgacatctttctcaacgatcaataccatttaatttgtctccctagacggtttggatgggaaaatatgcgatggaaactacatatgtagtggaaacctgtaaattaccgttagatcgaaaaatagatatctgagattcgtccacgttattatgagtaaaaattttactcgttgtccatttttcgatccaaagacagtttccactgcatttatggtttgcactacatattttctcggtttggacatcattttatgttatgtagcagctacatggcacgctaacatagtcttttaatcaatgtgacgtctacgtggtattatatccactaattcattgttaggttaaattatttcaactcctggttgactgccaataaaaattaaaattctaacggtaattctaagcatgttcaaataagttcccaatcaactaacatagttaagttttttttaaaataaataaataaagttattcctataatcaaattgataatccatggtgataatctgctcaacaatttaccatggtgataatattatatgaatattgactctaatcaaacacatacaaagctactatcaaattaccaaacgatcgattttggaaccaatccaattcagacctcagtcagatcaatgagtcagcctctcaacgcttagttacacacattgcattacgagggtgatacaaaaacaactttgctgtggtcaatcgaatctggatatcttgaaaattactgacatacatacgctactggaatactactactactactactactactactactactactactactactactactactactactactagttcttatctcggtagctaggtagaagatcaagaggacatcaagcatccaagttactacagtattcaagctgcccctgatcgaagcaaacatatacaaaatggacgcacgcacgccacactctcgttcttggctttctagctgcatcaaccaaatctttcccagcttcttgatgatgagtcgatcgacttgattcttcttcttcttcttcctcctcctcctacgtcttctgatcgatcgatcgccattgctgtctggcaatttgctgcagctgtaagtgagtacgtcagtaacctaggtggcccatctcccagttcagcttcgatgccaccctgtcgtggtaaggcacgtactcctgcagcagaaatgttcatcagagtctgcaatgttcagaggtctgcaatgcaagaacctgaaagtctgaaacccaagctcgatatatcgagtgactgtcttgtcagtcatcgtgtacctctagcttgtccatcagctcctccgccgtcggcgccatgacgatgatccgccgcgcgctggtgttgatgaacccttcctccaccgccttgtcgatgaacgtcagcagcgagttgtagtacccgtcgacgttgagcagcccaacctgaagaacaagacattcagacatttttttcagttattttgcggttctgaactttctgaagaactctgagcatgcagtatgtaatgtaccggcttatgatggatgccaagctgtgcccatgtaatcacctcgagcagctcctccagagtcccgtaccctcctgcatcatcaacacattcccatgatgaactctgaatgaatattcggtgcgcacacacagcaagatgctggacagataattttttcagtgttcatacatccatctactactactcatcagtcaaagaatcacttgcagtggtagcttagctagctccaattattggttacactagatagaaagataggtagccccagctttctttttttttttcttttcaggcatgtatggtgcatgcactgttcagtggcagaagttaatttcttgctcccatcttgctgtaactctctctgtcagggacttgaatgttctttttcacctgatccagatgagataaacttgcagactatactactgtactatactacaccatgttagtagcacagtaacattttctgactgacagtttgtaaagtaaatctcaccaggtagggctatgaaggcatcagactgccttgccatctctgccttcctttggtgcatatcagcaactggcctcacctcccccactgtctcaccacttatctgccagaaacaatgaaccatgatttggtttttgcaatcagcaatcatcctgagcaatgcatgcatgataaaatgcaaagctgaacagtaaaaagagtttcttggcatgccatgatactatcatactgtgtgttgtagtggtgatggtggtggtgtatgtgcagtgcaggcaaacactagtaggagtagcttatacattcccaagagggcatgattgtgctccaaggggagcaagaaatggcacttgatgatttaactactactctttgcctccatgaagaatggtaaaagggccaggtaggaagaggaccacaagaaattgaagacaggtgagtatggatggccagctttaatttctttgtggcatgattatggatggtataggtatagtgacatggtatacaggataagcacaaaaggtacagagtcattactactcccatactctatcacacattatgggtcaattatatacttattttttcttaagaggtttcaaatcttgcataccccaaaactcttgaaattatatactggctgatacagcctttgtcccaaatagtaactacttttagactatgtacttgaacaaacactattgttattctagtgtatgacaaccgacttagccctcatttacagcaagaccagtaggctttatccttctttttgaacaaaataattgtactagtaatatactagtactgtgaacttttttctcccaaagtaatattttttaacccaaaaagaaccttttttttttatcaaacttcacacacacaacaagaacattcctctgggcaagacaccataggcagtcaaagacagtgccctctacttctacacctctgcctataaacaacaccctgcttctgctctagcatcaagaatgcaaaaaagaaaaaggaaaaaaaaaaggtcctctttctctgtagaacaggatgatgccacagcaagactttttggggttaaggaaattaacatctgtaaagctgcatctcggtgagttgtttaatctcacgccaagatctggatttgtgcccctgaaactgaaagagcatgtagcccttgatcacaactgctcaggatttattctttttttgcccaagtgccaatgtcccctgggactccaacaacggctggttcatggggtccaaactcccaaaccccccatttgattatattttctactagtatcacttaaccaaaaaccttaaaaacttccaaaagatgagctcactgccatgattgggttcgtgacaacgcaagtactgctacgggtacaagctgaagtggatcaactcaaggttattaaaatctcgattctattaactgtcatacgattttacgactttgtaatcctagttaagatgtctgattttacgattctatacaagtagaatcttcaattttatgtttttttaatacatacgattctattattcgatcttagaacttttgattctattcagaatcacaaatttaacaataatgttgtgattataactgaaggtggaaaatagatagggcccaatcgtcagtgactcgttcggggcagtttgtgtgtatgtttctttgtgtgcatagtgacttacatgccgatgagaaccaacaatacattattcctacataatatactccctccgtcctaaaatataaaaagttttcctagtacaatgtatgtccagatttattgtactaggatgtgtcacatctatccaaaatcactcttatattatatactccctccgtcccataatatagcaacttagacatgatgtgacacttcatattataacgaatctggatagtaagcatgtccggattcattgtactatgaagtgtcacgtccgctactaggttgttatattatgggacggagggagtagcatataggagtacggtaactttgttgcaggtagacacaaaaatgagacgtacctctggcgtcatgagagtcttgggaatgaccctgcgcgtggacaacaagatgacaaaaagaagcgatcagcacaagaactcggaaacacaagctactagctagaagtactagcatgcagtaattaaaaactgctaaaactatcaaacaaggagagacacattctcctggggattcatgcagtaattagtactagtagtaacagtgtgcagctagcatggaggagtggagtacccgatgacgtggcggccgccgtcgaagaccgcctgagagacgagccccatgaggccgatgctgccgccgccgtacaccaggtctatgctcctcgccacctgcatgcataacacacacagattaaccaactaaccgcacggttaaatttcagttccagttataactcacgtacaactacgggagacatgcagccatagattaatcaaaagaaaacatgcttttaatgtattttagagccgtttacaaacgtcgattaaattcagtcgtacgtgagtcgaacaggtgggtcgtgtgcactcaaaaggggactagtatgaattaatgattgatcaactggggtagtaactaataagccggcaagatgcggtccaagttactatttttcttggattaattacccaacctgctgcagcagcagcatgtagcagctcatggcgaaatggtgattgatcgtctttaatgcgaggcgacatggatgacgcaacagcagcgatgctgagctgagctgatatgagctatggccgcgaattatggcgccgtgaatgcagtaggacccggctcggctatggaccatggaaaatttcggtcggccgccgcgcatgaacagatgggacggcgacggggaggcaggaggaggaataagaagacgatccatcagcttggtggaagaagtcggcgtgtgcagaaagttcagaaacgaaattcgctatagcttgcttgctcaatgagcagtggtagtagcagaggggattgtttggcaaaaaaagtctgcaacttttgcattatatttgcagaccgatgaactgatacggttatagtgacagactgacagtgaccatggacagaggagaagaagaagaagaagaagaagaagcatgtgtaggagtagcatgcatggacagagttagagtttaattaccagctcgttgccgagctcaatggcggcgtcatggtagctcctcttcttcccctggctgctgccgcagaagacgcagatcctcttgaacctcgactgcctcatctctctctcctctactattctcttctcttcttgctactctctacgatctatctaatccttgcagtgaaacagctagctagtaattgcctgtatttatcaccctcctctcctctgcccttagctagcgtcgtcgtcactgtgctgctgctagtgcaagcaagcgcactacgctgctgctgctgcaacgacgggttccttgtgatcagctagcaatctccctctgagctagtagtgcgccacccatggctatatactacataaaagtgggagaggagagaggaggagattgtagtgatgagttttcactttccggcgaaatggacgggtgggtgtgtagtacgttgattactggggttgatgtgtgagtccgagtcaccttatcgggattgccggtgcaaattggcttcaaaacaggccgagccggcgaaggttgctgctagctactgtatatccatcgtggggttcatctccatttgcagggtcgttttaggagaaagctaagctagcgcctgcttatacaattatactagtgcatgcgacggggaaaacgcctattacaattatactataattagatttaaaagtttttcctaaaaaaacttacggcattttttaagatagtccatattttttttcttctctttactttttgttattacctttttatttgttacttcctctgtctgaaaacatagcaagtttgttttagcctttaatatgagttttaagaagaggtttaaaaatacttgggttacctcttcgaggtgggtgcggtacaggctcatactacttagaagttaggactataataaagccaagtgatagtagagatagtataggtagtttagtgacaaaatttgttatgtttgaaacaaaaattgaaatagaagttgttatattttaatacggaggaagtactgtatttttaattatatggtaaacgcactcgccactagatacatgataccacacacactgggaatatgttcctaacacacgctaaaaaagacggggaccaacaacacatttttgacatcactgaaatcctattgaaaacccatcttattcgtgcataatatttgtggaaattaggacttaaatattaatagttggagtaatgcacccacgacttcattattcgccggtgcatcgcttactatttttgttcttttcttactaatgcaactactttctattaaataaaccatataacatagtggaatgtttcatattgatacaacagaaaaaattataagactagccttcgaaaggtataatcaagaaaaagacagtcatgccacgcgtctatgatagaaaagcccactactgagagacaacagtaagacatcccaactgcactcaagacacttttgggaacaagagggggtgggcgagagaagaatggatccactctcctatgtacagaccgctaacatggccatcttgtggtgaacggaagcgcctccaaaacaggataaaccgtctgaagcagagattggtgagaaaggacctgtctaaagcgaggacgtagttttcacctgaagaaattaattccctagggagggaaggaagacgccaagacaacaaccccaagaaagttacggctccaaaatggcatcaccgttgtcggccctgaaacaggatgggctttagcctggagatcttccagctctcccatgccactatctccccattgctaccatcttccatcagtcaaagaccgtcgtgccatgctttcaccatcgctcctccacgcccatctcctgagaccactgcgccataccgtcatcaccaagagccaatttgttggagagacattgggtctagctagtctagagaataacatcggatcctgccttggagctaccagatccgacagctccttccaccctctccactgccacctgccactccaccaccccgccatccgctggccctctcactagatacggctatgaatggtctagatctgtacgaccacctccaacctcttggtcacctcaatgcccgaactgaatatgctttctcggggagaaaattcatgtcgccgctgtccttatagccacgtggcttgtaggtgtgcctctcaaacagtggctaggcattatagaggaacagagggttggtggctatggtcgtcgcttcgtcgtctcccgtgtcatctctaggattggatgtgagatagaggacgggtgaatgctactactaatttaatccttagaataggactttgtttcaagataaaagataagagatgctgatttgcttgacatagctagaactcaattaaggctttagttattcatagatagctccacacaaagcagcatggacgcaaaatagatgttctttctgtctgcttactaataaatacttagtacatcaacttgcgtagctgcaaacagttgcacaggccaaaaacacggctaacagtggacggcaatatggattattacatgatcaaaaccccacacaattacgtgcatgtggtgtgcgcatatagtggtttgcgtgtgtgtcttctgtgtaatcgataaaaaaaataaaaaataaataaaaatccagcacaagcatgacagaaagtgatatgaatatatatatatatatatatatatatatatatatatatgatctatcatttgtccaagcttaatgccatatctgatctgcaccaatcgtatctctactgcattttttttctcatttttggttgtgcagagcagaggagttaattgactccacagtttggttgctggcgaggctggtgcgaacatgccaaccagcagcagcagcagccacacgccacgccatccgccaagacagctgttgatgggcgcgggccggggcatgtacgcaatgtagccgtgtgcaggggaggcgcgcgacaccggcatctgcatgggcatgcatcgtcgcggcgcgcgcgcacacgaggtgttcggcccgcgtggggcgccgcgcgcccgcgcgcgcgaggcgcgctgcccgctacggccgccgcgagaggggcgcgcgcggcgcggagaggcacgggcaccgaccggcacggggtgatgggggtggcgcgcgtggcgttgcgctgcgtgtggggctccgtgccggcgggcgcgcgagagttcgtgcccgaccgaccgcacggcgcgcgctttgcattggctggtgttttcggtctcgacgcgcgcgtggtccggcagcggcatggcgcgcgggcctgcacgttgtcttgggaattaaaacaaaaaaaaccaacacatgtagtataaaacccagggtgtaccaccgtacattggtcctgaactaggttgttctatgtctctttgttattatagatcgttttgattatttttactagttaaattttttctaggttcgattaaatttgtagaaaaatatagcaattttgttttaattttcatattcatttttttatattttatcaaaatatataggttccaatgttatatttaataaaacgaatttggtattgtaaatattatttttttatataaataaagtaaaaaaagacttataatataaaatggagagagtgctaacttatttataatctactctacaaaattcagagatgtggtacatagggttagaattcggagaagtatgtttcctgacagttggttagttcgatgctcaattagtttagctctacatgttgcatgcttgcagtactgtacttactgtagtgtagtattgcgcgttgtcgttggccgtgtcggtttcatgatcgatcgatgcttgtttgctaagtcactagttggacaacttactaaccgaaagaggttaaaaaatacgattaacttgcatgcgtgttagcgttcggtgccggccacccaagcacgcaccgcacgcgcgcgtgcccgttaaccggcggcgcatgtacgtcgccgagcctgcgacgccggccctgccgtacgtgctcgtcgtcacccggtgaaaagcggtctccccctgcctctatcaatatcaatagaatttcgcaccgtctcgtgcgagtcgttcaaaaaagaaaacggtctcccccacgagcaattttacagttcttgaaaatgtatcattttttccattataaatttgatacctcttgatatgtaggtactttttctgtttcacaatgtaagtcattctaggtatttacattgtgcttacattgtgaaacggagagagtagtaggtactataaggtactaaattttatactaaaattttggtatctctttaaggactgtaaaattactcctcccccacatttagagaaagtttgtagcaaccatagcttattataaaatctttggttcagtttagagaagcttaagattataagaatccgttggttggtaatcaatttgaatatgaagaagttgggttatataactagtttcttttctgaattatataactagagattcttggaatcttaataagaatccggactgtttgggggaattggagcatttgaaagaagtagcagtagctagaagctctttcaatcagggcctctagtttctccgcgcattaatttctcagttgcattgaaaaaaattgtagtagtagaattcacaaaataatctagatgtcagaaactgacaaatccagattttcgctgactactcgtaaaatactcataaattaaactgctttgaattctctaagctcccaaacagaggacacctctttgttttttggggggacaaatgttgatccttaattatggttgcagcaacgcaatattttcaaagtaattctctacacgctgcatgcaagatctaatagcaaatcaaaacaactaaaaagaaatgaagacgatcgatcggagatcggattacaccagatagccggaaggagagaaaggcagggagcttttaacatgcacgcagcagcaaagcaagccgcagcaggtgatcgatatcatatcatcactaattaatcctgaatttctgatacccctaatccgatcctttacatgagcttaattaacagtggaatccacaaactctcatccaccacttacaaagttacaaaatttttatattccacgcaactgtggggaaaagctactagcatcgctttctccccacggtttccattgctagctaatgacgcatcagaatgaagtataggttagactattaattaaataattagcactccatattataatttgggacactgctgatgtgccttctgacagccggccggtcggatttgactgtcatttgaccagcctctagctcctaataacatatgctggccctgatgcatgcctggatgcatgcctacatggctacagagagcatgcaaaacaattgatgctttggttggttagtgatcggtatgtccatccgtaaacaagaagttacactctgacactgacactgtctgctcatttggccatggagctatagcacgccacaagttgccaaactcacccagcagttgagagaaccaaaaaaaaacctactttaggggtgatcaggggcgtaaagttttaacatatcacatcggatattatatagggtgtcgtataggtggtcggatattaataaaaaaattacagaacccatcagtaaactgtaggacgaatttattaagcctaattaatctatcattagcaaatgtttactgtagtacaacattgtcaaatcatggaacaatttaggctcaaaagattcgtctcgcaaattagttgtaatatgtacaattagttattttttagcctatatttaatacttcatgcaggtgttgaaacgttcgatgtggcagggtgtaaaatttttatgtgggatataaactgggccttagtcttttccaatcgatcagactaattaaggctaagactgtttcagggaagaggaaaagaaaagattaagagagtatgtaaaataagatagttattaacgcatgattaattgagtattaattattttaaatttaaaaatgaattagtatagttttctcaaacaatttttctatagacatcttttttaagtaagcgtgcacacaaaaaattaagatggtagaaaaaaaagtagccggaaatctctaaaatgaatccgaaaatcgaattccgaaaaaaaaatactcagaaatccatagaatgaagccggtgcatgtaactcaatataataccatgaatcgacacgccatatatggcccggaaaagaaacatggagatgatgggagaaacatggaccgtccaatgatcaaggagtagggtgaggatcaaaggggatgggtacccatccatggcccatgcacacaccccactcgacacctagcttggcaaccactcctaaaggaggaggaagaagatggtgcatgatgatgcatgagctagtcttattctatgcatgcgttcgatggctgaagatggatgatgcagcctcctcctgcgttgcccccctcgtgccctagggatgggagacatatgcgccttttcggtaatgctgcgagtccaacacccactcggccaccctcccctgatacctgtatgaagttagcttattacgatccctttccatcttaaaataaatcaatcactggctaagaacggtcgtagttgatcaccatttcatcaccatcagtgaaatgataaattaaacaagcatactattttcattaaaaaaatcgatttctaggaacgaatctaaacttagactacgtttaaagatttataactagaagttattttttaaaagaactgagggagtatgtatgcaccttgcgcctctatacgggcatactctctctgtaaaaactaaaaaaagaacaaacctgagtttgaatctggacatacgctatatatgtctgatttaaacttaggctcagtttttttttcgaagggaatatgcatgatgcatacacctgctatgagttagatcaatccatgcatggccgtccaattgtactgtggtgccatcatcatgcacccatatgcactgtatccgagctggtccaaaacactaagctccctgatcactggtcccaaacactaagcccctgtttgggacgcggtgccttagtcttttccattagtactttttaaagggattaggctttttcacgtaaaactattaggggtttctttggaaaacaaaaattttacagaactttaacatgaatcggttcgattttcatgaaaagcgttcagaattccttaattcatttcaagcgaggccttatgttttgaatgaggcataaaacgaggggcgggtatacatccccttaggcattaagtgacgaaataattttccatatatttttttagataataagaaaacatatggaaaattttccatgtatatatatgggcgtggttaagaagttcttgtattatctccatgtgaattgtgaaggctaattatattggggctttaggatttactacttctcaccagcatctctttttctttaaccttggacagacagtaaggaactcccctacggtatattaagtttccttaatataacaaagtttatttacaaagtaaacaccagcatctcttgagtgacgaaatcctaaaataacactgcaaaaatgagatattttgtggtacattaaaaaaaacaaagagctagctagctagccagatgatcaccagtacattgtactgcaatctttttgtttgaaccgtgcacattgtgcaatctacagttacaacactaagccgaaatcaagttggaacaaataataagtggacaccggaaatacttggcacatcaactttgtggagcatcatatcaaggccccctgattaattaagtgaccaattaagcatttggtgtaacctagcttgagtcacccaacacaaaacacactgggaccaaccattagctctcatgggtaggcatattggatccaattctcgattccgattgtttaattagtttgatccctttcatgtgcttttattattcattgccacgaagattgaagcttttaacacatctttgccatatatagtaaggttgtttatatatgcctgctagcttaattaattatttgccataagccatagtcagaatttaatttttagaacttgaagttgatttttttattttccagcttagacttttaaattgctaagaatagaaatataaacatattaattcttaggaaaatgattctatactcctaggattacgtactcctgttcttattctaaatttatactaggttgctttgcgtttatttttctcggattacaagccatagctaactcagtcaatgacagctcttgtacaacatgttgctagctgctcgttttcgatggtcgatttccaatggcatgaacatatataattaaggtcttctttaggcacaatgagtttaatttaacggattaagatcgcacttccaccgaccaattgagttgaattccttagaattccaacatcggcacctgcttggaatgatttggcccctagtgtgctgggcactataatatttgaaaatcataagccccaggaatctcccaacatacatgcatcacccttatctttctctccctgccaagcctttttttttctctctctttttgtcttgctttcttccaaatgattattatttctccttgtgatgatgatgagccgacagtgctcaattgagctgttccgttacatgcccggaaaaagagctgttggttatatggactgagttcctcttacttaagttatgtgattttagaatcattaacatgtggtgtccatagtaaagaaagactacatgttagtgattcaaagtcaggatgtaaatccgttgttcatgtgtattggatatgccttcaagtaaaaggtagaacaaggaacgggatatgtatgtttcagtttctaaaagaatacgagtgatgaggaataacaggttattaaaatagttgcacaattaattaatattattgtctactacctcctttcttaaacagatatcattctaaattgctgtagtcaaagctataaaccttaaatgattaattaataaaaaatatgaagatttgacatgagaaaatgatatggtatatttgatcatcaaaagcaatttcatataattatatttttaatagcttttagaaacatgtagttaaaaagtagtgataaaatatatatgtgtgttggtactgggttgatttttaaaatgacaagtaaaaaagaatgcaagaagtaatagataaacatagagttagttagcaaaggatggaccatctatagacatggcgcacataagggtacgggcgccaaaaagttaaatgatacatctctaacgagatgtctaaacagtaaccatggtctctcatgcctctttgtcttataaattttggaataattaggtgccttgtcccagtaaggattagagtttctttttctggatatgcctataaaggccatttagattccattgcaatcaaatccatcttttgctatcacaattcttccattgcatgaatgaattcagctgataatctccctttatttaaagtagtgagttttccaggcatcgacaacgagatcaagcaccaagccactagctagagacccttttgtccaactgtaaaacccaaccgatgat

SEQ ID NO: 65579 - DNA, 23740 bp, Oryza sativa
ctagctagagacccttttgtccaactgtaaaacccaaccgatgatgtccaacactatacactccataaagataatattcctggtacctttgagaagtggcactagagggaaaaatctaggccccttttgagccaccaagaggaaatctgataggttatgagcgaaaatgacattgctcccttctaacaccacttgtcagcaacagttcattaaccagtggaaacaactgtgcctaaacacaaagttgaccgagaattcaaatgactatttaaccctctaacatgagagatgcacttgatagtgtaatgtatggtttcaatcttgaggtctcgtgttcaatccccaacattctcataatatttttcttaaaatatgttaaaatatattttcttattattccgatacatgtagtagctcttcctaccattttttgtagtatgatgatcacgatctctcgctttcacttaaaatcatcttctctcctataaaaacggttcaacttaaaaaaccgatttcttaaaaaaacaaacgttataaaaaccaaacagattaatcggtccaaatcctttcaccaaagtaaataaaaaaccgttataacgcacgggcctaacagtcttgagtaaaagttcatctactgcctaactagcacgcagcactgcaaccaaccaaacgaactaattcaccgaagggctctgctccggtgtttggcgagtttagccgaggcgcccgcgcgaaaaaaaattgtgcatatacttttttttaaataatttacgttcatgtatctgtatgagaagaaatgtcacaaatatatatgtcccacaaatcgaatacgcgggagcgctcacaaatcacgttgcggattgtgggagcactgtttgggccgttcccgttgaatgggcgagcggaaccgccatggtcccgcggctacaaaaatgtggcagcgtggtggccagcgggaccacacggcaccgagacggtcccacggttccgttgcgtggaactggctctgtgaatagtagtaaacaatgtccaaacagcgtaaacaatgtctcaacggtgctaaacagcaccgaacagtattatatatgtctcaccctatatatgcgcagccggtctcgcatgcccagcccgcgggaccgtcaatcccgtgtttttaggtcacgcaaaacactcggtcctgcgttttcaccatgtaggatgtgcatatttatgcaaattcttcgtatgccgtaaattattaaaagaaatatgtatattcacaattttttttttttgctggcccgcgcgagcgagcgagcgaaatcacgcgccgtatcgaggttttcggtgggccgctagcgcgcgacaagtctgtggccggtgagtggtggtctgattttgtgctgcgtcgtcgccggcggcggtacgtccacggcagaatgggggcctcggatgagttgtcgcgctcccaaaattcccaataacagtggttcatattagagttgacatctatgataacaacaatatatatacaatgttcatcgagagtttgacatctatgacaacttggtggccctgtttagcacgttggtttttttgtcttcttcacaagacccacatcatacatatccataagcgattttatcatctttttacaacccgcacaagatagtgcgatatttctattgatatagtagaaaaaatgtcatgtatattgtcgaggaaaagaaaaacaaattaagcacacaacacctctaaggaatgatcatcgcctactcgttggttggcttattagcggtaaccaaaatttaaattttattgcattattgtggagttgattttaacttttttctaagcacattttccagccttgcttttgaaccattaaaataaagatatatgtaaacgttttacctataaattattttttcttcatttattttctcacggcttttcatccatagcttaaccaatcaaaactatattaatacattaaccatctatcaacgagaaaagaaaataaattacactcttgagtagtacatgtattattcataatcaaattttatttttgcctcaacttgaataggtcgacctttagcttgcatgttagttccagaatcataaccatgtgcctaacatgcaagggatgaatgtgcatccgcttaaaggagtaaaatgaccttttcaaattaatcaacacaaacctcaactaagttccagctatataaacaccctcatctgaggatgcaattaaacgataaatttgaccaaaatttctgcttcatcgatccagattggtctcgacgtgcatagtatgtttcaacaaacatgacatgccacatgtacggggtatctactctttttttttaaaaaaaaaaaacttgggtatacttcctccatcataaaaataaatctatgatgggatatgacacatcctattatttattatttatgtagcactctctttgcttaaagttatagggtatttttttaggataagattgatcaataattactgtattaaaatatcatttgtgatataaaagttttataatcataagcaagttctttttaatattctactattataaaaattgaaaatattttgccggtattttgatactctctccgttttttaatagatgatgccgttgactttttcttcaatgtttgaccattcctcttatttaaaaattttatgcagatgtataagctataaatcacacttaaaatactatgagtgataaaacaactcataaaaaataaattataattacgtaaatttttttaataagacgaatggtcaaacatgtgagaaaaagtcaacggtgtcatctatttaaaaacggaggtagtatgtcatatgtatctaagtaggttttttaagtttgttcgcttttggaaatacatatccgtgtttgagtcggattttaagtttattttgagaaacacaaaaggagtcgtataagaaatatctttaaaaaaactcacatgctaacttgagatgaaagttggactcttaattgcagctcatgattttctaaaaaaaatatccaagcgaattcctaaattgaatttcattctagctaaatcgtataacaataataagatcaaaatagcattcacccgtagcaacgcacgggcacttttctagtaaatataaaaactttattttgtgtcacaaaaagtgtatcctagtagagcaatcgttgatcaaattcttatagtaagaaaacaaaatgtgtcatatattttaaaacggggagatatataatattagcagcccaagcccccttgtccagtcatctcattatgatcatgctgacaattactccctctgaaaaaagaaatctagtacagaatacgatatcttttgtctagatttataatattaaaatatatcatatttcatattaggattattttttattaaacggggagagtacaagttactacagcggtacagcccatccttcctttcatgatggtataacgtacggaaaggagtcgccgctcccgagtagtaactagtaaggctccattcgaaaaaacagcttggcttagtttttttaaaaaaaaacattaaacgacaaataatattatcctatactctgttcattaagtacttcgtcctgtactctgttcattaacaacttcctacttttaaaatttgtgtcaaaatatgataacttctccacttacacttttctcaactaatcacaagctcataaccttctactatttaaattccttacatatattcttttacccaataaatcataatattcatctatttaatttcaccaacctttttttaatacccatgttaattctggaattacgtatattttgggaccgaggtggtattaacttattataaacttaaaaaatgtgtttgtttgatttctctttaaaataacctctgtaaaaaaattctaaaaaataaaacacgccgtttaatgatttaagagaacatggcccaataagtcggttggactcggtttttctctggtactatatccgttccaaaataagtgtagtcatgggtatccatgtttaacatttaaccgtcctttcttatttgaaaaaattaagaatttttttttaaaaaaagtacactcataaagtattattcatgttttatcatcaaataatattacaaatactaaccataaaaaagaattgtaataagacgaatagttgggacctgaactaaggtaagttagatttaggagctgaggtctcccaaacgggctcgtagtgaagtactgatccatcgcaatgctggccatgcacccagcagcagctcatccagagagcgtggcatccagcgatctcagacaggagtagtctttccccccacgaaacacaccacgacgccaccccgctcggtgtacgtgaggccccagatcagccgagacgacgaccttgctgatcgaggcagcgatcaaccaatcataatgctccctccggttttattttaattgacgttttaaacaatgacatggtctataaaatatatctttgatcttatttttctactataatatgcctcatctgtttcaaaacgtttgacaccgttaactttttagtacgtgtttgatcattcgtcttatttaaaaaatttaagtaattatttattcttttcatatcatttgatttattgttaaatatactctcatgtaaacatatagttttacatatttcacaattttttttaaataagacgaacggtcaaacatatgctaaaaagtcaacggtgtcaaacattttgaaacggatggagtatataataaataaatgcatgtttacttttattatggtgcttatttatactaaatatttttaaagtacatatgtagaagacaaaactacatatgttgttctagtttatttatactaaatatttttaaagttatggatggtcaaatataaaagtttgaccttaaccttctttaaaacatcaattattatagaatcggagggagtactatacgggatcaaaccgcggttttgcaaaacaatgcacaaagttgccgcactcccgcatcgcaaatgaccaggaacactaatgactgctacaaattactgtaaaatcgtttgttactccgtactaagcatgtataagagcacaccgtatactaccagtagagattgatcgagatcacagtaaaataactccaactcaaatctactttcccggcacagtttacggccatactcagtgtcctgtgtccgtatacaagtatacaacagataggtgcagtgacaaattctgaggctctctttagttcccacgcaaaaatttttcaccctgtcacatcgaatatttaaacacatgtatggagtattaaatatagataaaaaaatctaattacacatattgcgtgtaaattgtgagacgaatcttttaagcctaattacgccaccatttgacaatatggtactacagtgaacatttgataatgatagattaattagacttaataaattcgtctcgcagtttacagtcggaatatgtaatttgttttgttattagactacgcttaatacttcaaacgtgtgtccgtatatccaatgtgacacgtcaaaacttttcacccttgaactaaacagggcctgagtagtactatgaaacggaggtagtatatgctaatgtactgcacgagcagtagacagcattgcagtacctcacctttcttcctctgccatcctctcttgccgcggctttcgccaacaacgacagcctgctatgctcacatcggtgcctccaggtctccactggtggaagccaaagcaagcagtgtgtgtgcctgtgagcctgtgcagcacctggcccatgattctgcttccacccttgccttctgaaacgggcaaattttcatcttcccttttcccctccctgctgccagctgctgatgatgcgttttcagaaggtaacagagatgaatgccatccatccagatgtctgatctgcacgtactagtacagcatggatccattcctggccattgacaaaattcgggacattttacttgccatatgagttcaggggacagatgcagagtgcttggctggtagactggcttaccgttcttcattttttttttaccatggtcaagtgtcactatccctcttgccgcagatcatcaacagtggaggctttatccgattgtcctctagcacgtcgtccttgagcttgttgggcatcagcttcacattttggcgccatgccatgaatgcacacactttatactccatctagcttccaaatcctgggtcttccctgttcctgaaagaaaaaaataagttggggtgcagactgtaagtgacatcaattcactcagctaaagaatcacaaaagtggtgaccaggtttacaatgttctcaagtaaagacacagtgtcatctctcttaaggattgacggcaaacctgatctgttgtctattcacctggatatatacatgcagttggctacatcatgaatgctgtacatcttaatacaaagtgctattgtttctgactaaatattcatgatctgattacaaacgtgtaactgtgaaatgcatgttagacaaactacataaagagggaaacgctggaatcccaggatggacaatgactaaagcacatgaaggacaaaaaacaacagaacaagggtggtcatctaccattccaccaagccctgaagttgtggctttcggtcatacaacagatactaacagagatctcaggagatgctagcttggtagaagagatctttggggcttagactagagatcctgggggccacctgacaagatgctcttcagtaggagagtgggatggctagcctcatccttgtcctcttccatccgacaagtaggaggttttcatgcttcatggatcccctctgatcaacttggttttcagtgatgcccacacagtgacccttcaatgaccaaaaattcgtcgttacatggatgaagttcaattggggtggcatctctgttgatacgttggaatttcacattccatgacctgtaccatgggcaagtcattttctcaatgttataccagcacacgatagattgaaacagttaacgaatccgtacctccagtcagcaccgagtgacacttaattttggttacatggcctctctgcaactactaatgacattcatgttactttcttgattgctttgttgctccatccaccgacgagccacggatggctgatggtgatggctcaccttaatgccatctgcctatctgcctcattgatggatctaagaatgagagaacaaagcattcttcagaaagcatgacaggactcctaaactctgcttactgacagtgccatagtggacatatattcgactctgagtgagaataaaatgacaagacacaaagtgacacacctagcattatttcatcattcttttgattgcaagaacacataaatgaaattttgttgtctgtacacattataatagccaaacaagaatatggagcttatttatgacaagatatgacaggatcttagatattgagttgtgagtttagatatagacaatgaaccaactgagcttttgtatagtaatgttgatggtatttataaaacaagtcttcatcaccaagaaattgtagcaatcctaccaagcaacaatcatgaaactcagatgaaacaagaacaaatctatttgacatacacctagagtaagcaaaatagtattcttggatctccaaaacagtgagtgcacggcttcacggttgcacaaattccatgatttatggtttaaagaatgaccaagccacattaagtgctttgaacaaaacaagccatttcacacatatgttttgttgattgggcaagagcaaataagtacttgtctgtatccagggcccacctgctttggatattttaaatatcctcctaaacatgtactttaaatatattgatataagcatgcaaacagggatgaaaaacgcaacaaccaagttccaatagtggagaaaccaacaaaacttagcaaaattcaaaagatataacaactacatggttatcttttaaacaaaacactacaatgactgaatggtcagactccagttacctaagaaatattcaccattgcagattcagctaaaaagatcaccaaatgacatgcgctcagtccgggcactgccaaaagaggagaaacagaattttaaatatagtcttgagctcttaaaattcttgattcagatattcttataaagtgatttaatataaaagagttgatttaatcttactctttggcacaacatatggatcctgtgattccctgggccaatattgtcctcaattgtcgattatcgagacacaaggagtcaagggcatagtgcctataaaacctgtacaacaccaaacatcaaccaaaaggtaaagtatgaattagttattcaatgtaatgtacactataagtaaaagtgataacacagtcgcactcacatgctcaaggtattaaataccagttttaacagcaagtgcatttaatatgggtagatagacaagctcactatttttctgcagagctctgcctagcacacaatatatttgagtatctgggtaaataccaacagatagcataatcgggacaaacataaaggcttctttggcaaattgtcttttgcaaagtcgattgattgctgcactgaaatcttcaatagaagcttcaaatcctgcatctagaagcttaccaactaacaaaacagcattgataggcattccttttgcgcactgagctttgataagtgttgtgtacgcaaattttctcaacttaatgccattttctctgagggactccaaaagtatttctgcttgaataacttttcccttcaaacacagcacattaataagcaagttataagtaacaggtgtcggcacaaggccacggcataacatgatgtcatgtatgtggaaagccatctgaacgttttctgattcacagaaaccttgtataagggtattgtaagttatcgggtcagcattaatacctttgctatccatatctttgagaacattgatagcctcatcaaatctgagctgcttacaaagccctttaacaatgacactgtaagttactgcatttgccttgatcctctttgcaaccatttcatcaaaaagacttagcatggtattaacttctccagcttcagagagtgcatccatcaaggtagtgtatgtcactgctgttggtagaagtccacttagctgaatagccctaaaatagctctcggcaagttgcagatccccaattttacaatacccatatagaagagaattgcatgtgacaatggttgggtgcataccagctacagtgatctgatcatacaaacgaacagcatttacaatatcaccaagttttgcataaccatcaataacgacattatagaacactacatcagttggctgatattttctagctacattttccaaataccaccttgcttcaactaacaatcctttcttgcaaagtcctagaagaatagaaaaatggttcagtgatgttggcattaccctctgagaactgcacattgcattacatacttgaagagccttttcaatttcccctagcttgcaatacccatggataaggatggaatatgcgataacatccatatccaaaccaatattgtagatctcgccgagtaggttgtcaatttcgcagaacatgccttttttgaagagagcattgagaaggacactatatgtgacaatattcaactgcaaaccttggtctaggacatccttccttaccttcattccttcttcaacatcaccactttcgcagtgaccagcaataagtatagtatatgtaacaagatcaggttcaacaccttggcctctcatcatctggatgattttaggaatttcttttgttaaaccaagcaatcggtacccattgataaggctattgtaggtcacaatctcaagttccattccttcttttgtcactctctcgaaaagatccaatgcttcctccattgaacctactttacatagaccgtgtataagggtagaaaaggtatacctgtcagggactaatccatatttcagcatcaggcataaaaatgattttgcagactgaacaaacccccaattacacaatgcagacataagaatgttaaaggtcattcccaagggtttaaactttccctccttcctagcttcctgaaggaaagataaagcttctccaaccttatcttgcttacagaggccattaataataatactatgcgaatattcactgggagagacaccacaagactccatttcttcaaaaagctccaatgccacgtctgtcatccttaagccgtgcaataaactgtcataggtgaacaccgagatttgcatgtttaggctgctcattttactaagaacgtaaagggcatcatgaaccatctgagctctagcataactgttcgctagagcatcccatacacaaccgttggaatcacactctctgaatctgttccataagatgtcacagagagcagctgcagacccagatcctacagcaggaagcgcaataagattaaacgcgaacaatttttatgttactagtttgtcatacttgcagagaccttctagtaaaaaacgaattacagtaataatactacaccaaatacaactatgtatgcattgctttcgacccttttcttactgttttttatatggtaatgatcaattgataatgcctctggaaaaacaatatatcctgtgtcacacattcatatcgatcagaagttcaaaactaccgatgccattcctacgcctcctcacaccaatcaccatagttattcagataccacatgagtagagttgataatcagaatggggaaaattcatagcatgctcaccttgctcagtcaccagctgcgccaaggctgcccgcatcgcgcgccacctcctctcccgcagaagctcatggcagagcttgatccgcgcgacagcgcgggccttcctctcgacctcctcgtcatcggcagcccccccgccattgcagccaaccctaggcgctccccgtgcaatcccgccgatggagggaggggctcgggtgtccctgccaacagccgccgcgtcctcctcggactccgtcacctccgccgccgcggccgccgccgagggataatacgagagcggtctccacgcgggcacgggcgggcggggggaggagcggcggcgccggaggtgaggcaggaggaggaggaggagggggagcgggaggcgcggtcggaagggcatccgaggaaggggcagggtctcatggcgcggggagggtgtgcagagctccggctccttctcgagctagggccaccggcgctgcacggccgcggcggcgaagagcatctccggcggcggcggcggcggcggaggcggggtttgtgtgggcggcgcttcaagggaaggggattttaggagaggtgtgacggggaagtgggccaaatgtttgtggacttatggagtttttgggtgattctttggaggcccatattgtagggcactccagcccaaatattcgccgaaaggaatatagttagcagcacagaagtctatacgaagtcctccagtatggactcaaattttcctctctcactgcaacatcagaagctgcatttgcttgaattttgaaaatcaggtgaattttacttccttggctggtttgcacagtgattttctttttatgtggtgtctacgtggtaagccccacttatcagttagaaacgatagacccacatgtgagttacaactttagtcttcaaccccacctcccctctttctctctcgttctccttagtggcactgtctgccacacgatctccttgaagacgcttgaatctagcggtggagcgatggtgtctacttagactcatgcgatgaacctgtggacaactccgatcgcctctactgcacctcgatctcatccttaagtttgatagggaggaagatgagagccatattgtcgtgtgcctgaggaggaggagtccttgccggacacgctcacgactagatctagtctctcccactctactccctttctccggtctccttcgcgttcgctacctccgccatacaccctaagctctgttgccaccacgactctttctcaagttcggttaggatagctgtaagctaaacttgaggaaaacacaggagagatgaaggtggtgtatccgtgtatgatctcagcgccacctggaggttagctaggatgacaacagcgtgatgctattgggggagttcaatagaggcagtgagatctagaagctcaacgaagccgaagaagcgactccaacgggctaattgcatcaagagccaggcatggacatggtgcagctttggttggagcatcaagaccattgtcttgtcgctgaaggccacggttagcagaaagagagtagtagagggagaatagcgtgataaattaaggttcactagcatgtgggcactacaatttttcttagtgactttagcataggagaccatgtcagcataccacgtcagacaaaattaatgtacaatctagtcatagaggtaagttgactttagttttcaaagctaagggaggtgcagatcttggtactgtggtttgaggaagcgaattcagattgagcccctagggaaggcggtgatatagacattttctgggaggaaattagttgagtacgtactccgtactaattattataaaattaaaaattggatttatctgatatttgaaaacaacttctatatgaaaaattttccgtacaaaataaactatttaacagtgtaaaccgtttaatgatttaaaaagcatgcgattcttctggacattaacaaatgtgtctattgcccccgcgtcacccccacgctggcgaccggagaagggtgaactgaaaccctagcgccgccactccctctttccctcccctgcctcgcctccaccggagctagccgccagacaccgcgcggctaactaggatggtgacgggggggctcagtttcatcatcctcatgtgcggagaggaggggcagcggcatggagcagggccgcatcaacacgttggggacaagtggcagcgatggccacatcggcgcatcagggacaagcggcggtgacgacgcgacgaagtcaagcgacggatggcatgatggaagcacgtggagacgacggcgcccctaggggacgccaagctgctcagatctggggccatctcggcttgccctcgctagttgctacaagcagctagggcaacaggtcggcatggcgatgaaggccctcccacgcaatggcaacgcaatggggcgagggttgtgcagcgctggtggcacggttggtggcgtggcggcggcggcggcgggtgtggggttccatacccaccttggttcaaaagtgctaatgggcaactggagcgactggacacgtgtcgcgtgcagaaagggggcacagacggcgtgcgtgtggagactggagacgattttttcggttttttttctatttctatttgatttttttctggttttcttttggtttctctttctttttttttaaagatgtacgtttgcaaagtttgtattcgtatgtataccaaattttgtatttgcacgtatacaaagtttgtattcgtgattttaatatgtacatatacaaagtttgtatacacatacgtgaagtttgtatacgcatatacaaactttgcatacgtgtatacaaagtttatatatgtgtacgtacgggatgtaaggtttgtatacgcgtatacaaagtttgtatttgtacatacgtataaaaacataaaaaaatacttgtatataaattttgtaaatgtgtatataaactttatatacgtgtataaaaaattagtatacgtaggtataaaaacctaaaaaaatacacatatacaaactttatatatgtgtatacaaactttgtatacatatatacaaaattggtatacgtacgtataaaaacctaaaaatacacgtatacaaaatttgtatttgtacgtatataaagtttgcatacataagtattaaaaacagaaaaagatatggaaagaaaaaaaacagaaaaaaaacaaaacggaaggtacggaagaaaaacagaaaaaaccaaaaaaaaaagagaaaccgaaaaaaaaaacaaaaaagaaacggaaaacgcgggcgctcaagagaaaccgaaaaaaaaaacagaaaacgcgggcgctccaagcgagtgctgtccgccgcactagtagtagagaggagagactagatgggttagaactgatcgcgcggggcgcagggagcacgattgatcgcccattagggctccccaccttggttggtttcggcctgctctgtcgacgacggtcagtcgaggcgcgaggaggagtgcccgctgcggtgcttgatcgaggagaagtagcagcaaccagtggcatgcaaccttcaacagctggcgacgtgagcgagtaagcggctggtggcggtgacgctttcttctcggttgccggccgaccaatatcctttcggtggagctcctcccatcctatggctagattccgttctggctgtggggagcttttgggggagggtggaggcgcaagctttgtatagcagaggatgacgcgcagcatggtgggtcggtggcctcatgggcctgcctgagttgtggggtggtgggctaggcatggtggctagagagacggtccgatggtccgacgatgtacattgtatgggttggttgtgtggttttggatgaaaatcattggcgaaagcctcgattggcctttggttggctcgactacggcggcgcccttaggcatcgtttccctccttggaggcgtcattatggcgtcttttctccctcaccgtcaatcttcctgcccgtatcatggtcgttggtagacttctgtgtcgaaactctataggcctatctgttcggtgaggccttcacattctaggctccattattggatatggcgagcgtccaacattctttgtttctgctaggtgaagccagagctgcttcgttgtgatgcgatgaagcttggttgcgataacatgttgtagtcttccaggggtgggtgttagctgttgtgcaagaagtggtgtttggcagcttgggctgaggtccaaagcgggcgtcggtattgctttatttgttttggcgatgcctttggtaataacggtgtgttagctatggagttggagctgttgtgtcgctaggcgacaagctcgccaatgataacacttgtctcaccaagtcatgatctctgcgtcgctttacaacaaactctttatcgatggatgctttgggctccaccattatttttttttcgattattggtagcgtaggtttttttcgcgcatactatgcggtagacgtaaatggaacgaaagctagccggcaagttaatttaacttagcgtgtgaagaaccgaagcgcataaagcgtagtaattgactcgaccgcgagcgacgtcgatcgatctgtctccctcgatccataaccgaccgaccaattacgcgccgtacgtacgtggaacacggtcgaacgatccctcgatcgcaccacacgatgacaccacaacccccacccccccccccccccggcaaaaaaaaaaaaaaaagctcagccacctgcgtctgcgtctgcgtgccaggcggcgatcggtacgagtagttttcgctgccagatcagaatcaggttctcctcgctcgtcgatcgtcttccgctacttaacccccgcacacacaccgcccccatttccatcctgcacacagccatttcacttgctttgctccacgcctccacctacctaaatcgctctcattagtactcaattaagtcgatcggcgagcgattcagcgcggctcctcgaccgatctctccgtttcgtcagatcgatcgatcgatcgatcaggtacgtgcaacacatggtgtacgtttcacatatatgtcattcaacaaattaggtagcatcattttagtagtgccaagattgattcaaacaagccctatatcaatttttgtgtttattgcaagtagccttctctcactcagcccatgtgctctgtagtctgtacaaatatagtcctactactactcgagttgagagattcagtttagcacatactgaattaagcccaagtttagatttgaagtttttcttcaaactttcaacttttccatcacatcaaaacttttctacacacaaacttctaacttttccatcacatcgtttcaattttaacaaaacttccaattttgatgtgaactaaatacaccctaagggcatctacaaaggtagagtctaatacgagctatctatattaattaatattattagagactatcctcctacagtagtaaagacaataagatttctaaaccattaatacactaaataattttttattatacttctttccttttctctatcctcattgcaataaattttccgttaataaataataagagtcgactctaatccgttgtcatgcgtaacagcgatatttctcttttcttccctctttttcttccacgtcatcaaatttatttgcatgacaacgaaaagagctcgttattaaccaccattgtacatgccctaagctggaactgacatatatgtatatgcatgtatcgctggttgctgatttggttgagatgggtttaatttaattctattcaatttaattgttgtttgcagggctgtgtattgcgccgtgtagtacgtgagaggatcggagtcggagcagcgagcgagatttgttgaagcaaattaagtagatcgatctcatatcgatcatccttaattaatttatcatggagctggtgctggtgatatcgctgccgctgctggcgctcatcataatcgtcgccatcgtcctctgcgtcatctgccgctagcttagctgattccttcctgcctccgcgatcattttgcatacatgtagtatgtcagtatgtggtgcatcaaatgtgatcattttgccgcccgttgttgttgggcacggtgattgacgacagaaagaattactcccttcatattttaatgtatgacaccattgactttttaaccaacgtttgaccattcgtcttattcaaattttttatacaaatacaagaatatttatgtcatgtttaaagaacatttgatgataaatcaagtcacaataaaataaatgataattacataagttttttaaataagacaaaatgttaaacgtttattaaaaaattaatggtgtcatacattaaaattaaaatacagagggagtactagagaacacatggcttcttgttccttctttggcctggtatggtgtgagtcgttgtgactagtgtgctcccaatccaggctgcctatacatttgtccatttcttcttcttcttcttctttttcttcttcttcttcttcgtttttctgttggttactgatgagttcttttgctaaggtttccaactctactctcttatttttcacgtgtatatgctttccaaactactgatcaatatctttttttttcaaaatttctatgcgaaagttactttagaaaatcgtattaacctattttttattaaaaaaactaatacttaattaatcatatattgatgagtcaatctatccttatatgtatgaaagattagttcacaccactaccaaccgaacgcagctctaacacgaaaggcatcgattccaagcgtgcggtagtctgtccatggtgagtgcgtgagaagatgatcccaacggaagaagagcacataccgtgcacagtacagctcctgtgctgtgtgtacgcctagctgcaggcagcaccggccggcacgtggcacgcggtttttctgggcttttggcctcttccccctaggctcgcacccccaccaccacccgattcccggaacccgccccatttccgcctcctccttcgccttcgcggcttcgcctctctcccacacatgcatcgccatcgccgtcatcgtcaggactaagctctgctctgcatctgcaccaccacccagctgcagcccgaacaagaagacgagcatctcatctcatctcatctgccgatcgatcgattcgctgcaggtacctactattaccactactagtacggtccttacgccctctagtgtcagagctaagcgtcaatcgatccagccttttggattcacgccgccatatagctcgcgctagctccccccaaatcgttcccggtaatacttttgctgctggtttcaggcgggcgagctgctctgcagctgctaactcgccatggcaccatcaacgctgtagagctctctgtcgttgctgcatctgtcctagctaattaaatcaagattagctgcggctgtactgatgtagtagtgctagtactgcaccttttcatttcatcgggtggatgagttttttccagatctattgattgatcatctgtttaactgttcaagatagcttttactactatatagtcaattaattagctctagtagatttgacatttgagagtttgaggctactcatgcttgcttgctctgcgatttttttttctctaagaaaaagagagagagagaggcattaatggctactggatttatgtaggaaatggagtggttgagaaaccatcaactgtagcttccaataaaattgtttgtagtagagcaaggttcaagattcatctgttgacttgtggagtcatctaatagtaacagtcaagagtgagatgtgggttagtagtgttatctaattggaatcggatccaactgttgccaactagtactagtacttgtaacatgggcagacactccagcagcacaagcagctactgtagtgtttagctgtacatttagctgatgaaaagatgacgatgctactactctgatcttagctgaatccgagaggcaacgatttctgtcggaaattgatctcttttttatgaaataaccggaattccgaatgcttcaaacaacagcaaaagaaattcagttttacgcgttagaagttaagcaatccttgagaaattcggtgaggtttatctcctcactcgcattgattccaaagaacaaatgttgatttgatagattatgatgtgcgagtgcgactttcttgtaatcgcgtagcgatatctcctcctcctcctcccctgtttcgtgcggtttcgctgccacgagtgtgaggtgtgtgaggaagctttccatcccctctcttgctctgtaccctaacttgttttcgtccctttaattcatgaggtagagctcctgcctttttcgctcaatcacatcatatttacagttacttcacccattgatatgttttctcaagaaaaattatatgcgactaaattcatcgtgctatacaattttgcaaatcgcaagcctatggttggagcacccatataccgcatgtttcagaacacataagtacagaaaaaaaaatcatgacagcattttgctgcttttctttttctagagaagtattttggtactgcctagaagtgacgaagaaggaatttatcaattttggtttgaattgcagggagagctgaacaatggagttcgtgttgatcatctcgctgccgctcctcatcctgatcataatcgtcgcggtggttctctgcatcatctgccgctagctgaatggtgacacctcattgttcttcctgcccatatcttgatgtgaacatatcatgtatcaattgattagtatctcatgactcacaacagagcagtctcgtactctctttggggggccagtgtggttgtgattagtttggccctagctttgatgagcaaaaagacattgattctgaatgtcatacatacatatgtgctgtgagaatcccctctctgctttggttcgtttttgatattattcatacgggagatcggacagctgaaagcatgatattctcattctctttgtcattcttctgaagatcagaagcatcatctgctttgtgttgttctgtaccattttgttcatgccgccccatgagaaaaaaaagccacatagtgaccatacttttgagcaggaaacgcaaagagaagcctgatgagaaaggaacatgtggactgtttggtacgccttgttctcacgccttttgtgtgagatctttgcttttgcaaaaatatatatacatgcatatagtgcatatgcttttgtctgtgctctttcggatgtccttaaatcttaaattctttagtctttttttttcttctcttttttgagttggatatgtgctggggctgaaaaagtctagcaagtgtaatgccgacactttggttcagataagaaacacttccaatcccattagaaacatctggtaaatgtgtgctgatctgggctgcaaaatagccatggcgagcaggttgcaatggcatggctcatgtggaatcttcagttacttattggtattgcgttcttcagacagatagaaagaagcatggtggagcctgaagcttcgcctgtatctgagtcgagcaaagaaaaagttgctcaagatgtacacgcacaatcagatagacatgacaacacctgtctacctgctactggtctttacatgaaagatcaactaatgacaaaccttttcaacaactaagtacctatttatgatcacaaggtcttcttttcacacgggggtattcagctaacgtcacttttgaaaccaacatctgaacaaaaatcactggaagactggttccgtttctagtcctttcatgggttctccacgctatcacttcgcattggaaaccttggagatcaacaagcagaggacgccagatccaaatggaaaacattaccaggaaacctgcaacaaaatggatgaattcagttgattacaagtatcaaacaacctgttcatgacatttgaacattactatgggggactttgaggccactcaaaatttcagtttgtggttttgctttgataaatgctattctgtgcaacagacgaaatgaagtgaaagagatgatacttccgccataaggtgagcataatattaaccagaaaaggggaaaagagtaagccatagcacaggcaccttatctaagagttttttttttttttttactttctattttcgagacattggtatggtatccaatacacacctttgactattgatttttctagttatatcttagtaagatcactaaacatataatgacatgagagaattctttgtgacatatctactgcaactgcaaaggtgagaaaatctaaaaatcaacaggtggcaattaaactgttatctctctgttgcactggagcaatgggagaatcgaagcagtactaagaagaaatgcatttgtgatatagatcgattaacaaactacacagagataacgtaatatattaaaaagtcaatagctatggttgctgtcgactgcgtctgtaccaagtatgggcctgaacattggctcggtgttgggcactgccattgcgcagggcgcctgcctgggttagacaatatcataatagtgtggccaaaaacactatatgcctttgataaaggacataaactagttgaaattaaagtcctacttatatataaaaacagtcagtactcattgccctcaacgaaagaagggaacataataaatcgtggtagaatggtatttgcagcaaatgtttccccccttcgctgctgccttagaaaaaagatatattatatggacagaataaacaaacctttatcatcagttttcagttcattagaattcagaaacagtcatcttcttgataaatgtccagtgaataaatatggcaagatatcccttcaggttattcttgctcatcataaataaaatatagctcacaagctgccaatgctttagacacctcatcttgtttttttagaaagctttgttgaggacaaaatctatgttattgccatcatttaaacctaactatttaaatattatacaggctaatgaatggtattgtccttccttttcttttgtcaatgtcagcttaagaaacaaaagatggtcagttttggagttgtggtggcatgataaatagatacgtgttggaagccttaactctagttacacctcacggttaagtttggaaaaatatgtgagattcagatctgctacagagcttataaattagattttgttgagtcaaaaattttctttgtcaaatattaagcttcagcaaatggttattaaaggcatgaagtatgaacagcacaagaaggcttgaaacttatgttcagtggtaaaagtaccgaaagcacatgatggagcagagaataacaacatgaacagggtgtaaaatgaatgtaatacaactacaaacagaaacacattcaaaatttgctgttagttgctaccaccccatagttcaataaatgtgagccaataaagctttactgaaaccttgatagcataagcatcaaactagtgcttagttttaaaacttccaaccaccattcagggtacaagaggcacaagtagcacccacaagaataacgaataggtgggtaggagagaagctctgaaagagctaattcatctaattcagaaaatgagtctacacagatatgtttaattactctttacaaaattttgtggttcattgacatcaacattaagaattatgagtacaccaggttcgaatgtaccatggttcatgcagagttcagcggcagcatagaatccatagatcaaagaaatcaggttttcatgaagtaaagttgttaacaatcataaagcataaagtgttcgatgataatacgtggtggatactcagaattaataaggaccagagactaaatattagaagtattattggagaaatcaatcctaatccaccaaacatatccagccaaaacacatcattatccaatatgcaatacctaatctaaaaggatccccatatattgtcaggtaagaaatttctattcataagctgccctacaggtcagtacactaaaagagaaaatcgaagcagcgcttagaccaacaagagaaaccagaccaaaatgtgcaaattgtgattgattcaccggaaaaaaaggagtaacaatttagcatttcatgaaccttccaagaagctaaaattatgcagatttcgtgcgaatcacccgcgtaacaggacattcagacaatcggtcctcgcacatcaaggaccaggctagcaacctgttctctcgaggattgtctatcagtctatctcctcacagagtcacagcgccacagtgcacgggtaaattattagtagcagttgtacatttttttgcaattcgtgcaccttcatgatattgatagcccacaaattcagcgagatttcaactagacatattcagactgtcctcgcacatccagactactcctagttagtaacagttcttgcaactggctatcattcgcaacgtgaccgtacaagggtaaatttggatgagagaattggggaaaaaaggggaagaggaggaattggaggagcttacatcctggggcgggggcggctagtgcttcttgctccgcgcgggctgccttgagccgtcggtggcgagcctgtagatccagtagccctgcgggggagaaggagagagggatttttaggccgaatccacggcaggaggggtagggagaggcgcgtgcgtacgagggcgaggacgtgggcggcgatgaggaggacgatgaggaaggggaggaggtcgaggagccacggcgggcggaggacggcggcggcggcggcgtaatcccgcgccatggcgacgcggcgggagatcagcgcggcggccgggtgcgggt

SEQ ID NO: 65580 - DNA, 15408 bp, Oryza sativa
  unsure (1)..(15408): unsure at all n locations
ggatatcaatttcttccaagtgaattctcgatccatcatcagcaatactctcccaaggcctcaagcaacacctagacatgaacaaaccaaaaaattatatccgagcacaagttctttctcaacttagctcaacattagcacacaacatacgtattgaaatcatctcaaagtcataaacatgaagtgatcacaaaaatcaaaatatcaacgtgaaatcaactccaactcacagtctgccggccagccccgcagtatggatcgtaaccctaacccttttagggtttcatctttatatatactccctgtaagccgccgttcaacgttttgtaacttcacccgatatagtgaatttgtaggctggcacccgtagctttttctctcctgcacgccttaggagggttttccacgttaaatctcatgtcttctgtgattgatctgttgttcttcatcatttatctattgatcgtttcctaacaatcttgtgccgtagaaaaatcattttttttaaaaaaatatcattacacaatgagggacttaattaaggcttgaacactaggttatttgcacacacacaccgactggttttacactggtagtgactagtgcgccctgcttcaattccaagcaccgcatgttttggcagcattaccatgccgacaaggttggaattttgctgggtgtcaaaagagagaaaaaaaaaacgttcatctctcagctgcaagtccccaaacctgtccaaacgatggtcacattagcccgtcacctaatcctgacatcctgtgaatgattcttcccacatcacacggttgaccttctctgccccctaggctatccatctcatcctcaatactttaattcatttgcccataattaactaattttaggatccagctgattagttcgtcacactaatcacactactaaaccgctagctatagctagctaaagctcagcttgatgccctagatgcactagtagtacgccattatgttaaacaaatgcatcggtgtgagcccctcgaaactgcaaataattgtagggttttgtcatcttgtcccaatgccacgaccatgacatactgtccaaaattccattttgacatgcatgcatgtatgtgtgcattgagcaaatgtagctcagagagagatcatagcaaagctggagggttcttcctgaaagtaatggcttggactgtgggaaagagatgggggagatatcgacacttgatccctttgtgtggctagagacaaatgcttgccctctgtccatgtgccaaatcaatagtattttatttgaagagcttaaattaattttctggtccttgtatagtgcagcaatgtatatgtataggagtataattatatgctgtggatgaatgaataatatgctgatccatatgtcatatattttcaccttttgaagacttgagcactatagaggagatctaaacatggagagaattagaagatagcattagtctataagttcatttaattgcgctttttagtttttgagaggattcataattcaacatagcagctgcaccgggactacttcctttattctagctttgatatggttgcaaataaacggcactctaaattccatggtgattagtgacccactaataaattagcaggtttagttttacatttttcagattgatcctatgatcaattatattatttctttataatttaatttattaatttgaaagttacaaatgcatctctttcaaattaataaattaaattgtaaaacagagggtatatggaatttgtattgatcatgcatatcagggggcatcgtctggaattctggatgctctgtacgtaagttaaattatcttagattccttgatccataaattacacttgattattcacgaggatgcatggacaatacaaacgatcaacttggaatgagttggggctcagtaggattctttgggaattattacaacctcgcaactctatatattaaacagtaccttttggctgggtaaactactcatctgctctcaactaacacctgccacactgtctctgcttgttgatccattagagaagactgcaacatgctaattttattactgtggaatgattttgagatggatggccacttaacaacacacagacacatgcatgtagtactacactactactgcaaacatgcacgactttaagcatactagctgaaagcatatatttctgtgaggtcattattagtttgattagttttgggtgttggtgtgcgttatcttctttacaaatcccttgacatttttatccagtacacaaattttctagctagctagtttacttgtgtggttgcttcagaaggcatacttgtactatttacaagtatactaatattattgaatgttaattgatgtattgagctgctttaaaaatgtaaaatatagattctatgttaattaattagctgaggcttgttttttaaatatcatattataaaaaaataataactcatgtagttcccaaaacaaataagtctacatacagcttacatatgaagtgagatttcagttgactgccaatgacaaagctaatgcatgaatatgctaggataaatttagaccatctctagaatatgctgaatgaaaacaaaatcttgtcctgatgttctctcatatacatgtcattgatctaactatatcaagtagcccgagtggtgaattatttgatttagctagctatgtaaaaactaaaattaaaataaaatttcctgactatatcttgcaccatccagctgagattgaataaatgtagccatattacattcttggtaataatagcacattgtatgattgtaatattcttgttgaaatcaattatctgttctgattgaaataaacaaataggtggtaggatagaggagtgcacagacatcccctcatggtagcatatagaggaacaattggatgctgaataattaattagttaaccaataagggggttagcccacattggaataaataaataaataagatggactcagagatctagctcagagacccttgtccctaccttaattaattaaaactctgttcagtgtgcttgcatcctcgatcagttgctcagctctagtagtttccttgtggacttcggtgtgccttcatgtgtcgtactttctctagtttcttattttcttctctgtttttaatctgtgcataaccactgttttagctgaagacccgccgcaaacacaggcgatatattccattagatgcagatcttctgcaccggagattggtgtgcatattcataatgcattgattggtggccttgtacgcaccacagaattcagaaattaatttgtttgccttgtgtattccaactttcatgtgggagaacaaatggtactagttaacatatcttttcagtgtgattttgttgtttgttaaccatgtgtagttcattagaaatttgtcttcagctagaaacatatctttgacatgaatcatcagattgtattgccttttaatttagtatgattcttaaccatccatggtagataaataggcactatgtcaagaatataacatatatatatatatatatatatatatatatatatatatatatatatatatttcaactgaaaataatagttccctaaaaaaactctgccaataaaggtcatcctactcaagttatcaagtaggagccatataaccagaaatattggaggaattttctttttatttttttatcttttttgcaaatcctctgtgaaactcatcttctatttctgaagatacctcactaatagttcatttgtgtatacttggccacagcgatggcaaccgcagaagaaggataatcaccttgctaaacatacatggatgaactgtgtgagggagctgctttcactgacaatttttgtcgtacaactcccatccccatgtaatccaatttcagaatcagataaaacaacggggatgcttgtactcatgtgcaaattttggttgcatccctagcttgtttacttgtgtgcgtgtttctaactttgtatactaattaacaccattcatctaaaaaagtagaattccctgttgaaatgagtgttccggtggtatctttctccgtttgaacatatctgaaaagaagaaaccggtccaaaactgcatctgcttttcgacaaaagtgcagatttctctttggttagtgatgacaagattagccaactcgctagaggtgcctaattttatattgttttttaggagattctccatgtagtcattgcctcatgggtgtttcttggagatcatcggccttcctatgctaggccggcataacagggcgtccacattttcacttaacataccaagaaaaagtccactatacatcccttcatctaagggtctagtttcaatcgcgttcctcaactataaaactggacataacatattccccatgttataatataacagtgcaaatacagccccaaggtagtattgagggtggttttcgttaacatagcatccacgtggccgcctagtcgctaaataaattaaaaatagatatggccccacatgtcaatgcccacttcttcctcttctcttctttcccttgcacagtacgggtgttgacgacgagctcacccgtcgtccatgcgagggagatggaggtggtcgagggagagggagacaaccagccagcccctcgaagctcgagctcaaggacaaggacacgggccttctcctctgttgaccaggtgatggcctcgaggaaccgtgtgcacacctcgacacacgcgtcgaagaggagctgaagcgtgacggcactaacgggcgagtggatggtaccaacgagatcggatgtcccaaggaggcggaagacctagacgtgggtgggaaagggtgcaaggagaagtacagagtgccctctaaccaaggagtcgtccttgcatgtcgttgacaaggatgtcggtggtggcggcggctaccggccaaggacactaggtaacgagattgggagtagagaatgggtgcgaaaaagagagggggggaatgggattcggctcctctaacttcagcgtgtgaagtcaaaggtgcacagtaaaatgagtcttgcgctacagtgcctctacagttgatcactgcagtaacagtgaaaaatagtggaaaacactgttatgctttactgttcgcaaattactgtagcgattgatttcgaccgtcggatttacatcggacggctgagatggggtgnagtnacaggtnntgtgcttntnngnccccaccccctaaagtcagaggatctcatttcgggggatgggactaacaagtgcgccttcagtaaaggtggggccggccacatgctaactcaagtatggtcaacaaccacgaaagccgataccactgaggaacttaatttacactgcttctaaaagttaaggggttctatatcccttttttcgaggaatatgattgtaactcgactcttatttttgtgggatctaaaagcgaactttttcctattaccagtgtgctggacaaggctaggttggacttggctttaagttagcggcccagctatttatcagaggagtgcaacattccacaacggccggggtacaccattaacaattcagatgattgaactcaactgaactgtgattttcattattttcaatggagattctttactcaactgaactaagtccttgccagcttggtgacagtttcaaactttcaaattagcaccgttaatggatccacagttatattgtgttctatacttttgctcccccaacttttgttctttcatttctacacacagtcgcgcatgcttctcaaattgttaaacgtcatgtttttttaaaattctataacaaagctttctttagaaaccatataaatcgattgtcatgttttcaactaatatttaattaattgatgcggggatggccagatggcggatgggttcccaaacccgtaggttcgaacgcataccgaccggagtcttgggccggagattagccagcccaacaggccgatcttgaacttttgtttagcaatttgaggctcccgtatccgtttagcaaactgacccaaaaccaaaagcatcccagaagcggctggctaaacaccagaggcaaggcggccggcgaggcacgacgagcagccggcgcgccacagcgcgatcggtcgaagccctcaccgtctcgcggcagcaagccggctaggccaggtcccggtaagcttggctactggctggacagtggacgcacttattaaagattgacaggttgttgcaatttttttttctatctcaaataatttggtggcaacattcatcgttagaaaggtacaatagatcgtctatatatattctaccttcatttttataaatgaatcatttaccacataagttgaattagagaaatactaccagtgagcaaactacaagcacagataattggagattcaatcttcaaagaaccatctaatgtcaggttatctttgctttgtaacatactacaccctaaactaggatgaacagaaattaaaggagttggagagggcagggaattgttgcttctgtttagtgtcatatattatttgtagtatattttgaacatatgttgtgtgattttctgtgcatcatattgatcttggataaatatttacctgttaggttacacgtcctcgctgaacctataatttattcctgtatctgctacttaattaattaatgagatgtgatcagtaaaaaaaattctttgtaactgctggttttctgtttgacagatttttcctgtactagtaattagaatgaaaaaaagggtaatacatgttcattttagtttttacatctttttttccgataggcgggagaatttattatctagcatgcttgcatttacaataatcatttcagtttatgtgtatattactttatgacaactatgcgctcttgaataaatccactccctttgcatgtgaacagcatatatggcattgccacattgctagatttgcatttggaatgtgctttaattcgctttatttgatttcataatagaagactatctgaaaaggcagaatttgaccattgtaaagcaaaaagtttcttcagttgtctctgccacattattattgaaatggagcatatataggacatctatatcactcattattgttggatataagttcaaatttatgaagaaaagtgaccagtggatgaaggcaactaatcaactctgctcctgttgatttgtgaaaatagttgcatgggtgagcttttctccattataactatgcaggcaattataggccaagcgatttaattgtattcttgttgagaggtactcactgaaaggtactcagccattaatctgcagcttatgtgtcaaaatctttcttttcaaatcgtatgcaattccaaactgaatactactaagcacaataaggtgtcccacgaaatcaatataagcggccattgtttgcatggcccgacactgtgacatgccagctcttggttgatgacaagaacttgattaggagtcctttgtttgttgggttaccgtacattcccctgtgatttcaattattcaaataatgtggattgctatttcagagatgaacatacaagctacccaattatctgctctcactaaaacgagggtataatgcgaatccatgattgcctcaatgaattgcaagtagcactatgggcgtaaccaatttgtattcttggcaagttgatgtccaagattcaattctgcactgtcaccgagctgtagctgcagattatgaggctcttattagttttgattgatcgtttgtttgtttgcttgtgttgtgtgggctgggggttgaataacttatctgatttgttcctccaaaatctgtaaaaataaataaataaattctcctgcacaccatattatgtgttcaaattttataggactatgataatgttgtgcctacgttaccacactgttcagatttctgtttgtattatcaccgttaattcatggatgcagagtgtgtaagagagagaatgatatttgtattacaaagagtaatcagtttcaaaggcggaaaatttgagaaaataaggatcatgtcaaactgaagtttggaaattataactgataaaacctgaggaaccatgccaaacagctgaaatgtgtgtttcagaaacagacgaatgattgcgtatctcccagttccttaacctgaattattgcgcagatatgatattcctacatagtgagcctgtcctggcagcctgcctgccatttgtagaactagattcttctaatttgtcctaatcttgttcaacttattgttaggttaaccatcatggttcaggtaaagaagacagacatacactcgggcgaaatttagcaagaggtgtgtatatttacttctacaaactgcagtcacctgcattaacaggtgtaactgtcaaagtgtcaattcctcgatcgccagaatcacacaaacttccagagacatgtttccacgggtgtacatcgttgtttatctgtgcaaaacaacgatggagaaaaagaagcatatggaacggttataatggaacggcttgttcttttccacgcgacgaaggtgataagaagtgagcaaaagtcgatttagcaagaaacatttaagagtagcaaatgatgatcaatcgatttagaacacaccatgattgaaaaataatgcaggtaacgcgatgatatttcaggtggagacacccgaagacaagtcgccttcttgagtccattattatgaagaaaattggttgatgtgctgcaaatatacgatgtgagcttttcttttctgcctttttgaaacttcagcggatgctgataggtgcgtatttaaatcaactgtttggacatgtggctcgtccaaagcaatgaaccattggtttggtacactttgatgaataataatttgtggttttcattgccttacctgtgctggactgctggtagttataatccagtactctaatttcagctaatttccaacaagagaatcagcagttcagctgtagtacctaggttactgccagtttcagtagagaaaggagcacacaaataacagcagtaaaattcagaatgtacaatactgatgtttttgggttgcaatccacatcgggcatgccatattcagcaagttgcaatcagcagaagagtggttcagattgcatggctactcatccaggttgcccaaacaatctcaccaaagaacagtggtgctatcaagcaagatttgcccaacctgttgtacaggctagataccacacaacaaaaaggaaaaggagaaagcgagcaaatgtccaaaacctgaagtttatggcagagattcttctacgatataggaatataggatagttttcattccatccaaaaatagtttcagaactacagatatatatcatatgttagtctccactgcatctttctcctttttgataacctctccaattggccaatttatttttgaaaaagaaggatatatatataagttttcctttgtctcgatagaacttttacggtacaatatattgccagtatatactggcagtatatagaagggcatgctaggaatttgctagaaaataaaataacactttagtaatttttggttcagattgaatctaattgagagtacccggtgctaaaccttatcgtgcactaggggagaagcatcctgagcgccattgttgacaaagcacgtgacaatagcacggtttgatgatagaataacaaagaaaagacaaaattactctttcaaactttatactgtcatctaattaactaaaaaatcaaatcaatctacaccgttaggttatatatacttgcagtatatactggcaccgtaaaaatcctcttctcagttgcatatgtttcctcgtaacagcagtctacctacctaccatcatgggatccttttgagaatcatacagggaatttcaagcctatcagtttaaggacactttgatatttgcatcaagagattctatatctcaaaatgcattcgatataagtcaaattggcatgattacaatttctatgccaacatcaacatgaagcattaagcattaagcatgacccctgaattaaagcagggccacaaaatatttcagacaagaaagaagccaagaacaaatgactctatatgtttcaacttctacttgcaatttaatcgagattcgttatagatgtttatctctcggagcaattttatagtacttgaggaggtacatgaggtaccattttttctgttataaatttgatacctcttgatacataggagtaggtactaggaggtaccaaattttacagtaaatttttggtacgtactcaagaactgtaaaattgctcctctctcgtggcaagaacatggatatacaataaaacgccaaagttaacagctccataggcttgccaatgaacaatctttcccaaatttaatgagcacaactacgagaacagggtattagtagcagcatttagcagcctaattaaacagcaacagtgccacatgatacattcatcaggatccaccacacaatcactgtcaaaaatgctaaactagactaataaactaatcaatgatgagtaataaaatgaaaaacaattaaagatactgggatcaatccttgttgaaagatcaattctttcgagccaactgatccatcattcattcggcttcagccgcagcagccgcgccgccatggccgccgccctccaccggaggcggcagggcgtcgacgacgaggccgcgcaggccggccttgagctcgttgtcgcagaacctgcggtactcggcggtgtcgccggccttcttgcacacctggaccatgacgagctcccgcgtgagctcgaacaccttggcggagatggcgagcgcgcccttctgcccgttccgcgtcgcctcgatgctcacctggcagtccttggtccgcgccgtgaagctcaccatcccggcgatctcctgcagcttggcgataatgtcggccaccggcgcgccggacacgaagcgcatcctctcgccgcgctcctcgaacagccccgacaggtcgaagctcggcgacgacgcgatgatgtcgaacgcgttcaggctcttgggccgcggcatgcgcggccggggcgggagcgggagcgggagcgggagggacgcgctgtcctccatgcggtcgagctcggacagagccggcgccgacaccgaggtgtgcatgccgcggggcgttccggccaccggggtgggagattccgacgacgacgaggactcgatcgtgtcggtgtcggagtcgtacagctccggctcgccgtcgaggccgtcgaggctgcggaggcggtcgttgctgtcgatgtagtaggtgacctccttgaatcccctcttgaaccacctcatctccatgatctctggtatggtgatgcggcggtcggggtcgggctggaggaggcggcgcacgagacgggcaaggtcagggctgaacgacggcgggcactggaactggttctgcccgatcaggcggtagagcctggagacgtgctcgtcggggaaaggcttggggccggtgaggagcacgtagaggacgacgccgcatgcccagacgtcggccttggcgccgtcgtagccccggcgcttgaacacctcgggcgcgaggaacagcggcgtcccgcagacggtctggaggtgggcctctcgccgctccatgtcggcgagcgcggagaggccgaagtcggcgaccttgaggttcccctgctcgtcgacgaggaggttgtccagcttgatgtcgcggtggaacacgccgcgggagtggcagtaggcgacggcggagacgagctgctggaagaaccggcgcgcctcgtgctcccggaggccggcggcgccgccgctggggcccctgcggaagtagcggtagagcgcgccgccgcggacgtactccatgacgacgcagatgcggcgcttgttggccatgacctcgtggatgcggacgacgttcgggtggcgcagccgctgcatgacggcgatctcccgcttgatcagctccgtggcgccgagcctgacgagcttctccttgtccatcaccttgatggcgacctcctcgccggtggccctgtgccggccgaggtacaccttggcgaagttgccctcgccgacgagcggcccgaactcgtaccgctccgtcgtcatcgccggcggcttcgtccccgtccccgtccccatggatcggaacatgcacgcacgcgcgccgcggcgggcggcggcggcggcgagaggacgcggattctgctgctgttaggggggatcgaggcaaagggcggctcgacgattggaaggtggttaaatacacggatcacaagggtttagcacgcgagacgctcgtgagttcgatggaaatcgccagccgtacgccgcgccggtcaatcctggccgttcttttgttcatgcggctaggattttctggcccgtgtataattgacagggcatatggactcatggaggcccatcatagctcccccttcactttcgttgactagcgggagttttttttcttacaataatgtgagaaaaggtgattaattgaaaagcttaattaggctcgactcgttggcattaatatatcattgggtatattgtaaaagacagtctagcctgtttcgcataagctaacttcagttcattttttgtttttggtatagagagtgtatcaatttgccattgagatcgtgtgcaggtacaattcgttaaaggactgcagctaatctcatctattgatttttctgcctcttctactaccgtagtatctttgtctaccgcaaaacacagtactacctccataccaaaatgtttgacgctgttgacttttttaaaaatgtttcaccgttcgtcttattcaaaaaatttaagtaattgttaattctttttctatcatttgatttattgttaaatatatttttatgtatacatatagttttacacatatcacaaaagtttttgaataaaacgaacggtcaaatatgtttaaaaaagtcaacggtgtcaaacatttaggaaaggagggagtatttttttaaccaaaaatgttttcgaaattagatcaaacagatctggtgtgtgaccgtttaagttacagtcacactattgactgcatgagaccgaatccatcaattcatatgcactgccgctaaactgaccattttgtttggctatggttgtacatatatataagcacccgctccgaacctatctctctgtttcatattagaagtcatttaattttttttattagtaaaatttatttaatattgattaagtttataaaaagtatagtaacaattcaaatataaacaaacatattattaaaatatatttaatgtaaaatttaataaatttaatttgttattatagatgttgttaaatataaagaaattttaataattaaaaagtcaaacgatttataaaaaaaatgaaacagatggagtagtaatcgagagcaggacaacggcactcattgtacatagttagtacggagtacaatatatattcaagaattcttccagccatgtccggcagattagtgacacggtgccccttggtgtctgtttggcgtacgtttctcctggcagataatcgaccaaccaacaaccgtccagtggaagacacctgcacgagatcattgcatctgtgaattgtgattctggtcaatctcgaccatgattggatttctaattaaccaagtcattaattacaataatcgtcgtcgtcgtcatatcatcacgaggacctacaaaaattaatatcctagctacaggagctagtttaatccagctaattaacaagctagccgactcaaacgtcacgcgtacaggcaactgacgcctggatcgtgcatgatatgcatggttttgcctgacaaacgatcagacacacagctgggaatgattcatgtatacgcgtatgctgaacaagtgatcaagccgcgaaaagaggaggaaaatgttaccccatcttttgcaaaatataaaaagtttcagaattgaatacgagtattatgaaaattgataaacttaaagaaatattatgattggttaagaaaagtaggtagatacaaaatttgaacagttaaaggttatgatttgttaaggaaaaattatagatgaaaaattattatattttgaaacaaaatttaaatgttagaagttgttatattttgtgaggaagtgggcttttggtcttgaatctttactacttaaaaaattcatagtggtggtggtgagtcctgaacgatcaaatggttaacattcatcggagaatcctctcacaggaatcagcggatgagattttctcccacgatccacccgtcgcaccccttctcatctccccgatccgcatcgcgctccctctctctccgatccgtaatttcgcatcgcactccccagccccccatccttcctcctcggcgcgctgcctcctcaccccaccgacgcgccgccttcccatcccgcccaacccacgccttcttctccggttgtcctccctccgtattgtgccgtccctcgctccgccccctccctctccatcgcgccactgccccctccataaaccataacctccctcaaatcccgatcatctgcgcagccgtcattatcgtcagaccgagttcttcgatcatcaccctccgttgccgccactgcatcggacccatcgaaatggtggataggaatgcggacctcagtatggttgaggggtaggacgagatgatggcggtggttgcaggcgcgcccaccagcacaatcgctggagtgtggagctagaggagcgcgcccgctgctgcgagtcaccggcggtgtcgtcggcatcatcgtcagctagctctgcatattaaaaacataatatgagttgtcaagtaaagttagtgcaatgtaataagatgtttttaatttacctatgagaatcactattagtatttcctcttgcatcaatttagtggaagatatcaaaaaacaacagaagatattcaaaagggaactatttggatggaaatatgcatatattgatggattatcaacacctggaagctaatggtaaatacaatttatttttctcgatagcctagcaacataatttcattaggataaaacctttattcgtacctaatatatttccctcttgctaagatttagctcagggtattcttcattcaatggcctagccagatccatgctgcatgttaattatgacatgggttgtgctgtttcttggtggagaagatcgttaagtatctcctggcatgcatgccgctgccattaacattctttcttgatggctgtgagcttgtcatattttatctggtgttatcccggctgatgagcatcccattcgattttttttctttgtttacattggtt

SEQ ID NO: 65581 - DNA, 18790 bp, Oryza sativa
tttttttggatttttgggagaagcaaggtgaatttttggagaagagaagagtttttgagaagagcatgtttttggttcaactgggaatttctttcttttaaaaagagggagaagttttcttttggatttttgagcacgatgtgtacgtttgtacgaagtgtgctttttaccgcttttgtttttatttttccaaacacgaaaacatttttaatgggtttgccaatgtgttcatcaagggggagattgtaagattaacgtgtgttttgattcttattctgtgatgaacaattggcatctgtgattattggttttgatatttggagattactgtcgaagtggttttttgatataactgttttgtcagttttgttgggaccggtcaaaccgggcggttgttgccggtcagaccggctcatgtgtagcggtcagatcggccggcccgcggtctgaccggccgacgctgtgtcggtttcggtttcgggttgtttctttggatatccgtgattttttcatggttatggcttctagatggatgctatacgtatgtaatactgttgtttgctaacaatgagtcaagttggggatagcttggtctcggaatatggtttctttgtttctttcatgtgtaggtgactcgatgcctcgggagagtatttacggtgatggaccgggagtcggcttggtggtaagatgatgtccgtggtggtcagatatcatgcgggatactaaggctagaattgatgcacgtggttggtgaagattccatatggcttacgatggaggtattgtgtgcgtatgggatgcggagtcgaatttggaaggagtccaaattaggtatgattggttatgtaaagtttatgtcttatactagagggtttcctaaggtgtttaggactcttagtatgagtttggttcgtggctttaggctgcctacctcatgtataagtagagggggagcgtgaggcttcccggtatcgcttttgtatcgcttttgagagcaattgagttgctagtttagttagggtttcgagtttagtcgatatttttgtaaggagtattgttggtgcactttgtaaacacagagagaagcaataaagtcgtcatctactttgagagatcttcgatttgtgttttaccgggtttcagcggtctaaccggcaactcaccggcggtctgaccggcggcaaggcggcggtcagaccggcagcggcaacaggcgcggcaagcgacatcggcagtcagaccgggtgatctatactggtcagaccggcggcatccactcggtcaaaccgatttccgtcgaattcgagggtaacttttatttccgctaaaagttttcggtttttgggtgtaccaaccattcacccccccttctggttggcttagttcttgtgattcgatcatacactgaccaggtccatcaccaacgtcgtggcggtagcaccatagtcaccgatgccgttgcctaacatgggacgaaaccacccatttcattctccacatcatgacacaggtgtgagtcagtggatcaatcggtatccatggtgcagtggcaatggtgctgagtggcgccaacggtggtggttcttggtgacgcgttgcaatgtggtgactgtagatggatgttgaacgtgtggcctggtcaaatggatagagtggcacacaacaaaacaatttgcatcccttatgagcattgacaatcaaactttcatggccaagttaaggataacataaaatcatttagacatgtgaaaagacaatggagttataacattggattacatcaaaacagttggaaatccggcaaatccctttagtaagagactataaaataatacgagtgatactgcatcgaaggaggtgagttatactatggtggtaacacaaccaatatgatgagagatcccatggattaggacctgagaagtacaagccaatattcaattagagaacaatatcttcgttaaaccttattaagtgaagatgcagatgtttcggttacacgtcctgatatctccgtaggttacgtgcaactcattggttttggttacgcattatggagatcatggaggcatcatgatcacttgtcctaatatcactataaatactgagtcgttgaatccacgcaacgcgcgtgaaaataatctagggtttcccttcttctctgtacaacatcgtgacacgtagtctactccatcccacctagcaggttatggtcttcgtcatcattgatgaataagatttttgggaagcgctttgcgcaattgctcactatttgtctgcgatgacacgtcttcctctatgttcaagtgatgcacgttgtcatcatcatctggtacttcacgatgtatgtgcactaagtgttgcatgtaccccatccaataaaaaatagtgggtacgtttcaactatattttgtatatttgacctattcatgtttagtgatgttgtatatatgttttgatcatatccgtgcgagatgatcacgttagtttatttgttcaatgtcatgatttatttataagataaattaaacaccaacatatgtgcttatattttcaacatgagaagctatcatggcggccgttgggtgcagcacacatgacaagtagcacgacgggaagtgatagcagtagcgtgttggagaaatgggaactaggatacccctttctccaggtcttagggtaacatttgccatgtcatcacattctacggaagcagaatacaatactagcagaatacaatactagcacaaaaatcaagcagaatacaagaccgagcgagtcaaccaaatattggaggatatgttgagagccagtgcgcttgactttggtggagcatgggaaaaaagcttgccgtatgccgagttctcctacaacaacagttaccaggctagtctgcaaatggcaccgtttgaagcactgtatggacggaggtgttgcactccgctcttctaggatcagacaggggaacgccagttgtttggtacagaagttttaaatgaggcagaagagaaagtcagagctgtcagggaaagattgagaatcgcgcaatctcgacagaaaagctatgcagacaaccgccgaagggagctcgttttcgaagcaggggattatgtgtatctccgtgtcattccgctcagaggagtacacctcttccaaaccaaaggaaagttggcaccacgctttgtgggaccatatcggattttggaacgtagaagtgaagttgcttaccagcttgagcttccctccagcatgcttggcatccataatgtgtttcatgtctctcattgaagaaatgtttgagagttccagaggaacaggcaagtccggatcaaatcgaaatccaagaagacttgacgtatgtggagaagccgactcgtatcctcgaaacaagcgaaaggagaactaggaacaaggtaatcagattctgcaaagttcagtggagccaccactcagaggaagaagccacttaggaaagagaagatgagttgaaggccgcccatccgcacctcttcactagctcttccgaatctcggggtcgagattccatttaaggggggtaggtttgtcacgccttgaagtttccctccctttttcttgctttaaaaatttgttgaataaatcgttcgaagaaatggttcaaattaacctagagctaatttcttaattaatgaatgcaattaataattggaaatggcattgtggaatttctcttgggttccacatgtcataatacattaacaggaattttagtggaattttcagagccttaaaagtaattttaaccaattaaaatcatcaaagtgcaattttaatacccggaaaaataatttttctttttctcttcctcctttttctcttgatgggccgtcgacccatctctctcccgcgcccctccctcttgctgggccggcccaagccgcctcctctcctcccttggggcgccgacaggtggggcccacctatcgatcttcttcctactccaactggccggcaaccgtcgtagaaccgcccacgccgtcgcctttcccgcctctcccacgcccactccgccccgcgcccacgtcaccgcccacctcctccacctctcccgcacgcgtgcgcactcgcttggaggcgggattcgatttgaatcccacccctctctctctctccctccactcccccacgtcgccggcgcaataggggccctcctcagccacgtctgcccttcccgtgcccataaaatccttcccccgagccccctctctcgtttacctcactcgctgcgctcccccgtgcctcctaccgccgccgcaccgcgctcgccaagcttcgccgccgttgccgctctccggccgtgcatcgccgccgctgccgcgccgtgaaaccgccgctgtcacgctcgccagtgccgtccgcacctcggccgccgctcgcttaccgtgcgccgtcgccgtaccgctctccccacacaccgctgcctactgccaccttcattcgccgctagccgccgctagtcctaccgtcacgccactccgtcgccaccatcagcctcgcgaggtcgaggactgcctcgtctgtcacaccctgattttcgttacaggatttataaattatttaataaattattatcagaatttatattaaatgttcattaatttactagtgaagttaaatgtgggaaataaaaatataaagcatggatgtatttaatttttattaaattcttcatggttaattatactctctagaactttctcggatttttcggagctcaattcctaattttaatcatacaaagagaagttcagcaattatttaaatattaaattaatcattaaatggtctgattgtaattttgttaagtactttgagtgtccaagtattttcaggatttttcttgaaattatttgagcataggaagtatttttaacaattcaaagatcatttcattgattaatttaattggaaaagtaataataatcctcctcctcagcttgggccgaatccagcccattccctcctttccctctcccttcctctcagcccggcctaaagtctgtttgacctccctggcactacagtactccatcttcctcctccagacagagccgagccagccgtgctcgtgcacagtgccgccgcctccgccgtcgccgtcgcttgccgtcgccgccgttggtttcgccaagaggtggagaagctcggccgccacctctccttcgccgccggccgccgtagcccgtccccaccggccaacccgagccgccgccgtcgcctcctcgtcgccggccgtcgtcggtcgtcgtttggcacgagggtgagtatcgttgggttcgtctcgtcgtcctctacgtgtacatgtcctccaaaatcccggccgatcaccctagctccggcgaggtcgctatccgagccggccgccattgatgacgtcatcatgacatcaacatcttccccttttccagttatttctaatagattaaatcttcggaaaatcataactaaataaccgtagatccgtttcaggtggttcaagttgctaaatttttctaaaatcaagatctacatgttaaaaatatccacatgtactgtttatgcttgtttttgtactgttttgttgaattttgttctttcgctttagtttccgacgttccggaggagagcgttttcgttgaggaaggttcggaagtgtttgcggaagctcaaggcaagtcacacagatcccaaataaccctttgagcatgttgaacccgtttaaagctattattttatttcaactatgcattattttcgaatgtcattgggtggtgaacctttccccgttaattaatggcctaagatgactttattttcctatgggttataatttgattagcatgaaccttatatattggattggttcagctaaatgctatatgtatgtgtgcttagccatgcttagaaacattagctaactaaaggggttaattataaactatattatattatattattattatggttatatttaatggtcgctcacgatggttaatcgtgtgatgttaattaattgataaataaaatctggttaaggtgggttgtgagcatatggttttgatggttgtgctcatgacaattaaggaccggttcgcgagctactgttgtgagacatttaccgtaccaaccacaagccagcatgggcaacggctttaccttttgtatagcatgattcattgcggggtgccagactgtgaagcggcgagaagtccgtgggggtcgctggggagtccattgcctttggttttgagggggagattataatccaggaacggtgcactgttttgagttgtgttgtgcaaagggtactgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacactactcatcaatgttaataatgtgataattaatttgactcctggtttggaatggataattcctggtttggaggtttgatctgtacgaccggggttggttgctcaggtttggttgggcctgagcagcatgggtgtgctgttcagtgttgattaaaattgatgattaattactctactgttttacttatcttaaatctttgctaaacgctgcttttgcaaatgagcctatattatgccatcctttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagatcgttattccgctgctgttttcttttcttttgtaagtatgtaacgttattattaagatggatttgtatattaaattgtcagtttgtgtacctcggctgattcctggacgaggattttatgcacaaattagttcggaaattactagtgaatttccgggcgtgacatcgtccatcccgcgcaccccgccgtttgctgctagctgccaccgtctccccccacgtcggccaacccacggtaagaaccccctccccctgtcacatcctgatttttgtttcaggatttataaattatttaataaattattattagaatttatattaaatgttcattaatttacaagtgaagttaaatgtgggaaataaaatttcctaaatataaagcatggatggatttaattttcattaaattctccatgattaagtctactctctgaaattttctcggatttttcggagctcaattcctaaatgatacaaagaacagttcagtaattatttgatcattaatgatctaattataattgttaagagcttttcttgtttaaaaatccttaaattataaattgttgtttaaaaggagtaattagaaatgatcttaaaagcctaaaagagaagatctaattttaatttgctaaatctcaatataaaattgggctagataaaattttgataaatacttctcttgaatctttagttcctagatttttctgggatttatttgagccaaggaagtatttttaatcaatggaatatcatttcatgaataatttaaatagaaaaaggttttaaaatctttcttttggttttgggccgaaagtcagcccaagtctctctttccttctccctctctcctccccggcccagtcggcccagtccgcgagccgccgctctcctctctctctctagtcccacctgtcagtcttcgtcttcctcgcgccgccgccgctttccaatccggtcgatcctttccgtttccggtgaaatcgttagaggggaaatgatcttctcgatctcctccaccttttctcttttggaatcatcgtctttttcgctttggaagttcgtggattcgaggtcgaatcggatcggtctctttcctccgaaccctaacctttccttctcgtcgccggtcaccgtgggcctccgtcgccgcacgctagcccctttaaaaggacccccgagctctcctctatccgccgccacctttgccttagcccgccgtcgcgtctagcgccgcctccgcgtagccctagccgtcgccgtcgttgccgtcggttcagccgcgccgcgccgccgttgcagccgccgtcgtcggtcgccgtcgccaccatcgggatcgcgaggtcgtcgccgtccccgtccaccgcttcgccgccgccgaagaccgccggagcaccgccgtcaccgtcgacccgaagaccgtcgccgcctcttcctcatcgccggcgccgtccgttgctcttccgccgttgttttggtcaccggtgagttcgccgcgtcgccctctacccgttggtgtcctccgtttgcgtcgtcgcgctgtcgttcgccggcgagcatgcgttcccgagccgccgccggtgatgacgtcatcgccgacgtcatcgttgccatccgtcgtagaccggtcgtggaccgttcgatctcggccgtccgttttggataggatcgatctcggccgttcgtttccttagaccgtcccgtgcacccggaccgcctttgatgacgcaataatcctccttttccttttcaaaaataattcattattgcgtcataattcaattaaaatctatataaatgctttaatctgatttaatctttgaaaattcataactaattcattgtaactcagtttaatgtggttgaagttgcaaaaattatacaaaataaagatctacatattaaaattatccataaattgaattaaatttatttaattctttttaaatgggctttaattagatttaatcttgtaaaattcataataaattcatatgaagtcagaatgaggccattcaagtctcataattcatctaaaattatgatctacatgtttgtttactttttatgtactgtttatttggtttttattagtctttttcttcgttttgcgtgttagcttgtcgtttccgtcgttgcgaaggttcgcgagtgcgccgaaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctttatatattggttcagctagatattagatatgattgcttagccatgcttagaaacattagcacattattgggataacttatgattcactattacttaatgatgatttaatgatagttcacgatggtcaatcgtgattggtaaattaattacttgccaactaaaacttgataatggtgggttgtgagcacatggttttgagagtcgtgctcatgacaattaaggaccgattcgcgagctactgttgtgaaacattaaccatgccaaccacaagccagcgtgggcaacggctttaccttttgtatagcatggttcattgcggagcactagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcatgattagtctcacacctctcacaataattatggatgttatacctggtaataatttgcttagctcctggtttggagttagatctgtacagccgggtatggttgttcaagatggttgggcctgtgcagcatgggtgtgttgttcagtgctgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaggatccagaaggagaagacgtttggcttataccccagttgagctgcctgtgggagtggagccggagcttcgctagattttattttccgctgcagttttcttcatggtgaggacgaagtgcctcttaagtaagtatttatcgttttagttaatttgatgaatctgtatattaaattgtcagtttgtgtacctcggctgattcctggacgaggattttatgcacaaataagttcggaaattactagtgaattttcgggcgtgacatcccctcctttcttctcccgtgtgtgccgctgccttggccacgccgccgcttcagccgtgcgccgccgccttcgcaccgaccgctgctgtcttccacgccaccggtcgtcgccggtggccgcgcgctgccaccaccccgctatggccggccggctttgaagccgagccgagcccggcgactgcctccccgcgccgtccgattggctttggcccgatctggaccgtcggtccgtggaccggcggtggaccacccgcgtggtcccggttgacggtggaccagcgccctttgagccgctgccaagtggggcccgcttgccggcgccgctccccttgggtgacgtcatccctgggtttattgcgcaataaaattgattaaggatttttacttattagtaaaaacatagtttatcttctaaaattcataagtaattcatccgagctccgtttaagtccattcaagtctcagtaaatcaagaaaaatgcaaataatccattaaaaatggtttttttttcctgttttagtagtcttatagcatgttttgcttgtgtgctttgtttgtcgcataggtttcggtcgtttcgtcgatccacggttccttgaagacgttgttgtggtctcatctgtgcgagagcaaggcaagtcatgcattacatttaatcatattgtacccaatttacaaatatcccgcatttgtattaaatgttgcatcgttttacaatgtcatgtgagatgggtcctattactcagccatttattgtttaccttatgccattgataacttgggtatcaaaatgactagatgttggtttaggaaaatgcttagccatgcctagttcaactagtacacaaatggggatcatattattacatagactttgactattagcatagctttggattggtgccaccgcaatggtgttagttaattaaaatacactgaatggtgggctgtgtgtgcatggttttgctggtcgcacccatggcaattaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccgggttgtccggttgtccagctgccggattcaccacggcgcacgaggggactgcccactgccttttgaggggtgggggtgaaactttagcgtggtgtggatggttagaggagggttatgcgaagggtcttgtcacgatttccccctttgcagtatcatggtgatacttcggtgcatggcgacatgtgtggaatagtgtcttgtgggtacagttgtatacctctggctagagtaaaactattcgaatagctgtgcccgtggttatgggcaatcaaccaaattcactatgattagtctcatccctagtttagcttaatgaactggtgtagttcaggtggttagttgggcctgttgcaatgtggtgtagcgttggacagtgattcgttaatcttgcttaatctattgcaactgttttactgctttcaactactgtttttaaatgcctgctttattgtaaatgaaccttttagcctcctttggttatatcctgcatcatacctcatcttccggtatgacttgctgagtacagtgggtagtactcagtcttgctctcttttcccccacaccagagcggaagttcttcccagttggagctgtctcagaaaggttggtttcgtcgctgccgtcaaggatgtctgtggagtagagtcgctccgctacagaagtcaagtttccaagtttagctcgttttatcttttccgctgcatttgtaatcttttctatttttgtaagacgtggatctgtatgtcaacaattgtcgtttgtgtaccctctcactaacaagagcttagtaaccatgaagtacactggcagaggggttagagagcacattttgaagatgagtggcatcgcttcaaagctcaaaaagatggacttggttctccgtgatgagttccttgttcaccttaaaattgcctccttgccttcagtttttgaggtttttctgttgtgaactacaacacactgcccgaaaactgggactttgagaagctcattgccaagtggtgcaagaaggggcactatcagaaggattgccctgaattcctaaggcatctcctaaagatagggattctgtacgaggaggactcttcaaagagtagaaagacgcaatagtaatgtgaatgttgtatgcaatgaagtgaatgttgcgtgcaatagtgtgtcttcctcgtgtaacaatgtaagaagtgagcgcaaacgatgcaatgaggaaatctcagcgaaattgtggcactgtcgtttgggccacatttcgagggggagaattgaacgattgattaaagaagtaattttgcatccgttagattttgcggatacaaaatattgcatcgattgcaataaagaaaagtatgttaaacaaataaagaaacgagccatacgaagtttaggaaaattggatagttatgattcatttataacattcacggatgattatttgtgttatggctgatgtagaaagtcagaatgatctaaagattaaagtagtaaagtctgaccgtggaggagagtactacggtcggcataccccttatggccaaatacctagaccttttacaaggtttctacagggaaaatggcatagtagcccagtactcaataccgggcgagcctcagcagaacggagtagcaaaaagacgcaaccgcactctaatggatatggtgcgaagtgtgctaagccactccactttaccgataagtctatggatggaggcattaaaaaccgctgcccatattcttaatcgagtaccaagtaagtcggtgtccaaaacaccgtatgagctatggacaggaaagaaacccacgctaaattacgtacaggtgtggggctgtccagctgaggcaaagttatttaacccaaatattgggaagctagatcccaagacagtcagttgccatttcattagctaccctgagtaaaggggagcatggtatcccgagaaattagtcttgaagagaagcgggtatgtgcacctactccgatgattcaagaaccttctttctcgatacctgttgctgctgcaccgacaacacagaacgttgcgatgcaagcacctgttgttagttctcctgtgacaacaacgaatgagcaagaggaacctaagattcaggatcctacacaacaagttgtcacacaaaaggaagagcaacatcagccccaagtagaagatgtaccacaactcagaagatctcaacgagaaagaaagacagttattcctagtgactatcaagtctatgctagtgaagaagttcaaacagagggtgatcccacatcgtttgaagaagccatgagaagtgatcgttcatcgaagtggcttgaagccatggaagatgaaatgagataaatgagtgccaataaagtttgggacttagaagaaattcctaaaggagccaaaacagtaggctgcaaatgggtctacaaaacaaaatgtgactccaaagggaatgtagaaagagataaagcacgacttgtggcaaaagggtttactcaaagagaggcaaaggaacttgtatggaagagggtgtttgtaccatagtttgcaataggtagtttattgagtagaccagattatttagattagtctttatgtttgagagtggtttgcttgagagttgattattttagccttgcagtcaaggaggtggcatgcaggggcattggatggagttcagtgcagaaccagcgtcggcagcaggtcattttcatgaggccaaacgcatacgcagtacaaggatatatggtggtcattctacttctacatggccatacattggcccatgcatgatcgtgcaagaggtttcgaatagcttggtttgcaatgcattcgtggtgaggaggctgagcccagttgcacttgtagacgaacagaggtttaaaataagatatgatcatttgatcgatttgtttctgtattcggtcggataaggaaaccatgagtagtttggatttgtatacataccactaccggagaaaccacctttgctgggttggccaaaaaccacattagtcctggatccaatatattcccttaggacacgggacaaaacatcattttttgtcctggttgaaaagcacaacgccaacaaaacatcattttttgtcctggttgaaaagcacaacgccacttttatgaagatcatttttagtttcggtttaaaaagcatccggtcccttactacctttcgtccatgttggtattaccaaccgggactaaaattcaacgcgtcgtatataatcccttgcacttatcctctcctcctagatcccaatctcttcctcctcatcttttaacttcctcctctgtcctctctccctttcctatctcttatcctctcgttttctttttctcgctgctctctcttatcctctcctttttctttttcttgcagcagccagcagagagcggcagcggcctgcgcgtggcgagcggcagcggcagcccacatggtgggaggtggcagcttggcgcgggagcaagcagcggcgaagaaagtttatttagttgttgatttatctgtgaatttgttgatttgtgatgtttttggatctgtaaatttgtgatgtgaattgtgaatgttgatgtggatgattttgtgatgcttatgtgaatattgatgattttattgttgagtttggttagaaaacaatatgcagacaacaaaaaaacaatgaaaataaaagaaaaaactttagtcccggttggtgttaccgaccaggactaaagatgggcatctttagtcccagattaggggtcccggttgcatacccgggatgaaagggggttgcgaaccggaagtattgatgcattccccagcagtgtgcatacgctagtcggatacgtctgctccaccgagactgccggtatatacacggatagatggccgtctaagccccgaacaaattatcaatatactattttctcattcttttacttttatgtgttttctattttgttttcatggctgagtcctagcaaccataaaatttccttaataaagcaaggaagttatcctttgctaatttggttggaaactagtcattcgttgtcacgtaaatacgatatttatcttttttgctaatttgttcaaaattagtcatttgattccacaaaagtgaactaatctcgaaattggcaccgctagccaattttgatctaacgattttggcgactccattgattataccataaaccgttaagtgattttgtgttggccacgaaaaaccatcagcagaggtgcatatctggcaacagtcagaacacatagccaattttctgaatcattcaatttagatattgtagtttattcatctggcaacagtcagaacacatagatgcatttctggtcccaatgaaatcgaagaaaatgaactgcaaccaattatcacccttatatatgcctcaaacacagttccgctgataagacaaattacaaatcttctgtaattattaattaagcacatggaatgagctgcacatcacaccattttgtgttaacgagatagctaactcagtacttcaattcagcccaatttgtggaagtggagggctattcgcacaaaagttgcagtaataaagcccatcagtactgaagcactcgcctttgctttggtacttatctgagcatatcgctttgcaggttgcatcaacgcatggttttggtacttctgtgattggtgcagcatgacactcttcagtagctgaaaccttccctgatatgtctggacatgtagatggaaatatcgggtttactatgtgtaggaggtataaaattctcttacataacaaggtaaatagatctcataaagacaatgtaagcacgcaagtttgcttccttatgtctgagaagtatttaaatacctaaacatagcaccatgagggaaattgcaaccagggcaagctgattggtcttcatctttttccttacaaacgtcaaatactagatgactggtgggtaatattgatgtttgatgaagatgcttacttggcaacacatgagtttttatagcattggtgctagcacaattttggaatcaatttaaggtgtgtatagataaggcatcaattcaataccgtaatcatggctaaaatgatcggataaaatacatatgtacatctaaaggcgtgtccttaccctggaagttgtaactgaaattttaggatgtgctttcatatccctatggagatagttcctagtatagcataaacttataatttctgctttaaaacaatacttgtttaagaaacagggttggttgcttaaaactatgacttaagattacattccctcctttttcaaattggaaccatgcaattacgattttacaggaattcgagatgtgccactacaaaccccttccaagcattatcaaaaaaaatttcaccaaaattcccccttcatcttcttcctttccctcaaccggaccatggcctgatgatggggttgggggctactgtcgctaaagtgtgaatgatggccccctctttattgggttcttggggcactgtgaggcccatgatagttaaagcaagaatagtaaatagtcgcaaatgctacctcgaagccgaggaagatgacccaacgttagggatgaaaatggagcggatacaaacggataaagcacataccatatttgttttcatattttttgccggatacagaaacgaatacgaatagcctgaatattgaaacaagtacagattatctcgaatacaaataagaataaaaaatgatcggacatgaataaggaaacatctttttcttggaacacgaaaaacaactcaacttctaatagaaacaagtatcaacatatataattagctcaatttctataaaatgtagtataatttataaatattattaaaaaatttaaataatattaatagtgtggactagtgttaagagatgaactactattaaaatgtaaaaaggtatattgaaggtcatagagtaataaagaaatggggtatgtctcatggcttctgcgaatatccgaatagcactgttcaccggatattcgaattattatccgtatccaacggaaaccccagtaccatattcgtattcgtatctgggagaaaatatccatattcgaactatccgaaacttatcccatccgaaaggtattcgtattcatttttctccgaagcggacgataactattcgctccggtttcacccctacccgacgtcaatgccagtgttgacggtcgttatagaccaatttcgaccgtcaatatgactaaaataaaggagagctagctatgcttacaatgcatatttattttagaataatatacttccacttgtacttggattttatttgagtgcaggaattgagcaaataaaataaagagaaaatgaggaaacctcaatcctaagcaggcttatggataagttgggcccacttgtcaggagtaaccgtctcggaaaccatcataactgtcacaaccgtcatagggacccacctgatagtggcccaggagaatttggaggcctgctgggctggcccaggttcggccgaaccaccctggcaacgctggctcaggctggccttacacatggacgtccaggatcacttgctaaaggcggttgcggggcattttccgacatttcgcatgctctacaaccatcatcacttgctgaaggaggagctcattcgctctctcaacacactcaaccaagctcaaatatatcttctacactttagtttagttttctagtgttaattggagtagaatagaatagctctcggagtcctcggaagtcttcggaggaatttcggtatggttgtagtagctttccttcttccttttgtaagactttcggaattaataaattactatttgtaatatactctcgatactttagtatatctaagtattgtctttactttatacctgtatcggtacagtcttatagctagcctaacagagaggtgcagtggtgtaggtttagtgtccgattattcggttgctctatgtcatctcgggggatgtagagtagtatttaataatgtgtatgtggtgtctagattattaagtatcactatctgtgcatatatgctacgggtcagtcgaggtgggccgctgatggtgacagctcagtacgggtattcctccatgatagtatatgttcctaagaaactt

SEQ ID NO: 65582 - DNA, 3686 bp, Oryza sativa
gagctggactcattaatggacttggagtcggattgaggctgtgctgctcgctgttgctgtgactgccactcttgtagttcttgttgaagctacccgggtggtagggacagtgctgccggataatcatggtggaaggtccaccctgatgtcccgtcatgaagcgaggcttctaactgttcccctggagagttctgaactaagatgctttcctttttcggttcattttgttacactgctcctcctgatggatagccttgtccacaagcttcatcaacaggttgatcaattcattatcaagactagaccaaaacttctcctgcctctcgacatcagtgcgcacgtcctcaggagcgtagcgcgcgaggcggttgaactcgtgcagatactctataactgttttggttccttgttgtagagaacaaaactctctcttcttttgtgccatgatcccctcaggaatctgtgccttattgaaactttgacagaactatgcccaagtaacctctgtcccagctggacgggtcaccatgtagttgtcccaccaaacagaagcggcgcccttcaactggtgtgtagcaaaagcaaccttctcctggtcgttgcattgcaaaaggttcagcttcttctcaatagcatgaagccagtcgttggcctcgattgggttggtggtgcttgagaaagtgggtggcttgacatggagaaactccaacagcttggacttgggaggtggaggaccaaaccgcaggttctgctgctgcggttgtgcttgctgctgcacctgctgcaacacctgatgatactgttgctgcatatgttgcatcatcattgtcatcatctgagtctgattgtcaaacacctgagcgattgttgggttctcgggcggtggagatgaactgctgtcagatgcatagcagacacgtgctccactgatctgctcttcactgccactgacgttgttggagtcacggagaccattccttatcttcaccatctagaggggattgggtagaaatatgagaaaaggaagaaaaacaggaggcttagaaactaatctttcttataaatttaagtgcaattatcttaatcttgattgaaacactgaaaaggaagcaaacaactcctaattaaggtagccataccactcacacatgatatcgaccgccgactaaccaacaagcaacaaacctaaacacggaaactagcaagcaaacaaaactaagaaggcgacgaagctaaaggcagtgactctgaagctcggagcggcgcttgcgatcagtgaacaggtttgacacctaagatggacaagggatagcaaccaaggcatgctcaaatccaaattaaacatggcaacaaatgactcaaatgaataaccgagcatggtgatttctatgcatagaacatttttcgtgaacccagataaagaaacaaatgcaactgactaaacaataacttaatgcataaaatagatgcatagttataataatatgcataaaattgccccattgaacatagacacgacctaatgcatatcacccgataaattcccgactgactttcgaataaactccgaataaaatattactaaaaccctagactgagctaattataaagatccgatccgaatgaatgactaagatttttttcgcaaaccaaagaggcataaaccccaaattttcccgaaacgaatccaagtgcaaagagcatatgcaaatgaaaaggggttcaaagggctcttaggtttccagttggcttgtcctacggtgaaggtcggctctgataccaacttgtcacgcctagaaattcatgaaccagaatttctaagctgaatgtgcattaaatcactgtccaggaccagccagggtacacaaatgacaattattgacatacagatccacgtcttacaaaaatataaaagattacaaatgcaacggaaaagataaaaccagctaaacttggaagcttgacttctgcagcgggcgactccactccacaagcaacccttgacggcagcgacgaaaccaaccctaacaagacagcttcaacttggaagatctttagctctggtgtgggggaaaagagagcaagattgagagcaagactaagtcataccagaagaggagaaatgatgcaggatataactaaaggaggctaatcgttcatttgcaataaagcaggcttttaaaaatagtagttgaaagcagtaaaaacaattgtagtaattaatcaatattaaccaatcactgtccaacgctacaccgcgttgcaacaggcccaaccaaccacctgaactacactagttcattaagctaaactaggggtgagactaatcacggtgaatctggttgatcgcccataaccgcgggcacggctattcgaatagttttactctggctagaggcgtacaactgtacccacaagacatgattccacacatgtcgccatgccccgaagtatcaccatgatattgcaaagggggaaatcgtgacaagaccctttgcataacccgcccctaaccatccacaccacgctaagatttcacccccacccctcaaaaggcagtgagtagtcccctcgtgcgctacggtgaatccggcagctggacaaccggacaacccggccgacccaactccatcacgcccactctcgccaccggtatctaggaaagggtcgagctatactacaagtcaagcagttacccactcctgcttgtggcaagcacggtaagactcgcagggtttcccgtgaactggtccttaactgcaagggtgcgaccagcaaaatcatgcacccacagcccaccattcagtgtattttaattaactaacaccattgcggtggcacaaatccaaagctatgctaatagtcaaagtatatgtaataatgtgatctccatttgtgtactagttgaactaagcacggctaagcatttcctaaaccaacatctaatcattttgatacccaagttatcaatggcatatggtaaacaatatatggctgagtaataggacccataccacatgacattgtaaaagaatgcaacatttaatagaaatacgggatatttgtaaattgagtataatatgatcaaatgtaatgcatcactttccttgctctcgcactgatgagacctcagcaacgtcttcgagaaaccgtggatcgacgaaacggccgaaatgctataagactactgaaacaggaaacaaaaccatttttaataaattctagggatttttatgaatttactgagacttgaatagacttaatcggagctcggatgaattagttatgattttaagaagataaactttttttattaataaaggaaaatccttattcgatttattgcgcaatattgccccagggctgacgtcatcaaaggaggggggcgccgacaggtgggccccgcacgtcagcggcttgagagagagagggaggagcgccggcatgcgggccccacgggcagcggcacaaggtggaagggacgcggctggcggctcggcacagctcaagccggccggccatggtgcggtggcggcggcgcgcggccaccagcggattgcgaggcagcggcgatcggcacgaaggcgacggcgcacggccggagcggcggctcggccaacggcggcggcgcacgtgggaagggagagaaaaggagggggagggagtcctcaccggaggaagcggtg

SEQ ID NO: 65583 - DNA, 1819 bp, Oryza sativa
gccgagcgcgggagggagtggggcgacggcccaagaagataaaaggggaggaaaaagaaaaaggaaaaatgagaggatttttcatgtgattaaatattgcacttgctcattttaaattagttaaaattattttcaaggctctgaaaattctactaaaaatgcatgcggaactcaagaaaaattccaccatgtcattttcgattattaattgcatttattaattagggattagctctaggttaattaatcaatttcttcggacaatttatttaacaaatttttaaagaaaaaaaagggaaacttcagggtgtgacaggagatggcggagacgatgcgatggtgccgctagccacgaaggccaggacgtcgcacgcggagagacaacgcccgtgaggtctgtgtgctcacttgctatcccctcttcccattcacaatttgattcggttcgattttatttactactagctcatagtgatctctgttcaatcccaaatcttatctatccaattcaatctgatttgtacctatccaatggaagcagagcctctctgtatctgtctctatttctccctctcttcaacttaattaatggataaagaacattttcttgagtgattggagtttgaggatgatgcgtgcgggtccggaggatgaacaggaccacaggagacgagatggggaagaaaggggcattaggtccaaataatttagaaaatagagtgaaggagtaagtagtggtatatgtgaaataaccaaaaagttgtaatggcatgtctctaaatagatgaatagtaatgacatatttcaaaacagtgaaagttataatggcatggatccaattaaacctattattatagtcggttttttattgaacatgcacctataattaattaaaggtgttggtttttttattttcagccagtggaagtggggaaaacactctagctgttggttttagctcttctggcacctattgtgccgatctatatgtgtgtttttaagtagtgaaaagggcgatgcgctcgatgttgtggtatggtttactgtcaagaaaataaatgcacaacaaaaacacaaatttttacataaaaaactcttacatgaaaacaccatgaacatcgattggcaataatcagtttagaagatataatgacaacgtaggggatacagtagaccgtcgcactattcgcgtatagccgacaagagtatataaagaagaaaaatagagtcctaataggataaggaaactaattcaaactctaatagattaataggaaactactcaaaatatactggtaagtgaatctcagataacatatttaacatctacaacgatagcaatggcttgtacgtcaccagtttctagcgtcgtcggctggggacaagatccacagactggaaagggcgggtgtgctcatccaaatacggtgtgtttgtgtggaagaatctgtatatttgctctcttttatggtactccatagctcggtggtaatggcaaagaaaatattgcacattgtttgtctttatttgtcttatctaagtaaaaaaaatatatactcctcctcttgattaatacttccggtcctgaaatagttatctttataggttacttagcatatatcaagaacaacggacaagagagccacttatcaaataaacaatttattttcggcagcagaaggggaaattttgataggggtgattgatgaggcaagtccaaattacatctaaaatttttggagtgggcctaaaatagggtgagctaaatttctatttatttttcaactaaaaatactagtaatatgcccgtgctaaacac

SEQ ID NO: 65584 - DNA, 16521 bp, Oryza sativa
tcaccctagaataaacaaaaccccaactagtggtcactctactcatggtaccactagtatgattttaggtagatgcttcgccgcttattaggtaacattaggtggttttacaactctagactttgggatattcatatcacctggacactatggaatggttggattattgtggaattggattcacacctccccctctattcaaaatcctcaaaatggttttaggttgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacaaagtcgggggtcaatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccatggtggtatgtggcacgtggttacatgtgaggaagatctgtcttgtgggtaaagatgtacacctctgatcagagtataacctattcgaatagccgcgcccttggttatgggcaagccgagcaatgtatccaagttagtgttttaattttaaaacctgcttaacaactaaaatgtggaaatggttggcctgggttggcttgggacgagttgggacccagggtcgagttgccagttcggtctgaatcatcgtaggccttgggttaaggcaggttcgtgtgggttcacggccttgattaataatcttgtatagctctaggatcgtatttacaaaatagctttgagcaactaagtgtcttttaatgctgtttactgcaaaccctaaccctttatattataacccccttgtactcccttgcatttattctgcacttatgggtgtgtcttgttgagtacggtggttgtactcagtcttgctcaattttgccaaacccagaaaaggagccccttgatgatgaaggctttggtgtttagctcgtgcctgcagtcaagcgcctgtggtcgtcgcccttgtcttccgctgtttcccgtttgtcttcttgtgtgctgggccttcgccgcccatgtaataatgtaactatttatgcttccgcttgataaactctgaaatgtatcaactttcggtgtaccttgcctcctggaacaaggaataatacacgcacgtaaggaacgcccgttgggttatttccggtcgtgacactagtctaaaggggattctgttggtttcaccaatgatgaaatcaatggggtcaatattgccgattgggccaagaaaatagtggttttcgtgcgaccggctgggaatcgcgactaggttggaaaggtgctgcaaatccaaaggaatcgggaagcagaaagcacgatgagaaaagaggaaatcgatttcatgcgaggaaaagggatctatccgatgagaacttacctcagcgtactctgccgatggcgcggtagacgggctagcggaagacgacatcaccataggcggagatctgatcggaaatgaaatcgcctgggatcgccttgtgtgttggagagatcgctggagagagagagaacaaagttggttttagcggtgaaaacggaggaggacggtgtgaaatttttcgagggtgacggttagtatttaaagcacaactgtaacagtcggaaaacggcaaagtgcgaaacttgctcggagttgatatacagcaaatccggaacattaccaaatattccagacttggggggcatatgttaacgaccaaatttggtaatatcagcatcggaaaagaggattagattgaagtggagtcgaaggcggagatcgattcgagaacagagcaagaatcggcaggagtccaaatcagctacgattaggatcggctggatccgaatcggactgagtaagttgatatagccgattctgacaatacaacttcgtatacgatatcaggttgaattaaggtgcttcaagatggttgccgcacttggatagagtcctgagaaggcaattgtatctattaattaggatattttatgtaattttcttagagatatgtttagggcaaaagtctgccataaagacttattgtatcttagagtttgttagagatacgagtcatgtttgatatggacatagtttgtaatttttgtgtataaataaaccccgaaccccatgtaatcaattaacacacacgttcaatacaatttcggcgcatcgccacccttttgcttttgttttatttcgacgaattcttgcttttgggttgagctgcatcggtttcgatcttcaacaagaggtaaaacttgttatgatggcttgcattctcgggattagtgcttccatctttatgatactctaatcttgtttatgtaattcatcgagttatgatatatcttacataatctctggcaatatcactatctaacctacaatcggctaacatctgttaatagagggcagccaattaggttagattttgacgttgatttagattatataagatctccaccactctatgaaacttccagcagcttgattgtctacatattgttcttcttttcatacttaatgctgcatcagttgagtttgatctattaagtcgtgcttagaatattagtctctagcctgccttctggttgccgattagggtagaatcggagtttcagccgatcttatctggtttaactatatttgctctatatgcttcgttgacatgttaaatctgctctttatgtcaagatattattgcatctacgtatattaagcttcggtttggtatattctgcttgttttaatatcttaacatagagctgtatcggagtattagccgatacatgctagatctatctgatcggatttgctgtaaacatatatagttctattattaatatatatttcgatctaagtgatttatactgtctcggcatagggactgatctatcccaatcacttgatttaaatatatatcgatataagaattatatattgttaatatgtatagccgatcgaatagatttagtcctttattatctagttccaactgccgattgatttacatatgacatcggctcagagataaatgatatgtcatcggcatctagccgatcagctatcatttataggtttaactgcggtttctttgtctttatttcttgttgattgcaggatcaaatcaactgccacgctagcatacccgaacgcgagttttggacctgcactggagttcagcagatctcccaggcctcgtgttttacgtcaacacccctctaccaccaccgctggtgtcgctgagccgccaccgccccttcgctcccagcgccgctgctcctccgcagccgtcggccctccgcagctgccgccgccgtcgctctttcctccgccgcaactgccgccaccgtcgccgcagcgctcgagggagatagagagagattagagagagaggataagaagcaggtcaaacaagcaactgggttaaataagtatgggtaaaatggactatttacgcctaaattaacaccgttaactcatccaaacggaatatggtcagaccagtgcttcgttttttaaaaggagggtcaaataagcacattttaaaaagcagggttaaattggtagttacagttcaaaacagggtcaaataagcaattgccccttagtttttttatgtgttctgaaattttcatgagttcaatgacctgtaccagagatatcaacttcctgcattgtcatcagcagtgcctattttctagcatgcaaaccagtgatccacaaacccatgaaaggttttctttttctctcttgcttgtgttgttacaaaatggcatttttattttcttctgcggtaaattttggctttattcactttcgcatgtttcatagctgacatcactcatgttataataaactagattttttttggaactttgcaatacaatataatagcccatcttcatcttactccctctgtcctgaattatagggagccttaatttttaagtaaaatcaaactcgataacttttgattaataattacactaacaatatctacaccaagtattatatatgttatgtcattacattcgtattataaaatacttccatgtaatgctaattgtatatttgttgatgatacaatatgaaataaattattggttaacttaagtcattgaagatcgtgaaaaaaatatatagatcttataattcgggacaaagggagtacattgctttggctaagatagtttttcttggaactaaatggttcctagcaaaaagggagaatcaagaaatgggaaccaaagagatctgattagacaatgaaaccattgtcattatgcctgttcatggaactagacgatgagcaccggtggaatgaaccatccattaaggtgatcgacgaaacaagatcttcatatatcctccaaatcacattgacttcttgttaacaccaaaatttgttacgattattttgtggaattggttaatgaaagaaactgattggtagatggaaatttatccagattaagccgagttcaatgaggaatcctgaaaactacgacaatactgctttatattttccttagtatatctcttaaatagacatgattagttatttcttttcttgttaggaaatattatggctcccatcggatggcctaatcagccaaagaaaaagctaaattttaaatttttaaaattaattttgagattgattttgagatattttcaacgtagtttttttttctgcattggcttttaagtcaccaagaacacatatataaaatttttacctacaaattcatttttttattccctaataagccgttttggcttatttgggaaaaagccaaatgatggggccctatattgtgtcgaatcaggacttgtatcaaccttagggtataattaaatatgtatacctagggtttttgtaaggaaatccacgtcaatacaattatacgtcggtgtattgccaacttttcccaattaaattaatcactgaaatgatctttcaattgttaaaaatacttccaatgctcaaataattccaagaaaaatcttgaacatacttgaacactcaaagaatttaacaaaattgaaaccagctcatttaatgattaatttaatatgtgaataattactgaaatattctttgtattattaaaattaataattgagctctgaaacatccaagaaaattccagagtataattaatcatggagaatttaatacaaattaaatccatccatgctttatatttaggaaattttatttcccacatttaacttcacttataaattaatgaacatttaatataaattctattaaaaatttattaaaaaatttataaatcctgaaacaaaaatcaggctgtgacaaatctaccccccttacaaagaatctcgtcccgagattcggaacggctagaaagaaaagggcataggtcaactgcagtctatcttattccataactccgataattattctaaggctttaaagaagactactgctgctttgaaactggtggctgagctgtaacacttgaggacgcaactggcactgcattggctcctgtgacgacaatgttgttgacttgaccttgcggctgctgatgcttcggcttcggacactttcttgcgaagtgacctggctcataacagttgaaacatacttgctgctcccttccactactgttattttcttgagactgatcctgctgaactggctccgatagagtagcttgcttgatgttaacttcattgcttgcattagtctctgaattgatctcaccaccgatgttcaactgttgcgattgttcttgagatgttagacttgattcaccaacttgggatggcttgatatgctgcctctggctactgccctgtgcctcctggaaaacagtcattcttctcttacggttgtccatcctgttcttcttatcttccagttgaattgctttgtcaaccagctcatgaaaatcagcatagtcatgagagatcaacgtaactgacagttcatccttcaggccttccaagatcttctcctgcctttcctcgtcagtacagacatcttctggagcataacgtgctagacggttgaactcataaagaaacttagtcacggtacgatccttttgcttcaatgtcctgaactcacgcttcttcaaagcaacaactcctgcaggtatgtgtgtcttcttcaatccttcggtaaactcttcccaagtgattggttgtccttctgctctgttcatccggaagtgatcccaccattctgaagcatatccatgcaactgatgtgaagcgaacacaactttctcttgatctgtgcactggagcaattccaacttcttctcaatagtgtgtagccaatcacctgcttccactaggttgatagtgctagaaaaggtaggcggcttcacacaaaggaaatcagctaacttgttctggggcggtggagcattgttgttcccttggttgagatggttctgcatctgctgcatcatcatgtttattaactgagtctgttgagccagaacttgagcaagggttgggttctcttcattgttattgtttccacttccactagcatgagtgttcaccattcgttgcagatttggagaagatagaaggagaggggttacactaaagataaagaccttaactaggttatcactgatctggtgtgtgtagaccattatattgttcaagttgattaaacgagcaacctagtacaattacacactcatcaatgaacttcctcaatgatgagaatgcaaccatacctacacacaagcaaacaaaagcgttctaccctactaactatacttcaaagtcactttggcggtttaagttctaaggtaggatccaaacttcattccttcttgacaactggacacttcagatcgatcatcaccttcatattcctcgatccacttgataagtagaccacattggcttcttcaagtttcaacaactagtttcagaactactcaagctgaaagaggaagaggaaaggatgataaagcaatttgcaaagaattctggagaaggaagaaaggaaacattttcacaaaatcatgttttttgaaaattagtccttaaagtttgaccatttggcttatcctacagttgagatggctctgatactaacttgtcacgcccataaattcactagtaatttctgaactaatttgtgtgtcaaatcctcgtccaggaatcagacaaggtacacaaactgacaatttaatatacagattcatcaataatacagcattacatacttacaaaagaaaagagaaaatagcagcggaattacggtctagcgaagctccggcaacactcccacaggcagctcaattggggtataagccaaacgtcttctccttcgcaacttttcttgaactgaggtttgattgtttattgcaaggtgagtacatggaatactccgtaagccacacagcaaatatgcaaatgcacaaggataccaaagaatggcataatatagggctcatttacaaaagcagcatttaacaaacattcgagaattgtaaaatagtagagtaattaatcatcaatattaatcaacactgaacagcacacccatactacacagacccaaccatactaaacaaccatacccggctgtacagatctatctccaaaccaggaatgtatcattccaaaccaggagctaatcaaatattaccagttatagcattatttattatggtgaaaagtgtgagactaatcacgacagacattgttagagccgctcatgaccgcgggcacggctattcgaatagttttactctagccagaggtgtaccactgtacccacaagacacagccccacaacatgttaccatgcgcctcaataccaccacggtacctcggaaaggagctgtgacagtacccctcgcataatacaatccaccacagcacaccgttcctggatcataatcacccccttataaacaaggcatggactccccagcgacccccgtgggcttatctccaccacttctcaatctggtgccccgcaatgaaccatgctatacaaaaggtaaaggcgttgcgcatgctggcttgtggttggcacggttaatgtttcacaaccgaaactcgtgaaccagtccttaattgtcatgagcacaaccatcaaaaccatgtgctcacaacccaccattatcaagttttaatggcatattaattaattaaccaatcacgattaaccattgtgagctacaattaaatatccatcattaagtaatagtaaaacattagttatcccaattgtgtgctaatgtttctaagcatggctaagcaattatgtctaacatctagctgaacaaatatacaaagctcaactagtaaaattataataacacaaggtatcaaggaatagagtaatgaacgcaaattggccataacaaaggaataagttcacaccacccggtgacattcgaaaataaatgcacagttgaaataaatagagactttaaatataggatcaacatgctcaaaggaattgtatattaggatctgtgtggcttgccttgcaataattggtcttcaattatcttcttgaactcttacgacacacacgcgaaccttcgaaacgacgaaaacgacaagctaacatgcaaaacgaggaaaaagactaataaaaaccaaataaacagaacatataaagtaaacaaacatgtagatcatgattgtagatgaattatgagactagaacgacctcattccgattttatatgaattagttatgaattttacaagatttaattccagttaatcctattagagaaaagactattccaaattaattaaacaatatacaaatgatttataactgagataaaagattaaaacaatctctggaaaaaattagattatatttggtagttgacatatattaaaaatgaataatatgccattgaaaagagagaacggatttatattgattttggatggctgagattaatcttaaccgagagttgactgagatccaacggattagattgaatccattctagggtttagttagacatggcacagcagagacaacgaagtggctaggtggcggtgaagtgacagcagagatgcaacgacgtggcaaagataatacaaccacgcgggatcactggacggcagacacgggagcgacgatcaccggtgaactacggagcagcggcaaaaagggagcacaccgggagaaagagcacgagacgacggtccttaccaacacttacgtgatgacggagagcgacggaagatggcggtgacgagatccgaatggtggcgatgtactggtccacggcagcgacgactttccggcgatgagcagcgacaatggaggagtggacggccttcacctcgcagctgcgaacccaaaggaggcggtgacaaaacttggcgacaatgggaggtgctgcagggcctcgctggatatcaaaacgcgacggtgaacttcgggttgacggcgctgatggagctccggtggtgatgagggatgttaggtcccgatcttccgattggtattgataaacaaagatttgggtggagtcgtgacacaactcgatccggcttctgaacgaacacgctactgagccccgtaatcgcagcaccacgtctcctctggttatcaaaagtgccgaaacccggtttacctcgccgagaaggctaatccctgcatgcgaattaaagaacacaagcaagaacaagatagattgtaaccaaattgcatatgaataattaagcactcgaatttggggttccacaaaccgatctagcggcgaaactgttcttgacaggataatctaagcaaaacccaactctaaacgatgacggctactgaattaatatgattagggatgtcctagggtttccctatggcgcacatcccttgggctaagcccacgacacaattacaaggcccaaaacccaaatcagattcggactggatgagatatgtggcttgttttgcagatttccggcagctcggtaggaattttgacatggggacaaaaccatctgaaagtagacccataagctttccaacaagtactcataggcctcaaaattccttctagatcagaggctaggtccatttaaagttgatgctgtcaggaggcctgaatccgaaatcaaaacgtgtagaactttatctcttttcttttatggaccaaaagtgacgtgttaagatgaaagaaaaccttcaaaaaaaaaagaagacttgcagaaggtcttggtttggtccccaatcaacttcttcaatcatccatgcattccttacgctcggtctcttttctttcgcccaagcaagtacctctgcaaacaaaaacacacgaaactcattgtgtggcagcgtttgttcaaatatataacaaatatatctaatgtagaacatatgcacctttatttgattaatacataaggtagtcatggttatatccgagctaattatgtcctcatcaggtggatttcggcttcggggaagtggaggacgatcttcttctcctcctcgtgaacccaatggcggcagtggcgaccgaaggcgacgaccacagcgacggcgcacggcggctggagcagcggccggaggtggagagagaaggcgagcgcggggagagcgtttccggcgacggcggaagacgggatttgaggggataggtagaggacgactagggggtcctttatataggaccgggagctcgggtccaagcccatatcgacgggaaaaactgcgggaatgttaaggatcttcgccggaaaaggaaagattgatccgcgaaattggaaaggatttccatagaaactttttgggatttcttgggaaattgtagaggagattgagaggattccattccctcaactaatttggaaaaaggagcaacgaggaggccggattttggaaggaggaggcggcggcaacaggacacgggcatggctggctcggactctgtccgagctggaagatgaacagtgtcagggaggcaaaacagacttttgtctgggcttctattgcacagcccgatagaagcagggatgcaaactagactattggaagggataaggccggccgaatagaaagaagaatgggccgaggactaaaggtgaactttcctgtttcggcccaaaaaggaaaaggggattttaattacttttcccaattaaattaatcactgaaatgatctttcaattgtaattccaagaaaaatcttgaatatacttgaacactcaaagtatttaacaaaattgaaaccagctcatttaatgattaatttaatatgtgaataattactgaaatattctttgtattattaaaattaataattgagctctgaaaaatccaagaaaattccagagtataattaatcatggagaatttaatacaaattaaatccatccatgctttatatttaggaaattttatttcccacatttaacttcacttataaattaatgaacatttaatataaattctattaataatttattaaataatttataaatcctgaaacaaaaattaagctgtgacatgtatgtatcctgacttagcagcagctcgatcttccacggactatccgataaaccaaaccaatatagaatcaattacctggaggatgacagcagtagggagatatgaagttggaggatgacagcagtagggagatataaagttggaatacatgatggggataggaagtggcggtgcaccggacggagcagggagcatagggctggaggaggagaggggctatgaagcgatggagtagcattgcggcggaggaggtggcagcagcacaacgaaggagccaccgggggcgccacggaggcagcgccaagtggcatgaaggaggaggtaacgggggcgtccaagggcaggcggtgtgatgcgggcggacggtgtgatacggaggtgggggcggtgcgggacagcatgaggggtatctgagccttttgatctgcacgaggatcctaagggtaatatcggcccttagattatccaggactcaccaccactactatgtattttttactacgtagtaaataaagataaagattagatatacaagggataattgttatttgatgaaattactatcatggctttgttggagagttaaaacttactaaaaggtatgggataaatttggttactattttatcataatatccgaaacatgaacataatattttgttagcgcttaccatctatcaggcggatctacagtgttaccactggtgtcagaagacagcgatgacattcgacaaaagctatgtttaaattgcttgtctatatattataacactatattctaaatataattagcatgctatgataacgatagacacgttaggactctagatccaccactacatctatgtgaccttctgtataatttgcgttgatgattgctttgtgcataaaaaccatcaatgataattatagagaaggtcacgatggttttgttgtgaaattcctggagaaatcatatatggtttgttgataacgtgaaatcatgcttggtctgctgaattttattgagttaccatatacagatttgcccttctctacttcctctattttcccctatctatttgctttgctctgtttcatcgagccggttatcctcactccgcacagtgcgcgagtgcgtatgtccaggtgcagacgttctttattaactagtgaagaaaccatatttgatcagtctggcgaaaatcataatagtcccggttacactaaaaaccgagactaaaaatggatttttagtctcggttggtggttacaacaggactatttaatttttagtcccactatagatcgcaaccaaagaataacgacgatctaatacattaataaatactagtaataaacaaattggcgattattttctctaattaaacacactttaatctagctatgcataattaatcttgttcctgatcatcgacattcggcataggtacatactacgtggtgataaatccacaagattgcaaccgcaaaacagggagaggaaaacggtataatacaagctactttcctgcttttctctgggcatcgcgaaacagctaacgattattttcctttcgaccggagtgaagaatgggtttttacggaactgcccgtcatgtgtaacatggaaagacaaatttaccctcccgcttgagcccaccgccggatccgcatggggaagggcaggggagagccgctcccggcctcccgctcgagcccgtcgctcgatccgcgcgtggaagggccgagggagttgccgccttttccgttgccggcgcctgcattcgccgcagttgccagatcagctatcgaagcctccgtcgatgcgcggggaagcccaccgttgatagcaccgcctgccgcccgtcacgaggccggcggaggcagagccgcctgatgccaccggtcgagccctccacctgccaccagcagtgccccttgcctgccgcttgccacgctgcccactaccggccgcgccgcccaccgctggctgcaagaggagagtgagataggagagctgcgcagaggagagaagagtgagaagaagaggtgagagagtgagaaaggaaaggagagggtctcgccctgaaaaaaccatttatgcagtagggtaggaaactaattcgtcattggattgtttatactaccaataaattataccgtaaaaattcaatataaaagaccatcatccagcaaagcacgttcatcggaccatacactccatatacaacgtgacccacttaatttatgctcccattcttccgatattttttttcagttctaacataactacaacgttctttgatatgtgaaaatatttagtacctggtatattgaaatcaatgaagcggcgattttttattggttgcgcccgatgatcttttattttgcgtttttatttggaatgcgcggcatcaggctgatcctgggaggtgcaacagtctgtaccggtggtgttaccaaccaggattaaaaaattttttttcttttccttttatccggttggtcttttttctttttcattgttcttttactctttgcatatcgcccaaatcatcatagatcgaatgaataaaataaaaaaaagcccaaatcatcacaaatcaaatgaataaaatcaacatcaaagcatcaatattctttgcatttattcacatctacaatatctccaggacaacaagcattcatcatagacaacagagaaaaaaaaagttcacatctacaacatcgtcagcattcatcacagagaacagagaagagaagaaaaaaaaacatgttgtccgtcggccgccgcctcccaaccggcgccggccgcggcctcccgcccggcgccggccgcccccgacgcagccgccgcggccctcccgcctgccagctaggtcaaagataaggggaggggaggagtggagaaggagaagaaggagaaaactaaatgagaagtgcatctggaggaggagttgagaaggaggagaggaagaaaagaagagatggatggggaggagtggaggaggagaacagataagggagctgggcgcctctgattttttttgttctttattttttttgagaattgatcgacacgcttgctctgtttgatttttgttgatctacgcgctagggaggagatagaaaaaataccgctaccctttttaactgcgactaaaaatttttttagccctggtttttttaagcaaccgagactattatggtttttggacaacccattaaagatggtttctccagtagtgattattcatttttgtttgatgcaaatcaacactaaaggaaaattccatatcataatcatcataacacaaccattaatgtgtgtctactaaaccaaaacaccggatacaagtctagctgactcaacaggtgccaggctttttccaaattgacgaaagcttcaaatataatatgaccaaataatagaattttcacagtagttgagggatttattattctagctcggattttcttcaaataaaatataaccaaaaaaaaatgatgccacatcataaatagtgaaccgtgggtcggacctaggtataaaacttgagtttctttttgtgagtcgagggacaaataacatatagttttgtaattggatcactaagtggactaacgacgccatagtctatagttccatttttcatgtttttaggtgtgtttttaggaaaggtgccgtgaggacccagctttcataataagccacttctttcttatgtgtttcaattctcttgaaataagattgatagaaccgtaactctagaaggtgagctccgtccgcatcgctcccacctcaggggcgactaggatgcgaaacaaccaccaccgcctttgcctcaccaccgtccgagtcgccatcggaaaattcagatggtgaggtagaggaggaggcgacagtgctagggaagcgaccaatgatggatagtgggaggcaggtcgtgccttgggaggaaccaccaaatcttgtgctcatttggccagttctggcaccccggcgactggatctggcctcttatgtaatttatacaagtgggtattcatttaaattggttataaaagtatagaggtatcttgatatacagtagtatcgctatcgctactatttacataaaacaataaaaatgataatatagtttcgaccatttaatttcatccctaggagagaaacacctagagtcgtgatgcacgggattggaagaaacgatcaaatgtacacagatagatgcacaattgcgtgacagtccattgtattcacacgtggtccactgtattcacacgtggaccactgtattcacactttttgatcgataagcagcactagcaaccaaattggatgccgcatggcgccacgttagttgtgagatgcatgcatgcatgggattgaaaacgatcaaattaatatgtacagtactgatacatgcagcatgtactctttccgagtgattaattcacacattaatttgtctcatcgatcagcagctctagccacatgttttctattaagaatccatgcatatatccatctataaatatacctcatgcatgccagcttcttctactactcgcagcgcatcactcacagctacatccacaagtactaaaccaatctctgccagcagtagctctcagctatggctgatcccagcaagctgcaaatcacaccctgtggcatgcttgttcagggcaaccagatcaacttcaccaaactctacctgcaccacacgccggctggtccagaacaaaaccagtcggcggtcacaagcaatgacaaaaaaaccgggttgggttgcattgtcgttaacaactggtcagtatatgacggaatcggcagcgacgc

SEQ ID NO: 65585 - DNA, 62058 bp, Oryza sativa
  unsure (1)..(62058): unsure at all n locations
tttggtctataggaaataaggactggctttccttctttgggggaaataattatgcttctgttttaagtacctcgtcataatgaagaactatgagcattattttctgataattcttatgttactgactaatatgatagtactgagtggcagtagtgcaggatttggaaaacaaataaatcctcccaagaatttcctaaatttggccaattcggatggcaattttatactgttattgttagatccactgctcgagtcaaatgtattaaaataactcaaactgaaactttagttacaacagaccaactgaaaatattaccggattagagctccaatttggcaaattctgtttattttcttttgggattgtaaattatttaagcagactccagccatgtagactggttgatgcatataaggaaactggattatttcatgctttcctaataataaaatccacaatggtcatgaagtaatattagtagctaatccatagcatcgcaggtttcttatagtagctatattagttgtctctagtgatacattgtctcaaaatctccgtctggtaattagttttctgtgatttttacagatcaaggcaaacaatacattgatgcaaatggtaggtgctgactggataaaatctgataagcgtgaagatgacctttctggccgccctggaggactagtacaggtatattttcttaaagccagtaattttccttcaacggcaaaaggaaccgagaattttaccaagagttatattgcagaaatgtgcagcacaagggggcaacaaattcttttttatcgttaacatacaggtgggattttcattagctatacataaatattggggcctcatgtgatttacaacaacatgcctttttacttatgaccctgatggatataggttcctggttcatccacatacagcttagccttgtattatatgatggataccccattggaaaaggttcctctacttgaaagatttgtaaatggagatgacgcattcagaaattcaaggttcaaactcatcccgtacatctcaaaggtacctattctgcactaccagccttcattcttgtcaagctttacttagtaaatgctgatggtttatcttcggtatatgtgccgcttcaggggtcttggatagtaaagcaaagtgtgggaaagaaagcctgtttggttggtcaagcactagagatcaattatttccgtggaagcaattatttggaggtaaaccctcagcatgacatgtatctccattagtttctcatttcattccgtcatcagaattcagatgcttggtgtggcaatgccatacttactggcttcaataagcagtttatccaaagcattatgtctcacttacaaatagcgcagaataacaatggattgaattttggctactgttgccacttacttgcgcttacggttgacttcatttaccacaatctacgactagcgttacaaagattgtctgaaataaatcgtggcgtaatgaatctgccattctgtttggtacatccagctctgaacatctttacatgcatttttcagcttggagttgatataggctcgtcaacagttgcacggggtgtggtgagccttgtgcttggctacttgaacaacctggtgattgaaatggccttcctggtacaggtaattgtggcatatctaatcaagtaattacacaacgagcttgatgtttcttttacttctcaagattcagaacagtgctgtttcttttttcctttaatgagataaaagattcagaatggatcagtaaatagtgctatgagatgagagtttcagaattgctcttttccttcttttttttttgagatgagagatcagtaaataacacagctgaacaacctcatgaaagaactccttgattccttcctactatcatgaaacaaaaccctgtttgtgtcgtgcagggcaacacgcaagaagagctcccggagttcctcctgggcacctgccgactgaactacctcgacgcgtccaaggcagtgtccatagacgagtgctgaaggcgtcatcagccaccattgaccccgccaacattctttctgaggccaattacagtagtacagcgaaccaaggaaaaaaagaggctcaagtcattcgtttcccctgccggccccggtccaaagatactccttgtattgctccacacaaaagccgaagaattctggctcattctgcctgcctgccagcactgtacattctcctcttgccgacaggtattgcgatgtaatgatgatagcaatctacgcccattctttggcatgccatcatcgagaaaaagagaaagggaagtgtatcctaacggtgacccccgtggcgttcattctgacctgggactcgtctcagcttactgtgagtagtgagattgcatcattagatccaactccaaagcaacccattaccggacacttgactactcctgttccataatatttctcctgagttcgagtgagtggtggcagccatgattataccagagggactcgtcaacaactgaaagcgaccaaagtcacagggattgatatactatgctcctaccattggtaaggaaggaacacccaggcagacgcactcacaacccaaaccctttctttttgcctagtcacttgagctagaagggagggatggaacatgagcaagtggagccggcatttccctttgttcttgagaaaagacaggacatgcaaactatgcttaaggcagggacggatagagatgatggtgtgtgtcgccgtcgcaaagcggcgagacatcgtgtggtcgagatcgctgtgcgtcgtccgtcgtctgcgtgcttggctagctaacctaaaactaaaaggcttccgtctgcccgtgcaccccgtcgccgctgtagcagccgacgtgacaggtgaaccgatctctcctgcattttttgctcacacaaattctgtaccactagtagtagtttgccgcgtcatcgcttcgaaatggagagagattagtgtggggagaagtatatttaagtggacacttgcagggttagacagaattcccatttccattgactcgaacggatcccgatgacgccgccatcgccggcggcggctgcggcggccgggctgggcggggtcggtcgcgcgatgcacgggcccgtgcctggaggccgggctcacgtgcaaaacgcaaacgcaagcgaggccttcgaagccaaaagaccctgtgaaaaaacaaaccaaccaacaaataccaggaaggtgccaagttgccgtgtctctggatcggtcgcaacgtcgccgccggtgaacacgatgaaacgaaggtttaccaaaccgttttaggtcgggacgattatcatgagaatattattgcacatgataaccacggtaaccgtacacggaaacagccgcacgctaacgaacggtcgccggccgtaggatctgccgggatcctatgcggcggcgatggagtcgtccggcgagcgaacggatgagttgtccgggatgcgtcagcggctggtggtggaccggtgtttttttaggggtaggactgtgtaggattaaggacggatgggacgggtttcgtcgcgttctttttttgattgaagcgagaaggaagaggggaccggttgtggtgcgagccggtggtacagcgagaggcaacagtttgggtactgtttgggcgtgtggggagcgtcactgcatcagcatctacttgcggccacccaccacaccggaggattttcttttatctttttttcttttggagtattatttcagaagctttcttttgataaagtttggtttgataaaaacaacatattgtgtagtaccagtagacagtagtacctaatttgtaggaagtataaatccgaaagatattttgcaatgcatccgctagaaggacgatgttgtcgcgtatgttttggagggttatagattgtgatgggttggcggcacttttttttttttttgctgtcacaaacttatcaaaagtgtttgtttttcaataaaagcggtatctaaaaaatatattgcagagtgccttttaaaaaatttaccgctaaaatctcaccttatggagttggatgtagtaaattactacgatatacaatgcactacatgatgggtagctataatgtctaaaaaggtgaaatgactactttcagttcattatagaagaagagagttgacacagtttatgagagaaattagccatcaaaactttacaattgtatagttaattaaaggcaaccaacaaaaacctactgaaaagactaggacaactgtctaatgcaactcatcaccacacaccaatgacctacaactactaagatctatcacatatcattattgtcaagctcatcgcaacaagcagtcccgacttcccatgacgacatgtagcctggacaatcaacatcgttgataaaaagatgtttatggccactcaaattcagggaagtatctaacaacatcttaatagaggacacgacataaaaacattatcaatgtttgttgggaacactggaactaggttttcatctaaaggataatatgagaagaaccaaaatgatgcctttaaagagggaacggtgtccacatgcatcgatgtcaccagcatcacgcgtaaactaggcaagacttttgccgagctcccacatcctaccatcgcaacttccatgagcaaggtggtagctataatatcactatacgcataatatataggacatagtgtttacaataaaattctcagaacaaattctcaccatcttttttatatatgtagggttgtcataacgcgtgaatgagccatgttccactaagattaagaccctatttgaggagcaagaaatggtaagaagcaatggtagtagactagtagtagatttatttttgaattttgttgttagtgactttcttaacttggagagagaatataaactgtaaagaaactagagatttttgaagtagttgtaactactagaagcatagaagaagctttttaagtaagtacagcctagggtgagaggccgtgggtcacgcaagaatgaataaataccaaaaggcaggagagaggcgtctaaacttagcagctaaattatgcaaattagtagtagcagtttattccttccatagagaggctgtgtttagatataaacttccaacttttccatcacatcaacctgtcatacacacataatttttcagtcacatcgtaccaatttcaacccaaacttctaactttggaaataactaaacacaaccagatataactcaaggttagaaaagcacagtcatgacagaaacagaaaggggaaaatggaaaatgaagctccttttcgtcaacttctctgagaagcccccaagttaattactccctacgtacctaaaaaaaagataaaccctggatttccgtgtccaactttgactgtccgtcttatataaaatttttttataattcgtattttcattgttgttagatgataaaacatgattaatattttaagcgttacttgtctttttaattttttttataattttttaaaataagacggacggtcaaacgttgggtatggaaaccagagtttgtctttttttttttcggagggagtacagccttacaggaaagttacaccccacagattgtacggtgatcagtgttcctgtgtgcttgcttagagtagcataagcagtgttaccactagtactactgctgctgcacgacgtgaagggcatccacggtatactccaaaagtagtccataggcaacataatatttgatttagccacctagcaacattgtgaaactagtctttaggaaagaaataacaaaagctacccataagtatatggtctgcccatagagaataaaatatattatttatctttatctcttctcttctactatttgctatccatatacattgtaaagattatatatggatcccatctctattgactaatttttgttgttgcctttacacagagagagacagagaaaggcctctctgcttgtggaggaattttgcagtaatccgatcctgaggcgagatgcggtgtcagcagccatgaaagtattactcctactgtgtttagatacaaagtttatccaaacttcagtcttttttcatcacatcaacttatcagacataattttttagtcacatcattgtcaatttcaactaaaatctaaactttccgctggaataaacacagccttcagctgagagcaagttaaatagtatagccaactactggctctaaatcatctatagtcaatttaatagtcaatttatacaatagttacttataaacatatactacataattaatatctagtcacacctatcatacaaatatgcactttagagtccgtactatagttggctacaaatctatagcccgctgttcttctttcttctcttttatctcttgaaatgtgtctatagcttgcttataagctgctattgtacctgctctgaaatgacagtttccagaggtgatgttccctaggttggttcagagattacgctaccctatgccatcgtcatccacgcagatgcagcagtacagtgtgggagtatacaggtattgtgcagaccgaaggagctgctgctttggaggaggattaattggtccaagcttgagaggattaattggcccattggaggactcgaagctgttccagtcaaaattacaaatccccagatccacgtcttaaggcattgttagaaattttgtctcgttttttttttcaatttatggtgtattctgacatctgaccacgagagacatcggttgctgctgagagtttcagctcttcaggccgagtttagtccaaattttttctttaaacttccatttttttatcacattaaaacttttctacacataaactttcaacttttccgttacatcgtttcaatttcaaccaaacttttaattttgacgtaaggttgaaatttaaattttagtacttaaattaattttaatattttttactcatagtttattgtttaacattagtttttaactcgtttagaacatttgtataaaagtttgtatctacaaattattatattttttgtcgctaataagcgtaaaggtttacattcagttctagttaaaacgatcagcctgcagtttgtgttttcggtggacgcaactatagatcatttatgatcatattttgtataaagaagtttttagaattaattttaattagtcgttaacatgtacattagacaagctattattacagatatcataaatattaacattatgttaaacatgttagttaccatttaaattgtagatgataataacaaaagaagtgtctacgtcagtcacagcttgctaattaataatttcgatttttaaattatattaataaaaaatagcccaagctaggtaagatgtcatatttataaattaaaaattttcaattaaattagagaccgtgttgttttcatttgcatgatatatttaacatgtacgattcaccgaattaattgttaggtttttctagttaacgcgtgtgctccttaaaacatccattagtgcggtatgggtatgtaattgacttcttattaaatactacattattaaccattacgaaaccaatattgccacaaatacattaaaatatgtatatccgtataggttttaacaccaaatatacttgtaatttgactaattatttattaaaataaatgaagtttgacatttcgaaataaaaatatattccttaagaaaaatgtcatatgaaaagagtcatggctatataattacacctatcacggtacaggtcctcttacctacaaacagtaaacgtgcgtggtttttctttttccaaataagagtgtgtggctatgtttttaaatcagcctttagcaagcctagatttatcggtgatctctgtctctgtgatagtgcgttaaagatatctatttgcagggattttgtttgtagtgtattgatttttgaaaaattacacggaaatcatacactccaacactatttatacgtttgaatgaaagcattgataatgatatgcgaagagaatactcactgcttcctccgtttcacaacgtaagactttctagcattgtacatattcatatagatgttaataaatttaggtatatatatgtgtctaaatttagtagggcagtcccaaccctccacctaggatggtgtggtattaactacattgtcatgtaggacttttaggttatgtgacactatattaattaagagagagagtgaagagaggaagaaactgggtctcatgcaagacacagcttcaacaggagaacttatgtactagacactatcaaattttgcattgggagagaatagtgtcttcataatagatgaagaataaatatgattggtagagaagagagatgatgtatttattaatggcccactttaagaaaccatgggttgtaaaatgtagtttctattgtgatgtcttattgacatggtaccatagacactacttataaatattatgtgttgagactacccttaacatctagtatatgagtatgagtaatgctagaaagttttataatattaaacagagggagtattcaattaaacttgtacttttaaaagcgtacctgcagtatcaggctatcagcatccataaaagaagttactccactccagcagtaactactcgttaaaaccacttgatcaaaataagacactttctagtacaaatgacaaaatacggaggtcaggtcaccaccaaaaccccgtatcagatttccctgccaaccctgcctgtctgcggtacactgtttattacaccacgacaacccattcaactcctgtcccatcaaaaaggccaagaaacacatactccactacagtggactccaatgttcatctcccatatcgccttgctccttcaattcgtctgtcgatttccaggtcggattggatcatggattcctttggatccatttcatggataatttcaggcctcattgtttgtccctttcctccaaaaaaaatcaattatagttaaaatttaaataaaaaaatcaagttaattgtaagatatttataacgcagtttctttgtcagcattacgtgtgtttgagagaaaggaaaagaagaatattgataatatacgtaaaatgagatgagttattagtgtataattaattgagtattaaatattattttttttaaaaaataataatatgattcttaagcaacttttctatataacttttttttgcaaaaatacacagtttagcagtactttccttattattccctccgtcccagaatatagcaacctaggatcggatggaacatatcttagtacgacgaatctggatatgcccctgtcattcgtagtactagaatacgtcctattcggttccaattcggttccaggttgctatattttgggacgaagagagtactaataaaccattttggtttataatcagttctcgactaatcaatgaggctccttcagccgatcgatgaacagaaacacacagaaaaggttggctgtaaaacgcagcggatggcgcccaaaaggaagaacattacgatcacaaaaaggcagagaaacaacagtcgcgtgcgtaccgtatgccgggcgacacagtaccgcggttggtaccttgctagtagtgatcggcaacagagtttttgctgctacacagtgtccgaataatgaatattgtttgatgagggggatcgcttttgtcatttgatgagctacagggggagagctaaccgtatctgccagcaatggtgccagtgctatagactgtagttctggaaaaaaaattattttggccccggcatagttcggccaaaacagaggatggtatatattaaccatgcatggtgataagatcgagctttgtttggagggtaattttaccattcttcaaaaagtattaggaggtaccacactttcaagtataaaatttggtacctccagatatactaaataccttgagttacaaaaaatttagtgtaaagttgaggtacctcgagatactttttcaaggatcataaaatttcttttgtttggaacatgggaatttttatagaaatgggttcaattcgcgagtccgattatccttgccctacacaagattacactatatgctacgtagtgtagtacatggtcccatttgagatagctgaaattgatatattcatagataatcagattattttatagctatttgagggcataaataaagaaattaactactacaaagtattccataaaaaattatatagaaaattattacgcaaaacacactatttagaagtttgaaaaataaaagtttgaaaaataaagaaaatccagaattaaaaaaggaacatggccattgtgttgagtaattcatctaatactcttgtactacacacggtaagaatttactttacatcagctatatggtaggagcagtagaaatttacgatagaacaaactcggatgccgactcttcgatgaggagtcgcattcactgacatggtagggtatcatgccttttggatgggcttgtgttgtgtgggtgatgaacttgcgataggggccatgcactgttctagggtcaatgagcaaagatgcatgggtagtttggctatgggtttctaaatccaaattcagtagttggggtaatgatagtgatatataaggatgtgcacgtttttccttacaaatgcactgatttggatgtgttgtggtatagttctttttaaatattacgactttaaatcttattccaatgaatattacacaaatctagaagcgttgtcaataataatttagtaaggacatgattcatcttaactctatcttttttataaacttgccagcattgtccgttcaaaggtcatgtgagttggtatcggaatttcgctgcttttttttgaaaaacaatcctttttaatagaaaaaaaaaatcttaaaatcaagacaacatggaaaatatatttatcgtagtatcttcccatcagaacaatatcccagcaatttctctgaaacatgcataattccactaattgagaaccaaccagaccaaaagcaggagacgctaatttgtctctaaccaccatcattacccatcactaaacactcccccaaaacgtgtagagagaaccactgatgatgttgatgatgatgatgatgcatgagatgacttcgatttggtttggttaatttcttcatcagctggccggccggtagcacgagcggcctcggcgagagagagagaagataggggttgtgtttggacaacccaccgatccggtgctggatccaacggaaaccgggccattttttacaccgatcacgatgagatctggggggagtgcacgcacgcagatgagtgcatcataaatcaccgaaaaatctctctctgagatgggagtttggttgacctcgacattggcctgccttcctgtgagctggctcccgtgcaacatttggcctttttttttcttctttgttgcaattgatctagacttcggaccagcacacgggcatgtgttgtagattgtttcgccaacctacaggttgcacggattatgattatagatactataaatattaaaattttaatattatactatatgtttactaactttgaaatcatagcttcttatagtgaaagaagagctcatatcagttacaatttggtaaccgttaatcttaatttttagaactaagttaataaaaatcattaattgaaagtccgagatagatacgatttcgtatttattgattaaggattcgagagttatcaaattagagccatgtcattttcagttacgttatttgacactcaacacgatctacggccacgataatataatcatttagaacatatgaattttatatgattttttataaggttttagtgtctagtttctagctccgaagaaggtctaagatgtcttatcatccggactactccctccgttttaaaatgtttgacaccgttgactttttggtacatgtttagccattcgtcttattcaaaaaatttaagtaattatttattctttttatgtcatttgattcattgttaaatatactttcatgtacacatatagttttacatatttcacaattttttttaataagacaaacggtcaaacgtatgctaaaaagtcaacggtgtcaaacattttgaaacgaagggagtatatagtatgttgacattatttatcgctttgtgagactatatagaatgttgacattatctatcgctttatgatatagaggagtaagaatttagctctagcttctgacgaagaaagacaatgattttttttcttcattataaaataaatgtttgtctgaaaaacaattcaccaagaacaaccataacaccgcaaccaccaattcccgcaaaagcaaagatcagttttctgaatgaaccagaaagtcttgcggcagtaataaatccccacaactgtcacaaaattaaaggagaaaagcacacgcatagatcatcgtcaactacagtcgcgcgaaaccgggcgatgtgccccgtccaactccgacccgtccctgtccttgcaattagccctacgtggcttgcttaatttgcttcttgtcccaacagttgttgttggttggatccaaattcccggtaatctgtttctttcttgcgctagagatggcaccaaatgatactagtatttttgttttgttttgtttgtgagggcacaaaaatggtgattagtaggacattggtggtaaggggttttgatgaactttgggagacgattcggccggttttggtttcatcagatggtccagcttccatgagcaaaaatggactgttgcttgttgtttcggaggaggtttgatctgtaataattggagaaattcccttcttcagttgagagctgctgattccgatggcgtgttcttttttctgtcatggattactgtgggtatgttttctaagacgaactttaatactctctgttttaaattattataattttaattttattctaagtcaaatattttaccattaatttgcatacatatataatttaacctcttaagatttatggtttagatttacataccatatataattaacatgccgttaaaccgcataaatttatgcccaagaataaatacataaatttctaaaattattagtgaaagttagcaaaattttgatttagaacaaaccgtgaacgacaagtaattgagtaagtaacattccttttcagaatttctaggtttttaagtattttttaactttataatatatttaattatttcatttgtgccctagaataatcgacaaacactctatttcgtcccccaacgcatcattcataaaaactttataacattcttcatccgacacattaaaaaacaaatgcatactacaaattctaaaccatcctaggtttgtgggagtacctaactagaaacatcatttagattgcataagttcaaaacaaccacgcacgaaccaaatttcagtggagattatctagcagtctgttcgggtagcttctgtaaaaaaaaaaaaacaaaaagaaaatcaagcggacacaatataatgtgtttagttcatgcaaaaattgaaaatttgattgaaattgaaatgatgcgatgaaaatattgaaagtttgtgtgtagaaaagttttaatgtgataaaaaaattgaaagtttgaagaaagaaaaaagttaagaactaaaccaggcaatctgaattataaattcagaaacattctgtaaaaaaaaaaaaccacaaccaaaccactcggtctcatctcatcagtcgtcactgatccgcagactccgcgcccgtgcagcaccccgagcccgagccccaccgacaacagagtagaatccgacccacccactgacacgtggtccccacccaccccacctgtccccacccgtcatcatcactctcgccgcgctgtccgcttctcgcgccgccgcacccgatcccgacctgacgtgtgggcccgtctccactgcactaccagcagcagccgcagcagcgaagcgaagcgagcgacccctctctcctctaagccaagcaaaaacacaaggagaactcgccataattccaatccactgtgccctagctcgcccacctcttcctcccccgcgagagagagaggagagagaattcgatctcttctttctccctttttttctgttcggtttttgcggtgtgggagggggcgtggatttgatgtagattattagggactaccaccaccaccgtttctgttgcagttgcggaattggaggattgtgtgtttggtttcttgatctgaggaggaagaagacatgagaggtagtatcgtttgtgtttctttgtgatgatttcgattcagtttgcgttttgtgttttgtttttttgatttagttttggattggcaaggtttggtgggtgagcggtgatcgcatttgggggttggagatgaaggaggtgggggaggtggaggaggtgaggtgcttggacccgcagctatggcacgcgtgcgcgggcgggatggtgcagatgccggcgccgcgttcccgggtgtactacttcgcgcagggccacgccgagcacgccgacggcggaggcggggcggcggcggcggccgcggagctggggccgcgcgcgctcccgccgctcgtgctctgccgcgtcgaaggggtccagttcctggccgatcgggactccgacgaggtgtacgccaagatccgcctcgcgccggtcgcccccggggaggccgagttccgggagcccgacgagctctgcccgctcggcgccgccggcgacgcggcggagccgtcgccggagaagccgacctcgttcgccaagacgctcacgcagtccgacgccaacaacggcggcggcttctcggtgccccgctactgcgccgagaccatcttccccaagctggactacagggccgacccgccggtgcagacggtgctcgccaaggacgtccacggcgtggtctggaagttccgccacatctaccgcggcacgccgcgccggcatttgctcaccaccgggtggagcacgttcgtgaaccagaagaagctcgtcgcgggggactcgatcgtgttcctgcgcaccaggcacggggagctctgcgtcgggatacggcgggcgaagcggatggcgtgcggggggatggagtgcatgtcggggtggaacgcgccgggctatggcggcggcggcttctcggcgttcttaaaggaggaggagagtaagctgatgaagggccatggtggtggtgggtacatgaagggcaaggggaaggtgaggatggccgatgtcgtggaggccgctagcctcgcgtcgagcgggcagccgttcgaggtggcgtactacccgagggctagcaccccggattttgtcgtgaaggctgcgtcggtgcaggccgcaatgaggatccagtggtgctccgggatgaggttcaagatggcttttgagacagaggattcatcaaggattagctggtttatggggacaatatcttctgttcaggttgctgatcccaacagatggccgaattcgccgtggagacttcttcaggtttgcttgatccagtgttatttatagttgttacatttcacagaattggcgctggatgcatgccctgcattgtgttgactaatatctattgcttctcagtgttgctagaacttgctgttcatatattatcagttatgtttgaaattagctagagtggcaaactgctgttgaatgtcaatctcatcaattagtgatggtggaacctgagtgggttactagcctgatgttcacggttttcagtgaatgtgttcttgtcttcttggtcttaaactgaggtttctctactcaagttatcaacatattgattaggaatttgtacaatggtgggttcgggttccaggttcctactttatttaatgaaatcatgcaatgagtaaagccggtgggaatcccagggtattaggacttaggaggatgcaataggtaggaacagcagagtgttcttttctgataggtagtaacaaactcgttatgaaggaaaagggtttttggtccttgggagcttgcttggtgcttaaaagttggattgtctctttgctagttctacaagtggctgtattcttttttgacactcggcagttaacccttttaattccgagtgcagcatttaaattctcccatgcaactgccaaattgatatcagatgccacacctttgcatccgaccttcacctcagtccaaatgaagaattgaaaaggcatgatatattagctggacacaataaacaacagaaattgggctgttgggcccagttaaacgagcaacggtatgtttagttgcattaacctaggatgtattaaacaaatttctaagcatataatgaactgcatatttttagaaagtaattattttacctacatgaaactacactgtttgatagacccattctgaatcctgttcccttcaaattgatagtatacgctgcatcagtctcttccagtggtcaataattgagatcagggtcttcattgtcagaagtttcatttgcaatcaatcatgtatcacagggcccatatatcatctttcatgcttgacataatcatttaagagcatccattagccacacaattgaaatgtgctaaaaaatgtccttagctttgcatctttcaaaaatttcacgaggaaaaattttatcacccgacacatcgaaccactgaatgttgtatccgccatatgctcagcctacatcccaccttgtatccacgtcattgtgcccttttgctctcagccgtattgcgcccactaaacatattgtatctgctaggactgagagaggcagacccatgtaaatttgtgtatattggggggttgtagggggcaaagaaaaacctgccagaaattaattatttatggtgttttactatttttctgcccattcgcttttcattggcaaactttctcaccccagccctgcccaagagccacttgttctggcatcatggttatccgtcgccaacaccactcatctacctctgacacgaagttatagtttgaaagcgagattaaccttaaacaatatgtgtttcctgccaagtgccaaatactgcatacactttttaaaacaaatgcaataaattgggtggtaacatcatatttaatatgctattagaaggaaagctattagttgttaccggtactagtataattgtatgctagtagcagtagaacttcaagtgagggagtgagctatattgctgtccacatgtctcaataagtatctccttcactgccataaatttgtctttttcaccagtttcccctcatatgatagctggctgatattgttaatcagcacataccagacatcaacttttgaagaggagattaaaactaatggtgctggcctagctgaatatgctagttctattggcagatgtgccatatgattattagctccttcctttcctgtcaatatacattggatgtcagcttggcatgtacaataaggcaatgaagggatacatgggggatgctttgctagtattattattaagtgagatgttggaaattcatgctgcttacgcagtcatagcagatctagatagagttggcttgtgaaagtgaaacatcaacggtagttgccagttttgcctattttagttgtgctgacctcagtgtgcttttcttcattgctgcactatatccttttctaattctcatggttgcaatttgcaaaattcttacaggtgacatgggatgaaccggacctgttgcagaatgtgaaatgtgtcagcccatggcttgtggagcttgtgtcaagtattccaccaatccatttaggaccattttcgtcacctcgaaagaagttgcgggttcccccacatcctgacttcccatttgagggtcatcttctgaacccaattttccatgggaacccacttggtcctagcaacagcccactatgctgttacccggacaccgctcctgcaggcatacagggagccaggcatgctcaatttggtttaccactaacagaccaccagcttaacaagctgcaccttggtctgttacatagcggcagttttaacagacttgatgctattactccaccttcccggatatcaaagggctttgtggtcagtagtgcaccagcccatgacaatatctcttgtttgttgtcaatcagtacaccacaggtcgcagagaaatctgatgacagaaagacgacaccccatataatgctgtttggaaaggctatatttactgagcagcagataacttcaagcggatcaacagagacactctcccctggagttactggaaatagctcacctaatggcaatgcgcacaagacaggaaatgcatctgatggttctggttcatcaatttgcattggtttctcatctcaaggtcacgaggcttctgaccttggtttagaagctggtcactgcaaggtatttatggaatcggaggacgttggtcgcaccattgatttgtctgtctttgggtcatacgaagaactgtatggtcggctggctgacatgttcggaatcgagaaagaagaaatcataaaccatcttcatttccgtgacgcagctggtgtagtcaagcatccgggtgaggtaccattcaggtgaggacctcattatcatatcgttagtttttttttcccttacaatcctctaacaagtttattgcgattgcgatgagatatatctaatccattctatttacgttatagtgacttcatgaaagcggcacggaggcttacaataatagccggcgacagggagagaattgagagacctctcatcgaatgcttagttgagcaggcgtgatagttcaataaactcccgtttgaatttaattctgaaatatgaatcgtagcgtgaaaagacttcctttgttacatgtacttgcgttgggctgttaactaagcagacctgctttgtattgtcagtgttgtggattgctcaagttaaggtgtgtgtgtttttatcttgcctcggttagctgtcagtttctttgttgcaatcagtggtcatgttcttctgttcaagttcgtaaaccaaacacttggatgaatcttagtcaaaataaaagttccttgggaaatcctacaatttcacagctcactgttactacttgctagtgccaaatgcatcctgaatctgtcagaaaagcatcagggcctgacgcaatttttctacttgtccaattggtcttttatagtagttgcaatttgcaagtcgggaaaccacagcctagagttggaacttggaagtggttttgcttacgatttcgggcttcattttctgagatgagtgaatgagaacgagcccttgcgtgttgatctgggaagggagaaggcaaaaacaaactatccagtgtcttttggtcaaaagagagaacagaagtagcagtacgtagtagtaaatttgtggcataagcgtgtgaaaaaaaaaaagaaagatgcgatcactcgcacacgtgcgcaagttaccaagaacggtcggtatgtacgacgtgtagctatcatcaattaattaatcatcgtcatgtggttgtgcatttcgtcgaaagagaccggcagagtagtttagggtttgtttaggttgcgtttagatccaaagtttggatccaaacttcagtcctttttcatcacatcaacatgtcatacacacacaacttttcagtcacatcatctctaatttcaaccaaaatacaaactttgcgctaaactaaacacagccttagttggtgaaataaaaatttttaggtgtcacattggacgtttgactggatgtcggaagggattttcggatacgaatgaaaaaactaatttcataactcgcttggaaactgcgagacgaatgttttgagcctaattaatccattattaacatatgtgggttactatagcacttatagctaatcatggactaattaggcttaaaagattcatctcgtgatttacatgtaaactgtgcaattagttttttttatctatatttaatgctctatacatatgtataaatattcaatttgatgtttttgggaactaaacatgctcttactagataaagcaccatcgtgaaataatccaaacgacatatttgcaaacgaaaaataatttctgaacaaacattttaatgcgtgtttctagcgatataaagtaaaggctgaaaaataaacttgggtgaagaaaacactaaaatcagcttcaaatttaagattgaaaattcaagttttgactgataagtatgagtataagtgaaaagatgaagctgaggtgtacactgctgccaaaagttgtaggataacgtgtactcatatcaggtacaaaatgaagccggggtgtacactttgcacaataacatcttaaatagaacttcagttatagaaatacaatattacagcttcataagagaaaaaaaaagacaataggccaataatccaaatactaaaacataatttgaggtgatccggcaacgttagaaatattgacgacgtgactttataaaagaaaagagataatagatcagatctaaatgtcataattaagatgatatacacatataaagtttatgagagaagatggatagtttgcaccatagatacttcctctattttcttcatttgaaaatataaggcacacccaccattaatctaaagataattattatcacattctagtatgtatcatccaaaaaatataatacatactagtatggtagatgattattgctagttcactataagatctacaaaagttacaccgatactatgatacggatgcacgatacgccattgctggttaaaaataatataaagatgaagaaacaaaaggttaagattttaaatatagaggagacggcaattcaatttaatttaatcaataggacgatcacacaatccatccgtctaaaagtataaaaatataaagtgcattaatttttgcacaataatactttgatcattggtttgtttcattatatagcatcaacaactacagaattaatattacatcatatagcaaatatgaatttatcggtattacttggatcatgtaacactaaacaaatatattgatgccttagttattaatcaaaagttgcacatattttttttgggggaaaagttgtacatattaattaatataactgaatacacgcatgtcgttttatattttgaacatgggataactttgatttaggcttgatatccaaactagaagtgtcggcgaagtattaattaagagaagtatccagaattaatttattattttgaaaaactgaaaatcacctatatgtgaatagtacatatatagaaaggttgattagtcctgcagggataggtgtaatttataaaaatatagacataatgtccatactaaagtgtatgatgtagaaggatatcagttaaatattttattctatttccatattatgttagttggatagaagtataatagtttgataattgtgggcaatgagatggaatttgtattccataaattcttaaagtataagtcctgaacactatgaaatagaagaatgaaagtaaatagtttattaataatatattatctgacaagaagcataatagtttgatagttgttgctaggaggtagaacctgtccaaaagcaccacctaattatataatagattgaacataagatttgtgttcagtagattaaatgctttaagatttatttcaaaattatgctggtgattaaatgttttaagaagtctaagagcacatattgatggtcctaaagttttacataattatgtgttctgtgttgtagctgttatacttttactattccttatacaaatttataatacaattactataaaagatctataacttgtccataaaggaatttggcatgcatgtaaacgtgacacttaccttagtaaaagttagtaaaaggacagatgcatggtattcatgatttatactaaccaaaagtattagtgatagaaagtggcaccatttgaactgcagaggaaccatgaacatattatattcaaaccatcttattattttgagattataaaaggtttgacacattataatgttgttaagtttaaaaattaagaaggttattgtacctcagttgatagttctaggtttttttagccctccgatcagatagttggtagttctagttttttttttagccctccgattagatgtgagagttgtgtaaaccgaagagttttttttattgacaaagttgtgcaacatagaaatcatataataatttaatgataaaatgtaagtagatataatttggatcgtcttcttatttctacatgagagaatctcaatagttttttatcccctgcgttttttctgctaccttccggatggttctttttttaaaaaatatttgtttgactaagctaatttgactagcactgttaaccttttttcatctggaactatcctgatagctaattggtgtattatcctaatgatctaacggtccacctttcttcccactattatcctagggctattgttattcaggtgacgtggctcatccttgttggagagaggttgttgctttcacatatgtagatacataataaaattagagatcttgaggacaaatgatttaataataagttaattatatgcatgcacgttttatattatgaaacatctaaaaaaataattgtgttttatattacggaatgaagggagtaaatgatttaaatgttaaaaacaattgaggtgattggactttatgagagatgatcagagaattaatattgactacatttattgagaacaactttatgagtgtaggattatgcccgttaataagctttatctcacttatagcagctttaaataatatatgtaatatgctggtgtactagcatcggcaggtttaagagatcacgtatccggatcaaccatgagctttggatacactcgacatgtccgggagcgctagagagcaaggaaaatacatgtcaagacatatagattcaggcctctcgaaggattcttggacactgtcagcaaagtttatacaaggtttatagagctctcaagctagctaacaagcatgtagttcttactgattctaccatccaattctttctataaagcgtggctgccccctcctccgcccaggaacaaagggcactatacataatcataagcttgaattcctttttactccatgctggttttattgtgtagagcaaaacatcacatgggactctatctcattgcatcaatgcggtgagaccacataagtttaatagtgcagccaactactgactccaaatcatctatagctaatctaatagttcattcgtacaacagttaactataaaaatatactataccattaatacttgatcccacctcttaaacacacgtaacgtcttggagtccgtgttgcagctggctactccctccatctatttttgatagtcatatttcatcttggcacaatgaccaagtataagtaattctacttatcatccatttaaacatgttactagttattcctcgtaaacaagcgattcattaatatttacatttctcaatgtccatgtagtcaatcttgtgtggaagaatggagagtcacgcattaaatctgagaaagtcattaagaagatagatggttggattgaaatatgcctatcaaaagtaattttttttaaatttggaaatatacctatcaaaagtagatgtagggagtataaatttgtaccccgcttttttctctctcttctcttttcttctcaatatgtggttatagctggcttatagcctgctattgtacctactctaatggaatctggagttaatgtgatgtatagactctgcagccggctcatcagtccttagggtgatgcagaatccaagcagatacgcctccattacagcaagtttaatagtatagccaaatgttagctccaagtcatctatagctaatctaatagcccattcatacaacagttacctataaaaatatactacaccattaatacctggttccacctctcatacacacaaaatatcttagattttgtattgcaggtggttataaatctgtagcccgctttcttctttctcttcccttttcttctcgatgcatggttatagctagcttatagcctgctattatacttcctctcagtcctcgatacgtgagaacaccacctatcccttcttgagtcggtgaggggttctctcatgtgacattctgattgtgagatccgatccatcaccggctgtattcacacagcctcaagcaacacatacatataaacaacaaagaaactttatattcaagtacaagttcgcaccaaacttaattcatattaacacacaacaatatcgcatacttacagaaactatctagaagttataaaaataaagtaatttagaaaatccacaaaaactgtttgaaaccgactcacacttggagcttattagtctgaccgccgagctatccggttagaccacaccaacacctttgatctgaatgacagcatctgctcggtctcataagcctaacaaaaccgataacactattcaccacctgtgtaggatcgaatcacaagaactaagccaatcagaggggggtgaatggttggtatacccaaaaaccgaaaacttttagcggaaataaaagttaccctcgaaatcgacggaagtcggtctgaccgagattgatctgccggtctgaccgagtggatgccgccggtctgaccggtgttgaatctccggtctgatcgccgaagtcgcctgccgcacctgtcgccgccgccggtctgaccgcctcgctcccgccggtctgaccgccgcaatgccgccggtctgaccaccggtgagttgccggttagaccgctgaaacccggtgaaacacaaataaaagaattcttaaagtggatgtcgactttattacttctctctatgtttacaaagtgcaacaacagcactccttacaaaaatttcgactaaactctaaaccctaaaccaaaactcaactctattgctctctaaagcgatacagaagcctcacgctccctttctatttataccacaaaaacccctactcaaagtaggtgtagaactcctatacacaataggactccatccttcagtttccatacgttttacaatttccaaacgtgcagcaaacaaccggccgcaccagaaatccaaaacggattcgctcccaagctgacgtccacgcgtgaccgtctccgactcgctgccagctgggcccttgcttctcctgggccgacttggcatgccgccaacagccaccgaaacccaccgagccgctctcctgctgctcggccaaccagtcatgcacacatacatgcttcaccatgcatgtatcgatcacacatacatgtacagcaccgtacatgcatgcatacctgcacgctacagtacctcgtgtactgtagcaccatatactactccaactttacaattcccttcgcgaacaccggcacttgcacgcacacctcgtgaagcccgttgcaaagatctctcccacacgatttccatccaccgtatgccatcttgtatccaactttgttacccggtatccttgaccgtctggacctcaactcctccctgagtctagtcccgattcccaccgttgaccgaagttgacctccaagaatccagactctagtcaccttctcacatggtatcccgaccgcaatagacctctgcttctccctgagcatagtcccggtcctcaccattgatcaaggctgacctcaagtcacctgcacacaattagacaaaacaaccgtttctgagcacagatatcacaacctgacccacattagtcacacgcactcacaccaacattcacacaaactctcaaaccaattatttgattaaatcatttgtatagccaattgttcatcacaaatattaatcatgacaatgatttcacaacctggaaacaccttgatttcacatctggacccaaaacaacttgaatcatgtgtcgaagagctaaagatgcataaccattttctcaaaaaaaaaacaagaaaaacgtatagccataatcttttacggcaaaattttgcaattcttttcgttttgatccctagcggatcctttgaattaacaaaagtgtatgtatgcgccatggtacagattagtactggcgctgcacgtgttgcatgacgcgatcgagagaggaggcagccagcaagcctccctcagatcattattaatccatggactcctccatgaccaaaaattggcccgcactcgtacgtatcgttcttactgcggtacattcgtgacacaacccacggaggctagctgcagctggctgctggcatatcatagtaactctctccgtcccagaatataaacaattttagctataaatctagataattatgtgtccagatttatagctaagggcccctttgaatcaaaggatttatgtaggaatttcataggattcaaatcctataaaaaattttcctttttggccctttgattcaaaggattgaagctttctaaattctataaaatttctatggaatgacacattgcatatggattttggaggaaatttagcaagagctccaacctcttggaaaaattcctttgagtcattctctctcgttcgattcctgcggttttcctgcgctccaatgaaacgactttttctgtgtttttcatgtgttttgcaatcctctgttttaccctttaatttactgtcagaatcctgtgtttttcctattcctccgtttttggccctaaaatttgttacattttgggagggacgctagtacgcatctacagatatatccaccacgcgacaaccggccggcgcatgcatgcacaccccaccccaaccccaacccggttggcttcctgcctacctgcaggcgtacgtacagacacagaccagctggggtcaaggtagtacgatacatatgcacaagtacgcgtacagtcgcgcacacgcgctcgtgcacgcacacgtacgtgccgccacgatggtaccgtgcctgcctctgccggcggccgttttcgccgggcatcatcatgcgcatcttggaaaccccggccggctgcctctgccgatgacgcctctgcagtgaaggatgcaagcgtacgtacaagtctcatggcggagctagctagcgtcgtcgtcttcccgtttatgtttatacttatcaaccaaaatttaaattttcaacattatatttagagttgattttgaggttcttgtcatcaaaatttattttttaatatttttttaataaaaaatacatatataaaagttttatttataccgtacgaataaacgaaacaatggctcctgtcgccgtcaagacaatagcagtagctgcccgacctgctcgggacgtagctccgtcgctagctagccagctcgattatcaggccaataattaacgaggcaacgaacaggcccaatgaggaaggaggccagacaaggcgaggctagtacctttgaacggagttggatggaagggagaaattttggcgagtagtgaatttgccgtcatcctaccataaactaagagtctgtttgaaggagctttagattctgagaagcaactgtttggtaaccagcttctgaaaatctggaaaagctctgaaacccagcttctctagcttctgccttcttagttcatttttcagaatatgtaactacagattctcaaaagctgtggactgtttggggcagcttctagcagaagcagcttttgggaaaagttgcagctgggacaagcttccccaaacaggacctaagattgcttgctcctttgcatgtgaagatgggaagcaagaaaacaaagagaaattcttggtcgggcatagccttcgatacgagttaaagggaagaggatttttgtaaatatgaaacaaatattgcgcggattaggaatgcaagtgggtaaacccaaatccgcttatagacaaaattaatagataacccacgggttacctactaatttgatctataaataggtttatgaatcgatccacttgcatctctaggtgcagcaaaccagaccacgatgcggaaacccgtgggttaccacttatttgacagataagtaggttcgcgggtcgatccacttgcatccctagtgtggactaaagggtccacctgttgtctgaatatacccatttctaaattccattgcaacacccaggcaattttaccagtaggagtaaaaacaagaagtttttaaaaaaattcaatgtgttccatgagaatccacaggccaggcattgcgcggaggggggggggcatccaatttttttctcaaggtcaaatgatgcacaacaacacgcgctacctgccgatccacacggaccagcggagccccgcattgtacgaatctttctgctgcgaaatgcgaatcactgccagtataggcctccggcccaaccgaatgatgccctctttgaatatacatggtaccctacaccttctctcagtctctggcccttctgagacacggcccaactacagcaatgtaatggatgaattcgtcgtcttctcttttgtttcggtttttttatatatattttagtatattgatcttggtacccaaaggaggcagaattattgtgaattcagttccatttctgaattgcatgatggcaattgtagtacaagaatcttgtgtgtgccagcctctgtgctgtgggagagatccatgaattgtcatttcaaatctatcaccatgagaagtatagtcatttcaaatctactatcaccatgagaccatgagagaatagatgtatggaagtacagtatactatttcctccgttttaaaatgtagttatttctagcacaatgtcttgtcctaaaaatgaaactattcctcatctcaaccaatctcacaaccattcttcttcacttactttctcttttcaaccaatcatacacttcctctaatcattctcatctacttttttaatacccgtgccaatcttaaaaatgtctatattttgggatgaaggaagtattgagaattacgagtactctcgattgtcaaatagttaaaaggcgtcggtctatacagctaatggagatacaagttggtttttttttgggacacagggtgtatggattattcgtgcctcggttataaaataccatttcttcaaaaaaaaaatctgtgacagcattttatttatctgtattaggaatttatctgtccacaatctattcaatcgtgcagttaagatggacctaagctagacaagttttgtacgtatagtctactgcagtttcggattggagtgaccattgagagacagcaatcgacctaaccttcagaactgaaacctctcaccagacaagacctctgcagggagctgagttagccaactgcagtatacagcacctggctggagagacacctgaactgcttacgagttgaacactcttttgtttgattgattaattgtggtctaacgacgagtagccaatgacactgacatgatcatcgacattttggattgagattggcaggtaagcttcatctcaacgtacgatcatgacctgctgaccataccttttatttgggatagctttaaattttgagaaacggttgatgagaatatggtcgagctaagaaaaccagtttttaacttttagttcattttatagattctataacaaacttttcttaaaatctagtagatgaaaaactaaacaatttagtctctagtttccctgtgcaagtacatgattggtcatttcataagattcaaaaagaaaaagaatacagttctcagttttcccaagattcagaaagaaattaaatgtccaagttttcttcgtggctgaaatctgatagtcactgcaattaaaatggattactgcagtggactagtggtaacttggagtgctgtacgttagtcactgaagaaatcagatagagctagccagacagcagtagtgcaagaatggctgacgaaaggggcagtacatgtttcatcggtttgttggggggaatttttaccggcgagagaaatgccaagtgactgacggacgcaaacgccatgatggcgccttggccttaagctcacagttcgttacgcgtcgtcttcaccgatttttcagcgacatgtttcctccctgcatcgctggaacaacgcagacacatttgctaccccccctgtttacaatgtccactgctacataccccttccgtcccaaaaaagtttagctatgaatctggacacacatgtgttcaggttcgtagctaaaaggagatgaaatgaaatggaattgaagcacttctcgagctcgtaaacggtgttatttttgcaaagactccacatatgaatttctcataatattgttctaaatgcaccttttaactttatactaatagttaatttattcttgtttgtaccctcgaataattatcacaaattactcatctattcagcattctgtttcattcaaaagactatattttgccaaaaaaaatataaaatatatgtatggacaaacattagaaatatcatcactagattttaaaatattggaatttaatatggtaaggcgatactaatatagacctatcatataaaaaacacttctgtaaaactatacttttgataacacataaatatatagctagaaagagtagtgaaaaaatctagctatacatcaaacagtgtccatgtctaaaacggagacattaatattttcttcttatacaactgaaagacatgcatgcgtagtctcttttgccggctacctcgtaagtgaaattctctactcttatctcctctaagttgtcggcgtattattaatttatgtatccctgcctgctttgtactagctacaactatctgtaggagcattacaaatttacactagcgatctctttctagtcttgattagtatactaaaactacacaaattaaggaagtcatcgtcaggtagacctgcttaattaccatatctttgaagtacggacatgtactaataaacagtttgtgtagttggacagtacatgttgcaccgtacaatgctaataatatactcccttcatactcataaaggaagtcgtttagtacagcgacacggtctccaaaacacaactttgacttcttgtttctataaaaatatttattgaaaagtgatatatgtatacttttataaaagtattttttaagacaaatctatttatataatttttacatttttaaacttaacaacctgagagttattcatgatttatattcccaaggtttgacctaaacattgttctaaacgactttctttacgagtacggagggagtactaaagaactgtagatcaagtgtagtgtactgtatgtatgtctttcgcatgcttgcagggaaggagatagagtaattagattgatagatatatggccggccatacaaaagtggtccatatgttaagcatgcgagctagcaatttgtcgaccattcttgccttcaaagtctcttccacatgcacacacaaacttgattttagctagctagccaatgttccatgtggatgatcaagattggacatggatggatgggacttggcaatgttttgacatggagctagggattagttgtgcctagccaattgagcaaagtgtctcaattatctataagcatcataaaacatcatctagtactatgtgagaatggagctagggattagtagtagatggagaagacaaaaactcaaagtgaggatgtgaggagaggacagagcagcagctagcttagccaaatagccagccagtcagggtgccctttgcaatcaaagacaaaaggaaggaggcccctctagctagctgatcatctgtgtaaccaaaagggagattgagatgtgtgctacacctagcagatgatgcaataagttttaatcagattcatgcatgaaatgcatctttcacacacactcatggcttagctagagacaacatgcatgaatgaatggaatggtcacaccctatggtggggtatatatgtaaatttggtgatgtttcaggagtacacacatggcagaccgacaaaatcaaacctaatctcctcgaaacaaattaatcaaaattaattagaaaaaatcagcgcacacttttcctaattaattaaagaagagacaacaatgtgtaatttacaaaactaattaaattgcatgctgccactgtagaataaataaaatatcatgtggcctgtccagctcggatggttagggtttttttttctttacgtgtaacctactcatgtggtttaaatcctaaactatacaacgtattcgtcggcaataagatataaaggtatatatgtcgattggtctcctctatcaaagatattcatagggtaggatgtacacgtatatatatttttatagatgagtatgcgtgtgtatacgtaagagcgtactccctccgtctaaaaaaacaagtttaattttaactacgaatctggacacatatatatccagatttatagctataattggacttttttttatgacagagggagtacatgtttgtaccctgttttaaaaaataataaaatataatgtgaggatatgaaaaatgaaaaaaaacgattggatggattcatggaatgcgtcacagtcgtaggcagggacagcgtgcatatgcattggccacaaccgtagcggtccaaaataccaattggcacacacacatgaattgaatggcccatgcctgccttaattaaagggtatggatggcgaaggtgatcaatgtgtccaaacatatatgcatacatactcctgcacgccccctatacccgccaagatctcggtatgtccgataaatttgtcggattttgcatacattgtattgtaccacacccccatccatcttttttttgtccccttgccctaattgatcgctgcacggcagcgtttgtattgcagaccccaaatgtatccaaacgtacgcccatctatcctacgtattcgcttcgtcctaaaataaacttttatatacacgaatctatgtatatatatctgcctttaattcacatgttatatttgtaagtggacagtgtacgtttacgttagatgcagagatcgtccacaggcaaggcgctatagggtggccctaatatatgagcagtagtatgtgtgtatatcacacgcaacgcgaaaacgcatgggcgtccctacgctgaggtacggagagattggaacagcccaacgtacaagctagctaggggaggaggaagaagatgaagagaaacaaatgcttggtcgaccaagctagtgataggtgaaaaggaccagcgttgtgcaggcttggcaaagagagaggatcgaggaccacttgatcgatcgatcgatcgtgccggtgccataatttgtgaacctagctagccaaaaaataagcggcgaaaaggcctatcattgtgtttagtaaaattaatagattcgaaactgttgaattaatgtgttctaaggttcacatatatgaagattaatattttttgaataatcgcaaaaatccacctcatgaacatgcatgcatgtgaatctttagtaccaccttgcatgttcttaaaaaaaaagtaagatctccttaaataggagagtgcttttatagttacttaagatatgtgtggtgaagagtactagaggaactcgcgcactcacttgctttgcttggctcgggttgggaagcgcacgtacgcgacatgctcgtgaatagtccaccaaaaatgggctcctcatgcttgcgtagacgcgacttccttttgtagttttgtttaatgcataattcggcgtggagtccaaataagtaagtgcacgcgacttattcggtggccgcctcctcgcaacacacacgaaatcaatttagggtttatctcttcctttgtactgcgtcgccgctcatagtctactccatcttgctcaccggcgtgcacctgcgaacggtagagcaagtcttcgggaccttcgccttcgacgtactgcatcaggagaagatgataataaagtttttggaaagcgtgttgcgtgactacttgctattcctctaccacggctcatctttcccttctttcaagtgttgtgcgccgtcgtcaacgcccggtaacgcgagttcttactgctatgcagttaaacgtccagaaccctcgatacatattcaccatatttcacatattcgatctgatcatgttttactgtctagtttacatgtgtagatcttatgatacgattatgctagttttaagctagtttacatgtgtaatgatatgatttatttattaaatatattaaattaatatgtgtttatatattcaacaggaaaagtatatttgaaaccttatagacggttaattctcataccaaattgtgtctattggtcaagaaaaaaaaacagttatgggttggtcagcaggcggctttaccaaacgagattatcataacccaccgaaatcgtaagcaacagtgctctgtacagaagtctgtcctcttctctttttttttgggaagaaaattaaggctaacacaaattaacatcacaattaattggtgtgaagaaaataggttttggaggccttaattaatagatgcggcgattaccttgttttacaaaaagcttagctggtactgtacccagcttgcacatcacatcttttttgaaggacagtacgtgattacaatgtgatatatggccacatccatgcttaattaggagcctgaaactgaaagcaaacaccactggcaaccattgattactgttcatgcatgtcattcatgggcctaccaactgagtaacaaaaggaggtttattatatttttttttcttattgttgatggaaaagacacaaagaagctgcctttgaaaatatgctgagatttgagaggcaacagggtccctgtagaggattgataattcaaagatggatgagcaaaacctaaattattttccaaaggtgacatgaagggccctacaatgttgtatgatttgcaccccctttctttcagttccaatctcctttatttgcttctactaccatgcattcttttcctttttcttttctttcaagaactttgagttggacaggctagctttggtcgagctggtcgaaacattgtatcaaatgcttgagacagacatatatattgacaggtttgctgatctgaccacctgacataaaaagatataataggggtatatcacactctgcaggataaccatcccctgttttttttttctttccacaaaccaaagaaagcatctcctgttaattagcaccataattttgttcatgtcaacatctgtatataatcatagtatcataccatacttttaaactgacaattataaagtcggaacactactgaagaatttcagatatgctgtcaccatcaaggagtccttaaattaatatttgctccaaagcttggcggctgactcgattagtactatgcatgaatgtaatctaatccatgttacattttttttcccttttggaaaagctaacccttgtcccatcccccttgttgatacattccaattgcatctcaaagcagagggagatcatcgagaaaaaagaagaacactactactgctggtgaaaaactaaagggaaaaggagttcgaaattaaagctaaacccagcagcaggaagaacacatgcatgatcctattgggatcaacaacgacgaccataccgaattttttacatcagcctcggaagacaagaccataccgaggcaaattgcctgagaataccattttggggctaataatgctttgcctcggaatactacctctagtatgcaaatacttggtactgtgtggaactattcatttatgtgcattgagcctttgaccactcatctttttaaagaaaacaatacaaatacttaaaaaaacaatatgattaaagtttgttgcatgcagagtataaccatgaaacctttgcgaagggagcgtgactcgactaattaagtttcctgtggtagaacaagtccatctagatttaagtcgtagacttgacataggtgctcgtgttttcggctaattatttttatgataggtgatgtacccgtcgacaataaagtacttgtggtcacttcattaatttaaagatatgtcggtccaacctttcgaaggtactcgtaagagtagggtgtgcatgtgtgtattcatagcgtgagtgtactcgtgttgtgagcgcgtgtgtttgtaccgtgtttctaaaaacataaccatcgaaccttcatccactattactaaccattttaaaattactttgtggtcaaagttagaactgtgaaattcaaaattgccaagtaaacacaaactgaaggagcttatgaatcttgaggctagtccttagatcaagaagctgcctcggacaggctgcctagctgaaggtcagtggtggtgcagttgatggcgcgaaagcgagataacatggagagggaaaggggaatgttttcttctgcttgctgcatggtccaagcttaattaggcactgtttggttctgacgcacatggaacgtttgaacatctgtataaagtgttaactatatgctaaaaaataactaattacatagattataactaatttgctagatgaatcttttaaacctaaatactccatgatttgacaatatggtgctacattaaacatttgctaatgaatgattagtgaggtttaataatttcatctcgctatttactgatggattctgtaattaattttttattactgtctgaacaccttatatgatactctatataatatccgatgtgacacgctaaaactttacaccctgcatctaaaacaccccctagctaagggtggaagaagatggagatgagactgtgatcaagctagctagagagtggcctctcctacacctagcattcatccaaaatgcaatgcaactgggacgaccgaccgacgatcgatcgagctagctgctaaccacccggtcgctttcggcttaattttgccggccggtcagccgcggccccggcctgcgcatatatcgatcagtcgatctactcgatggatgcgtgtgtcctttctgcatctgtgtgcgcccagctgggttcatatatgctcctttcttttatttaaatattatctctgtgcgccgttgagtttttataaatatttgaccattcatgatatttaaatttccttttgtaaatataaaaatattaaaatcaagtttaaagaatatttaatgataatcaagtcacaataaaataaattataaatgaacatttttttaaaaataagatgaatggttaaatgtatctaaaaacgttaacggtgtcatatattaaaaaccgggcgtggagcatatgttattttataaaaataaagtaataaatataagtggaaggaaaaagtaattattagaaagttatcaattaaannattttntnaagcnccnnnnnggggggggggggggggttgccgtcggtgtcgtgaaacgcatgtggtgcggtgtatttggatatctgctctcaatggtgacggaacctatggtcggtagctaggtcctcaactcgtccatgactagaggtgtgtactatatgactggccactcataattatctgagagtacatttgtcatttgtctcaagctaagagtgtacatgtctgactctcgtagggactgttcatattatagtcaaaataaatcttaccaatactaaaattttagcaatttagcgatattgccaagtttttacatgattcttatatatttattaaaatttggtaaaaaaaaacctaaatggatgcatattttttataactttatcaaaaattggtaaagtttaaaatggcaccaatctgaacaaccccataatttttactagtgtatggtaaaaatggaaagaacccttcattaaggaccattaaacctgaaaaaatagtttgtaaaacctactatcgcgcttagaatagagagggaaactattgcgctgcggattgtctacaaatacattatatatatttaaaaataaactcaataaatgattagaatatatggtttaagcaatatagcaaaaggaaaaaaatacgtgtattaaagaatactcctttcgtccttaaaaaaacatagccaataagtcgatatttttttaagtatggtaggtgtagtttaggatgaataattaatcggttatatactgctcactctatctcagaataattcattttcatccattttacacatagcaatacaaaactaaaaaacgatgatatcttcactttaccaagtctcaatgtgattattcctactttatttactcttgatacatttatagcctgctttttacaaatttcgatgtaatgattatttagaaataaatttatatttgaacaaataagagtggctaaaaataaaacttattatgaaagtagtatatcgtactcctccgtccaaaaaaaatccaatcctagctacgaacctgaacatactcccttagtactcgtaaaggaagtcgtttttgacagtgacatggtatccaaaacacaactttgacttctagtttctataaaaaatatttattgaaaagttatatatgtatacttttatgaaagtattttttcaagacaaatctatttatataatttttacatttttaaactcaacaacttgagagttattcatgatttatatttccaaggtttgacttaaacattgccctaaacaacttgttttacaagtacggagggagtatgtgtgtccagatttcgtagttaggatttgtttttttacgtagtggtttgttataaagagagattaattaaagcgtacgtaaacgaagaaagaaaggtggcgtccgtacggggggcggctggtgagattaacaaagtggatcggccccacgctcgtgcggaaaaccgttagttaacttgccacttaatcaatcctgcaccatgtttaaaaagactgacagtagcgggcagctgcagacgcccttagctaagctttgccgtctctccttttctcgcgtgcctacatgcaggcataagatactgctgctgtctgtgtaccctctcctcccccaagctaccttgtctttcgcccatcaccaccccacagcccagccacccaattaacctgcaggactgtactctgtgcatcatatatgttttggagtagcttcctctccctgcatgcagccattgcaactttgcaagccatgccaattcttggatcatatcatactccttccaaaaaaaataacgaatccggagggagtattatctaagctatatcctggtgcttggacaatatggctcggtttagagcatgtttatcggggctctaacccttaaatctaactttaagagtagagtctgaagtatggtcgaagctagagcagtccgaactctactacttcaccgttcattttttctagatcacatcaatccactcaattttttacttggaactatctagttgagctgcagcctcataagggatggagctgaagcctcgtccaataagcctttagaaatttgttttttagctgcttccaaattacttagcggcatagctaataatttatagcttaattttctaaatgatagatgtttgctaacaattcgttagctcctaaaaaaatatgtccatagatacgtgccaatctctgaataatagattgatattgatgtggtctgtaattaactataactaatatatccacacattcaacttagctttcggacgttgcccactgtttgtcaagtgattggccctgcatacacatggccttgtttagctaggtatgagtaacgagaaatggaggccacacccagcagcatgcaccgacatgcatgcagagagaaaagggaagatccattgatcagcaagcaaaggatgcaattgcagctagctggggcatgcagccatggggtacgtgcaaagcgagaaacaggaagcccttatactagcttagcttagggcacattctaagcagcttatggtcgaatggatatctctctctagcttaaaaaaaaaaccttttacatgagcatttacttaaattacatgactggatctgcagtggcaaggggtgcgtggattaacctgaggtcccatgtttaatatctaatacgctcacaatttcttcttaaaatatatttggagggacgtctctcactccaaatcttgtttttttacatgttttaaactatttattacctccctcttctctagtacatgacaatgttaactacgttcgtcttaccttaatttcaaattatttttaaatgattatggatgttagtaacttagtatggttatattagtttacggtacttcgcagttcgataatataaacatatatgtatatttgagtatttgtaatttttttaaaaaataaacgagcaataatcacaatttaaacttaatagtcaattattcgagagaacattgtgcgctgcaaaaacaggccctgattaaagctgaggtgctgcaaaaaattacggcctctacagtttaatttaactagtcgtccactccatctccgtcacggagctgatcatctcagcttatcatttttcttcgccttttctttctctggcctccttcacgagaagcacagtcttcgtctccggcaggcctgagcttttcttctgctttactcctccaagtggcagggcctgggtttgccgggcccacatcccagccccgcacaagcaactagctaggggatcgcattacgcttatatgtattttttatttttcgttcatacaggagtgtatagtattaacgtgtattaatttcagcctttagtttattattatgtactatatccatcacaaaataaatcaatctcgtattaggatgtgacacattctgttacaacgaatctacacatactatatatccagattcactgtactatgatgtatcaaattctagtatgaggttgtattattttgtgacggagggagtagcgttataagcggattagatcattcgtggattaattgtagaagaattaagtattatattgctctctccaacgcaaagcataaagaatttgtaattatatttatagtactacttatcttatcaatcagctctcttttacttttttttttcatcttactcacctatcttcccacttccccttattaatttattaaagagcgctaaaatctattcttcttaatattgctaaataaacaacttaaaaatgaaggacaatatagtatgactcttataataaagccttaaaacttatatttctagaaatgttgagtactctctccgtcttataatgtagagtactagctccctccatcccataatatagtaatatgtctcatcacattctagattgctatattataagacggatggagtaaataatccacgttaataattcaattggttggataagccggaaaagaaacgttaccttttgcaatattgctactgtagcaacgtagctctggaccatggtacatgagtgtacaagatcagacacgagatgatcttaattaatttctcctagcgtgcgtggctacagtgcgtaagaataattgaaatttgatcggccgacacatgcaatgcatacgtacgtacattacgtgccaagagaaatatatggatggatggatgcgaagatagccgaattggcgcgaataatccgagacgacacgacgacagtgtcacagtgcaagtgtgcactaccgacgactacagtatgcatatgccccccaatcgatcgatcgagttgacgaagtgcatgcatccgtggatgcaaaattagagcacatagaagtatatgacagcttaatttcttgttaattcgtgcatgtaagcatgtttgccggtgtactacatctagagaggtgcgagtatactcattcaatttcagaataagaacattttgtactcttcgtgtttatctcaaaataaggtttttttaatcggattttatgaaagtaggagataaatgtaatgggagtagattaagaaaaagtaataattacactgggatttgatagtggaggtatcctagttttttttattttgtattggtaaatgccagatagatgaaaagtaaatttaagagagggagtactctgtattaatttatgtgtgattacctacatatatacggaggatccataaatacgataaggtatgttcacaatgcctatgttcacatggttactgtagtttaccaaacggccatatatatacctatgtttttttaacacaaacaactttattaagcaagaatagatattaggggataaaccctagtacacgatgaaggatagtagctgaaagcaaaagagccatcacttaaaaaaagagggttaactgaactacagaaacagccttcctgatgtaaccgaacaacagaaaaaggagcaagccgacagggagctgcggcgaagctgtgacgactgctaccttgggcctcattagaagtgcactccgcttgacaaaccgttaatcctcatcggctgcctccacgggaatggcacaagactgaggttggttgatgtgccgtagattttggtgtgtgcgtcaccggactcaacaaagaatccccacgggattcgtcattgaatctagggaactctaacatcaaccctgtcaaccaaaattgcgcagggggtccgagctcaactcgaatgacaaactatgcgcggtttctgctgctaggaaacaaaagagagagccaaattatagaccaaccaaccttcaacattgggggcattgagatgacttctgtcttgctgtgaggacgaagatggctaagaagaaggtgacttgcaacttggaaccacaggattctggccaaagcaaacacccaatcacaaatatcccaaagacttcggcctagaggagattgtcgtcgtcgagctagccaggactgcttccaacaagaccccaaccaacagaggcagatgctgcaccaggagcagcgcaagccagggcgcagcaaacagcgggagcacgatgaagggcgacgacaaccgcagcaacgccgagcacagcgcacacgccgccaccacagccagcatgagcccgctcgcatgcaaggcaccaccgacgaccgccgccgaaaccgcctctaccaccaccaaggcaactcagatctggaatcttcaccacccttcgggaccattgcgggaggatgtttccaccaccagagctgcgattcgccatcctagaagcacaaagccactagctccaaccaccaccgtcatcaagggcccctacaccggccgtcgccatgggaggcaacaccggcaaaccctaggacatgagactagctagaaacaggataaatctgactaaatactactaggggaagatggccatcggcaaaccactggaatcgaaggggaagaggggccagagggaagggattttgggaaggttactgtagagagaggaggggaatgagagaggggagagagatgactgccacaatatctatgttaacatggttaccgtacgtttgtttgcagttgttaacttgcagtgataagtgtaactacacctaatccaaattcgcgttgttacggaggagacagtaaggccctgttttcccaaacagaaacttttcaccctgtcacatcgaaagtttggacatatgcatggagtattaaatgtagaaaaaaaacaattacacagattgcgtgtaaattacgagatgaatcttttaagcctaattacatcatgatttgacaatgtggtgctacagtaaacatttgttaataacatattaattaggtttaataaattcgtctcgccgtttacagatagaatctataatttgttttgttattagacaacgtttaatacttcaaatgtgtatctgtatatccgatgtgataactaaactcagaaatttcctccatctaaacattgttagtgagttgcatattacggaggagacagtaaaaaaaaaaacaaagtgggtgtactccagtgaaaagcacctgtttgtgcggatgtgacataacttggtcgcggcaggacagcacggtaaaaaaaaaaaaacgtgaaagcagctgccgcagtggcgctgccactgcacgcgttgcactgatgctgctcccacttcccttgcctctcctctcacttcaccttcacggcgttcacttcacgcgcgacgcgcctctgttaaactcctcgcctacgcgacggtccaccaccagctacacaattactgctccaccggccgggcctctcacgctgactggtggggtccacttctcctcgctcgccgagaggatccagagtcttctagaacatccctgcagcaacagacactccgtcgtcgtctgaatacatgtccagtagtattttctttttaaaaaaatcaagtgagctgtggtatacccgtactcccttcgtcccataaaaaatcaacttctaactatgtatcttgaatataaagtatattatactacctccatattttaatgtatgacgctgttgacttttttttttaacgtttgaccactcatcttattaaaaaaatcatgtaattttcatttattttattatggcttgattcgctatcaaatgttctttaagcatgacataaatattttcatatttgcactaaaattttaaataaaacgaatggtcaaacgttgatcgaaaagtcaatggtgtcataccttaaaatacggagggagttatatatagtagtacaatattttttaggaacagagagagcactactatttgaaaacacagatttatgcctgttcagattgtggagaaaataaaccttgccaaaattttggcaagatggcaatattgctaaaattttggcatgatttcttatgtatcaaatttgacaataaattaaacgtatatttttttaactttatcaaaaatatggtatggttgaaaatgacatcaatctgaacaacccctatgtaaacggtgttgcggcacaataaacggagcaatgtgagtaaacacttcggcacatggtactttcttcgtttttaaatacatgggcccggtttagatcccacttcaaaattttttaccccgtcacatcgatcgaacgtttgaacacctgcataaattattaaatataggctaaaaaataattaattgcacagattacaactaatttgtgagacgaatcttttaaccctactccatgatttgacaatgtggtgctacagtaaacatttgttaatgatggattaattaggcttaataaattcatctcgtggtttactgatgaattatgtaattagtttttttaagtgctcgaacacctcatgcgacaccctaaataatacttgatgtgacacaccaaaactttacatccttggatctaaacacccccatgacaatggccttgtttggatcctcggggctattaaatagccctccgaaatctattaaacgtagattactaacaaactcattccataacaaaccctaaatagctcagaggttatggattgggttttattagtaatctacgtttaatactcctaaatagcaagattttggagggctatttaatagcccagaggatccaaacagggccaatgttaagttcggaacgtacatttactattcatctcagtagaaaaatatataaatattttaaacataatttatatttttacatatttatgttaaattttaatgaaatggatggttaaacattcgtatgcaagttcacacatatttaaaataaagatggtacagttaagtacaagagtctgaaaactaatatatctgatttcaatgaggttatatagaaagacttggtactttcattacgaaccttgccacgagtgtcatgcacgtccctagtgtctcttaagtccaaaaaatgtaccagctcactaattattaaactggaccattcgatcactgtgtgaaataagtccagatagtctatttaacctacctgtaaacacataatttattgttcttttttttatcaaagtggattaatttgttacgcacagaaaataaaaacgtgcttcggaaaaatgctatttcacgcacacatgctagcaaacataagcgcgcaatcatgcaccttatattctctatccgtcaagtgtatcatttcctacttttcgatcgctcctcttgatttcttccaactcgagcgttcgattccccacatacatcctcccaaccttggcacaccctagcaagacacggtaaacctgtcgctcctctcctagcaagataccgatgaactcacgatcctcttttccttccttccacgatcctcttctccctcctctctggtggcgggggtgtgatgctccctgtagccgtcttcctcctctatggcaagacgtcggcgagctatgatccccttcttccttcggtgtgccgctcctcctatccgttgtcctcttccatggcaagatgttgatgggcttgggatccccttctttttccttcgactatatctatttttaattgaaaactttgaaataaaaataattataacttaacagtttcaggggttttgggtatgatgttttgagatattagttaaaagtttcatatattgaatcgagaatcttaagattttagttgaaagtttctaatttcaaatccagagtttaacaagttgagatacgcaaccaacaaaacccaactcaatactatttaatattcaagctatatatatatttatgtgcaagtacaattcggatactccatttaagacatggtacatctcgttttcactttttttttaaaaatgaattgtttcacgtgtagcactccgtatttatttacaacgaaaataaattgaattgttgagatttctgtcaagtgggtaaaggagccgcaggtccgcagcaaaccagtagcaatcccccagctaaccccccgccgtcaggaaaataatttcgctcctgctgcacgatagtgacgacgctgtacgtacggcgaccactgcctcgtggccccccccaacacgcaagcacacggtgtacatccatgtgggccccagggtccatagaccgagcccacgtagaccacccaccctagttttaccgcacattttttcccagctcattcatcagattattttctttattttttaaaaatatatttaaaaaccctttctatattatagtattctcacatttgaaataaacaaatagaactggatgtgacatacttcacccgtttcataatgtaagactttctagcattgcccacattcatatatatgttaatgaatttagtcacacatatatataaatgtgggcaatgctagaaaatcttataacctgaaacagtggtagtatattagtataagtagtagtttttatttattttaagatggtaatccatccgtactacgatataagaaattttacttagatggaattatgatgctacgaatatccttagtattagaatgtgtccaattaaaccaaaacttcttatatcttgtggaacggaaggagcactagattaattgttttaaattgtttattaattttatttcttaaaaaatcaagtgatttttatagttattgagataatctgcgatgataataatcttatcaaacgttaggcagcgctcgctagctttcgccaactcctcctcctcatcacgtcgctacacaggctagtgtagctcgcagcgtgtacgagctgagctgagctagccccctgccactctctctctctcgctgacgctccctggcctttaaagctgtcgccttttgcctccccctgctactgctgctcctcctcctcctcctctctctctctctctctctctcccgtgctgtgattgctgcctcggggtgggcggtgcgagctacatacagcacaccggcggcggcggcggcggcggcgaggctccgggagaggtccagctaggcgtggtgggtggtggtttcttgatttcttgtgtttgggctgtgtcggcggcgggtgatggcggcggcggctccgtgcgccggagcgcggggcggctaggggcggctgtttctctgaggcgtctctcccccggcggcggcggtggaggtatgttgtgagcttctcttctgctgctgttcgtcgcttttggggttttccggggatggttctccgctgttcatatcctccttgccattacggtttttctaacaattttttttcatgattttttgagcctttggttcatccaaagcttcaaaccccgattcttggtagattattaattttactcgatttaaaaaccgtgctcttcgcctccaatttcgcgactcccgcggcggcggcgtctcatcgccggcatttcgcgtgctttgctctgcagaatcggcgcgtcctttgcgtgcttttccacgccttgttgttcaagggagaggagaggagaggaagaggcaagcttgcgcaatcgcacaaccgcctgtcgatttctctctttcttttctctctttctttctctttctttttttcatttccccctttcacatgtcaggttatttttttttctcctcgtctcctgacgatttcgcttttgctcgaaatctcccaggtttgttgttgttgtgttgaaggcggagaagaggggaggctttggtggtggtggaggaggaggatggcggcggcggtggcgatgcggagcggcagcggcagcgacggcggcggcggcgggtacgacaaggccgggatggactccggcaagtacgtgcggtacacgccggagcaggtggaggcgctggagagggtgtacgccgagtgccccaagcccagctcctcccgccgccagcagctgctccgcgactgtcccatcctcgccaacatcgagcccaagcagatcaaggtctggttccagaacagaaggtgagcctaatcatgcacacatatactatcatactagtttgccctttttttttgtgtgtctggatgtgaaatgttatgatcttatggataaattggttgagaatggagcaatagcaatggtagtgttcaattgtttgcctttgttggtattgtgaggatacaggaagaaagttacttgttgtggggttcttgaatgtgtttgctttgcaggtgccgagataagcagcggaaggaggcatcaaggcttcaggccgtgaaccgaaaattgacggcgatgaataagcttctcatggaggagaatgagcgtcttcagaagcaggtctcccagctggtccatgagaacgcgtacatgaagcagcaacttcagaatgtatgtcttcgtgttgttgagctcacatcgtgcttcgggtggtaaaggcgctgccctttctttgttttctcgcctgctcatatcatctctgttcattgtttgcagccgtcattgggcaatgatacaagctgtgaatcaaatgtgaccactcctcagaaccctctgagagatgcaagtaacccgtctgggttagtgaaatttcctttgaatgttttggttttgggcaattggaagcggctgccctctagggattggtttgccattttcttgataaactagttatatgatttttgtccagactccttacaattgcggaggagaccctgacagagttcctctccaaggctacagggactgctgttgattgggtgccaatgcctgggatgaaggttgattgccaacttctcagattcactctgcctgcatcaaatgacgtgtgcattcgaatgttctaatttgtgttcccttttctttgataagcctggtccggattcgtttggtattgtggccgtttcacatggttgccgtggtgttgctgcccgtgcctgtggtttggtgaatctagaaccaacaaaggtaatagcattcatcagtacttcatttatttatttatttttaattcttaattctacaacaatgcctgctgtttgcttccaagaaaaagaattcctaaaccagcttcatctgcaagtaactatgctgttttcatgctgacatactttcgatcaaagaaaagtcctttaaagtacccgtcacaagcacaactagctgtgctgtgcatacatgaactcttttttacttgaggggcagactcctttactagaatgaagagttgccaagttttcggtctcacgccatccacaaaaagagaagttctcgctctctctggcttaacagctaaggtgttccacatccaaagattcattgcaaaatcttctcttcatgcattttgttccatgttggacataattcttcatacgtatttggttgatgtgaatattttctagaaagctgaaagactttattgttttcagaaaattgttgggagattcttatagtgtgctatgcagatcgtggagatcttaaaagaccgcccatcttggttccgtgattgtcgaagtcttgaagtcttcacaatgtttccagctggaaatggtggcacgatcgaacttgtttacatgcaggtgagcgttacatcctaacttttttcttgaattaagtatcccatcattaatttttgccacatgcattccctttttatttatcattcttggctttttcgctcagatgtatgctcctactactttggttcctgcacgagatttttggacacttagatacacaactacaatggaggatggcagccttgtggtgcgttgagcttgagcatcttcattttattttagtttgcctacattgtaaattagcacaggtgtcctaagtccatgtatcttgcaggtctgtgagagatcattgagtggttctggaggtggtccaagtacagcctccgcacagcaatttgtaagagctgagatgcttcctagcggctatctagtgcgcccatgcgagggtggtggctccatcgtgcatattgtggaccatctggatcttgaggtgtgatcttcaagttctgcattctttctagttagatgtgctctgcatttgagtcattatttcttttattaatttacttagattctattttacaggcttggagtgttccagaagtgcttcggccactctacgagtcatctagggtagttgctcagaaaatgactactgcagtaagttcctataacatttcctgatctgcttttatcttgacaattcaatgatattctctcttgttacatacatatatatgaagaaatgcccactgtttccttatgattggtcatttcctcaagacctacaattgcatggtgcaatcccaatgttaagtacccactgtttgtagttagattagacggttcatacattgttcagtccccatagtaagtattacaacgcctacacctgagaagtgttgacatatcactaaattctttgtttcctgaaagtctaatagttttggagagttaaggttggggtagtgcttgagcctgtaatgtcaatttcatcatttttttttctagaggctacttagccttattcaaataagtatactgaagtgctttaagttttctttcatatatattctaatcatagcccatctttgcatctttggactactgaaatgatattaattttcttcgtcatataatgattactcttactataaaggcactacggcacatcagacaaattgctcaagagacaagcggggaggttgtatacgctttggggaggcaacctgctgttttgcggacatttagtcagaggttgagtaggtatgtccaggatataaacttctttcgcttctactgtttatattggatgttttttattctaacacattactatgcccatttagaggcttcaatgatgctataagtggtttcaatgatgatggttggtctgtcatgggtggggatggcattgaagatgtgatcattgcttgcaatgcaaagaaggttaggaatactagcacttcggccaatgcttttgtaactccaggaggtgttatatgtgctaaggcatccatgctactgcaggtgagtgttaaatataaatttgtttctatcgatgcaggctgcttagttttcagtgcctaagatgtgaattcacttacgttttgttttttattcttaactgtaacatttcaagagcttacttttttttttaatttgcatcctagagtgtcccacctgcagttttggttcgatttttgagggaacatcgttctgaatgggcggattataacttcgatgcatattcagcttcatctctgaagacaagctcatgttcacttcctgggttgcggcctatgagattttctgggagccagatcattatgccacttgctcacacggtggagaatgaggaggtatgctgacagatctttaacatttcataacttgctaggtgctgttccgtgactattttcattattaggttttttttatttatatatagtatctttgaatatgttcttatttatctagtttattgtcatttttccaattgatgatagaggatttctatgtagccttccattgttattattatgtccctttagtagttggtctttgtgctactttccttgtctagtagtgtgggggatccatttgtctgttgttcacaaagtgagctttataaaagtctatatcatttggacaaaaacaactgacaatttgcatttatacaagataagatttatcacttttcatgctactttgttgatgagttttatcaacatacagattttagaagttgtccgtcttgaaggacaagcacttacacatgatgatggtcttatgtctagagatattcacctgcttcaggtaataattctcttctttcggcgctatctggttttcaaaagagcactattaccaatcgcagtaaaaaagagcaaattattctaataattaagtcccgttgcaaggaattcctaatgtacctcccatcttgcctgatctttcagctttgcactggaatagatgagaaatcaatgggatcctgcttccagcttgtctctgcaccaatcgatgagcttttccctgatgatgctccgttaatatcttcaggctttcgtgttataccgctggacatgaaaacagtgagtttttctcatgttagcctttctttttaagtgcattagttctgtgttgtatggataattcttgaaatttttctgttctttttaactcccatgtagtgcataccatttttggtagcttatgggttaaaagccttctaacttctgtaggatggagatccattagacctgaacatcttgtttctaccttgttacttctatctggtttgattttcagcagctaggattttaaccatcaatgtcttccacaggatggtacacctgctggtagaacattagatttggcatctagccttgaagttggttcaactgcacagcccacaggggatgcatctatggatgactgtaatctacgatcagtgctgacaattgcctttcagttcccttatgaaatgcatctccaagacagcgttgcaactatggcccggcaatatgtccgcagtattgtttcctctgttcagagagtatcaatggctatttctccttctcggtctggcttgaatgctgggcagaagataatttcaggcttccctgaagccccaacgctagctcgttggatttgccaaagctaccagtaagtacatgtttatttcctatatatcttatgaatgccttttggtattaatagataggagctgcattattgctctatacggctataccactacctgtccaaaattaaaaatataggactattaccaaatattaacttgtattcaagctgataaggatttgtggtgtttgcaggttccatttgggggtggagttacttaggcaggcagatgatgctggggaagcactattgaaaatgctatgggattacgaagacgctattttgtgctgttctttcaaggtactataatttttcccttgttcttttcataatttccaacttgtacattttatgtcgttacatttaagtgagaataagctttgcctttgtatggctcatatatttggcactatatattctttcaggaaaagcctgtgtttacttttgccaacgagatgggactaaacatgctagaaacatctctcgtcgctctccaagatctctcactggacaagatatttgatgaagccggtaggaaggccctatacaacgagatcccgaaattgatggaacaggtagagagccacttgcaaaatccccattttcttttccccatgtaataacagcaatgtcctaaccgctaaacacaaaccaagtagagatgcaagaactcaccgtagccacagagtaatctttcgatttcgattcaatctgttcttgttcagggttacgtgtacctgcctggtggagtgtgcttgtccgggatggggcgccatgtttctttcgagcaagctgtagcatggaaggtgctcggagaagacaacaatgtgcactgcctcgccttctgcttcgtcaactggtccttcgtgtgacccaaaatccaatccaccatgctcgcagtcatcgtcgttgtcgtcagatctccattttttgcaatctctgtagaagagaggacaccaaaccaaccacaaacctgtcagctgttagctaatgattctactagcttttctagatctttgaaggcaaaatgctgccggtgcctgtaaagagtgtgtgcgtgcgtgtgtaaatttgggcgcgttttgcactaatttgatctggggtaaggaggcgctggctgctgctgtgctgtagtttggtaaaagttgagtacactaaccttggatggtctcgaactgtatgatgaaattcctagcagtaaaatttcaacttggatccgtgaagatgagcatgtttcttctcccgatggctctcgtatctcgttgccgcaatgggggaggtgatgtttgggttggatgtttcgtcgcggggaaggattggatcaccggcgagtcgccgtcggcggccggtggtggtggtggtagactggttgccctgccctaggcgagagcggctcggatccgcctctcgcagcggcggaggcgggcgccggtccgcggctctgtggctgagcagagcagcgccgtggcggcgcggccagcttttggcggcggcggcggcggcgcaaccgccgccatggatggtgtggggtggagagagaggcagcgaaggcccacacgcttttcggcccacggatcggtagccgtgggcccgcaaccgatgtgctcagcccaagtagctgctaggagtaacaaaacctttcaagcacaggaatccatctcccaacaacaatttcatgaggccaggaaaagacgccttagcaggatttacaaattacaatttgagataatccaagaaataccattgacaagtactcaattcaaagaaatgtcatcgacgagtatgagttccatgaaataccatcgtacaagcgacattgtcctaaaaatataatcgccgttagggttcttgaaaacaggttggtttttgaaaaaaaatagaagtggctatacaacattagatagttcttttatagaaaactttcaaatataattgcattgttcttcttgttctttatactagtaacccgcctacccagttaaacctaatccatctacctagccagaccctaatttggagggtgatcacgaacgcatttcgtgaaattcaaatctaaagcagtaaattcgattgaaagtcgatcgaaactggtccaaaattccccagttttcgacatctcgctgaacccggagcctcaggctacgtctacgagaaacgtgttcgtagagaccctttacaacatttaatttcctgttgactgttaatcttaaagctccttcaaacctgagaattttctctagctaagatcctgtttagatttcaacttttttcttcaaacttttaacttttttgtcacatcgaacttacctacacacaaactttcaaattttccatcacatagtttcaatttcttcaaacttctaattttgacgtggaactaaacacaatctaaattccaaagaatccctatgttacaaaagaaagtttgtgatgcacatacatgcctatctcctcctcggatcaggcatctctaccttcaaactacgtgtgcctttgtcactgaaatatgggaccaataaaccatggtcgcacatgtcagtgataaaggtacgatgttttgaaggcagaggatctcaatcccactgtcggtgatatgggcccgggggtatcaggtttagagggaggaggctgccccccgatgccacgtggccctcccccgaggggagtcaggcccgaggtggggtggcggcaactccttccctaaagaatagtcagaagaggttgcccccaatgccacgtggccctcccctgaggggagtcaggcccgaggtagggcggaggccactccttcccaaagactggatggaggaggctgccctccaatgccacgtggccctcctccgaggggggtcgggcccgaggtagggcggcggccactccctggccgagactagagggagaaggccgccccaggcgccacgtggctccccctgaggggggatcgggcccgaggtcgtgcggcggccgccccctcccgtgactaggggtcgggctcccccgaccccttctctaggtcaccacgtacggtgggttaggtatccgcctccaggtgcccacctacccgcacttatggcgtcccgagcggtcgcgccacgccgcatttaatgcggtgtgcagtgcactcaaccggtctatgaccagtcgaatgactgatgggacccaagatgtcaggcgcaccatcgcgtgtgtcacgcgacgtgcagcccgacatatcccatcaaataatgatgatgaaaggttctcatcctcttatcccagccggagtcggtcctcccgctctggtcaaagtaaggctcccgtttcccggtgtaataggagcccagaagtcttcacccattaaatggtgactgacaggggcaccccccgtgtcaggcggcaagatttgataggccccatcatcaagacgacgtgtgcttggcttcccaagtcaagagacaagacatgcatttaatgcaaagattataatacttctccaccggagctaggttaggttgttgggcccatgtggtaaccccttgaggtataaaaggagattcaggcctagtggtggaggggggggggacttccgagcaaactggcgcttgggtctcgcaaccccaagcactggtgttctacattcaatcaatcatgcacaggagtagggtattacgcttcatcgcggcctgaacctgtataaatctcttttgtctcatcgtcttggaggggcctaacaccctcaagatcacacagctccgctcatcaagccatcgaatctcacccgctgcccccggccgaactcacaaaggggggcctcacggttccctggtggaggagttcattctccgacatctgacgcgccaggtagggggcgcgttcgtgatctttgaggttctttcgagcgccggcgtagtgagtgtcgcgccgccgctacgggggaaagcgtagcatcctcaggagtgttgcgccaccccaggcagggggcaaggcccctcacatccccaccaggtaagcttggctaccaggtctttgtggcgagtcttcggaatgtccgagggcccccaaagctctagccctacctcaccgagaagtacgacgatggcgccgacccctccgagtccctccagatctgcatggcgatcatagaggcggcggggggtggcgaccgggtcatggtgaacgtcttccccatggccctcaggggccaagcgtggggttggcccatgaacctgctgccgcctcggttcactcctgggagtactcttgcagttttgagctccgggtgccgttgaagcccgggaccccctattctggcttttccgtagcggctagctttggtcccgccggctggctacggtgcccggcccggctcaactaatcgtcctctcatgttttcagtattttcaaattttcaactcatcaacctagtacagcttgaaatcttatatttatttccccccattctattctcatggccctacgacgcccgcgtgttgcgcatttgtttgctccctcggtggtaagagcccaacccctctcccatctacatgaacgattcttcgctaagtgtggggggctaagttttctagccttatcctagccttaagttgagccccgggtgccgtcgacgcccgggaccccctgtactggcttttccatagcggctggctttggtcccgctggctggctacggtacccggcctggctcaactgtggacggggattgctggctctagagttttcagctctcacactcatgcgaaagtaatcgtccatgtagaaggaaaagagattggaaggaggccatcgaaaggaaagagcaaacataatgtgtagcgtggggacacaagctcgtgggaacctgacctcgtttgctaagtggtcacaggcttcccaagatggttcggaacccatggtggggggccctctgcaagcaaggtttgtgtttgcttcattcatacaaacaattctttgctataagtgtgggggctacgattcctagctctgtcctagccctgcgtcgagctctgggtaccgtcgacgcccggggccccctgtgctagctcttccgtagcggctggctttggccccgtcggctggttacgacgctcagcttcgcttgatcgcaggcgaagattgttggctatagaaagttcagtcctcacactcgcgcgaagataatcgtttgcatagaattattattgcttatatttatctctcgcctatctcttcctcgcggtcctgcggtacctatgtgtcgcgcgccggcttgtctcccttggtaacaaaaagtttgtattcgcttcatccattcaaacgattctttgcttaaagtgcgggagctacgattcctagctcattcctagccctgtgtcgagctctgggtaccgtcgacgcccggggccccctgtgctagctcttccgtagcggctggctttggccccgccggctggctacggcgcccagcttagcttgattgcgggtgaagattgctggctatggaaagttcagtcctcacactcgcgaaaataatcgtttgaatagatgaagtagaacatgaacagaggttaacaaatggcaggggcaagcgaggtacgcggcgtaaggtcacgggcccgagagaatctaacaacgtttgctgaatatatatagaaaataagttcacagcctaaggtacgggttagcgagtcgccctcaggctggggcgaaaaaggcgcatgggtcctagtgccagcaaagaaagaataagagatcgggcccacatgtcatttgactaacagagtggcgttaaccctgaccacctaggaaaagttttggtcagggctaacgccgggggctactgtcggtgatatgggtccgggggtatcaggtttagagggaggaggctgccccccgatgccacgtggccctcccccgaggggagtcaggcccgaggtggggtggcggctactccttccccaaagactagtcggaggaggctgccccccaatgccacgtggccctcccccgaggggagtcaggcccgaggtaaggcggcggccactccttcccagagactggatggaggaggctgccctccaatgccacgtggccatcccccgagagaggtcgggcccgaggtagggcggcggccacaccctggccgagactagagggagaaggccgccccaggtgtcacgtggctccccccgaggggggatcgggcccgaggtcgtgcggcggccgccccctcccgtgactacgggtcgggctcccccgaccccttctctaggtcaccacgtacggtgggttaggtatccgcctccagggcccacctacccgcatttatggcgtcccgagcggtcgcgccacgccgcatttaatgcggtgtgcagtgcactcaaccggtctatgaccagtcgaatgactgatgggacccaagatgtcaggcgcaccatcgcgtgtgtcacgcgacgtgcagcccgacatatcccatcaaataatgatgatgaaaggttctcatcctcttatcccagccggagtcggtcctcccgctctggtcaaagtaaggctcccgtttcccggtgtaataggagcccagaagtcttcacccattaaatggtgactgacaggggcaccccccgtgtcaggcggcaagatttgataggccccatcatcaagacgacgtgtgcttggcttcccaagtcaagagacaagacatgcatttaatgcaaagattataatacttctccaccggagctaggttaggttgttgggcccatgtggtaaccccttgaggtataaaaggagatctaggcctagtggtggaggggggggggacttccgagcaaactggcgcttgggtctcgcaaccccaagcactggtgttctacattcaatcaatcatgcacaggagtagggtattacacttcatagcggcctgaacctgtataaatctcttttgtctcatcatcttggaggggcctaaccccttaagatcacacagctccgctcaccaagccctcgaatctcacccgctgcccccggccgaactcacaaaggggggcctcacggttccctggtggaggagttcattctccgacacccacctcctctcgcaggatctcgagccgctgcagcctgcactgcattgcctctggctcatcagcttagctccaacggatcaacgcagcgacatgatattgcagtcgtagagctcagcctagcacagatagcagcagcagcacactgtatgagcactatgcgtgtgcagagagagagagagagacatatggccgcaagtcgcaataaattgtggttttgaaggaggagggtgggagccagcagcagcagcagcagctagcagccattaaattgggcgccctccggttagctggccgtccatgctgccgcatcaattctcctccatcgcattgcacatcgcattgcatgcactcgctagtgtagtagtagtagctgctatagcttcaccccaattattagctccggttggcacggcacagcgagctggaaaacgatgtctcctctcctcctcctccatggcgaattcattgctggttaaatggagcaatggccattggccacctctacatatagtagcaccaggactagtctgttagcatgttactccaatgttaccatctctgttagcacccaaggctgaacacatactatgaacctgaatgaaaaggtccgtccatattcgtagcaccaaggctgcgttcggcaaaaggagttggaaacccactccccaccttttccacacgtacgcttttcaaaacagttaaacggtgcatttttttaaaaaaaattctatacgaaagttgcttaaaaaaataatattgatatattttttaaaaaataactaatacttaattaatcacgtgctaatgaaccgctccgttttcggtgcgggaaagattagtttccatcccttgctaccgaacacagcctaatatatgtctcatctgaatgttgctatattttaaaacagaggtagcagacgtgttcaaagttatactgctgctgctcctgccaatctcgttgcaaaaccctaaccgaggtagcgaccaatcgaggcactttaatagaaaaaagttaatgcgtgcatagagggggaggaagggggtggagtgattgacatgtagggcatccagccatgttaaaatcatttatttacggaaaaaatatgaattaccctcctaaactatcgtggtcggccgaattaccctctaaacccgaaaaccagacatcgtttaccctgaactttcaacaccggataaattatccccctcgacccaatccagagcagttttgttctacatggcgtacacgtggcaatccagtcagccttttctttttttttggtgggtccacctgtcatatatactctatcacatgtctctctcttgccccctctctctctcgggccgtcgggagtaggtcaagctgtggcgggtggtcggcgcgcacacgccacgcggggagcgggtggtgagcggcgagggcggcgggacgtggagcaaggcggcgacacgccggcactgcggtgtccgcccccctccc

SEQ ID NO: 65586 - DNA, 4229 bp, Oryza sativa
tttgttttatcgtgatttaaaaattgttccaaattttcgaatcaatagtagttctttcatgatttaaaagtatcaaaatttgaaagtaattaatatatatcgctacacttatctgaagtatcagttatttctatgatttaataattatgaatttaggaattaactggtacctatttgtgcttgtgttggtctcctaatttagtgtactacgctagatgcatgaattttagtggcacttttagatcatcggtgtgttgtaaaagtggcccacatcattacagtagacataattcagaccaaatagtccttaaaactgacaaaaggcttaactcctagttagaaatcatgcaatctaactcctaattagtcagctaaattgaattttttatgaaatcatacattcactgaaacaaatgtatttggatgaagcatatatggagcagatttgttagtgatgtatgtttaacttatcttgtcatcttggtaattgggcactttctagaagcttccacgttaatcagattaatctggccatttattaaatagatcgtaaaatcatgaccatagattaaatattataaccatggacttttaattaaaggcccaacaagagaaacatgtatctgggctaccatttaatctatatcggcttccttcaaagtctacaaactgtgtccatgtcgatctcagccaccggactcaactccacacacggcaagatgacgatacgacaggacatacgtcgatctccttcacaccctgccgctgatgaactccatcgatcgatctccagttcactattttatcgatgcagatactattcagattgatctttgcagctatgattgctattttaaatactcaagtaagcaagatctaattcattatatttaagttttcattaagtattttttacatgtttctcatctattctaaactatgtaaaaatttcagattttaaggtatcgcaatttgatagccataaatttggatggagtttatcaggtatattcatttacttctaagttaaattctcccacatccttcataagcaaccaataggctttactgcgtatctttttcttgacatgaataatttactgtgtatctaatgctttagttggttccacgcgtaaaacagctacataatatttttgacaagtttgtcaggtcaggtatgattacaaacaagggaacgtagctgctgcccctatctatttacgaataagaaacaaacaagcacttcctttaatgtttctctgttcatatttacagatgtttatttacattatctatgtcaggtgtaattagcaaatgtcgacgatgttggctgttcttttaaccaagatgacaagataagttaaacatacatcactaacaaatctgctccatatatgcttcatccaaatacatttgtttcagtgaatgtatgatttcatcaaaaattcaatttagctgactaattaggagttagattgcatgatttctaactaggagttatgccttttgtcagttttaaggactatttggtctgaattatgtctattgtaatgatgtgggccacttttacaacacaccgatgatgtaaaagtgccactaaaattcatgcatctagtgtagtacaccaaattaggagaccaacacaaggacaaataggtaccagttaattcctaaattcataactattaaatcatagaaataactgatactgtagcgatatatattacttactttcaaattttgatacttttaaatcatgaaagaactgctattgattcgaaaatttggaacaatttttaaatcacgataaaacaaaaattaagatttcaaaccgagtataatatttttagttagcaattttaaaattaaattatgaagatgttataattgagactccacacagaatacaacttgatatttaattattatgaatataggaatcattaaatcatgaaaaagcttaactccaaactaagtttatttctgtacttattaattcaaaattgataaattatattatagcaaatgctaacaagagcaacaaaacgagtataaatctatatttctaatattgaaattttaaattatgtaattttgaaaaaatagagtaatagaagaaatattagaatggattatatatgaaattactaattaagattttggcaactatcagcttcattcaaagtaacatattttatcattatccagtgaaagtaataatattttaattattagtcacagtaacccgtgcaacgcacgggttgacggctagtttttttaatatatcatgtcgttgactttttgataaaagtttgattattcgttttgttcaaaatttttgggtaaatataaaaaataagtcatacttaaagaacatttgacgctaaatcaagtaacaaaaaataaataataattatattaatttttaataagatgaatcgtcaaaagtatattaaaaagatattaaaaaactagatgatgtccagtgctttgctgcgagatatatgttagataatggagaaataatgaaatgatttggattaaaatattataaaaatgatttgagaatgattatctagcatgtgtatatttagttttagaatgaagtaacttgtagatataattactatatgcttccatgttgagctatgtgtgcttaaaaggttgatgtggcatgcttgtatgtaggttttaagagtgctaataaatattatgattgcatgttgagttttagatgtttagtgggcattagctttacagaggaagtagtttgttatattgcttagttatcagaacccactatctagatgcaccacttctgtcatcagatgacgatgctgaatttgaccacaatcgcaaaatattgtagattataatggtgattgtacatgcatcatgccttagtttccttgctttcgggagtaattgcaatcagtggccgttacactactagaaaaaatattttttattccaaacctcaaaacacaaatatcccgactagattaagaacatatattaaagatgttttaataccgattctaaaagtttaaatccaagaaacatctttagttccagttggtgttaccaaccgatacttaaaaaagcatctttagtactagttagaaacaccaaccaagactaatgctggagaaattttagtcccggtttatattactaactggtactaaatattttttttagtatcggttaccaaatgcctctagggttagttaaaaagaaagtatctctatccaagttagatgtgtgtcgtaggtgggatagtaactcgtattaggactgagtgagaaatcttaagttcgaatctcgcatcctacatatcttttttcacttattttgcatttttagtaccgattctatcaaccggtactaaaaatctcgatctttagttttggttgctataaccggtactaaagggggtttcaactggtattaaagattgtttctccagtagtgttactatcctgaacctgtaacttcatagcaacaaatcttgaagttcatcggtgccatcctctggcattttcttacctgatttcagtttgtaaactattttgcttcattgattcctttattttatttctctgaacaaatcttgtatttttctaaccaaaatatgaaagtaaccatttgtttctatcatattgtaatggaaaattttaaatcaaatctaaccaagataatatgaagcattgccaaaaaaacagagaaattttgagcatgcatatagagtgccagttgaagtgaatttatttaaattgaactttgcaatggatgaagctcgccatgtttctgtatcaggtttagcatataatttcactttaaactaggtgcatagaagtaagtttcactttaaggtcaatataaatcatcaaacatatggaaattttctcataaattctgattgaaacttcatgaaacaggtccaaattcgaaagttccaaaagatacactcttgatttataaaatttcccttccattatatggtgaacctctagcggaaagtggaaattattcagaacattgcaatttactcagaacattttgatctgcagtttaataaatgaagagagatcacagtctaattttgctagaatatcacattggcgggtcattattgtacccagtgcccatggttacgatgaaaaaacatgttttaatttttacgtagaacataggcttttttactaactagaaggggaaccttcaaa

SEQ ID NO: 65587 - DNA, 32154 bp, Oryza sativa
  unsure (1)..(32154): unsure at all n locations
tatcgtgttgcttagtttgtttagagatgcgtgttttttgcttttaatatccccgcaccccgtaacgccaaaaacattttcggtaattagcttagaggggtatctaagtccattaagaagttgattctaatcggagctagtgctgtatgtaggtccaaaaacattttcggtaattagcttagaggggtatctaggtccattaagaagatgattctaattagagctagtgctgtatgttggtcaatttggcgttgtcacaatgataaagtttttaatggtaaacaattatctaaccctatgtaggttatcttcatgtcttcctactggctccacttttggtctacaatgctaccacaggaggagcaggatactatgcgcaatggtgctacactcttggaatcggtagccaagggtctcttattccactatgggtggcgttgttccataagaattgctagctaaaatattttatatggttgaacgctagtcaataataaaggggagttggggatttgtcccatcaccttatttctcattttgatttacttttatcttacctttttattactattaaacttatggctgtgtgtcttatgacagaagccggagatataatccatttccattatctaaaaaattcatccacttcatcgatcctgcaatgttgtaggtgggtcattactctctcatccctgtcatgctgatcaattatctcttgtctcactgtctcagctatatatatgaacccctcccgatcattattcacttcccttaaattggcacaaaaaaaaagacacaggggttggagaacacaaaagtcttgagacgctattttttttaatcgcaatcttttgctgatcatccccataggacagcataaactattcctgctttggaatgggtggcatcaggaattcagaatcttgccattgcctggtgaatcctgcaagagggagcttcaagtaacctgccacgttgagtgtcctctggaatacacatggcgacaacaaggagcccgtgtcgccataggcgatggtccgccatgtcctctcgagtgacgtcgtgtacactccgtttcttgctgatgcagctgctggttcaccatgaggccgcaggctcgcctgcaaccagatcagattagtactcctaccccgttctttctttgtgttaattaccaggaggagatatttcttttatgggtggattgggctcaatcggagattataatgcgacaagcaaccccacctgaacaacaaagtttttcagcccaacttataacttttcagccctgtaatttacactgattttcgttccaaaacttgtgttccaagaaggtcctgagggttgttttgtttccaagatattagttactatatttgttaaattctgtagtaagtacttcaggatagaaataactgctagattaaccaacattgcaggtatctgcatggaagtacaatgtgcgggactgaacaatctagggtttaattgaccctatcctatcaattaaacctaaggttttggtttaccagcccagatggtctgccatgtgagctgcctgtcatttcgttcagcctttccgtctcacaagcaatccctcatctccattaattcattgatccattaaacttaaaggttttggtataccagtccggatgatctcccacggagatcgcccagtccagacattgctacgttcgcattgtagaaactacatgtggagattacgggtttcatatatccacacagacggcttattcgactgcgagcgcttaagccgtctgcacgtgctaatagaaaatcgcaaaaaaaaaattccagaaatcaaaaccctagccacagaacagtaacctagaaaccgtcgccacaaccaccatgtcgtcgcccctcccaccgccactactgccgtcatcacccctcccgtcgtcggcggatccatgtgcgggagggggagggggttccccgattttgtcagcggctgatccgccctccccgcggtcgccgacgatgaatccgtctgtcctgcggtctccggcgacagatcggccctccctgcggttgccggcgacggagccacccgtcccacaatcgctgtcgacagatccgcgcaccgttgtcgctctcgtggatgggaccggccgaatccgcgtgctgtcaccacccgcccctgaggctgcctccgccgcctgccaaagagaccttcgtctctgcatgccgccagagcccgcctgcgaggccgtcatctccgccttagccaccggtggtggagaagagaacgaggagaggaaaggaaaagatatgaggtggagtgggaaaggaagggtgagaggagatgtggagtgagagttgaacgggaagagagaaaataaaaaggagtgaaatgtgtggtagagacgaggaggagaaaaagggatgcggggacacgtgtggcccacttatctccgagttgcccgcatgcgaaaatgattttcacatgtggttctttgataggcccgtctaaaaaatatccccatttttgcatacggctccttaagatgtttgtatgtgaaaatagtcttttccatgtaggccacttaacgagttgtgtgtaaaaataaaaataaaggtcgatttttccagacgtggacacttatgacccgtttacaatatattagggtgctcttataggaaaatcatttgtgtagtagtgtatgtaactatataaggaaatccatgttatgtccgattgggtttccctttgtaactttgcccccaacctatataaggagagcacgaagccctccaaggacataacataattaggtcatcagattaatatacatccggtggatacaatagccaaacaggagtagggtattgccattaatcaagacggtttgaacctatctaaatccttattttttttatccatttaattttaagtctcgtgcgttaccacttttattattgctgattttcagaatcgacttaccgttctctaaaccgctagatttgtgataatttgtgcctgcccatatccatgtgccaatgagcgtcctgtttgatgtacggttggtctggctagacatcgctcactgtgctctggaaacatcgtaggtgcctgtgacctgcctatgatttcgttcttccatctcacacgcaatcccgcgtctccattcattcatctttcgatcgcgcctctacacctgaccttttacggatttccgtcttcgtctgtgctcctccaccggcgtctacctgcgttattcttgcttctcgattatgtagctaggctctagaaccttattgtcaagctatcctgaaccttattgtcatgccatcatgccggccgtttgaatataccagcacatggcagggtcctcatccttgcaatttctagataagtatagacattcatgatgtgactttgcagtagtagcagcaaagtcacatcagcgttcagtagctattcctgcggcagtgcttgtgttgtgcagctgcagaacatgccagctgaacaatagaagagtagcaatgtatagtagtactactagtttcaagggttatcctcctataaaagcagaagatctctgttgttgtctacttctgcacaccggctgccgtagcagcggaccccccctcccctcgaagggggcgactacgactggcgcatcactctcctccaatgccacgccctcgtccctcatacttcttaggtagcaagacaatcaatatttcatgcaaaattaaaacatgtcgtcttcaccttcactattggcatgggacatgataatgacccatcaatgtgatattcaagcataaattggattgggatatctcttcattcattaaactgcagatcaaaatattttgagtaaattgtgctttgcacaaggtagagtatcctggtttactttgcaccggatcaggatatactttcactctacatttgggtatcttgaaataattatcactctgtaaagaggttcaccatataattgaagggaaattttagaaatcaagattgaatctcctggaactttctgaccttcgacttgtttcatgaaatttcattcagattttatgagaaatttctatatgctaaacttgatacaaagtgaaacatggtgagcttcatccaaggcaaagttcaatttaaatcaattcacttcaactggcagtatatatgttcaaaatttctctccgtttttttgttctggcagtgcttgatattatctttgttagatataatttaaaattttccattacaatatgaaacaaactaatggttcttttcatattttggttagaaaaatacaatatgttcagagaaattaaaataaaaggaatcaaggaagcaaaatatctacaaattgaaatcaggtaaggaaaagccagagaatgggactgatgaactccaagatttgttgctatgaagttccaggttcaggatcgtaacgtccactaattgcaattactccagaaaacagggaaactaaggtagggatgcatctacaatcgccacaataaatctacaatattatgcgattgtggccaaattcggcattgtcacccctaatgacaaaaggtggtcagttctttgcccaactttcctaactcacctccatcattttccgtgcgcattcttttcaaactgctacatggtatatttttttgcaaaaagtttctataggaaagatgctttaaaaaatcatattaatccatttttaaaaaatagtaaatacttaattaatcataagaaaatgcgttactccattttccgtgcggagaaatgagttcccaactcgacataacgatctagcaaagtagtactctctccatttttcaatatatgacgccgttaacattttaagatacgtttgaccattcatcttattaaaaaaataatataattattatttattttattgtgacttaatttattgtcaaatgttctttaagcctgacttaattttttttatattcactcaaaaattttgaataagatgaatgatcaaacatttgtcaaaaaaaaaagtcaataacgtaatatattaaaatacagtggtagtagttgctaaaagttacacattttcgtgcaatctgattacaacattatatgacccaaagcaaacaacatgttaatgactacctagctatatataggatcaagacccataattatttttcagtgaaaagcatgttgacatattcttattatccactaagccttaatcaaagttgtttacttattgtaggttgatagttctaagtgcattgacgccatattggcatacatgcaaagttgtttacttatgcacatgaacaattagaatatttatgcattgaagcttaaatatatctacctacaaccacattatttcttttagaaaagttataacttgaagttacaacaaatatgtgggtttcacaacaactattttataagtnttcttatgattggcgtgaaaagggggaggaatatgtgtattttgcaaattaatttcagaatatttgcaataaagaagcagaagaaattgtagatatgtggcaggcaaattggtgtgttataggtcaaatgctagaagcaaaaatagcacaaactattagcgaatcttatttgggataattatgaattattgtcacacaacgaagtgtgttatttattggccattgaaaattgcatattcatcgaggaagtatgaaattgcatatagctatttgaaagctattggtttacttgtagtaaacaatatcctaaataattaatgaccctttggattcgaatgattctgaatgatcaaatgacaccacatttactttggcgtaatgaataaaagttagacatgtcacccaattaatttattggcatattcaagaagaataaatattctcgtagaataatgtttgggtgatttgaaaagttccatgatggttaaactatgttcatagattaatgttttagtgttatagttatgttcttgaagacatcatgaagttatataatactaacacatccatcttatgatcatatctatgttgcatgaatataaacatgaagtgtattgatccaacttaattagagaattgaatatagtatgagtaattggatcaagtcttgggcaaataagaaaaaagctagaaaatagaggaattttgtcgactagtggatatttgtttgggcttcattgtcgcagaataataaccctctatgacttgggataacctacaatattagggatgtgcaatttttcatgccattgcattaatttttatgttagctcactgcatataatatctttaccccctttattttgtataagtgcatgttcaatgaatgaacatttccctcatatatcaccaccatagcatacatatatgggcctccacatgaagttggggatacaaatggaccgaattccattaatccagtgcctatgataggggatttttgtgatatgctattagataaagatcgaatatcagcatcagggggagaaaagcccatgtgttaaagatgccttatattttcaagaagaaaaagatctttataagtaagaataacgtacaagccaaactaaactagaaggtttagtttattctcgtgtaagccagaagcggaagcttgctagataattatgaattaaaggagtaatcagaagttatgtttacttgtagtaaactttctgctaacagtggtataccccgggttttgaatagtatatccacaaatgcagagtgacatgttagtcaatgttctaaaatctacgggaacacgtgcggattctaagatctaatgactattttcaatgtacccattaataactccttacaactcttgtagagtaatcaccatgaaggtgaattgcctcatgaagaggttcatcatgaagatgaaaacccagaacgcacatctatctaattctggggtgcggaacaaccatacatcttatgtttggaaatgactaagatattgtttataatgaattaacttcacggaatgagtatgtggagaaaataatagttgtcgacaacatcgcctctatgattactaatatttctctaatgagaatccggatccggaaccaaagtccatggcagagttgcatagtagcactcatatcaggtctattgaagaaagcaatgaggttgaaccatagtcgctaaataagtctatgtgaacatggaagttcagacttaataggaaatgaagtggtgaaaagcgacggctcatttggtcatggaaaagaccgatattctcctactatgaatgtattaaattccactatatatatcgctggcaaaagtcatgaatgaataaatgatatgcagtttatgggttatgaaaatccatatgaagttttcactagaaagaaaacaattccgcaacatatatgtaaatctcatactaattagtatcatgaagcacactatattttcatgaagagaattgcaagactcgtagaagagtttacgatgactcacgaagagtttttctcctagaagcgagaatatttctcatagtagagaaaatgacttccggaagaataagttgatccccgtaggattatggtaatgtatgaattaccggttaatctccatataacaccgataactcgtactcccatgaagtggacagacccgttcaaacgaatgaataggaaaatcacatccactagcttgcaagtggattggtagttttctacatactataaaggtgtaagaatttatatatcatgaagatatacttattgatggtatttggcattcttattaattcccctaataccaaaatatagaccgttttatgtcactctaagtggtttaagctaattgttgaagattagtgaaacaatcaaattggtaatgatgactgataaatccaccaagagaaagttgcataatatttaacctcttgtattgagctaattattttatacataccgcatatgtgtatcgttgcatcttattttcccataatcctccataaggattaaactttgtttgtattgcacatttgaataagtgattatacatattgctcctatacgttgatttatttcttatgttcatagtagaacttatgaaataagtaaacgaaagattaaacattgtggtaattttattatcattgttttacacattaataaaaatatggttatgacattggaacatggaagtttcaacggatgtcttattgagggggagcatatatgctaaacattgattatcatacttaagacttggaagtcctatatttgatttacaaagaattaatcaaattaatcattattttgataatttaccttgaaggttactaccactatattgttgtgttaatccaagttgattaatataataaatcatatagatcattagctatttatgaagaatagtcgatattaaagattatgcgatcaagaagatcgtgtgttgtactctttttcccttagtgagtttttactagaatatttctcacgcaaggtttttaacgaggcaacaagtgcaatataactagcgtgtacgatgtactcttttctcctatctttttctcccactgggtttttggacggagtttttaatgagacatgtgtatagcgcggtattcgcccaaggagtgttatgaaactattatctcctgccagagataaatatgggctcataccaaatatatggaaacgtatcctaataggactcttcctaatatgggtatatatactgagagagagggcttgagtggttggttgatgtatccgcatatggttaaagcaataaagctgtggtgcccctccctatatccgtgttcatctactatatgattgtgtgcatgagacgtcgtctactactctgaatcagcgaataggccactagttatttaacaagtagctactcccatgaaaccattcatcacttcatcgatcgtgcaatggtacagggtgggtcattactctctcgtccctgtaatgttcatcgcatctggtctcactatcttagttatatatatgaacccctcccaatcatttttcagttcccttcaatttggttacaacatgccctcggctgcaaaagagactttagggttaagcacacaaaagtcttgagagatgactttttgtaatttcagtgttatgaacatcccaataggacaacacaaacagccccggctttggaatgagtggcatcagcaattcagaaccttgccatggactgatggatcctacgaaaggattgtgatggcctccatgaagcttatggttcacgacacagggtggatttgcccttgacaactcctgtcttttctttgtggcattaggagatatttactttttaggtaggctaggatcaactggggttgtaattatagaaattaccatctaaaaaacgttctttagcccaactggggctgtcatgtacgttgaatttaggtccaagacgccttccaagcagataccaaggttttttttttaagtaagacatatatattgaccacattatcatataactagatttaagatgatgcatcacaaaactataaatttaacatcaaatttataaaaaaaacatatacatttaaggtgaaatatgacaaaactacatatttcaaatgatcggctcttcctagaggaggcgcgggaaggggaagatttcttcggtgctgacgagttcacgttctaggtcgatccgctctcaggcaacacctgtgttgttttgttattttatcttatgttgtgtatggtttttctatttgtagggagtgtgtcgttgtaagtttggtctatcggcccctaaaacctactctaatatactcatatgtaatgtttttatgtaaaatctcaaatatatgtaccgaaagatattttgtttatcaatctgtacacgatcaaaatcctggacgatcatgggtgatttcaagataccgtactcaaaccgagtatccctacagttttgtactccctccgtttcatattataatccgtttgactttttcattagacaaatttctttaggtttgactaagtttattggaaaatttagtagcatctataacatcaaattagcttcattaaatttaatattgaatatattttgataatatatttgtttggtattgaaaatattaatatgtttttctacaaatttgatcgaatttaaataagtttgactaagaaaaaattcaaacgatttataatatgaaatggagcgagtacaattgtagcactaaaattacattaataaactttcatattgcattcatcgttcacccctacagttgcagtcattgtgcggggaagatagatgtagtataagggttgcagtggcagtcattgtccagtaaatccccgtgatcacgcagtagtaccattaaattgcttcaaccaatcatcctattcatattcatcttttctactgtacataagaactgcgcagaaacatcccaaaggacattgatgctctttgttagacaatctcgttagcttggcctgcatctgggcatgactaaggaatgagaggcatagagaagagaagcatcggtatccacccgttaaagcaggaagcaaatgatgtctagctccaaccatggatggcgggctggctgctggggacaaaccggctgggaatttgattcatggcaagctgaagctgaagacggaagacaagcagatgtggctaatgaacgaacaacagtgctgtctgctgtgaggagatgttcgttgatgcaagaaaacctgaggctgctggtggctatcacacttgctgttgctaattctttcatcaatattttggttgctagttggtacaaaagatatcgcactacctgaaaaatataaatacatgctagctagcttagagaactgggggtctggaaaacattatgatcgtctccagtactgccactcttcatatttcaccaacatatgagctcttataaactatagcatgatgaagagtggaggtgctgtacacttgagttctaataaaggtcgaggcccccatcatttggcttattaagtgaataagaaacggcatatttacaaataaaaattaatctgtaacctttctttcgtcttctccgacgagaagaaaagtcgtgcagtcctcaaattatcccaacacgattgatatttgttcatttctaatagattcttgattagtttttgggacaattgcttatttgaccctattttaaagcccaactaccaatttgaccttactttttcaggtttgcttatttgaccctcttttttgaaattgaagtttccgtttgactctgtttagacttcaccgttggaacaacatttagaaaaaagaaaaaaaaaacatactaccccaaagtgacaaaaatacccccatattactaattaaccctatccccacctctccatcccaaattcccaatccccacatcttcagtttttagtcgccggcgatggcgagtgctgcggccgacggaggaagcggtggcatcggcgcgcaggaggaaggagcggtgtcggcggcagctgccgtgcttgaagcggacagagggagcggcggcgccggtggctgccgggctcggagcagagggagggagtggcgacggtggcgcgagggccctcctcatcgccgacccaacgcttccccttgttaacgaccaaatttggtaatatcagcatcggaaaagaggattagatcgaagtggagtcgaaggcggagatcgattcgagaatagagcaagaatcggctggagtccagatcggctacgattaggatcggctggatccgagtcggactgagtaagttgatatagccgattctgataatacgacttggtatacgatatcaggttgaattaagatgcttcaagatggttgccgcacatggatagagtcttgagaaggcaattgtatctattaattaggacattttatgtaatttccttagagatatgtttagggaaaaagtctgccgcaaagacttatggtatcttagagtttgttagagataagagtcgtgtccgatatggacatagtttgtaattttcgggtataaatagaccccgaactatcacgcccagaaattcccgaatagaattctaagtagaatgtgcattaaaatccccgtccattaccggccggggtacacaaacgacaaagttaacatatagatccacgtcttacaaatattataaaagtcttacataaatgcagcggaaaattaaaagataactggagctaagccttgacttggactgcagcgggaacaccactccacaggcattctcgacggcacggacgaagcctactcctcagagaaaccaccatctgatgcatactcaaactctgggggtttggggaaaataaagcaagactaagtacaaccaccgtactcagcaagtcataccggaacagggggtatgatgcaggatattaccaaaggatagctagagaggttcttttgtataaagcgagcatttataaacagtagttgaaagcaggaaaatcaggtgtaataattaatcaatattaaccatccactgtccaacgctataccacgttgcaacaggcccaaccaaccacctgaactaatcagttccatcagactaaactagggtgagactaatcacggtgaatctcgttgaccgcccataactgcggacacggctattcgaatagttttactctgatcagaggtgtacaactgtacccacaagacacagccccacgacatgtttccatacgccgacatgccaccacgacataccggaaagaggccgtgacaggactcttcgcataaccccatctagccaagcacaccacacctcaggtttcacccccgtccccagcgggcaacgggcagtcccctctcgtgcctaggagaatccggaagcaacagaggccgtcgcagggcccgcccggctccatcacgcccacccttgcctggatgcgtcagctagaggaaagctacactacaagcccagccgttgcccacgctagcttgtgataagtacgtggaattcttccaggggtttcccgcgaaccgatccttaagtgccatgggcgcgaccatcgaagccaagcacccacagcccatcgtttaatatattttaattaaccagcaccggagcggtggtattaaccaacatcattactagaatcagatatctatgctttaatgtattttccccactgtgtgctagttgaactaagcatggctaagcaatccctagtctaatatcaagtcatgttatatccccaagctaacaacggagcatgatacaaaactagtatggctgtaacagtaggtaaacatcccatggtgacattataaaacgatgcagcatttaaagtaaaacggtagagcatttgtaatataggatcaacatgttcaagtgacaagcatgacttgctttgctctactgctggaggaacctcggcgactatttcaaagtacaccggagcatccggagagccggaatctaagcgacatacaaagcaaacaatacaaacaggctataagactactgaaacaaagaacaaaaccatttttaatggattcttcacattcttcttgatttactgagacttgaatgggcttaaacggagctcggatgaattagatatgaattttagaagattcaatgtgcttttactataaacagaaaaatccttaattgatttattgcgtaataaataaaatcccggggagagagagggtggcgccgacatgcgggccccacatggcagtgactcggggagggcggtccacggtggaccgtgtccatggaccggggaggagcggcgcaccacgtggtgcacacgtggtgccgacgcggcgcacacgcggcggccacgtggcagccacgcgggcagccggaccgatggccccgatatacccggcggcagggagctcgcggccagcgcgcgcgggctgctcaagccgacccggggccatggcgcggcggcggcgcggcaccggcggcaaccagcggacagcggtggcgattcggcagacggcgacggcgcgacgatggctaagcggcggcgctactagggaaaagagaggaggaagaaggaaggggaaggagggatgtcctcaccgaaggggtccgaccggcctggagggagacgacggtgaccggcgacgaggaatgacagagggaggtcgacaagcggcggacggggtctgggacgacctaaggaacgaaatggagaggattagtgagggagagagaccatagagggcgggaatgccggccgaagacggcggccatggcgtttcttaccggcgcacgacggggatgaggctccggcggctaacctcgacggaggaggggtggacgaggtggacctcggccgcgcgaacccaacggtggcgatggcgcggtgcggcggcggccctagcagcggctagaggcggccggagtagaggaagaggcggcggctggtgggtgcacggtgcgggagcgatggagagctctggagaggccggcgcaaaaaggaaaaatgagaaggacgcggggatggattatataggggcggagaggtcgggaacggcctggagtggcccgatttcgccggccgacgtggggaggtggaggtggagagagaggcgggattcgaaattcgaatctcggccatctcgggggcgcgggcgagcgggagagggggttgaggggtgcgggaggggcggacgcacacgcgggtgtggccgacgtggcgcggggaaggcgggcgcgggcggttgcgaggcggcggctgcagacggtgggcggccaaaggttagggatgggcctaacaggtgggccctacctgtcagcgcccgagggagaggggaggctcgggcgagcggatgggctgtggccttcggtcggcccagcaacggcgcgggaggtggaggaaatgggccggcggcccatttgggaaaaaggaggggacaaaggaagaagaaaaaaagaaaagaatttccaaggattaaataatgctggtgctcatttttaattggttaaaattatttctagagctctaaaaattccactaaaaatcttgttagcatatttcgacatatagaactcaagaaaaatcccacatgccaattccgattattatttgcattaatttattagggtttgtcttgctttgacaccggtattttctctaggtgatttataattttcatttaggcttgggaaagaaacttcagggtgtgacacgaaccccatgtaatcagttaacacactcgttcaatacaatttcggtgcatcaccacccttttgcttttgttttatttcgacgagtccttgctttcgggttgagctgcatcggtttcgatcttcaacaagaggtaaaacttgttatgatggcttgcgttctcgggattagtgcttccatctttatgatactctaatcatgtttatgtaattcatcgagttatcatatatcttacataatctctggcaatatcattatctaacctacaatcgactaacatctgtcagtagagggcagccgattaggttagattttgatgttgatttagattatataagatctccaccactctatgaaacttccagcggcttgattgtctagatattgttcttcttttcatacttaatgctgcatcacttgagtttgatctattaagtcgtgcttagaatatcagtctctagcctgccttctagttgccgattagggtagtattggagtttcagccgatcttatctggtttaactacatttgctctatatgcttcgttgacatgttaaatctgccctttatgtcaagatattattgcatctacgtatattaaactttggtttggtatattctgcttgttttaatatcttaacatagaactgtatcagagtattagccgatacatgctagatctatctgatcagctatgctgtaaacatatatagttcggttattaatatatatttcgatctaagtgatttatattgtctcggcatagcgaccgatctatcccaatcacttgatttaaatatatatcgatgtaaaaattatatattgttaatatctacagccgatcgaatagatttagtcctttattatctatttccagctgccgatcaaatcgactggtacgctagcatacccgaaggcgagttttggacctgcactggagttaaacagatctcccaggcctcgtgttttacgtcaacactcttttggcatgcccgatgggaccgataagaagtcagacaagcaattccttctcatggccgagaaaccaccgctatcaccatcttcggctagttcaggcactgtcaaggagaagatccagaagttaggtttgaccgacgtcaatgaagggaacgtcgtacccatcgatccagaaaaattcacacctgatcaaaagaaagattttgaagcgatgatgcaggcagcacgtgatcaattcttgaactcattcatgcagactcgcaaggggacacttgttcagaagtataaaataaaggtggttcttgacgatcccgagactggttcctctaaggatggagaaggaaaacaaactcaagatggctcggctcaactgaatgacaaaggtgctacagatggttttccaccaaatcaaggtgacaactctcaaggggtacatggggttcaaggtgatggttttagggggttcaaggtgatggttcacagggagttcaaggtggaggtgttaatcaagacgacaatgcaacgcagttgcagttcaacaacattcaagatcaggttgactatgctgtaagtcacgcccggaaattcactagtaatttccaaacttatttgtgcataaaatcctcgtccaggaatcagccgaggtacacaaactgacaatttaatatacaaatccatcttaataataatgttacacgcttacaaaagaaaagaaaatagcagcggaataacggtctagcgatggcttcagctccaatcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaatagcacacccatgctgcacaggcccaaccatcctgaacaaccatacccggctgtacagatctaactccaaaccaggagctaaacaaattattaccagatatagtatccataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtgcccgaatagaggctgtgacaataccctctgcacaacacaactcaccacaatgcaccattcctggatcataatcacccccttataaaacaaggcatggcctccccagcgacccccgtgggcttatctccgccacttctcagtctggtgctccgcaatgaatcatattatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtggcttgccttgcaataatcggtcttcaattaatcttcttgaatacctccagcacactcgcgaaccttcgcaacgacggaaacgacaagctaacacgcaaaacgaagaaaaagactaataaaaaccaaataaacagtaatataaagtaaacaaacatgtagatcatgattttagatgaattatgagacttgaacggcctcattctgacttcaaatgaatttattacgaattttacaagattaaatctaattaaagcccatttaaaaagaattaaataaatttaattctatttatggataattttaatatgtagatctttattttacacaacctttgcaacttgaaccacattaaactgagttacaaagaattagttatgaatttttaaagattaaatcggattaaaacatttatatagattttaattgaattatgacgcaataatgaattatttttgaaaaggaaaagaggattattgcgtcaacgggctcgggttcacggtggaccgggtgcacggcggcggctcacggaaacgaacggccgagatctaccctatccacaacgaacggccaagatctaaacggtctacgaccggtctatggcggacggcaacgatgacgtcagcgatgacgtcatcaccggcgacggctcgggcggcgcatgctcgccggcgaacgatggcgcgacgacgcaaacggaggacaccaacgggtagagggtgacgcggcgaactcaccggtgaccaaaacaacggcggaagagcaacagacggcgccggcgacgaggaagaagcggcgacggtcttcgggtcgacggtgacggcggcgctccggcggtcttcggcggcggcgaagcggtggacggggatggcgacgacctcgcgatcccgatggtggcgacggcgaccgacgacggcggctgcaacggcggcgcggcgcggctgaaccgatggcaacgacggcgacggctagggctacgcggaggcggtgctagacgcgacggcgggctaaggcaaaggtggcggcggatagaggagagctcgggggtgcttataaaggggctagcgagcggcgatggaggccctcggcgatcggcggcgagaaggaaagctagggttctgaggagagaagtcgatccaaatcgaactcgaatccttggatttccaaacgaaagtagccgacgattccataagagaaaaggaagcggagatcgagaagatcattttccctctattgatttcaccggatcgggaaaggatagaccggattggaaagcggcggcggcgcggctcggctagggttcggccgggcgacggctggaggaggaagacaagtccgacaggtgggacccacctatcagcgactgagagagaggaggaaggagcgcggcgggctgcggctcggctgcgggccgacttgggccggggaggagagagagagcggttttgggccggctttcggcccaaagccaaaagagacttttaaaaacctttttcaatttaaattattcatgaaatgatattccattgattaaaaatacttccttggctcaaataaatcctagaaaaatctaggaactatagaatcaagtaaagtatttaatgaaattttatctggccccattttatattggaatttattaattaaaattagatcttctcttttaggcttttaagatcatttctaataattccttttaaacaacaatttataatttaaggatttttaaacaagaaaagctcttaacaattataattagatcattaatgatcaaataattactgaactgttctttgtatcatttaggaattgagctccgaaaaatccgagaaaatttcagagagtatacttaatcatggagaatttaataaaaattaaatccatccatgctttatatttaggaaattttattttccacatttaacttcacttgtaaattaaagaacatttaatataaattctaataataatttattaaataatttataaatcctgaaacaaaaatcaggatgtgacactgtacaccatgctttgatcaatcaatctgagaaatatggtgaagtcaatgattgatggttcaatggccgagtatcaggttacaggaccagtttacctacaaggaggggtgttcccgaattatcggccgttaatcaccgataatctaccagtcgccagtcagtccctcttaatgcaccatcagctcagccgacgataccagcatcggctcccgcacctactgcaccaccttcagccccaggccaattaattaatccccgattgttggtgagagaacagccacagcacactggacagaatgtgaatcggctaacgcaagaccaggttgcatctatgttcttacgtcctcaacacaccattgatccagcccagcagcagccgattcagcagacactaccaaggcagcaggttgtgcaaccagttcagcaaacacctccaatccaacatgttgtgcaactagttcagccaaacacctccaatccaacaggttgtgcaaccagttcagcagacgccaccaagacgacaggtcttgcagctgattcagcagacactgttgaggcaacaggttgtccagccgattcagcagcaaggtccgatgaatgcatcggctgggtttgcaacacctggtggtcaacccatgcagcatgccgcaaatcaggttgtcccagaacacttggttcatcatgtgcagccagatggcacggttgttcctcaagttattcctgaacatttggtgtgcaatattcagccagaccttcaaaattaccaggggggcaacttgaattatcaatatcacccaccatcacctcatgttcagtaccagcaagcaggatcggctcagccccaatttgttcctcaatacaatcaatttgagcctatgccacaacaacttcaaggaacacctcaacagcggccatgggccgatttgattgtagatgtcatgaaggagcagttcgggcttaggccgaaagacgctggaaacctatatcgacagccatatcctgaatagtttgagagagttcctctgcctaaccgatttaaagtttcagatttttcaaagttctcagggcaagatagtacatcaacttatgagcacattagccgatttttagctcaatgcggtgaagcatcggctgtagatgccttgagggttcggttattccggttgtctttggctggatcggcctttacttggttttcttctttaccgtatggatcaattaatagttgggctaatttagaaaagcagtttcatagctatttctatagtgggattcatgagatgaaattgtctgatctaacatcgatcaagcaaaagcatgatgaaccagtgcatgagtatattcagagattcagggagatgggaaataagtgttacagcttgagtttgactgatgcccagttagccgatttggctttttagggtatgattgctctaattaaggagaagttctcatatgaagactttgaaagcttgtcacaccttacacagaaggtagccttgcatgaacaaaggtatgcagaggctaggaaaaattctagaaaggttaatcatgtttgcccttatatatatggatcggacgatgaggatgatgattatgagatagctgcagctgagtgggtaaggagtaaaaaggttataccatgccaatgggtaaagagctcaggaaaaaaggagaggtatgactttgatatcactaaggctgacaaaattttcgacttgctactccgagagaagcagattcaacttcctgccagtcacacaattccatcggctgaagaattaggtaagaaaaggtattgcaagtggcataattctgggtctcatatgactaatgattgcaaggtcttcaggcagcagatccaagcggctatcgaaggaggcaaaatcaagtttgatgactctaagaggccgatgaaggttgatggcaatccttttcctgttaatatggtgcatacagctggccgaacagccgatcggggtcgtgcaaggggttttcaggtgaattcggctaagattatcaacaaatatcagaggaagtatgacaagcagcaggagaagcatcatgaagaagacgacgatggctttgatcctcattgggttgtgagttctttagatgttgttggaatgaaggtatgaggttgcaatctattgaagactgtcctaggtgcggtgatattgccgagagctcaagccgatcatatagtaggggcaatcggctaaggcagacaagagttcctgttcatcaaagattgggtccagtgaatcaagatcgtggctaagaggacaatgaaaacaagaaaaatcaatggtgtccttctggtatctttacgaagaatcaaaagagaagggttcaaagattgaggaacagggagcgctttcaggaggtcgagcaggaaattaaccatttgctgaagaaaacgaagccgaggcgggtgtggcgtgttaagaatcaggttcctgtagccgatgaagccacagctgatgaagcaaaaaggttagctaaaggaaaaagcgtcgtaactgcttcggtcaacatggttttcactttgcctgccgagtttgggatcaagtaagccgatatcgatgaagttgaagaagaatcggctaaattgattttgtcgccagggcaggtagtttttgagaagccagaggggacagagaattgacatcttcagccattgtatataaatggttatgtcaatgggaagccgatgtccaagatgatggtcgacggtggggctacaatgaacttgatgccttacgctacattcagaaagttgggcagaaacgctgaagatctcatcaagacaaacatggtgcttaaagactttggcggcaatccatcagaaaccgaaggagttttgaacgtggaactgacagtcggcaacaaaaccatccccacaacattttttgtcattgatgggaagggttcttatagcttgttgtttggaagggatgggattcatgctaattgttgcattccttcaactatgcatcaatgcttgattcagtggcaaggcgacaagattgaaattgtgccagccgacaggtcagtcaatgttacacgtgccgatttagctctttgggagatggatggtcttgattgtttatctggaaaagtttgggatggagattttctaaaagtgtccgattctgatatacagccaattgaagatggagagcccaagctattattttgagggcgccgtggaggattcacatgtctacaacaaggacacggtagatgatctcgatgacaaacaagggtagggttttatgtcggctgatgatttggaagaaattgatataggtctaggtgaccgaccaaggccgacgtttattagtaaaaatttatctgcagaatttagaaccaagttgatagagctgttaaaagaattcagagattgcttcgcttgggagtattatgatcaaatctttatggctgaagaagatattcataagacaactttcaggtgtcctggtgcaatcggcttgttcatatgggttgtgatgactttcggcttgaagagtgctggagctacatatcaaagagccatgaattacatataccatgatctaatcggctggttggttgaggtttacattgatgatgtggttattaagtctaaagaaatagaggaccacatagccgatttgaggaaggttttcgagagaaccagaaaatatggcctgaagatgaatccgacaaaatgtgcttttggcgtatcggctggccagtttttgggatttcttgttcacgagagggggatcgaggtgactcagaggagtgttaatgcgatcaagaagattcagcctccagagaacaagacagagctgcaagagatgatcggcaagataaattttgttagaagatttattactaatttatccggtaggttagagcctttcacaccattgttcaggttgaaagccgatcagcagtttacttggggggcagagcagcagaaagctttggataatattaaggaatatcttagttctcctcccgttttaattcctccatagaaaggaataccttttagattgtatctatctgccggtgagaagtcaatcggctcagtcttgattcaggagctatattgaaaggaatgagttgtattctatcttagtcgtcggctcttggatgctgaaactagatatttccctgtcgagaagttatgcttgtgcctatatttttcatgtacaagattgaggcattatctactatccaatgagtgtactgtcatatgcaaggctggtgttgtcaaatagatgttatcggctccaattttgaaaggaagggttggaaagtagatattctctttaactgagtttgatcttcggtatgagtcgccgaaggcaattaagggacaagctatagccgattttattgtggaacatcctgatgattcaatcggctcggtcgagattgtgccatggactttattctttgataggtcggtatgtactaatggttgtggcattggcttggttataatttcccctcgaggggcatgtttcgagtttgcttatactattaaaccttatgcgactaataatcaagctgagtatgaggcggtgctcaaagggttgtaattactcaaggtagttgaagccgatgctattgaaatcatgggggattctttgcttgtaatcagtcaattggcaggagaatatgaatgcaagaatgatacattaatggtttataatgagaagtgccaagaactgatgaaggaatttcggctggttactttaaagcatgtgtctcgagaacaaaatattgaacctaatgatttggcccagggggcatcgaggtataagccgatgatcaaagatgctaaggttgaaattgcagcaataacagccgatgattggaggtatgatgtgcatcaatatttacataatccatctcaatcggcttctaggaaattgagatataaggcgttgaagtacagtctattggatgatgagctttactatcggacgattgatggggtgttgcttaagtgtttgagtaccgatcaggctaaagttgcaatcggcgaagttcatgaaggaatttgtggtactcatcaatcggctcataagatgaagtggttacttcggcgtgcagggtatttttggctgacaatgctggaagattgtttcagatattacaaagggtgtcaagattgtcagaagtttggagcaattcagcgagtgccggcgtcggctatgaatcctattattaagccatggccattcaaaggttgagccattgatatgatcgatatgaaagtccaccatcgagtaaaggacataagtttatattggtggcgaccgattatttcaccaagtgggtagaggcgattcctttaaagaaagttgattctggggatgcaattcagtttgttcaagagcatataatctaccagttttgtattcctcaaactattacaaccgatcgaggcttaattttcgtgtccgatgagtttgttcagtttgctgatagcatgggtatcaaattgttgaattcttccccatattatgcacaagctaatgggcaagctgaggcatctaacaagagcctgatcaaattgattaagaagaaaatttctgattatcctcggcaatggcatactcggttgccgaagcattgtggtcttatcggtaggcgtgtcatggatcgatccaagtccctccttataaacttgtttatggacatgaggctgttttgccatgggaagttagaatcggctctagaagaacggaattgcaaaatactttaacagcagatgaatattacaaccttatggccgatgagagggaggatctagtctagtcgcgattgcgagctcttgcaaaagttaccaaggataagaagcgtgttgctcggcattacaataagaaagtagtacccaaagatttttcggagggggaacttgtatggaagttgattttgccgattggaactcgggataacaaattcagtaagtagtcggcgaattgggaaggaccgtttcaaatttataaagttgtgtctaaaggagcttacatgttgcaaggactcgatggagaagtttatggcagagcactaaatggcaaatatttgaagaaatattacccaagtgtttgggttaatgcatgatcggctgttgttgccgatacatgatagccgatgtattttcatcgtcttgagatggccgatattgttatatcgcccttagtcggtttttcaaattgtaatcggttatggtttgccgatatacaatggccgatattgttatatcacccttagttgtttttgtaattttatcaatgctattaacattataaaattagggggggcacatatgtacaaaaatgaaagtgaaaatttttgagcaaaatcagaagttatgttaatcggcacaaaggattgttaaaacaacagagtattaaggtatcttagccgattacaaaaatttctaggtcctattacacaaaagttattgagacaagtacagctggatagccgaaatagccctttgcgtaatttgttcgacttcttcaatggcttgggcatcttgagcatcagttccaggaatgatcttcaaagacttggtcagatcagcaacattcttgatagcctatttaagtcttgctttttgctcttcgacggaccgcgggagatcggctagtttcttgtgctccagatctaacttggcgttgcattcctgaagttgtgccagtagctcaatcttgcgagcctcgagccgatcaatgttggatttgatcggaccctccgaaagctgatcaagtttggatttctcctcatgcacaagctgacgattggcttgaattgtggcctcaatatccttgcgctcccgacgttcggctagtcttaacttggccttttccagcttgaattgatgttgctcaagatagacccctggagtaaggatgtcggctagctcatctaggattagagcttggatctcaagtagccgagtcctaattggcccacagtttaccaccaagttatctaatgatgatgcttccagccgatgacagatatcttcaagtgtcttcttcacatcatcggataagggagctagagctttgcttgaagtatcttcttctgtctcatcaagataatctctgatatcaaaggagaaaagatcggctaaagcctgcagagacaatttcggagagaataagagctaggtaaaatatagccgatctaatttcttgtatcgaaggaaaaatactgggatagcaggagcagctggttgttcttcctcaatgtgttgacttcccacagccgatggagttcggtcacttgacgattgctggacggaaggagaaggaggaggaggaggctgtaaaataaacgagtgttatataaaatcggctgggatcaactaattaaaatcgagactatcttattggtggagctggtttagatgttgctgcagccgatttcttcttcatagcaatcttgttttctgtaattacaaaatttgtgagtaatcggccataaagtaaaatgattacaaaagggatcaagaagagttgcttactcttgtgaaatgagtgcgagcagaaggagttggtgatgtctgcttgggtgaagttgatggtgttctttctatgtcactcacttcaactgcagcctgatcaacatcttcaccaatttcctcttcatctagagcttgttcgatggatggatctaaggcaggcagatcatcagtcggcttatcagtcgggttagttttcttggacttggcctttttctttggagctaaggccaaagtacccatagccgatgatctagtttttcttttcttgcctgcatcggctggttccctgaataggccgtgatggagagttgaagtctttggggcatggtagtcaataacaggggggatggtccacctccattaggaatcagacctggagcatattcaatgtcactgccactgttgctttggtgcggaggggaagagtcgatcccctgcaaaacaagaacaaaagattagtcaagtgacgaatcggctaaccatcattcaagttaataatgacaaggtttacctggggtatgacatcagggaataggtctgtcatatacatcgaagtcgattgatgaaaacaggtgcagcttccattcaccccaccatctgtcgaagtttctgctcttgaatcccgccaactcaatgttgtcaatgctgcctagagggggtcctgggaggttaagcagccgatccatcatcagcgttgatgtgatttctcctcggcactggatcttgtcggcaaagaataagccgattgggagttggcctaatccaagttgtctagccgagctcattgggtgataaaactcataggaaacttggatatttcttcttgatgaatgccgacaggaaggatgcatgggctgattgcagctgtaagaatttctctggatttttgatacttttcatgattgatatcttcaaatctaaagtctgatggaagttcaagatctactgagtcttcataaggaaaccaaactcgggcgtctttcttaaagccttcatagaagctgcagaaccaatccttgagcagctcggccgatagctttgctccagcatcggttggtgtggacgcatattccccatatgatgtgcatctgcgatgagtgtgttcttgtccatcatctcctacaatcggctctggcaatgggaactcagcttctgtcacagatggccgattgacgactttcatgaccattaggttcaaccaggtttgcagcagccaccatggtccacctgcaccgactactgagctgacggctatcttggccgatgcattgttcaatgtttgttataagtagccgaggaggatcttgctaagggaaattctttctttgattctaaggcttcggctacaaattgtcagttggttgtagggccacaactggatccacaaaagagaaatttttcgaggcacattagcaagaaggctacatgctctcgaggagtaacagacccttgacccatatatgctgctacatagccagaccaaccacctatgctttttgtcctgaagtcgaattgattcttggtgttcatgctcatgggattagccgatgaagtcacatccaaaccagtgatcatggtgatatcgatcaaagttggagtcatcggcccttggttgaacaagaaggcattgagggtgttggaccaaaaataggtggcggcagccatcagaggttcatccttagcagaattggctatggtgagagcaagcgcttggccgatcccaatctcatcccagtgaactttcttactagccgatacgtgctggtaccaggtggtccaactcttctcaggggtggttttctcaagagatggccaagatttgaaagtattcttccagtgacccagattagggttggttagttgtcacgtcccaaaacgactctaaaatacatcctctaaattaagcctagaataattaaaatccgtgtgaaagcctccaacaattaaaatgtgcaaagttaaaagtcaaataaggcttagaggatttttgtatatttcctaaaagcctaaaatgtgtacataaattttagtggaattttcagagcacaaataataattaagaagaaataaagaaagttaaaatgattttataaaaagaaaaaccataaaatccctccttctctctaatgggccgaattcggcccatctccctccccctctttctcctcttcccgcggcccattcggcctccctcctcgcgcgcgcgccgctgacgggcgggcccacccgccaccctcgctgacgggtggggcccacccgtcatccccttcctcccgccgctcctgccgccgccgccgccgaatccgccgcatcccgtcgtccccgcgtgcaatcaataggggggaattattccccgtgattccctctccctttcccctcaattttccctccctctctcccttggattcgtttggaaatcctcccctaatcccgccgacgccattgatggaacccgagaacgccgcgctggtttccttcccctccggccgctctctcccccttccaaccctatttaaaccctccccgcacctcctccgtccgtttccgcctctcaccgcccttcctcctcgccggaatcgagctcgcgccgtcgctctctctctcctccgttgctgacgacctccggccggctttctccgctcgccgggaccgtctcccgcctcagcgctgcctccttcggcttcgccgcatcctcgccgacttcgtccacctctccgtttcggtcgccgaccaccggagctccgccgtccccgacaacccgagccgcgccaccgcctccctctgctccggccgcctcctccgtcgccgccgtcgccccggggtgagccgtggaccgtcgcctcctttcccccttccctcccctctctcggccgccgctccgccgcgtctatggccgccgccggcgaccatcggggcgcgggcgcgccgcctcccgccgaccgcgccggcgtggccgccctcgtgcgcgccgagtggctgccgcgtggggcccggccgtcagccgcccgcgccctcgggtgcggctgacgcgtggggcccacggcgccggccggtgtgagcccgggtgcacccggtccaccgtggaccgtgaggctgccacgtgggccccactcccgtggacccggtccgcgcgcccctccccctcggctgatgcaataaacccctttttaaattaaaatttaaatgaagaaattcgcaaatattcatttaaatagcatataaacttcaaatggccataacttggccatttgaactcggaattggaccgttcaagtctctaatttttccttaagaagtcaagaacccatttttgtgctttgttcctacttgttatgtggagtttgttagagtaaaagccttttcttttccgttggtcgtgtagacgctgcagcttcggaagatccgctcttcgtggaggttgaagccgacgtttgggaaagtgagcaaggcaagtcacatcatccttgagcatattgaatcccagtttataaaattattttgatttaaattattgcattatcgctttacttaaattcccgcgttatcactgttttatctagccatgcctatttacctttgttatgaccttattattgttattgttattattaccttgttcaccctagaataaacaaaaccccaactagtggacactctactcgtggtaccactagtatgaatttaggtagatgcttcgccgcttaattaggtaacattaggtggttttacaactctagactttgggatattcatatcacctggacactatggaatggttggattattgtggaattggattcacacctccccctctattcaaaatcctcaaaatggttttaggttgggctcggggtgcatggttttgatagtagcacctcggccatataaggactggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcatagggccggtgtcctgctgataggggctcagtcctgcctacctgtcccaggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataacctattcgaatagccgcgccctcggttataggcaagccgagcaatgtacccaagttagtgtttttatttttaaaacctggttaaccactgaaatgtggaaatagttggcctgggttagcttgggacgagctgggaaccagggtcgagttgccagttcggtctgaatcatcgtaggggtaccgagctcgaattcgccctatagt

SEQ ID NO: 65588 - DNA, 10630 bp, Oryza sativa
tcaaaaccgccgagagagttaaattgcaccggttttaagagtttgggggtcgagatacctggtttcgtggtttagaatcatgaattagatttcgattacttttaagggtcacaaagcgaacttattccaattctggttgatccaacaaagctacagctttgacataagctgatgtcatgcatacaatgattacaatagacaatatctgagagtttagataatcatacctatttaggctagaattatatttcctgttacatacgaaagatgacaactgacaagggaacaagctcatacggccctgtttagttttaaagtttttttttccaaactttcaactttccatcgcatcaaatttttcatacacacaacttttcagtcacatcgttccaatttcaaccaaacttctaaacttcagtgtgaactaaacacaaccgtagtagattcagcaatcagcatatgctatctgctctagaacattgtttttttctcattagcgctttttttgggagtataggtgtttctttattcttcctattaaactttaccagcataaaggagttcctaaatttggaagctgggaggatgaagaccgtggtgaacacctctacacacagtatttcgaaaatgcccgcaagggtaaatctcaaggaggtctgttaatccaaacaatcatggagatgcggaaacacgctctaaggcctctccagcagtgagaaaacccaaggatgacagacgctcaaaccgagaagacgatcttcgtcagcacgaaaccactgttcgaaaaccatatgctgagtcacctaatcatagatatagggatcataccaactacgacaatgccgtgagaaaaaccggcatagagaagtcacccgttcataagttcattggaaggaaaccgtggatctgctcccactacacctggaaggtccaagttcagatcaactggccgtggtgatgagacggtaaagctctaacttacgatgcatggaacttcctccgtttctaaatatttaacgccgttaaaatttttttaatgtgtttaaccgttcatcttatttaaaaaatttaagtaactattaattattttcctattatttgattcattgttaaatatacttatatgtattagaactactgttgggagcgctgtgcgctcttatattccaagcgccaaacgtgtatcagccaggcccacctcaccccacgttccatcatctcgctcccaccgttatcggagtaagcgatttacttcgataaaaacttatctggttacaatcccaccccacgccctgtcatcccactcataccattatctgagtaaacgatttacttcgataataaaaacaactttcctttcgatcccaccccatgtcccgcatcgtgctcccaccattatcggagtaaataatttactccgataaaaacaacttctctacttctagtatatattttatttttcccgtacccaaccaaccactctcgcccccacttcatttttttttccggatctcaatcgatccaccatcccagcccacagataggcgacgcaccatggaggaggacgacgacaccgtggcagttgatggcggtggccggcgagtggtgggcggcggcgcttgaggcgaaggcactgcttcaggcctcgctgccgcagcatctacttcagatcgatgctgaagagacgtctggcccatggcgaacaaggtggatgtcgtggggatggtgagttctctcagcaattcctaatgagattcttgatttcttgcgagaattgtatacaatctatgattaattaaattctttatccttcttgattctatgcagtctgacttcgattgggttgagcactcatcttggcgtgcttctctattctcccttacatggcggagatcctgtttgtgatggtcaatcgatttggtaacatcggtaagaaactgtgatttgtttcatcacctctatcgttgcccagtttatgacagtgaggcgatgacaatagcaacgacgacctccatctttggctccgtcgacggatccggctcctaccgaggtcgcagcggccaaacttggttctacctcggctccagcctgcatctccgccgcattgtcttcttgctctctctagtaggacagaaactccattcagccgtcacgaggaactggcgatggcgtgtattgttgtgtttgtgtgtaaaatttttattcttatgcttttactatgatgtgcatgtaaaatctttattttttgtcccgtgttttaggatggagtgattcattgtataaataaaaaatttattcacgtattatttggggtaaactaattaggccccagtaactccctctttatttatttttcctttttttcttgatgcacttactataagaaatcgttaaccaagactagcaataatgcaattactacaagttaatgcaccatcaattttcatttacatcgacagtatcaaccaatgttgttcataatccaactactacaagcacatgcaccatcaattttcatttatgtcgacagtaactcgattactacaagatttcaccaagtatggttgtcgttaatccaattactacaggcacatgcaccatcaattttcatttacatcgacagtaattcgattactacaagatttggtctcagtttgtattgcacaccatatcgtaactacctcgattggaaacaaagataaaccaattacagcgattattttcaaccaaccaccgattttacggatctgtaattgatttaccccgaattcaaatataactaatctacacagatcgaacgtgggcaaccgaacaccagtttttacggactctaggcacgatgtgcggcgctcggaacaatattccgcgctctagcgctcggaatagcgctaccgtatatgtatacatatagttttacatatttcacaaaaatttttgaataagacgaacggtcaaacatgtgataaaaagtcaatgatgtcaaatatttagaaacggatggagtattaagtaagagttttttttaccgtccagcagtgaagcccggtaccaaatgtggaccgttggataggtatgatcggatggctgacatcaattggtaccttcaggtaccatttacttcctacgtggtactccctccattccaaatatatctacatatttgtgctcattcattaagtctattcgttatttgtgcattggagtaaatggacattgatgcatgcatccatgcacacacaagtatttataacccacatgcaatatcttgagaaacactcaggggtcttccggctagctccacaaggtggtggctagacgaccttggtttgaagcctcaccctttctaattatttgatattaggtcattccctaatattcgcggtttttacatgcaatatcttgatttgctattggctagaaaatagtggggatggtgcgtgcatcgagtttgttgctagagtaaatatagaatgagagagttattagtttttttttgtcttggtgtacttgtgaaatatgtaggtgaatttggaatagaggaatagagggagtacctgtcaaaggggaacaaggtggaggggtaaaattgtatttgcacattggaaaggagcttcgtcgatttgatccgtgttttggataaggctttgcagaggaaaatctgcggcagtggcggcgagccgacgacgcttcaggaattgcggtgcgctccaccagtcttctgcggccacaacggtgctccaggagttgttgtcagcggcgacgacggcggcattccaggagttatcggcagcgatggcggcgctccaggaatcatctgcagctgcggcggcagcgctccaataattgtcttcggcgacgacggcagcactccacgagtcattgctagtgacgacgatggttgatttggctgaacgacttttgagcatgaaagatacatacaagaataaattgagaagcaggaagttccccgcaaagaaaaaaaaaaaagagaagcatgaagttgatttgcctaaatggcttcaggttgatttgtcagacatacacaaaatcgatactcatacgaaaagctccaacacaacctccgttgcagaacatgtatgtttagatggggctaaaatttttttaagcccatgtcatatcggatgtttggacgctaatttagagtattaaacatagactaataaaaaaactaatttcataaatgagagctaatttgcgagacgaattttttaagcctaattaatctataattatcaaaagtttactgtagcatcacattattataattatggcgtaattagactcaaaacatttatctcgcgaattagtccaatgttatgaaatgggttttgtaattagtgtatgtttaatactctaaattagtgtcgaaacattcgacgtgacagggactttgaataagtccatggaaaccaaacaactacgcttgcggcgacaaagtccggtgcgtcagatacatgttgcagcagcgtcggccatcgggcgcactgtcgttgccgccagagcaaggacacgctggggctgggggaggacaggcggcagcgacggaggttgaattaggaaaagaaaaaaggcaaaatttgaattttcaagcttaattttgagatatttttaacgtaattctttttcaacattggcttttaagtcaccaagaacacatttaaaaaagttttacctacaaattcagttttatttcctaataagcctgacggagcgtgtgggctcctcaccgggagaccgcgcaggcccccctttgccggttcggccgggggcgctgagtgagattcttcaccctcgatctgtggaatgttcgcgagagaggtaatgcacaagacacgggcgatgtagacaggttcgggccgctgagaagcgtaataccctactcctgtgttctggtggatctgtgagtgaaggagttacaaagagctggagaggaagagagttcaagctctagaaaccctcttcctttgtctctcctctacaagctcagatgttctctcagttctaagctcagatgttctctcagttctcccctccttcccctctgtttctggatcctccctttgctcttctcccctgttttttttttcatcctcctcttaggtgggcaaggtcctccttttatatttcaaggggataccacatgtaccacttctacctactcttcttttgggtggggacccaccctatcttgaccaaatcttgactcgcgcctccgcctggaagctaaatcaccgcttgtccttgagtgatgcccagcgccgtcactcgtcggacacaggggatcaccctgtcatttcttcattaatgggcggagatttgcaatggccgccgtccgaatgaccctccgatgggatgggtcatacctacctccactccaccggaagcagatgcaacgtgggagcacggttgtctgccgatgacgtgaccggcgtcagtccagtcactgaccggtcattcttctccaccacgcgtcagtttagcatgccgcacatctgctcttcttcatacagtgacttccttgcaatggttgcgatgaagcctggcatgaatcgagccgggactgacgtgctaactccaggagttaccacgccggctccagctagggacgagtgccaagaggctctcatcattccgacgggacggggcgaggcgtgagacaggccgcctgctgccacctaacccgcgatctgaccggtctgcgaccggtcacacactgcgaccggccacggaccggatatgcgtgcgccgcgccgcattaaatgcggcgtggcgcgcttgtccatcccgcaataaatgcggttagatgagcgccgctgtgcccacctaacccacatacgtggcgccaataccacagggggtcggggcgccccagccctcggggccgaaacaggagcggcccgacccctcggggagacagagggaggggtggccacgtcaccctcgggcccgacccccccgagggggtcaggccacgtgggtgaccgcggctgcccaagcctctagtcatgatacccccgatcccatgtcaccgacaaagccgttttggcttattaggaaataagccaaacgaatgggacctgcgacggcagcggccactcagatatgcctgtgaagatgaggagatttagtcgtcgcacgctaactggctgctttatggattcagattgagtgacatagagtagccatgtcacaagatgacatagcgtagatctaaattttaacttgtgatgacgtggacgaatcccagccgttggatttgttttggagagctgagatctatgctatgtcaccttgtgacgatggtcccggcgatccagccgcaacagtggagagaaaggagtgaagggaggcagcgcaagggatgtgaggtaccgccgatccggccgggttcgcgcgacgacgacaacctggagcggtggttgcgcggtggaggagtgacgggggaggggggatggggcaccggcggcctgggtcgcgatggatgccggaggtggcgcgggcgcttgtacgacgggggcgagggggcgacaaatccggaggttggggcggcgtcgatggatggaggcgtcgagggcggtgacagcgggatagggctgctgttcgaggcggcggttggacgaacacggtggtggcagggcaagtggggagcggtggcggcggtgaaggaagggggtgcgggaggaatgatgcgtgagggccagggggaggagcgcgatattgcgggcgcgggcggaggggggcgtcgcgagtttggatgccgaggaagggggcgcagcgatgggggcggatcggaggagtcgcgcgatggttgttttgggttgcgagggcgccggttttttatccatagcatatccgattttctgatctacggtcacgtgtctacgtttttatgttggatcgcgtgtctacgttggcttcatcatcaccactacaatttttttaagcagtagagattacattaaactcttttgatttaacgaaattttcattaagctaattagacgaacaaaccaaatgtgaattttcgtaaacagacgaaaagaacggaaagccaaaaaagatcacgacgtgacagtacatcatgaaatggaagtgctagcagcgtttctcttagtttatcttagatgcatttgtaaatttgccaccgatttttttaattttacaaggatgccacttgaatgatagtttcagtggtattttttgtaattttctagtagcagtcttacaataacgattcaaagcagtgataaatttgcaattgcccctttctcttatggtggagcacaaacgaaatcaaacacattacacatcacagttcacaagaaaagaaaaaggatggaaaaaaacagagctggggcccctatttgctgttcttctggatgcagtctgggactagctttctggttaaagtcaaggccttgggtcggcttcatccttgtagcagctcacaccaccagacgatcgactttactggactttatcttgagaaagggtagctgggtaggtaatacattctacgacgagacacgataaccatcacttgtagttatggtcacgatcctacaatcaaggaagtcatagagagtcagcataaggatagtagctagcatttcatcatttgaaattaatcatcaaagaaagcttactctacaaaccatgatgacaactctcatctggttctgaatctgctacttcaagcacagcagcctaccaattgcatattgatgcgcctttgattctggcaaacaaaaagattagaaaattatagtattggataatatatagtagtagtaggctatagcagtcaagatttacgaaggcataataacaagacaattgaaggaaactacatatactcaactatattcaatggggctgtgaatttccagaaaaatgtcaaggcaagtattgtgttagttctgcaaatttaagctgttgtccatatcagacgcttaaagggaaagaatcatgagtattggttcgaaggaccatggaaaaaaccaccaagggacttcaatcacgactatttttttttcacgagacttcaaccacgactaatacaacaactaaaggatataggttaattgcatgatccaaactagcataatcacagtaatagatcatctaaattcccttgcaggtaccaaaatagcatatctatattttctatatagttgatatgtatccactaactcctaaagttcaacatacaaacgtgtaacattatcacctattaacaattattatctagttatattaaatctcatgcaaacatgacatgttatttataattttgttgcgtttttataactcaatatgcaagcaatgtaaaaaaaacgtgaatattagcccaccacctcgtgtagctagccggaagacccctgggcgtttctcaacatgcaagcaacgtcaaatcatcatctccacaacattttcacattatttaaatatatacatctatcatttctataatacataacatttattcatccacatctcccatagcaaagcgcggaggagacgtaactaaattcctttgtatgcgtttcaaaagtttaaagggaggtgacagctgcacgagtgagttatcaatgtgcattgtactctatgtacatataatcatatggttgccacactcgtaaactttttaccagtgaatcgtactacatttgccttttagggtacaccaaattaagcttctggttattctatagtattaaaagaaacgaagaaactggagattaccttcatagcgggcatctagttttttctcctcgaggtaatccagacgttgctgcaggctcagtggaagcaactctataccagaacaagaatcaattgtaagaaatctaagagatgagtatgcttgaggcccctcgggcaaggatactaggctcttgcaatcaaaaagatcgagttgttccagcgacgggagctctcctaagcaagattctagtgatttcaagctctcgcatgatctgattattaatgctcgaacggcatccagttttcctgaaagggactgaagattttcacatttcaaaatttccaatttcttgatggacggaggaagatggagaacctccaaacgatcacagcgctttattgctagagattctaggcatggaaggatgtgatcgttggtcccactgctggaccctgctattaatgatgacctatccggccgtgtaacactttctgcactcaccaacctcctatcatgctgctgactgaatatgatggacttcaggccaaagcagttcataatttctaatagcttgagagacgcagataagttgggcatctctacaaaagatatgcagtagcttatctctagggactccaaacatggcaagagttcacttcgtactggtgtagattgctcataagcttgtgtgtgtcctgtcagattcctgcattcacgaatctgtaacttcctcaaggaaaccaggccctggaataccttttctggccagtagtcaagtacatcgacacaccaaattgtcagatctaggagctgtacaaaacatgcccacagagccagtgcacttggatgagagaataaaaggttgcacccgtccaagtccataagttccaggggagaattatcattccatttctccttctcatacactaattcactcgaattttgtttggccaccaatgctgtttctgtgtcatcaattgagagatccagattgagactggacattgaagtaatatatctgctagctgccactagggataattgttggctgcctttatatatgtttaagtcacttagctttggtgcttcaggtagagtagtcaactctgggcagcacctgattgttaatttgtcaagctgaggaaatgttacctcctcccttggagtttcattgactgcctcccatctctgaaagacactcaaatcacataatttcatttccttcaatgctggaaatgcagaacgacacacagtgctaactcttccagaagatttcgaaatcgcatttgacgctttgggtaacgcagttagcctatggcaatattcgatgaacaacttctcaacctcaggaaaaaccagttcttctccttgtacctcgtttatgtcccaccatgtcataaaatttctcatatcagacaaggtaagctccttcagtttacaaaatgtaaagggagtgtgttcgtcactgttgaacaaacaatttaaaccatccagtccttcaaggaaaagaacttctagagctggtaactgccacagtggaggaagcatctcgagatttttgcaaccaattaactgaagctccaccatgtaccacagtttattcatccatgttggacatgtactgctcccacagcaatgtatcctcagaaccttgagcccctcgttaggcgtgaggccttccagcacctctttatgattattctgtgcctccttggaatgatttggtgaccaatctaagctcaatttggtcagttttttcttcttcctgagatttgctgctttcgcatctgcttttgtcacattctctagttgtgatagctctagttgaccaccaaggtccaactgccgcagctctcccaaatcactgcagccatagcaagtaccagcgacaaaacatgtaag

SEQ ID NO: 65589 - DNA, 6244 bp, Oryza sativa
tttagaaccaaccgattactacagattcaatttggactaaaaagggggatgaaataaacctcataaatacaagaaggattccactagattactacaacaaccaatcgaggaagactcaattggtcagatcgaagccgcgtgaagcgcagatccagcaagaaggaagaagagggttctggcggttcaggggctgaagagagcatagaacggcagggggattgtgggcgccggtcagcaaggaagagaagattgcattattgcaacgatgaactcaccgtggccactctagatccgctccaccgctgatgtgtgcagccgtcgtcgaggttgtcgcccccttcttccaatctgccaccccacctcatggccggcacaagaaaggagagcaggggcgccggcaccatctagctcgccatctggcgagtggggggcaaaggcaaggggtgtaaggaacgactgaccctggcttgctcttgcgccgccaccatcaagctcgtcgtccgacgaggaggggcagtggaggcggaggctaggaagatggcgagggagaggtgagtgccagcggcacaagatacgccgtcaccgaggccactccgccgacccctaggaggccaggacaccgccgccatggagccctctgccgatggctcgcgcctcacgtctgctgaggggctgatccgaacgctgccgcctggggagagaggtcaccgcagaggggagtccagatccggcggagatgggcagcatgctcctactctgacccctcacttccatatccaacgtcgccaacaaggggacacactgttcaccaagcaccataaatcctagaaagagaaaagtaaaatggaaaaggaaaccatcacctcgctatggaactgttcgagagggaggcaaaatcatggtggtgctagctggctttgtggcttcctgggatagagctgtcgatggagaaagtaaggggcattttgatttatagaaaaaatgtagaaattttggaggatttcaattctatgaaaaaaaaatcctacgaaggtctttgaaacaaaagattgtatcctatctaatcctttaaaatttttatggaatgggtaatcctatgtatattttggaggaaagttagcaagagatctaacctcttggaacattttctctgagtctatctctcttatcttattcctgcgtttttcctgtgatccaatcaaacggccattttctctgagtctatctctcttatcttattcctgcgtttttcctgtggtccaatcaaacggccattcctgtgttttttctgtattttgcaatcctctgttttataattgtattcatgtcagaatcctgtgttttttctattcctgtgttttttcattcatacgattcaaagggccctaaaagggaaaaggataaggcctttcacagtgcaagcgtggggaatagagagactgagaagattggaataaacgagagatttcttctgctttccttttttccacttcccgtcggctcagcttttatttttttttatgtattttttttcttccggtctgtttggcttccatttttccccaagtataaaaattaccctatatttattgatatttcacttcaaatgaaatttacaaataaaacacaatactacctaagaaaaaaaaggaaaagtttgaattacacccctgaacttttgggtgagtacgacttacctctctagacctaaaatccagacatctttcacccttaactatcaatactagatgaaaaaccaccacgggtagctttgtaagcggttttgatcctacgtggtagtctagtcaataattcttttattaaaaagtcgatagggcccacctttagatctctctcctcattatctatttcgctcctcattatctatttcgcccctcagacccctctctctcttgtcagatgccaaggaggagacgcgtcagcggctgcgtgcgtctcgcggcggagggccaaggcagtggccaacgacagtgaggaggcgggagtgacagagcgaggcaagtggcatggtcttagtcgagccatgtctcgaggtaggcgtgatgcaagatgtggctgcaggggggcggttcaccaccgcatccgcctcgaatcgcactaggtagacgtggcaggtcgtcgtcggcccgcccccatcggccgccgagagagatggaggtgagggaaggaataagaagagaggggattagggaaagagagagaggggaggagaaagagatatagagggtgagagactaataggtgggacccgccgattttttttaaaaaaattactgattggactgccacgtaggatcaaaaccacttcggcttgagtggggggtgggggggtaattcgtccggtattaatagctgagggtaaaaaatatctggtttttgggtttagggggtacttcgctcacccaatagtttcagggtgtaattcggacttttcgtaaaaaaataatgacatcaatttttatgattcagatgttccatcagctctcacaagtccttgtgtcatgaactcgaatgttcccttaatcaattccattcatttttcgttaaggtactaaaaatatattgatttttctattcatcacataaatttacatgtgtcaccttctatgcaaaaggagacgcattaatttgttcaccactcgatcctcgccattaccatcaggcccacacacgtaagaagcgtcatccacatcgtgcaaatataaagaattaattatcaaaaacaaacataatctttttataattgttcatatcgccgatgcttataatcatctcgtgtgctttggataaatcgtaaatatcaaacttcagccacccttcaatacccggtgcaacgcacgggtattttgctagtttttatagataaatatattaatatttacaacaccaaattagttcatttaaatctataattgaatatattttcataatatatttttcttgggttaaaaatattattattattttctacaaacttagttaaacttagagcagtttaactttgaccaaagtcaaaatgacttatagtctgaaagggagggagtagtaatcttcaaatggttctttctcctagttaattattcatatgttgagattcaattacaccattatatttattgcacacatgtgctcacttcgagctacaaagctcggtgctgagatcacccgtttcgctgggagggagtggctggcggagagaatcgatgctaccaggatggtcgagttcttggtcaccaatatcgttggcgaggaaagggaggtggccaacaagttgtcaaatcattcagttcacgaaggtggatcccgacgcatccgccaaggcactccagatgctcaagtccgccatcgtctatggctagggctacgctatgctttgccagggcaatagatgaggttgtatcatgggtgtgagaaatatgatgaaggatggcctcgatgctgcccaggccatgctgttggatggtgtcacttggccaaggggggtgcactggagaaggagggtgacagtgaggtgaatttgacaagcactacgtcttagtccatgagcgtcaataggagatagaaggaagaggtggtacgactagaggcaagaaggatatttctcctctagctttcatgatggtagtcggacatgtcatgtcacgtgggaaaagtggcaagggactatggatgcttttccattggcaaaaatttatgaataaaggcaaatgtggcatttgaagaattggcaagggtggcaaataattaaattctcttttgcagagacgtggagagagataccgctttctccgtttcctactcgctgcatcactcatccaagcacagtgagcccaaaaataacattgggccaatgaacccgagcccggcctagccgtccctcgtgcgggcgattgtcacgccttgattttttttcaaggatttaaacttatctaataaaccatttttagaatttatattcatgtgtaaatttattgacaagtgaagtaaataagggaaataaaatttccttaataaatcatggttagtgttacttttcttaaattctccatgcctgaaaatactccttggattttctcaaaattcccatatctcaatagctaatttgaaaatacaaacatcattacagtagtaatcatcaaagtgaaaaccgctaaattgtcaaccactcatgcccgctcactgctccttctccccacctatcgttgcttctcacagctagatccggcaaaggtaagcttggagtagcccagatctacgatctgcgagctcagcactgcacgttgtagccaccaaagcaggcaatggtcccttcaagctcgggcagctagaaggctgggcgagcattgacggcaatggcgatgcctacgacgatcgtgcagcaacggagaggagactacaacgacgactcaagaggagtcaaggaagcaaataagggaggtgggatgcatccccgcctcgctcaccatttacaacctcgcatcccgacgttcgtccacgcaactgcatgcacttagtcaggtgagaagtgaagctcaatttgagcaattccctcttgtcttgctagtcagacgattttcgtacatgtagagcttatccctacaggccatgctagcactaccaaaaaattgatacaacaaaaattgatttcaaacaaaaaagcccataaaccaaacctacatggcctataggataagatctttgtgtacgaaatctatcaaattttagcactagcaaatttaaatttgatagtatagaattggttctgaggtgaaaaaaaaaacggttagccaaatacccaagttatactagcaaaagaattgataaagataaaaattagcttcaatcaaggtaaccaaacacgccagagcttcaagccttcaatccagttagcccacaactgatccgggcggcttttttttcttaaaaaaaaaaagggacccgggggcctcgtgacgacgtggcttctcccaccaccgtaactcccgccccctcgcagtctccttcccaacaactggtccatacaccaccaacccccatacccccgccgtttcacctaccacactcccggctctcctgcaccgggcgcacccaattcacacccacaaacgcacgcccgcacgcgcgcgcgcgcgctcagagacctccgtcgccgcccgccgcacgccggcgacccaccgcgccgcacgatgccgccgacctcagtgagcccaccaagaacagcgccggggccggcgaacccgagcccggcacacccgtcccgcgtgcgggtgatccacccgggcggcgggaagcccggtgggccggtggtgtactggatgctgcgggaccagcggctcgccgacaactgggcgctcctccacgccgccggcctcgccgccgcctccgcgtccccgctcgccgtcgcgttcgcgctgttcccgaggcccttcctcctctccgcccgccgccgccagctcgggttcctcctccgcggcctccgccgcctcgccgccgacgccgccgcccgccacctccccttcttcctcttcaccggtacgcgcccttttctttttctttttctttttctttttcttttgtctccatccgtgacgatgacatgtgggccaccccgtcttgcgaaatgtgacgtggctttttctctggctcgctgacaggtgggcccgcggagatcccggcgctggtgcggcgccttggtgcgtcgacgctggtcgccgacttctcgccgctgcggccggtgagggaggcgctcgacgcggtggtcggcgacctgcggcgggaggcgcccggcgtggccgtgcaccaggtgagcgtggtggcattgctgtttgcatcaatcttccaagaaagttgggaatctttttggggatggataatgaattcgccggagaatttagagattcttgtggaattcttcgaatgcaggtggacgcgcacaacgtggtgcctgtgtggacggcgtcggcgaagatggagtattcagccaagaccttcagaggcaaggtgagcaaggtgatggatgagtaccttgtggagttccctgaattgccggcggtggtgccatgggacagggagcagccggagggggtcgactgggacgcactcatcgccagggtttgcaggtgcggatgataattctaaggtgtattgggtggtaattttgtttgtgtagatatggatgactattgattcttggttgtttgagcagtgaggcggagaatgggcc

SEQ ID NO: 65590 - DNA, 1036 bp, Oryza sativa
accccctggttcggccgaaccaccagctccaccgttggatgtggggttttgcgtggacgtcccagatgcatccctgatggcggttggagggcacttcggacatttccccttcgccaaccgtcatacctacccctacataaagacatcactccctcacttcacacacacacttccaagcttgagctgaattataagaggctctattgtactatattgtatactagaatattaagagagtagtgtagaaggagtcggaagaattccggagttgtcagtaatcttctcctatttcttttattctgtttattactctgaattcattataatattcttcttgagtaatttagatttatcgtgtgagaattatctcttggttagttcctaaatagcatacgggattattgttcactataatcaactaaaatatagtgattgctttggtgagttatgaacactaaaatagatattaattgcttagacgtggtgtttaggtaattattatctaataattgatgcatatcccacagtacgtttgacgtgggtgtagaggttttgacagccctcgagatcacttaagtcctccctgtccgggtacgtagtagagggacatctgggaacagtgggttgctagtgcctgaagtattgcgttaggattaaaattaagctttccctagacactgtttctcactagtaaatcatctctatcctggcctatcatttgcttggtgtccttggatgaaccggaggaagctctgatcacacacgttcccttggcttcggtacccttggaatactccgtaggggaagtgctacatcggtatatccgtgtgcttgcggattttatctgtaaccgaatcaaataccaacaagcatttctggcgccgttgccggggaacggttgccgatcatttcttcacccctgctatcctagagaagtattcctgtcaaactcttctcgaccatggagcaaccttttttgagctgtctgctcctcggggcgaattctatgagccgcctccttcatcagagctcattt

SEQ ID NO: 65591 - DNA, 1346 bp, Oryza sativa
ctgtagatctgtttgtctgatatccttgtaggcttctaatcattcaaaatttgctagcattgttaagactttaagacatacagtgtcacaccagttgaattcaagtgtacacattgatctaacactgaactaaagtactgcttactgcctaacaaacagtacttggcaaacgatgcctactgtgtaatgagaaagataaaagaaaatgtcttgcaggtagtgacgtttttttttaagtaaatttcacaaaactatatgtattttgtacaatttatcataaaactaaagatttaagagctttcacaaaactacagatttagtgtctccgtttattataaaattataggtactttgtacaatctatctcaaaactatagatttaagaatttatttcacaaaactatagatttcgtgtatttgtttatcacaaaactacacattcagtgtcttcatttatcacgaaactacagatttattgtctctattatcacaaaactacatgtttttaacaatgctcaaacttgtagttttgtgataatgaagacactaaacttgtagttttgtgataaatgaagatattaaatatgtagttttattataaaagtacttaaatctgtagtttgtgatatattgtgcaaagtacctgtagttttgtgataaatgaagccactgaatctttaattttgtggaaaagttcttaaatatgtagttttataatagactgtacaaaatatttgcagttttatgaaatttactctcttttttttatattaaagtaaatgacaaggataaaagaaaatatcttgcacgtagtaacgttatttttttataggaaaaagtacgaattaccccctaaactatcgtggttgatcgaattaccccctaaactcgaaaaccagacatcatttaccctgaacttttaattccggacaaattaccccccttacctcaatccagagcggttttatcctacgtgacgtatacgtagcaatccaatcagtattttctttttttttaatggtgagtagtcatattccacaaacaaaatctaccactgtgttgatagggcgtggtttggtagtatatgctaatttgaccactgttagtggacaatgatttcgtacagtcaaagattaatttacaaacaaatagttccacgctgtgccccctccaagaaatcatgcttaacaacagacattctgcatttcttattattttcaccccttttttaatagccaacgagacaaggcacaggttcttatttccctagaacgacatttttgaactgaacaaccaaagcatgtacatctgatttcacaaagagagaaacaacaaaaagggatcca

SEQ ID NO: 65592 - DNA, 663 bp, Oryza sativa
gtgactgggacaaaccctgataatctgtttccactcagatctagcttattcaggtttgcgatttgactcaaggattctggaattggtcctgataaattgttttgtcctagcaatatggaacttagagatgaaatatttgctagagatggtggtattcttccagaaagcaagtttccattaaggtcaagaaatcgaagagtccccatgttacgaggaagtggaattttgccaacaaaagaattcgtttgtagatcaacagtgacaagcttggatgagccattgaaaaaactaggagggatctctcctgataggttgttacgcgaaagatttagctctatgagtgatgaacttcttgccaaggattcagggatggtaccttcaaggttgtttcttgcaagcagcagactttgcagagaagtgaggttgccgatgcaatcaggcaggaccccagtgagctccatggagctaaggtttatggagacaacttgagctggagatgtcgtgccacatctgacaccattccatctgcagaaatggactgacgtgttccatgagatgaaagcaccggtggggtcggttatgctttgcttgaagcatagtagagcttgtaaatcggtctctgatctgttgctgggctgcgctgatgagggtgttattgtgttg

SEQ ID NO: 65593 - DNA, 969 bp, Oryza sativa
atctacgactaaatttccctgcaaatcctcttcttggcaacagacatcttcacttgggatgaccaagcttctaattggttgcatcttgtatacaacccactaatcacgcaagtctcgccttcgggaaggatattgcagataatatacttgtgttgcttgatgagccatagcaaatggttcaaagtttgttaattttgaggtagactttatttctatcattcccaaagttggtgtggatcgtttgccccgaatggggtcaaaccaacggcattggagcagcactatttcaatcttccggccagcatcaaatgttagttttataatgtcttcgatgacaccatagtagtcaagttgctggtcatcagaggtgaacgaggacaaacaaacccctgagtttactgtggtcaaccttctacgagatttttcatatttctcggacctaaaacgatagccattaatatcataagaattgtatgacaagaccctaggcttgcatccagtagctaaattccacaaatcatcatctgcacttggatcatttcgacactacaataagtaaataatttagaaattaaaaatatatattttgaacattataggtaagaaaatataaggatatatatagagtttttacagcattcttaaaccagtcaacaaattcctctctcatcaattgatcaagcccctcgactgaaagattattatgcattgcatgcttctcttcagaaaactttctacaaataagatatgattagaaattttgtttgtaacaaactatatataatgaaattttcatcacatactcttgaaatttgtcgaccatagagcaatttgtcaggacatataacatcgcaacattcaactcttgtggactaaggtctcgaggcacacctctaccatgaagcatgccctgttcctggaacacatctaaggtgcaaccatcattttgcaccactgtaccaccattgt

SEQ ID NO: 65594 - DNA, 1458 bp, Oryza sativa
tcctgcaccccgagtgcagccgaacaggcccatcccacatagtctaaaacacaagagtacatagggtattacgctcccgagcgacctaatctgtatacttggttgtgtttggtgttcatcgtacgaacgaagcttgatctcaactcgccccttagccgaatctcaaaggggagggggggggggagttcttacttccctgctagaggagattcactcttcgacaatagtgaacagtgaacattagaatgtgattcttgctacattggacatctggtgccttagtatttgtcttaaaaaattttcttctaaaatagcaaaagaaagctagatatatacatcattgagtactatcgtgtcaagatgtttcgtagtgcttcagctccaactctacctctcttgaagctagatcccagtcaaatagttttagctccacttaaaaatggcacggagtgatactctcacaaaataaactaaagaagcaaaactaggtttagatagctctataaatccagtacaaatctaattactatagttaaatttaaaacttagagccttaccaaacggactccaagaacataacttcgacagatttccccaaaacaaaagtgtttcaccaggatctagacaaaacaaaattaaccatacacacaaaatatgccctttttttttttttgcccaactctatcatacttgtactaaacttgggttattctgtagaacatgacttcactactaaaatgcatatgagagaatacttgattctccgttattccctcgagatagatgttttgttagttgttcgctgaccatctcgtcgctgttagaacttaaaaaaatcagctcaaaggtcttctttccgcccttccccctttctccgagcagcgaacggcggcgcacggcagccatggtggagcgcgaggatgttggtgggccgatttcactggcatgggccgagcgcgagcctgttcgtcgtcggccttgctcgctcgattggagcggccgcgaaacgaagggtagcagcagcagcgccgtgcgattcggaacggacggaccaaggagcgacgcccgacgtccctctgacgttgcgcttctgggtgggttcagttcggttctagggctccgataggaacgttgccatggcggcggcggcggcgggaggcgatggtgaggcggcggtgatgcgggcggaggtcgccgcgctccggctccgcgtacaggttcgcggaccagcgttcgttttttcctttttctcttcttgcgcggctgtttcggtggatttagtgaagttgtttcttctctttttttttctctactggtgaattataattgggtgtgattaggagttggagagggagaaccagaggctgggtaagattgcttcgagatgcacctgcggcagctccaaggtgagatttcttttatccttagtactgccattttcattcatctaatcggagc

SEQ ID NO: 65595 - DNA, 9686 bp, Oryza sativa
  unsure (1)..(9686): unsure at all n locations
atgcaaatatagttctctttgtcacatattattgccaaaggtaccattgtgaaaccatcggtaaagttatgctcctctcggtaattttttcctgtacctttggaacttataaccatttccgagaggtatattaaacccatcggttactaatataccccgtcagtcactaataataatttccgagagttatattaaacccctcggttactaatataccccgtcggccactaataatcatttctgagagttaaattaaacccctcggttactaatataccccgtcggccactaataatcatttccgagagttaaattaaacccctcggttactaatataccctgttggccactaataatcatttccgagagttgaattaaaccactcggttattaatataccccgtcggccactaataataatttccgagagttatattaaacccctcggttactaatataccccgtcggccactaataatcatttccgagagttgaattaaaccactcggttattaatataccccgtcggccactaatgataatttccgagagttaaattaaacctctcggttactaatataccccgtcggccacttaaaaccattttcgagtggtatcttataactctcactcattgatatatcccgtcggccacatgctaaatagccgaatgttctcataacaaccctcattaaaatttcaaacggtcggccacctaaatcttcctgacggtctgtaggattttttgtttggacgcttggcaaatcttaggattctagtagtgcatgcatatgatgtacgggtaaattccaagggtggtgtgtggctatttgcataaagctacatttcgcaaacctaagacctagcaattttgactaggaaacatgttagattaacgagggttcatccacctctacaggccttgcttggttcagtttaccctcataagttcatttacttcaactacatgagtcaaccttcctatcccataggcaaggtcacaatgtcatttcatgtttttaagcaaggttaaaatctatgagtctaatcaagacatgtataagtactagcgcttaataaccgtgagcacggctattcgaatagattagtttactcacactgcagtggatgtacgcttttaatcccgcactccgcggcttgcccaacacatgagcctagtcccaacacatgagacttgccacggcccggcttttcagttgctctcgcatttcagcacccactccaaggactatgagcccccattgcaccccggcacttcaacctacctactactggatggtgaggggagtcctggcgttcttgggaaaagggatatttactacatatacttctagggtgtattttaagttattgacatcatttaccaaattgacactgcactatcctcaacatactcatacagaaccctacccatgatctgaaggtgccncggtctccacgaagagcttctctaatccatcaggtctaccaattcgtgaaatgtggtcgtactcagttcgtttcttgcatagcttcctaactcgatccttaactgactagggtcggtgattaaccatttctagaaccacccatatactactcatgccgccccagtcaaaatagctttgtttcattaagttttgggttttcgcaaaagtttgtgtgaggtaggtggcgctcatgtctccacccacagatcgttaatcgcccctactgggcaacctttcatccatagtcttattgtacttgtatggaatatatacaaaacgtctacaagagcaacgctaagcaattgttggtaatcgactacgcgtaagtaatggactcgggcgtcaaggaggtataatacatgtaagggtaaacaatatcatggcaggcatcattcaagtgtaggtacgcaattataaataacatgcaagtttatttgcaaacaacacatttgtaaataggctcaatatgttcaagaatggggcgtagaaacttgccttgatcagtcaaggtctcaacctcaactggctcgcactcctcctcacagacgtaacctgtttaatcgaatgcgggaattaatgactaacttacgtctaacgccaaggctaaattgcaagaaaaattgaaaaaataccaaaccagcgtcatttgaaagatgaagattctagaagaattttggcgaaggtttcatcgaaatccgagttgaaatgggggagatataagcttttgaaagttgggttttgaataaatcaattaaaagtgaaagggctgacaggtgggaccggggagggttcggctgattggtccaacggattttaaaaagagcggggcctgcgtgtcagcctcagtctccttctctctgtggtcctctctctctctctcgcgcgcgtgtgcaaggcgacggaccatggcggctagggttgtgctaagtggcggtgttatgggatggaagtggttgcggccagggagggtggtatggtgaagggtacagctaggttagggaggcggtgcgtggcccagggaggtgtttggcggccagcaagggtgggtgcggcggcggccttaccacggcacgacgccggagatggcggggtggtggcatagcgtgggggcggggcgagatggctcgagaggagttgcgggtaggtgtactgaggggtacggagtcggtggctttgatcaagacggccgggagagggatggcggcagtgcggctgatggtggcggtgaccagaaaggggtgtggcagacatggacacgattagggcgtggttggctggtacggggttgcagggagcatctccgaccctagaggagtcaattcccctggctggtgtggccgaaagcgttggctaggggtgtggtgacgatggcctggacacgatcacggcggtgggcgcacggtgtccacggcggggctcagccggaggggatagggagggggatgggcatggtacgcggggtggctagcgatggtagcaattttgaggcttgggtggctcctaggaacattttggagttcggctggtggggctagctcgaacagagcatgcccgtgcgcggcacgcacgcacatgtcccgcggcgagagtggcgcaatgggtaggaggctagacaggtgatgcggttcatgaggaaggttgtctagcgtggtagcgttgtagctggtgaaatggcggctagcgcaggggctgggtgcggtgtttcacccttcgtgtggcaccgtgccatgtcggcggcggcagaacgagagacagagggagagcgagcgtcggtaagggcgggagagaagggcatagtcacataccttgtggcagttgtgtagcgacacaacgggcggtgatccctgcacgaaacaatggtcgtcgaggtattgcctggggatggtcaacccgcggatcgtcctcgcacgccaagtgttcgatcgacgatagcaaataaacacacggcgttaaggataaatgatagtgggttagggcgagttagttgttaggggccagttagctcaacaggaaggtacaagtcaacggttaggggttagtgcaaacgaaatcgaaagggttatcaattagtcgtcccaagttagttgttagccgttcttaggatcgatcaagcgtggcagcctatccacctcttgctcgactgaggcccagccgaagccggccgtggcagagcaagcagggagacggcggcttgtgcgcgggagagaggtggtggagcgaacgggcatgagtgaggacagaggggaaagagagcgtgcttgcgtgcatggccggggcagggtttatataggtgacagggatgtgaggactccccacgcgtgcattgaagaatgctcatcgccatgcgcgtgttggtagggtggtaggcgaggtggcggcgcgacggcacggtgttggtgacggcgcggtgccgtggcggcatggcattggcgaggagggacacgagatggcgtctggcagacggcgccgtgcgtgcggtgccttaccggccaggtccacgggcggttaaggcggcgacggtgatcggcggctaagccccagcggttagggcggtcgttggccaggagcgatgcaagtcgtggcgaggagtcggcacagcgagagtggaaggactggcgatggcagtcgttagcgacacgcgacggcattcgtcggtcgtcagcgagaatcggatggacggagatagctgtagagccggcacggcgatgggcggtggcgcgcgcactactagaaaaacgattttttatggcgttggcctattatttttgctggcggaaaaatgtgaaaaccgccagtaaagtcgtaacgagggggtggggggcaccgcccgccagcgaaaatatgtctatttttgctagcggtcacttaggttcgccgccagcaaaaatagataatcttcattggcggtcaaatttttgctggcggccaacaaatgaaaccgctagggaaaacacccaaaaatacctgtcacatattaaaaccacccacatacctcatcctcttcaccttctctcgtcttcttatccacttctcttctctccttctcactctcctcctccctcccggcctccccaccagcaacggcggcggcggccctggtggcggtgaccggcggcggcggctttggaggtggtgactggcggctccccatgccgccctgccctcccatcccctcctcacccctctcccagatctatccgaggggaggaggccgccgtcggcgtcacaaccgaggggagcacacagcgcggtggagctgacgacacggcgggcggtaggtgtgcacgcgggcggtggcagatctgacgacgacgaccacgaccgcggcgacgacgacgacgacgctgcaggccgtgctaggtgacagaggaggcctgccacggcggcgggcggcggatgtgcacgcggcgcgggtagcacgcgggcggcggcgaatctgacgacgacgaccatgaccgcggcgacgacgacgctgccggccgtgctcggtgacagaggaggcctgccatggcggcgggcggcggatgtgcatgcaccgcggggagcacgcgggcggcggcggatctgacaacgacgaccacgaccgcggtgacaacgacgacgacaaagctgccggccgtgctcggtgacagaggaggccgatgggcggcgccacagcataggggaagcggcggcggcagcactgccctcccctccccctactgtgttttcttgtgtgttcttgtttgtaaagatgtttattaggatatgtgtgttgttaatctgttctgttgatgatgtcaatgttgaatttggattgatgccaatattatgtatttgtgatgctctggatttggattattgtcaaatatgaacggttttgaatttggccaggtggggaattttgaatttggggtaggggattttctagcggttctcaaccgccagcaaaaaatcttttgtccgcttgcgaaaatcgatttttgcaagcggaccgcaaccgctagcgaaaattattttcgcaagcggaacgaaaccgccagtgaaaattttagatcttcattggcctttactttgtggcggctctaaattccgccagcgaaaatcaaaaatggtcgccacgaaagatggttttcgtagtagtgtcggcagcgtgcacccaggattagggggtgttaaggtgggagaaggggagggggaagtcataaacttctttattgggctgcccgagcaagagggaggtaaagtagacttttcccgaggtatttctcaggccgagacagggttcagcagaggggggagaaatagacttttgccggatcaaacaaagcgacataacaacaaggagaagaaaatcgaaatattcggaggagaaaagaaaatgatccaaaattaaatgcaaaacttggcatgatgcaaactaattgtgacaggtttttaataatcggatttttcagggtgttcccagtccctcacgccgccgcaagctccccatctccccgtctccttctctctacgcgaggcagagggcgacggaattggcggcgctcaagctcgagctctcaagcgatgagagtgagttgggtggcacggatccagcctcgtgctcgctggatctgccgtcgttgggctccctttcctctgtcctaggcggcacgggccacaacggcggtgttgcgaccacaacagcggcggcagatcctctccccctcccttcttcgcgagcgtcggcagtgctcctcttcgcgagcgtcgcatcggctggcctctcccatcccacccctttctcgtgacggtgaggggccaccggcagcggcggatctgaccatgagcacctactcgtgaattatacactgcgcatgctcttagtgcctgcgtacaacatagtgcaatcgggataacgtgcaatcagtactagaaaacaacacaccttataggtgcctgtttgcttaaaacctacacctataacacgttttacgtcttttcttggaataaaattaagaaccaatatctataaccactcattggaaccggtttataataaaaaccggcataaatagtcctcaagtaataggtgtcggttccttttaatagaccgacatctgtgaacatcatataggtgccggttcttataataaacatgtaccaatgagtctggtgccataagtaccggtttttattgtgaacctgctgacgaaaaatccgcgctcgcctgatggtgccggaactgtgttggcgcaaactaagttaacgaacacaacggcctagaagatctgtttagctcctgtgcagatccaaaatattaatgagatgcgggagtgccagtcagtttgatcctacaactgacaagatatataaacaacagctcaaacagctggtcggttgtcaagccgatggagtagttccagccgatgctgatactagccaatgtcgatagggtttgagcaattggctatatgtccaatgtagataatgatataaagacaatcggctgaagatagtttaatagaacaaaaatataatccagcagaaaccaatcggctaataatgatatgaatatatgatagaataaacactgatccgaaggttaaagcatacatcggctggaggtccgacgtcataaaatccacaagaatagataagcagtgaaacatttgttgtgatcagttaaaaccaacttgtatgcaatctttgtaagccgatggaatgtccagataacacatcggctgaaaccccaatgaaacccttattataatcaatgataggttagcttttatgattctaagcatgactaggatgatgcgtcgcaaagtatgcgaagaagcataaagtctgaacaatcaagcctttaatataatctagcaaagggatttagtcgatactggcataaacccagaagcgaatctcaaccgatacaagtaaatcgagctaccaaactagattaactaagatatatcataaataggtagataaacataccaaccaaaccagagcgatccaagaggttgaaaacgatgcagccttatacaacaccaatgtagctgatacgattgccagggccggtgcaacgtaggacttaccccttcgctggagatcgaaagccgatgcagtcctgcgtcaagtgccaagttctgccggtaataagtaaaaacctcagtaaagagggtgggatgcaccgagagtaattgtattgatctgtgagataaattgcaatgacaccgggtgtacatatttatactcatgggtagatacttgtccttgttggacaagaattaaactttcataaagataaaaggaaaacataaagttcttattggacattaaacatactttcttaaagataaaatggaactaacaaactcttcctaattaatagataaactgacatgccgcatcctccttgaactcggtctcttctggataaacttcttttaatagattaaattccttaaccgaatataacaagaatccaactattggcgacttgataattctcatcggccgattccaagactctgaagccgatactgactctaggccgatgatgatttcggggcttaccaaatttcactgttaatcacatatgtacctgttcttgataaaaatcggaaaatataatttcataggtttcgattacaattaaaacctacatctatgatgccacggctcgtgtatatgtattttttatctaccttttccatacgaagttggatgaaaataaactttgtatgaaatttttagagttctatgagatctacagctttgttgttaaaaacgttttgattggaggttgtgtgggtatccgaaaatgtatggtaaagtctcagatctatatgaataagtgaatttttaaaatttttgagcgatgtcagatgaataaaaaatctatatgaaagttgtagattttggatgagatctataattctgtaattgacaaaattttcatttgagcttatctatggttttaaatatgaattataagttcggataacagtggtctcaaaagaatagcattttctactgaagacaataattgttctgaggtgtgatgataagtagctttgaatagagacagaggccttgggttcgaatcaagctcggcatatttcatgaatatgggatgaaaaaaatgagaagtgaagtgtgagtgtggtaggtgcctaataaaatgtgaaatatttttctgtatctttttcgcatcttagaaccggcaccaatgaggggtagtaaggtagttggtgccggttttagaaccagaaccaatgactaccctcatagtgccactaaattgatgccgattttgggggtttggaaccagcaccaataaaggttattgaacagtgcaattaatggtacaaatgctgaaacgcaactttagcaacgctactaatcggcattggatcaaaacatacaaggtccatatggaccatattcctaatgaaaaagtacaaatactcctctaaattttagatggaagtccgtctatcaccataaagtttagaaccggatatccaccccctgaattttgtaataccattccctaaggtggttttagatggtgtttttttttcatatttttaaaggttaaattaataactttgaataactaatataatatatttggatatcatcaattgtaagtcatcaatttatacttatacagtgataatttactattattgtgttggtacctgtatgtgaggactaacaacaggtaaaaagaaatatttaggtatatatacgtgtgtgttatgtatatgtcacatgatcaaactcaaccaacttatatataaattagataaaaaccactatgcaaaaaccatcttagggggttatataaactttattgtaaagtttaagggttcaatgtctggtttaaaagttaagggtgttagacagacttttatcctaggtatagatgggtatttgaaatttttcatattcctataacattgttcatcaaaataaaagaggaaagtaatcaagaaactcataaataacaaaactgacttgacagtctatttgccaaatgactattttttttcttttccatcaatcattttttttggcactagattaatatcagcaactcaacttatctgtatttttatcttatggtgaaacaaataatattctaaccttaacgtaatgaaaaatatgatttggtgtaaattctaccagtataaaaggtgcatctaggtgaatcggaaaaaaaaa

SEQ ID NO: 65596 - DNA, 2220 bp, Oryza sativa
cagtaccccaaaagtgtcactcagcaagttttatggcattagtcaagcatgaccccaccatatgctaacaaaaacctgcatctgtggctatacctttatagctagatatcttggagttttgatgatgttatcatgttgatatcatttctagaagaatgcttatgtactgcatccctcacctgttatcatttgtcatgaggttcttctctgttaacatttttcctgattttcttctgtaggacgacagtgctgcttcctctccagtagttagtgaaagtttgtccagcagtaaacaagaaccacagaagaacgtaaagtcacatgtaagtgtaacttcagaccataatgtcatattttaatttgatcagatggttccacaataacatctaccataatcacataatggagttttgctttcttatcttatctgagtcatatgcatacaatcgaattatagtgcaatggtattgtggaatacaatagttcatgcacatatgcaacttaagatacactaagtttctataggtaaggatagtcatttgtttactagaaggaactctgtttgttgtcatttttgcatgtaaatatattagatgtgtatgtctccattgagattaatggagcatatttttcacctatactaaaacattaattttctaagaaaacttctgtctaatattacctgttttttttcttgtgtttagtgtagaggttgccaagtgggggttgtaagtcactgcccaaagcgattaattgctctgaaaatcatgtactttggtcagaggtatgattttatttccaatacaaaaatcatgtgtttccttcatctgtgatgctttcttgcttaaactccgatacaatcccaatattgtgctagcttctatgtgatgaagataagaagattgcattaaaatcctgctactatgtgatcaaatataggcgtactatatgtgtatatgcaacagctttaagttaggaacctcttcactggtcacagatcaaactttgagtcaataatattaacacatgtttcttctgcaaaattgcaatatgttctcctggcacctgcaaaattgagtcaataatatcaaactttccaatccaagaacttctgctggcacctgcatccgttctctttactttgttagttcttattgctcgtggcctcgtgccttgtctcttttctcatttttttctgcaaatatgcttgttctcatgcagattttatggctttgcttcagaagcccacacagagcctacagttgaggtatattttttttcctacgaactacatatcagcttatttttgtttctctaagggcgtctaaggttttccattaatactcctaccttttctgttccagtctgagatatttaaagcacttgaaagggcgaagcttctggttggaagtaggaaagaatcatgttattctaggtgtggaagaactgataagggggtttctgctactggacaggtacttgaatgtgtatggtttgttcaatgctagatgattatattatgttttcttcttgtatataatataagcttatattactcatagtagtctcagatgtgatcacgaattatttttgtttctggttttatttttaagaagcactcttctggtctttctcatcagaaagtcatatttttcatgtgctactttcttgctactgactagtgattaatacaattatgtactgtgattaatacaagttcactttctctgtcatggaaaataccgcataaaaaagttcataacccaaactccctttttatacataaccatcaaccttttacattccacaatgcaacggttgacctcaaattttaaataatagcctgtaatggaagaaagaaatctatgtagaagtatcttcacaaccaatcagtatgtcattttgatgtgctcgatgttaaatttctgaagacatacgtcaaagattttaagtgctactgcttgcatgcaataggtacactattttttaggaatctagatagtaattttgtattgcaatagtgtttgatgatttttgcatggtgcagaaatgagtgcaatatggaaaatgtgagatatgtctatgcactaaataaaatttgtttcctcatcctgcacctgcaacatgcaggtaatttccttatttctgcgatccaacataaaagatgccaaattggatgtactagacaacaaatctggtatgtttctgccttctattctt

SEQ ID NO: 65597 - DNA, 18459 bp, Oryza sativa
  unsure (1)..(18459): unsure at all n locations
caaattccagtgcaaactttttcattttgccattgcatagagaagaatgatctagaactatccggggagctaaatgttgtctctatttaaaatttggactagtgctatactgttattccacttattataatatcataatactatgagctttattggttgctcatattttctaataagccaaaacgacttattagagaataaaaattaatttataggtaaaaattttatatattaatccataacaactcataagccaatgttaataaaaattacgttgaaaatatcttaaaatcaaattaaaaattaaatttaaaaattcaaatttaacttttgctttggcttattaggctaatgggagtatgggactctacttctccatacgtggtttgttagcaaggatattttagtcattctcttgtcaaagttgattgcctaaatatgcgcgccttggtaaaaatgcaagttaaatgcaaacagacagagcatatatacttgtatttttggtttatgttggcaatgggatactatccagtttatatttatgacatcgacatatgccaaaatagaccattaagcctttgagtaagttgtactctagtatctctttttaatggttggtggctctttaatgtgtcttatttagataaagatctgtttggttttagacagatgtaatgagtggttggatctgtagtttatatcattattaaaaataagataattaatatatatttagctaatacgtccttacgatgaatactacaattttgtggatcagtgaatacatgctctgatcacaaattcacaatagagctagatcaactgttttagagcaagttcaatagtatagctaaccaataggtccaaattatatattcaatctaataacttattcattacttataaacatatattgcaccaaaaatatatagtctcacctcttatgcataaacaatattttagagtccgtgttgcagctggctataaatctgtaacccatttttcgtctctcttatctcttccatacgtgcttatagctgacatgtagtctgctatattgtacttgttcttactagctatctctactctcccaagctcagctaaaaaattcttccaagatattgggaaaaataaaagggcggcgagctgggcgagcgaccaccaccgacggctggtgtggatctagtggcggctctgcctgagctcaacacgacagccgcccggcggagcggatctagccatgggaagactagcgagtagtgaccgagtgacaaccattgtcgtcatccccttcctcgtcgccagggtgacacactgacacgggcagggcagatcaagccatcgcctccgctgccatcctttggcgagccatcgcctccaaatcctccctcgatggcgtctcggttgccggaaggcgtgggctcctgccgccgaatccggccctctgcactcgctctagccgtcggagccctctctgcatcttctgccccttctccgttcgccgccgtagcgacgctcagacaatgaccctcgtctttctcgcggaggtcgccgtcgatgggagccgcacgagtggcgggacctcctctctccttgatccggctcactctctcctgcttttacttcttgtctaacatggtcacccgttcctccattcttcgtttgggtagcgaggagcttacttggagcacggcagatacgtacagacgtgaatggaaatcttctagctagttagcgtgttggggctgaatgtcatcttagatgcattgtgaaaggactaatattcttcattaagtttagcaggtccagcacgaggaaagtgatttggctactgaaccgagactccatgagaaaatgaagtacaatagtagagggaattaaggattgagagatatgtgcacagtacgtacgaggtggacaggacgaaggaatttcctttcgatttcttttgccgtacgtgctgcccaaccgtgagacagggatcatcagtttgagatcgcctcatttggtgcgtgtatactgcatgtaaaaaatagcagcgttgcaacgagtaagacgtttttaatcagtatattatatattccttttttagttttgggtcgaaagcccattcctttattccttttcccgttatagcccaatctgctacctccctccacacagtctgtctctcttcggcccagctcacaagtaaagccatgtgtcttgctggcacgtcttcaacctccatatataagttggtgtcgtgcccctacgatgccagagtcaattctccccaatcaaatccgccgaatatctcctagtattggtttagggtttttaatccactcaatctcatctttccatttcttccaaaatcggagctaacaaaactcgggataaaaacgttgggaagctcaccgatcgaccagccatcatcccatcaaatccggccgtatctttatcgatctactaaaattggtttaggacttttgatccactcaatctcttctttcctttttttttccaaaatcggaccgaacaaaactcgggataaaagcggttgggaagctcaccggccggccatcatcggtgagggttgaatggagattaaatccgacgaattaaaaccgaattgaaagggataaaaatggttgggaagctcaccggccggctatcatcggtgagggttgaatggagattaaatccagcgaattaaaaccgaattgaaataggaaatcatagagaaaaagatgaaggatgagtggggaatcacattttgtaatcaattagaggagtaaacttatgggaagacaagatcgacatggtggcggcgctagggttcggcccgacaaaggaaaaagatggcggcaaaaaacataaatatggcggcaaaaaatgtatggaaaaaaaccggaagagaggggaggagatagagaagagaggggatgaggtggaggaagcggggcccactgtcatgtgggtcccactattttttaatcttattatttaactgacatgtgggcccatatattttgttttattttttaaattgttaaattttgctttatatgccacgttagatgaaaaccgaacttagctatgtaggcgccatgtcagctgagaccgccgtccaaactactttgggacttattttgcaccgattttaacagttgagagacctgttatatcttgttttccaattaaaatatgaaaattggattcttcgataagttaatagacctcagatggacttattccaaaggaaaataggccaagccttctaactcaactctattcattcagcccacgtgcaaacaagattttgataggaatgagaaaacataggaataggaaaaacgcaggattttgataggaatgtaagtgtaaaatagaggattgcaaaacacaggaaaaacacaggaatggtcgtttgattgggccgcaggaaaaacgtaggaattagaggagagataaagactcaaaggaaagtttccaagaggttttaccccatgttagaattcctccaaaacttgcatggcattaggcaatccataggaatttcataggattccataagatccattcctttgattcaaagggctatgtagaaaaaattcctataggaataaaatcctctaaaatttctatgaatttcctttgaatcaaagggggcctaaatagggaaatgaggaaaataattgcaaaaataggaaactttgcacgggcagacagactagtctttttggcttgtaataagtccatttgtcatcctcatttggtcgagtttaattggcatctctcacaccgtaatatcttcgttcctcgtctggacaaaaccgttgaagtcagatgatttcactacttaaaaaataatttagacgagaccttgttaggttgtagatggaccataactacccgtatctgcaaaaatcgagcaggcatttttgcatacatcttcttaagaggatcatatgcaattaaaaaaaaagcgattttcacatgcggaccttttaaggggttgcatgcaaaaataaactcattttttacgtgcagacaacttaagaggtccgtatgggaaaatcaatctttccatatgagcctcttaacgtatgggcctcttaacgagccgtatgtgaaaatcgatttttacacaacaaaggtttctcattttaatctttgactaaaacttgtaactagtctttctccctcatactaacttaaaatgtgttgattctttttcctaaatatttctaaaatcatgttctatcatgttattgtattcttgttgctattattttggccgtcttctattgtgaatttgttttatcaattaaaaatttgaatttcaaaaaaaatggaaacttcaaataatattttgaattagtaaataatttcagttgaaaaagtcatgaacataaaagttgtagaactcatcaagatatacaacttttattttggtcatttgttcatccaacaaaatgacagtaacattgtttataaaatttgcatatctctcttatagattataaaatcatacgagagatatgtaaaatttgtgaaaattttactatcactttgtcggatgaagaaatggccaaaataaaagttatagatcttgatgagttatacaactttgttgttgatgactttttcagttgaaatcatttaatatttgaaaatgttgtttgaagttgtcatattttgaaattaaaattcaaattgttcaaacaaagtcatatagaaaaaatgaccaaaacaaaagttgtagatcttgatgtgttatacaactttgttattgataatttttacatttaaaattatttactacctgaaaaattatttgaatttcttatattttaaattcaaattttaactagtttaatcaaactcggatggagaaatgagcaattttcaaaattggtagatcttaatgagttctacaactttgtttttgataacttttcacataagttcatttagtatcataaaattcgaatattcgatttgaagttatcattttttcaaattaatttttaatgactattttcacatgcggtcctcttaaagagctgcatgtaaaactctatttttgcatgcagacatttaggtggtttgcatatagaaatgctcactcttttttctcccctcctctttctttccctcctcaccacttcaaaattttcatccttatcccctctctctctcgcacctcctcatccttaccttactttctcacctcatcctctctctcactttctctcctctcctctctctcacagcagcgggcgcggctcagcaagtggcaggtgacagtgggcggtggtggcgggagtgggcggcgggcaagcggatccgccacccccgcccttgggggtgacggcgacgcgcggatccaccgcccttgaccttaggagtggcggcggcgggcagtggcggcggcagcgggcagatccgctaccaacgccctcacgggcgacggagacgcgcagatccaccgcccccgacctcgggaacagcaatggcggtgggagtgagcagcgacggcgggcggcggattcggtggcgccgccctcaggagcggctgcagctgaggcgatggtgtggcgtgactacggcgattgtgacgtcggcggctgcggcaagctcgtggatcccgccgcctctcctccctctccctcatcttcttcgatcccgacggccagaggtcgctgggtgcgatccgtcaccgtggatccggccggctggcgatggcgatgacggaagcgatggcgacggcggcggggctagagttttttcttgtggaattttattttttttcgcgctttttcttttttgcatgcaatcggcttaagcggattttcgcatgcggttgtgcctgcccccacggaaaaactccgattttcacagaccttgtcacgcttccggctggagcaaccgcatgcgacaatcagtttcgtccgtatgtaaaaaccagttttgtagtagtgttggtttcactaacgtgtcgttttagtcagcaaaataaaactaagaacaatatggggctacatgtaagtggactttcacctctctcccccacctatcccctctcttcctcatctcccctctctctctctaccttaggagctcattggctaggagaggggtcacccgtccatgagaggcggcagcagcgatggggggttgtcaatgagggggctccggtcttccgtgacggtggaggggaagaggagggaggtgagggaggctgtgagcttgagcttgccgaccagccacgggaaggcggcggtagcagtggccagtgggcggtcgaagaggatggggtcgcggctatttgcggtggtagaggaggagaggatctggtgccccagcagcttcgtctcgcgggtgctcctacggtcttgcgcgacgctgggagtgggctcctgtgccggccatcctgtcctcacaaaaatgggaagggtcgagcagagggcgggcgcatgcagatttcgcagttgcctctctgcctttctcgtctgccgctgccgccaccacggcatctcttgtttgctgaagccatcgtcataggaaagactttaatgagaatggttgcttcatgctggctttacgcatggttaacatctagctattggaaactagatgcagaattgccaatttaattcagttcttaaatcatgcagtaattttgtttcgaatcaatcccatgcgttcaattttttttaaagttaaaagccccgtgcgttgcaacggataaaagcaactgattttttcttgcaacggataagagataaaagcaaaaattatgagtttctagtatggctagttgattaaagcataactgatagtacatgttcaaacactccaactgatttttcacaaaataaaaaggcgaatgtccagcaaaacagtgaacacaattctaattagacgcttcaaaacgcatagtggacactgataatcataatatcacttaaggttagtaatatcaacattaaacttataataatacatctaataaggatgcaacacagcatcagagtatgcacacaaaggaaaaaaaacttcattttagcaaaactagcgaaatgcacatgcacatatatctcatgaacttgcactgtagtatgtataaaaagtgtatatgatatgatggctagagatagtaacaggtacatattctcatacccacacccaaactaaatacgtccgctccaacacctacacccgatcactagtgaaattattttcccgtacccatacctgaacgggtgatgggtacccataccatacccgttgcaactaacttttacagatcgagaggctgaagggcgagacgatgatggcctgggtaaggggcagcctcgcatgcagttgtggccttgccgagcgatggcttagagtctgtttggttgggtggatgagcctggatgggagatggccgtccgaatttttgtggtgtttggttggagggcagggtggatggggcgggccagaatagggaatattctctcaatatgctggatgagtgcatccggccgatttggttggatgaagccatccagttttggtctgggtgatgtgtcctattctgattggctgtggttggtttgattttctgttaagcaagctttaaatgatttttttttctaaaccgtttatctaatttatggtttgattacaccattatatttgttacaattaaatctttaaaacaagatctcggatgattatattacgataaatatatatatatgacaaatagatcccactaacttatggcttctcccatccatactatatccctccaaccaaacaagaaattggattgccatatccatataaaccaaacaaaaaaattggatcgccatatccaacaaaatatgaatggctatatcccatccatacgtgaccgtgaaccaaacacacggtaaagatgagagacgacatatggacttattccttttcgcttcaagtgtgctatgatagcgccaggcagaactagcttctcatgggcttttcttctcgtctatcatgtggtgagagcccaactaaggaataagagcatgtttggttggatacctcagtaacatgcctgagaaaaatgtgcatctgtgtaggaagaaaaattatgatgatgttgcctggtcagacgtatgagtttcgttgtttggttgaagcctgagcctgagcaaaatagatcccataatgctacactaaataaactctgagaagatttaactcttgcaggaaataacatatactacttgctaatcatgtcctggagccgctccctggacatcaggtcaggaaggagttgaagtagtcaggtagcaaccaaacaaccaatattttttctccggcatgtctcggccgaagcaggttcacctcaaggcagcaaccaaacagcctctaagttcacttgctgtccctcaactttacattaagtctatatgacgtccataatccccaatatcagaaatatcaactcctcaactgttcaaaaccatgcaaggtaagttccttggcagtatggatgcgtggtttcgctgacgtggtattctagttagcaaaacagataaaaaaacatatgtagagaccacatgtaagtaagaagaaaatgtggagcccatctgtcatccccatcatcttcttctcctttcttccccagcatgggagagcgggggaggcagcccgacgccagcaggagaagaggtggctggcgcggccggcgggagagggaggagagggggccggccgcgccggcgagagagggggagagaggcggccatgagatggctggatgggggcaagggcagcaaagtgagtgatggtggtgggcgccgccgctgccatggcggagaggaggcgggatggggacggtagcagctaagcaaggtgaacggtggtggtggctgccgtcgctgccatggcggcaaggaggcgggatgcctggtacggtgcttccgcgtagagtgcggcaagctcaaggcgcgggcgtacacgcttggtgtcccacacagccgtcgtcctacctacgacatcaagttccactagcgagcttggactcgccagacgcctcccccggcgcctcccttccctcccaggctcactagcggctgctcctccctctctcatcggcacgtcgggctcccgccgacactgctagtcgcctctctcctgccgaagaggcagccccctctcctccctgtcccgctggcgcggccggccacctctcctctgtctcccactggccgcctcgaccacctcttctcccgccaactacctccccctctctcccatgctggggaagaaagaagatgatgatgaggctgacacgtgggccctacattttcttttcacttacatgtgctcgacatatgtttttttatttgttttgctgatgatttgctacgtcagcgaaaccacgcatccatactgccaggagacttactttgcatggtttgagcaattaagaagttgatacttcttgtcttggggattaggtatgtcatacaagactcgacgtaaagttgagcgacgataggtgaactaatgttatgaagcaagccctcatgggcctcatgggcctcgatgatggttcaatgtaaagcccccttcactctccacggcctcgtcctaggcccgccacgtgtaggcgacgtgtccctctcgagtcacgagcaacccgcggtccggtgctacgtggcgtacgcgcgtcacgtgcttactcgtgcgcgcgcggcaaccggagtagtagtacttcgtacttgtgtccgcctcgccgcgagcccacgaacgcgaccaatctccgccgccgttgagctcgagctctagtactagaccacgaccacctctgctcccatggccagctccgtcggcgacagcaccgctgcagctaacggcggcggcggcgcagcagcatcagcggcgccaccggaggctgcggggaaggggagcgccaccatatccgtcaccgtcgtcctcctcgtgctgctggtggcctccgtcgcggcgttcctgatgtcgccgcagccgggcggcggcaagccaccggtggagggagtaagcggcggcggcgacagcgacggcacccgcggcggcggcggcggcttagagggtgtcaagggcgccgagccggtcgagcaggcggtgggccccggcgccgccgccatccccggattcaacagccggctcgacgcgttccgcgcgtgggccaagctcacctggatgaagctccggcggccacactccggcgagccccggtacgcatacagccatatatcgccgaacagtcgattgatctttgtcatgttaaacttgtactggtggttctaagatttggtttgtttgtgccaaaggaggtatgatgacgacgcggggagctccggctcggcggcggacgcggccaagaggagcctggagatgaccaaagagacggtggagcaggcggcggcgtccgcggcgagagcggcggggaacgccgtggggaaggccagcgacaaggtgaagggagctgcctcgccggcgaaacgggcaccctccgacgcggagctctgagcacacaggaggacacgttgcgcaaaacaccctcatcggctcagccttcttcgcccactgtttttttttcctcgaagaaattctgccagtgttaattaactagcctctgttctatgatgtatggattgaactgaatatttgtatcctgtgaatctgatgtacatatttccactgtactatatacagtagtgtgatccgtcctgttagaatcgacggaaataaaaaatgttcaggcagagttgcagttgccgccgtcaggcctgtgttctggatcaaaactgttgctgctactgacctacttttaaccaaatgacagccaaatgaaccaatgcaggtgtgcttacttttaaccagccgagtctctgtatctctgaccagccgagtctctgtatatacagagcagagtagtccacgggggggtttggtcttgttcagtcggggcagattctcctgaacacgggcagcctccggcggttggtcggaccgtagagcacgttgatgatcaactcgtcctcctcgtcggtcagcggccacgcgaactcctcccgggggctcggagcagacgacggcgccagcggcggtgcctctgattcgggatgctgcttcggtgcagaggacagaggcggcgctctcgtcaggagggtgacggcgggggcggtggtcttcggcggccacgagaactccgtccgcttgtgctgtgccactggtgttggtggcagcggcggcggcggcggcggtggcgttggtcgctctgactctgggagggtgatggcttcgcctctcccgatgagtcccctcttcgggttgaaaccgggcggcggtccggctaaggagacggtcggggtggctctcggcggcggcgcgaagtaaggagggcttggaggaggtcgacaaatgactcctggaactggaagtggcggcggcggccggaggaggaaaggaaagcctgccggaagacctgggatcgcgccgccgcctcgaggtggaccgactcctggaagtgacggcggcgggaagggataaaaggctcccggatgacctgggatcatggcgggggtggcgctgccgcctcgcggtgcaccggctcctggggatggcagtggtggcggaaatcctctcggtgtcggcggcggcgtcgggggccgctgcatgtagaatccggggccctgcgctggtcgtctgatctgcggctccatctgtatgacaagacagcagcatgtcagagatttgctcttcagtttgataacccaggaatggaattgtgaccctgtgaaaactttagcggagacaagatatgaacatatgatgcagcaggcaaaggaattcaacatgaaaatgttcttgatgcagggaatgcactgcagtaaacatcaaaaacgtgtgctgcccaggtcgttagttagattaccagtttaccactttcgtcagtctggtagtcttccagtttccgaacttccctcatttgcaggaattagaatcgttaccagagaataacgctctatggtgtattctatacaataaaatttctttcaactcaagtaggaataatgattgagatgacaaatcccagtggaatcaggttaagacatacttaagaaactactatacagtatcaagatttttatgcaattcgtaatgccatacgagcaaacaaacaaataagataagctgttcatcatccacaagaaggattagagagcagggatttgtcaaacccaaaaaaagggctggaaacaattcactggttcactacagaaagtgtagtactgtacatctacacgaattgtcgagtgcttgtgaactgttttcaggggggattgtgtaaacaacccaagctaaagaaacatgaaacgattctaaacaaaggttaaaacagtcttctggaacagaaactttgtgaaaggaagtaataagaaaccttgtttgatctagtcaatttgaattatgcaaagagagtgctgcatacatatgtcttctgataagttcagaatgatagaaatacgatgcatttttcagggttaaacagtgaatatcatggatcatatctgaccttaattgttagatatttactgcataaaacaatagcaattttacctcataagatgttcgtttgatgggtcgcaccacacgagggtcgcccttcccatcgaaaaactgcagaataaaggtcacggtaaggggaacaaatcatcagggaaagaaaacctggaaacggatttttcgtgatcaggagaactgcatagtgtaattttcaggacaaaagcatcgaacaagatggagtgaacctatcatgactagctcttattagtaggaacttaatttcacaaaatatcaaaaatataaatctactatctggtgagtggtgaacatggccatcaaagtcactaaataatgcagtcacggttctatcttttccatcaattactgtcttgtttcgttaacaccattcagttctccagatcatgtaaccagaagcaagcatgatagagtcaatgcaagttaagttagccccctatgtctgaacacatcatgaattccccaacagcgtgaagcatcaatgcaacgggaggagaacgagaattgagagcagagggaacaaattacctggcgattgaggccgtagcggccgctggcaccagaaccagaggtggtatcgacgagcacgccgtccatgacgatcacctcgtcgtcctgcgtgggctgcctcacgggggagctgtggaagaggaggcgctgcanattcggattccgagaggcctcgtgttggacgcggcggaattcctcgagaccgaggtccaaccctcctgacggcgacgacgacgacgacccgaggatcctcccgtcgccgtcccctgcagcatcatcgaacgccggcatgaggcgggtgcccgtcgactgagccgacaagcggctccgccgcgtcctgctggaggagtcctccgacccatctccacttctatcgctgcctctgctccgtcttccgctgccgctgccgctcccgctccctctgccgcgcctgccgctgccgctgtcgttgccgggggtgacgctgctgtggcggggatccatcgctgcgcatcacaaccgggatcggagatgcggattagtaaatcgaggcttgtaggagatgatttttgaaaaataaaactgaacccaaagctggagaaacgcgaaactgaaattgcgagcacacgaaaaactgcatagctcggaaattagaatctgatcatgcgcgagcaaatctagcagaaaaaaaaaatcctacgggattagggggctcgaaaccgcaccactgcccccgatttcacggaaaaaatcacgggaaatcccaagttcgatccaccaaaatattcgaacagaacagcatcagccaccgagggggaaaaaacccatgacgaatcaaacgaaccagagcaaaatcgcagaaaacaatcgattccgaccacaccgcaacgggaaacttgcgatcggatcgccctacctccagtactccagccggcgaaaattccagaaggttcgagaagcgtgcgtgcggctgggcgtggaatggaagcggagcgggaagaggagagaagaggaggaagcgaaggaagggggaggcggtggaggaggtggaggtgggcggagacggggttaagtacgcggcggcacgtcggtttgctcaccacggcttgcttcccgtttgaaatttggaggtgcgggcctgggagggggacaaacacgctcgaacggctgggctttccttcttcggcccagaataccttcatgggcttgtcatgggggcccacatatagattaactttagctttgtcttagcagtccttgaaactgttgatcatcatcctctgaaacatagaaaagtttgaaaattgtttgttataaatgataaggctgtttggtttgatgcccaaatcaaccctattgaaattgtcaatattttgttgggaagagatgttgccagtatttgataggggtagagatatttaaagtgtgtctggtttgttgccattgctaatgttttgtgagaggaagtttctaggatgagtactgcttgctatatatacggcccagttgtacaattcatgtgtaacaaaaaacatgcaaccatataccaatcaaagaagagcacatatgcattgcggcggtttagaaccgttgatcaaattcagttgtactaagtgagttggatagtttgattgtatgcatagcaatttccttataggattatcaaaaatattattattggactattttgaccgatttttgaatattacctatttattttggtaacaaactaatcacaacgctacatgcttaggctacatataacaatgaatttatcacaggtataatagatccctgcagtgctgtttttttttatatatattgaatgttacttctactccgcttggtaaaaaaatgacgttcagtctttttttagtattttacagtacgattttggtcatattttttttattaaaataagtttatagattgagaaaatttatggtgttgtaaaagcatattaaaaagaagaacacaacatcatttttcatattttcagattgtagtttagagtcattgataatcgaagtcttaaaatttcaattaatgcatattatccaaatgtcaaatattttgtgatccctccgtttcgaaatataagcacacactttatacacaaatataagcattttttggacacaaaatccaaatcaatggaatcttgttaatttaagtcaataagatgaatgggggaattcaaaatattcaaattctagctaatcagatgtttggggggaatccaagccccaaaaaatttaagtattttttcttaaatcttaatatttgttaaataatttagaaatgcttatatttgaaaatagaggatgtatttatttcgacagaagttcttataatcaattttcatggccctctcttcaaagtaaaaaaaaaatctaaattcaactaaatgcaacattttttcaagagttttctcaatgactattttgtttttcaaacgaaccgaatcaaacgataccaagtttcatattgacatagcagaaaaaaattgcaaaaccacaactttcagaggttaatcagaaaaaggtaaaaaacacaccacctcccacaccgatagcacatatacacaaactaaggaaggaaaaagcactaatccgatcaacgctgaacatgatcggtcaccgtcaatcctaagaatgagccacaaccatattgtcgagcaccaactcgaaccagctgaacccaaactccaagaacctcgggggtcacacccttcaccatccaactgattgcagaccttctagacaacgcctctaaggaagatgcgatatttaaagcagtatcactgcacatccaaaagaacttagacatggttttcaataggggatctactagaaaaaaaaggaatgtatctcgacaatggcgcctcctagatagaatatggtatccaaaaggttgctgctattgatctggtgtgctgccatattaggctttcgcctgccaccttcctaccccctttgctcatagctctaacaccccacaaccaacaaaccgccattggcgcataaccgccgcctgtaccgacgccccaccatcgatcaaccatcgtgcgagtgcccaagcacattcacttgagttaaggtaaccccactattttttatagctatgatcatttgagttatgactgataaggagttgaaaaatgaaccaagtaacaaaataattatatatgtattattattattattagtctataaaagaaaatattgaaacatagtctaaaataattctagaatcaacttaaaactgaaattaaactttaaaattgaaattttagctatgataagttaaaggacgacgaaagatttaccccaatattcatcgtacggctcgtactgatcctatatcatccaagtgggcgggggaaccggaaggaaatggaatcatctagagcatttcggaagccgctaacccaagtatcccaccggggacgaatttacggatttgccctccaccttctccctccccctcgcggcgccgcttcttatacccttcctcctcctccggcgtcgtccccgaggtcttctaaaaaaaaccctaatccatccactccaaatcgccacgcaggaagggaggaaaggaccaccagccaccgcgcgcgcccaaatcgtcgcagctgcttccccgaggagaagaacatgaggtaaatactccgtgctgcactttagcttgttactgctggtgatggtggtggtgtcatgtggaggtgcggctgattgtgcctgggtggctgtggggtggtgatgttttagtttgttcttacatgttcttgcgattgctggtatgcttgtgttagtttggttagatcgtaggatatatgaaatcttctggaagaactttggctgttgacttgctatcagcggtggtcaattttctttggtggagcaagaaacattagagttgttgcggttttgttgggacgctaggtcctcccgaatgcttttgccctgttctcggatgcggatgcgatttcttatccttttgagtaattgatgaaacgattgtgctgttgtcctattggttaacttgtctctgttgctgtgatttggggcaatcctatggtgcgctttctggctgttttactgcgtgtgttcatgattgcaaacctgaaatgtgttcatgattgcaaacctgaaattgtgatgtggagtgcgattctgagcaaaattttatgggggattggttttgtgtgcttgcagtcgccacccgagcactaagtgggcgcagaggtccgacaaggtgttcttgacgatcgagctgcccgatgccagggatgtgaagctcaacctgaagcctgagggccagttcatcttctcggcgaagggccctgccgacgacaccccttatgagcttgatcttgagctctttgatgctgtgaatgttgaggttagcgcaattgatggcatatctcctctgtttcgttataatcttttgcattctaatagtattttttgtcggtttttcgcaggagagcaaggcagctgttgcggcaaggtccatatgctatcttatcaagaaagcagagagcaagtggtggcctaggctgctgaagaaggaaggcaagccacctgtgttcctcaaggttgattgggataagtggcaagatgaggatgatgaagacattgggcgttagtccttttctgcatcccttgtgttctgtgtttggctttgtattatctagtttggcgcgaattgacagtgcacttccttcttgttgcagttggtgacttcggtgatatggacttctcggtatgagtctaccgcaatttcagctggtggtaaaggaaaatggtagtaaggattctcatgtttttctttgtgttgcagaagctgggcatgggaggtcctgatgatgatcttgaggacgatgacgaagatgacacggctgacagtgctaacaaaggtatattctccttgtcacctgtatagttaacttggagagaaagactggtactacttgcttcatgctccaagtatgttattagcacttatttcataactgaacattcttctggtattagctgtttgggccagttcgaatgctagatctttctcaactccttgaactgcttatccctttggctcagtcccctgaaactttgctgattcatgaggttcctcagagtagcctttacatcatcatttgtttttaatttgtcatgatttcatgtccatggtcattattacaacttggtgattccccgtgctttgctgcggaaattactaagcaattctcaagaaaatatctactttcttgtatatacatatatttctattagtatatgtatataaaattgattgaatgatggttggaaatagtaaatatgatatgat

SEQ ID NO: 65598 - DNA, 8161 bp, Oryza sativa
  unsure (1)..(8161): unsure at all n locations
aatttgatcttgcctccttcaatggctactagaatttgttgcctgaagacttgtaatcattagtagaatgagacccagagttatgccacttgcaataccttcttttgcctaattcctcggccgatggaatcgtatgaccagcggggagttgaatctgcttctctcagagcaacagatcaaaaatcttgttagccttggttatatcaaagtcatacctctcctcttttctagaattctttaccccctagcatggtataacctttttacttcttacccattcagctgcagctatttcacagtcatcatcatcattatccgatccatatatgtaaggacaaacatgattaacccttttagggttcttcctggcttctgcagacctctgctcgtgcagggttaccttttgtataagatgtgacaagctatcaaagtcctcagatgagaatatttccctgatcggagcaatcataccctgaaaagccaaaacggctaactgggcatcagtcaaattcaaactatagcacttattcctcatctctctgaacctttggatatactcatgcataggttcatcatgcctttgcttgattgctgttaaatcggacaatttcatctcatgaaccccactgtagaaatagctgtgaaattgcttctccaaatcggcccaagtgttgattgatccatatggcacagaagaaaaccaagtaaaagccgatccagacaaggacaaccggaacaacctaactctcaaggcatccacagccgatgcttcaccacattgagctaaaaatcggctaatgtgctcataagttgacacaccatcttgccctgagaattttgaaaaatctagaactttgaacctattaggaagaggaactctctcaaaccactcagggtaaggttgccgatacaagtttccagcatctttcggcttaagcccgaactgttccctcatcacatcggtaatcacatcagcccacggtcgttgctgagttgctccttgcgactgttgttgcttgggctcgaattgattgtactgaagaacaaactgagattgagtgggcccccctgctgatattgagcttgcggcgaaggaggttgatattggtaattcaaattgcccccctgataattctggtagttcggctgaatattacgcaccgagtgttcaggaacaatctgaggtaccaccgtctggtccggctgcacatgatgaactaaatgctctgggacaacctgatttagagcatgttgtcctagctgattgttaggtgttgcaaacccagccgatgcattcattaacccttgctgatgaatcggttgaataacctgttgcgttaatggcatttgctgaatcgactgcaaaacctgccgtcttggtggcgtctgttgaattggttgcacaacctgttggattgggggtgtttgctaagctggttgcacaaactgctgccttggcggtgtttgctgaatcggctgctgctggactagaacaacaataggttgaggtggtaagaacatggccgcaacctgatcttgcgtagccgattcacatcctgccccctatgctgtggttgttctctcatcaacaaccgaggactaactagttggcctggtgccgacgtagacgcagcaagtgcgggagccgataccggtgccgtcggctgagctgatggcgcattgggaggaactgtttgaacagatggctgagtattggtgatcagaggccgataatctggaaagacacctccttgcaaataaactgggcctgtagcctgatattcagccattgaaccatcaaccattgatttcatcatgtttgacaaggtattgactaacaccccagactgattgatcaaagcattgtgcacggcatagtcaacccgatcttggaagttattgaaaagctcatgtgctgcattgccattctgactaagatttccaccttgtaatccttgggaattatcaccttgagaaccaagaccttgaacttcttgaaaaccatcgccttgatttccttgagaaccatttgcaacaccttgatcacctggctgagccataccatctggagcctgttttagttcaccatctttggaagaacctgtcccaggaacatccgcaaccaccattaatttatacttctgaaccaacgttcccttgcgggtctgtgtaaatgaactcaaaaattggttctttgcttgctgcatcattgcttcaagatccttatgctgttcaggtgtcaatttatccagagtgatgggcataatgttgctctcatcaacctcagacagacccaacttaaggatcttagctttgacagaatcaggttctctagccgaggacggtgacggtggcggtttctcggccatgaggaaaactgctgttgtgactctgacttctaatcagtcctatcaggcatgccaaaagcgtattgacagaaaacacgaggcctgggagatctgcttaactccagtgcaggtccaaaactcgccttcggatgtatgagcatgccagttgatttgatcctacaatcaacaagaaataaagacaaagaaaccgtggttaaatccataaatgatagtcgatcggctaagtgccgatgacatatcatttacctttgggccgatgtcatatgtacatcgatcgatagccataaatgaataaaaaggaactaaatctactcaatcggctgtagatattaacaatatataatccttatgtcgatatatacttaaatcaagtgattgggatagatcggtcgccatgccgagacagtataaatcacttagatcgatataatctaagccaacgtcgctatttaacctaatcggccgccttgtgttaacagatgttagccgattgtaggttagatgacgatattatcaaagattatataagatatatgataactcgatgaattacataaacaagattagagtataataaagatgcaagcactaatcccgagaacgcaagccgccataacaagtcttacctcttgttgaagatcgaaaccgatgcagctcaacccaaaagcaagaactcatcgaaacaaaacaaaagtaaaagggtggcgatgcgccgagattgtattgatagtgtgtgttaataattacatagggctcggggtctatttatacccaagaattacaagatatgtccaaatcggacacgactattatctctaacaatctctaagataccataagtctttacgacagacttttacccacatttatctctaaagaatttacataaaatatcctaattaatagatacaattgccttctcagaactctatccatgcgcggcaatcatattgaagcttatcaactcaaacccgatgtcgtacacaagtcgtattgtcagaatcggctgtatcacttaacccagtctgactcggacttagccgatcctagttgtagccgatccggactccagccgattcttactctgtttccgcgacaatccttatattcgattccgcttcgatctaatcttcatctccgatgctaatattaccaaatttggtcgttaacaagcgtatgtaatattgttgtgctaatgttgagtctagttgaagagattttatgctccaatatgcatggcttctttgtaggttcatgtgtaggtaagtcttgatgcctcgggagagcgttgtcagtgatggatcgggagtcaacctgggagaagatgatgtccggataattaggatatcatgtgggatgtttaagctaaacatcaatgcacgtggttggtatagattccatatgacatacgacggagatatggtgtgcgtatgggatgtggagttgaatttggaaggagtccaaatttggtacaatcactactaaaaaaggcacatacaagtcggcactataggggctagaatagctaaaaccagcacatatagtgtttttcccacctccactgactaaaaatagaaaaaacctatacttatactataagtgcctttgttttataacaaaccgagccaagccagcgagcccagccctcggcattatctctttctctccaatccccttgatcttatctatctcacgcgtctctctctctctctctctctcttctctctctcatctctcgcggcggccggagtggcccggcggaggcggtagcggtagcggtcacaccccgccgccccttcgctagatctagtgggaggagaggcgtcgactgcctccgacggcagaaggggcagcgcccttcccttcgccagatacggcgggaggagaggcatctgcattctctgatggatggaggagatgcggcaggggtggcaccctccccttcgccagatccggtgggaggggaaaaagcggccttccacgacggcaatggtagcacccacaccttcgccaaagcagaggcagcggcggctgtagtggaaggggagaaggaggctcgcccctccccctatcctcctttctatctggcgacggcggcaggggtagagtacttcttgatctgtgttcttgatgttgtttttttagaccgtgttcttgatgtattgatgaacttgtttattgtgatctatgaacttgttgattgtgtgatgtgtacttgttcctttttttagatttttaatttatgtttggtggctttcaagcatcggctcggctcctggttttttctttttgagtaaatttcactttgggcgtgatttattaaccaaagtttcaccatgaaaccaggcctaactcgaccttttcagttaacactaggtatgattaccttcttttgcagtttggaccgggttttaagactttgggccaccacgctggcttgatctgagcctagtgaactcagttcggggaagagaaattatcgaggaaaactagtgtatgggagagaaggaagatagtgtcgtggaggcggaggcggacatgctcaacgcctcggtctccaccctcgccaccggtggcttctacgcctgcggagcggcacgatgcggtggccgtgtgcacatctccggttctggcgaggcatggcgcagcggccgtgcatgctcttcttcggctccggcgcggcaggacggcggcatgctcttcttctgctcgaccgcggtgccggcaacggggtgcacgcactgctccttcagctcacggcagaatgggaggattccaaaagcctcaccaagttagagtaggaattattagctaattgtattgtaaataagtaccactaaagagaaggcactggaaagggaaattatcacaagtacctcatgatcaggtacatgtacatatggaacttggaacctctttccatgtttttagtggcaaaattgacagctctatcttacttgcatacacatttagaaacaacacagattcattccaccaacaccacaccgaagctgaagagcacgccgccatgccaattcggagccggagaaggtcacgccgccgccacgccgtgctgctccggagacttggccgggagccgccggtggcgagggtggagatcgaggcgttgagcaagtccacctccacccccacctccacgacactatcttcctcctttcccgtgcgctagtctcccttgataactctctgcgctgaactgagttcaccaggctcaagccaacatggtggcccaaaagtattgaaacccagtccaaactgcaaaagaaggtaatcatacctggtgttaactgaaaaggtagagttatacctggtatggtgaaactttggccaataaatcaggcccaaagtgaaatttactcttttctttacaaatcgtatacatcaaaggtgttggttcctaaaccggcatcttggagtcttctcatcagtgccgttttcgtggtgtcggttgggaaatccagcacctttgtgtagttcccaaccagtaccaatctacatttctgtagttgtgaattggagtttataaagtttgtttctcgtccagcatggtttcctagaggattaggacttcttgtatgagtttggttcatggttttaggcaacctacctcagctataaagagaaatggaggctaacttttaattccgttaaaaattttgatttttggttactccaaccatttgacccctctaattggcttagtttttgttgtacgatcctgcatttacatggtaaatcctgcaaaaaggagctgcaagtaacctgccatgttgaatgtcgtgtggaatacacatggggagaataaggagccgtgccgccataccgatgggccgcaatgtcctctccagtttttttttttttttttttttttttgcggggaatgtcctccccagttaggtcgtggacactcggtttatttcatgctggtgcacctgctgatcctgcctcaagtgtaagctgtggggtgcctcacttcgcgtgttgctagtgcgggcgatggcttcgtttgtcccgttcaccatgaagccgcaggctcgatcgccaggtaaccagatcagagatatactactcattaggactcctagctcattctttcattgtgctatcaggaggagagatatttcttttctcggtggattgggctcaatcggcgattatagaatatgacaagcaacccacctgaacaacaacgcttttcagaccaactagaataacttttaagctctgtaatttacagtgattttgttccaaaacttgtgtgccaaacaggtcctcagggttgttttcattccaatatattagttatttgttaagttgtatatagcaggtacttcaggataaaaattattgctgaagactggattaaccaacattggaggtatctgcatcgaagtacaacaatgtgcggaactgaacaatctagggtttaattgatcatatcaattaaacttaaggttttggtataccagtcctggtgatctgtcatgtgaattgcctgtcatttcgttcagcttttctatctctcacgcaatcccgcgtctccattcactcctctttcacctctcagccaatctattccccacatgccttcctgcgcttttccatcttcgttggttcttcctccaccggcgtatacggtatacctttgtctgagtcattcttgcttgtcgatcatctaggctccacaacgttattgttatgccatcgtgccgtttgtatatatcagcgtgtggcggtgtcctcatccatgcattttctagacaagtaaggatatttatgatgtggctttgcagtactggcagcaataaaagggtagcaatgtactagtactaccattttgaaggaccttccccctggaggaggaggggaggaggactgtgagtagcgcaccaacgacagggggaggggggcggggaggggggggtgagtaacgcaccaacgacctatatcactctcctccaccgccactcccccgtccgtggcccctcctagttagtaagaaagtctatgttctacgtaagaattaaaacatgtcttttcatcgtaaccattggcactgggtacgataatgacccgccaatgtgatattctagcaaaattagactgtgatctctcttcatttattaaactgcagatcaaaatgttctgagtaaattgcaatgttctgaataatttccactttccgctagaggttcaccatataatggaagggaaattttataaatcaagagtgtatcttttggaactttcgaatttggacctgtttcatgaagtttcaatcagaatttatgagaaaatttccatatgtttgatgatttatattgaccttaaagtgaaacttacttctatgcacctagtttaaagtgaaattatatgctaaacctgatacagaaacatggcgagcttcatccattgcaaagttcaatttaaataaattcacttcaactggcactctatatgcatgctcaaaatttctctgtttttttggcaatgcttcatattatcttggttagatttgatttaaaattttccattacaatatgatagaaacaaatggttactttcatattttggttagaaaaatacaaggaaatttttgggtttttccaaagggggaaagaaaaaaaaattttaaaaaaaaaaaaaaatttttaaaaaaaaaggggggggaaaacacaatgaagcaaaatagtttacaaactgaaatcaggtaagaaaatgccagaggatggcaccnntnaacttcaagatttgttgctatgaagttacag

SEQ ID NO: 65599 - DNA, 9366 bp, Oryza sativa
gctccttcagtttacaaaatgtaaagggagtgtgttcgtcactgttgaacaaacaatttaaaccatccagtccttcaaggaaaagaacttctagagctggtaactgccacagtggaggaagcatctcgagatttttgcaaccaattaactgaagctccaccatgtaccacagtttattcatccatgttggacatgtactgctcccacagcaatgtatcctcagaaccttgagcccctcgttaggcgtgaggccttccagcacctctttatgattattctgtgcctccttggaatgatttggtgaccaatctaagctcaatttggtcagttttttcttcttcctgagatttgctgctttcgcatctgcttttgtcacattctctagttgtgatagctctagttgaccaccaaggtccaactgccgcagctctcccaaatcactgcagccatagcaagtaccagcgacaaaacatgtaagtgtctgtaggcaaatgaggcgtccgaggtcaggaggcatgctttctaagctcgaacatccgtgaaggtacaggtgacggagggtggtcaagtacctcattccctttggaagtccacgaagacagtaacagcggcaaaggttcaatgtttgcagatgatatagtatgcttatgtcttcaggaagtgctttaattttactttctgagagatcaagatacctcaggtgatgaagatattttggtttcagaaatgaacgtccccagatctttaatgctcgcactgacctgtattttgataaattctgcaaatcttcatttacagatctatcacatataaatgtttcttctttttgcgaggaacatatcaatgtttggatacctggatgtcctttctctagggaagtattcagaatagcttctgctctataacctgacaaaaacagatggcgagcggaagaaggaaaatcctcacttttactaagttttgtagctatagcagcacattcttttcccatggaagattgtgccacatcatgcataaggtcatggatcttacatgtaatcttagagtcctttatatgatggaactcaaatgggatccccttcacatcctcaaaaaatgaccttgacaccaactcactgaaaattcttttaccaatgatttcagggcattctccttgttgctctgggataaaaccattggccatccataactggattagcatttccacgtcaatctcataatccttgggaaaaattgcacagaaagcaaagcactgccgcatatatgatggcaaacaattgtaactgagcttgagtattggtaaaattccattttcctcatcgcaaatcatgcttctacttaatacagactcccattctttctcggtggtcttcgtgcgcagtgtagagcccaatgctgttgcggctaaaggagaaccagaacatctcttggcaatgtcaccaaccattttgagtagctcaggaggcctttcttgttctgaactgaaagcacttgtcttgataatttcctctatgaagctttcattcagtctcttgagatcataagctttttgagctggagccatcacttgagcaactgcttgatcacgagttgttgtcaacactgagctaccgctgccaccatgctgaaggtaggacttcagcaattcccacttactggcctcacggttccagacgtcatccaatacgaggaggtacctctgcccgctcagaacttctttgagtgcatcctgcggtgagtttttagccattacattctcattcttctctttgcgagctgcttcaactatgcctttagccagcaaatccacatcaaacttgtcagagacgcacacccagagcagcaactgaaaatgcttctggatttcagggtcattgtaaatgagctgcactaaggtggtcttgcccatcccacccatacctacaatgggaagaacggtgagatccctattgctgacttgagcaagcaatgtattgataatcttctgtttgtcttcagatcttgatctgatggcaatgttcatcgaaagattggagatcttacaatccgtctttctccatttcatggaggatattggtggctctggtcggaattcaaacctaaaggcattcatctctgcaattaagacttccatttcattcacaatcttgatgagcttgtcgcccatcctgcgacggaacgcaaaacggttgtgagtaggaatgagctttattacatccatgctgccgagcttcttgtagtggcccttggctttgcggcggagggcctcgtacttgaactcgtcgaagacatcattggcctgataggccaccttccggagcgcctcaagccatgctttcaccccttccctgtgttttgccgcctgctcctcggcatcggcgatgacgtcgaggatggccggcagcttgcgtttgagaatctcatgctgctcctccatgccctccatgaccttgtactgctccaggaggtagctggaggccttgtccttcaccatggacagcagtggcccgaccaccatggtggccatcagctctgccatcggaaggatctcctagagctaagaacacacgaacataacacggggaagcacaataagcaaggagtgtgagcagcagctgctttttgtgggaaatggaaactgaaggaatgtgttcgactgaatgcaactagctagtattaacagttgctgcctggaatgattgtgtttgattggaatgaaggagtaagcaagtacagtacagtgcagtaagcttccaagaactgggcggcgatagagatagaaaactgcagtgcgcgggagagaagccggtcggtcggcgcaagcgcaaccacgaagtactgacgatagctgagtctgagaagaagcacatgcactgcgacgacttccgcaagaaaggagctaggatgctcaccgatgtggtgctccgtcgaccggaactcaacggcgaattgggcttggccggttcgtggagagcaaggttggagcagctcggacccgtcgcaaattaaggcggagctcgacggacgagctcagcagcctgcagccccgcgcgccgccgtagccagcttgcacttgatcagctcaagtcacgaaaggagagagcctcgcacagttgcacctgtctgtagagaaaagaagcaaacaacgttggtttgtcgctgtggccttgtcaaggaagaaggggatacagtcaatcatggagaagagagaagggatgtatccactgcaaatggcacaaatgggtgaagcaatcaataacgtcgatcgggtgtcggcttcaatcgttcagacttcagacctcaggtcgttttaagccagatggcaaaaatatctccaaattatattgttctctttgtttcataaaaaactaaaatttgagaataaatatagacatagtatatatttatattcatctctataattttattttttttattaaatagagggaatacgcacgaaactttccattatacatttccttctactcgggacttggggggagtccactaaatcccttattcaaattgaggcggcttcggaccttaggtcactttaagcttcgctgacttgtacgctaaacattaaaggcttgtttaggagtgttcttttctcatgtgtaaaaggaaaactactgtaaatctccatgaccaaagggaaggccaaaaatagcagtgaaagattaacctcatagtaacgggagtggattctaatccttcgaggggatgtcccctcgtatactcaagggaaggacaaaaatagcagtgaaagaagcaaacaacattggtttgtcacagcggccttgtcgaggaagaaggggatactgtcatggagaagagagatgggatgtatccactgcaaatggcacaagtgggagaagcaatcaacaacgtggatcgggtgccagcttcagtcgttcagacctcagttcgctttaagctattattagcagatggcaaaaatgtcttcaaattacattgtactatgtcccataaaaaagtaaattttgaggataaaatataggcatagtgtatatctatattcatctctataattttattttttttttaccaatttttctttctttcttgtttggcggagcgctcagcaaccgcagttttctgttttttttaaaaaaaaaatttaaagtgcaaccgctaacaggtgatgcgcgcgagcgtgagaggtggaaaggaggatgactcctaaaatactgaacacctagctcgatgatttgcacaaagttaattactgaactatgaacttattttttttagaaagagatgcattcttctcctgtttctgttagagaaacgcagcattacaattgttcagctaagcgaaaacaaaatacgggctacagggtcgccattcggagcgccaccaccagatgccatccctcagccaatcagttcagaacaagctaggatctagttaagcaaaaatagaatttaggcatcaccaggaacagcatctgggtttacaacttcagccatacaaagactttcacttttggtggtattttgattctccacattttcttataggggaattgcatgttgtgcattttcaaagccctgtaaaaagacttaactgtgaacacactattctttgttaatctccaactcagcttgtcattttcttttgttagggacagcctatcaatctcattgcaaattcttctccactttaccttcttttctccatacaggcatcttctgaatctaacttcttctcagcctttttgttttacttttgcaattgttacacgtctttttagagttattacattatacagctcaggaaagctttctgctataaacttgccccctacccagcagtcttcccaaacgtgtattttctccattttccacttttttttctcacaaaaatttagaaacagttcttttttatctccatcagacctgatcagaagtacagtatgaatcactcactctgtgtatttctgtaagagtgttttgttattttttaaaatatttgtttctcaacacctcttgccataagccatctgtggttcccaacttcaaatgaactatgagcaataacatccatcccgaaataaaatgtttgacaaccaataacaaatgcagatcgaatcaccatgaaatttgacaagagaacattcaaatagcacaatagaagaacaacaaacccattattctccttccccatcctgatatccccaaaccaccaaccaacacaatgacaaaccagagcgaggaagagagcagcagcagccgacgaaggccacgcatcctcgcctgaagctccccccgtcggcgacggcattattcgcggtctccagtctccaccgcctataggccgtcccttccgacgtcgccacgccatgggtcgtctccgtcgcccgggcgctcctctgcatgagggcctccactctccgcgccgcggctgctggtactgaggctttgagggagaagggagaaggcgacggtggcggtgggggaagggagaaggcagcggcggccggcggggattgggcatgcggcggcggagttagaggctggactggaccgaaccttcgttggattgggccagaaatgggtgtatgttacacggcccatccaagcgtgcgttggaatcattggcctgtagtttacaccagttttgggccaaatactgggcttctaaatgggccctaagtctgcttactgggaaaaaaaaggaaaaagtacaccgaaggtccctcaacttgtcattgagttacaaaatcgtcccctaaccacaaaaccatataccgggcgtccctcaactaacaaaaacgttctctttagatctttcggtggttttgaccccggttttgtccgacgtggcggctgagtcagcgtgggacccacgtgggccccacatgtcagcttggccacctcggcctcctccctctttttccctctcctttcttttcctcatctctctcttctcagcgaaatcagcagcgcgaggcggcgacgctgccgggggcggcggggggaggagccgcgctgcagctgctagcgaggaggatgaagcgctgcgctgcagctcaatgaagcgctgcagctgctggcggaggagtggcgcacgacggctatcctgcctcctccctcatcgcgtgcgctcggtggcgtcgccggaactcctcccccgcctcgcctccggcttctcctccgccgtcggttcgagtccatgggacactatcacactagagagaggagcacgagccccatagccccgccgtggatggtgctcgcggaggcggcgctgcggctgtggctggcggcggaaccacgggagctaagggtggagctgggactgctctactcccgcgccatcgcgcgcagagtggagttcgacgccacggtgctcgatgatgccgtgccggggatcttcctggccagggtcgactgtatggccgtcgccgaggtcgagcttgtcgcctcgccctggtccgcccccgggctcgacgccgtcgtgcgtggcgtgacccatcggccggcctgcccaagtcccagagaggagcagagaggagaagagtgatagagaggaggaaaggagagaagaggggagagagaggggaggctgacgtggatagtctgacatatggggcccacgtgggtcccacactaactcagctgtcacgttggacaaaactggggtcaaatccaccgaaggacctaaagcgaatggttttgttagttgagggacgtccggtatctgattttgcgattgggggatgattttgtatctcgatgataagttgagggaccttgggtgtactttttccaaaaaaaaaattatggccagatgtgtggagcatcaattttgtttaacatattgcttgagatatagtaattgaatatttgaatgagaaaattgttattgtgccagttgctaattgatctctggcatgctcatttttagggataacggccggaaacgccatgcatagattatacagtaatttaatttgtgtgaactcgactgcacagtatctttgcatgatttggttatatcatcatattctaaattaatccactttatagccattgcaaaacatatttgtattttcattcagcgtatttcattccatccttgcaggactgcccatgcttcggttacatcttgtggaatcattttcttgttgcctccttctggggctattttccttggattttttttatttccaagaaaatgtgccaatctgaaaccgaaattgttgccgtgtccttttctgctcaattatgtgcagttatccaatttgccaagatccagggcctatgtagattatagccaaaataaacattaccaaattttggcataatttcttatgtatttatcaaaatttagcaaaaaaaaactaaacatagccacatttttagtaactatgctaaaaaatggtatggttgaaaattacatcaatctaaacatgcccccactcttattgtttggtactgcggcaaaaagttgagatattgtttggtagcgagacatgacatgtatttacacgaatttgaagcttcttgttgagcattttgtgcttttttttttgtataatgagggattcgtttatcttggaaggcatgtgtttggatagaggatccaaatccatacgacaaaggctaaattttaaccaaatcatgaaaatccaggccactttcaaaaaccaagtaaaaaaatgtatgaatttcctttttcttctttggaaatgtaagttgctgaatctgaacaatcacgacacctgacatgaaaaaatcaggttcgtctattagaaatttcagagtaattgcctgaactaacattagtttgcagcgcatacagtatgggctgagatgggccatgatgggctgggccacgtaatgttacattgtgttgcattgcactaaattttgttgcagtaggccatctgaggtgttgggagatctttcggcactatagttttctgaactttagttcagcaatagcatttacagagctgaggaatttttttttaccttgcaagtcccaacgattctgtcgagaacaattcatttttttgacgtaagaaggtagagctggctctaccttatagccatctcattaatagaaatgaggtggtacaaagttttagaaagaggaaaagccaaatatgggaaagaaaaagaataagaggagcatagaaagaagaaagagccccggggggaggatttaaataatgttaaatatgtgatccgaattttgggcccacaatatattcggattatatagtttcctagtaggacttcatgtctatcctattaggtgtccttctattatctcctatatatactcttgtaaaccatatggaaaggggtgacgttcccattgtgattcccctacgtttgtaatcaactcctctatagtgattattgccggttgacgcccgtggttttttttcgcaagagttttccacgtaaaagttcgtttctctgttgtgcatctattttcatatcaagtggtatcagagtattggagatcgatccactgcagtcccggccacgggcgatttttcctaatcgaagaaatcgatctaatcgacggaacgcgtcgtcgtgttcatcgttcggtcgaatcaatctgtttggccccctacctgtcgactccgagtcggccttgtcccacgcctgcgcgagaagaaaaggcagcaccgcagcagcagccacgtcaaacggcgcacgcgacaggaggaaaaggaggagcagcagcgtccaatccatccatccagcagcacacgtcccgaggagaaagaaaattagggcagccagctcttctcctgttcacgtgatttttattcacgttgaattgctacggccacctaagcttgtgtaccaggagattccctgatctacgcttcgtgcacacggaaagtgcaccagaggttcacgtttttgctagatttagcctaattctttctagcaaattcaggattaattcccatggcgagtttaaagtatgatctaccgctcctggaccgagacacaagattctcactttggcaagtgaagatgcgagccgttcttgcacagcaagacctcgatgatgcgctttctagatttaacaagaggactcaggattggtacaacgatgagaagaaaatggatcgtaaggctatatcatatattcatcttcatctatctaacaatattttgcaggaggtgcttaaggaggagacagccgctgggctgtggttgaagctggaacagatatgcatgactaaggatctgaccagtaagatgcacctgaagcaaaagttatttttgcacaaattgcaagatgatgggtctgtgatggaccatctctccgctttcaaggaaattgttgctgaccttgagtctatg

SEQ ID NO: 65600 - DNA, 10249 bp, Oryza sativa
tttatataaaaattgtagccctcgacgcgacctataactttgtagttgaaaagtttttgaactaaaattgtttaaggtcccaaaatattgttgcatgtttatagattttgaaattttaattttaaaattacattttgggacaaaaaatgacttaaaataaaaaaaaattcaactaaaaagttgtagatcgcgtcgaggactacaagtttgatataaagtttgtctttattagagttcacatgaaaaagttatgaactatttttaaatataaagtctttagaccgtcctatttaacccagatgatattcaaatccaagtttagggaccggggtgacacaactgaacaggttggaggacctaaacgagtgatctaaaagtttaaggatcgggatgacacagttgaacaagtttgaggacctgaacagtcgatttgcgagtttcgggaccgggatgacacagcggtacaagtttagggaccggtgatggactttactcttattattttgtgatgaacaattatcatttgagattattgttttgatatttttagattattggtgaagtggttttggagaaggttgattttcagatgataaatagggactgctgtcagtttggaccagttagagcgaactgtggttgccgatcagaccggcgtgtgttgcgcggtcagaccggtcagcccgcggtctgatcggccgaatatgtgtcgatttcggtttcaggttgttttctgtagatatttgtggataaatcatgtttatgatttctagatgaatactaagcgttgttgacagaaaacacgaggcctgggagatctggttaactccagtgcaggtccaaaactcgccttcagatgtatgagcgtgccagttgatttgatcctgcaatcaacaagaaacaaagacaaagaaaccgtggttaaatccataaatgatagccgatcggctaagtgccgatgacatatcatttacctttgggccgatgtcatatatacatcgatcgacaaccataaatgaataaaaaggaactaaatctactcgatcggctgtagatattaataatatataatccttatgtcgatatatacttaaatcaagtgattgggatagatcggtcgccatgccgagacagtataaatcacttagatcgaaatatatattaacaacaagattatatatgttcatagcatagccgatcagatagatctagcatgtatcggctaatactccgataccactctgtattaagatattaaagcaaataggatataccaaacagaagcctaatatacttaaatgcagcaagatcttaatataaagggcagattcaacatatcaatcaagcatataagataaggtagttaaatcaggtaaggtcgactgaaactccgatactaccctaatcggcaaccagaaggcaggctagagattgaaattctaagcacgacttaatagatcaaactcaactgatgcagcattgagtatgaaaagaagaacaatatctagacaatcaagccactggatgtttcataaagtgatagatatcttatataatctaagccaacgtcgctatttaatctaatcggccgccttgtgttaacagatgttagccgattgtaggttagatgacgatattatcaaagattatataagatatatgataactcgacgaattacataaacaagattagagtatcataaaaccgccataacaagtcttacctgttgttgaagatcgaaaccgatgcagctcaacccgaaagcaagaactcgtcgaaacaaaacaaaagtaaaagggtggcgatgcgccgagattgtattgaacgtgtgtgttaataattacatagggctcggggtctatttatacccaagaattacaagatatgtccatatcggacacgactattatctctaacaaactctaagataccataagtctttgcggcagacttttgcccacatttatctctaaagaatttacataaaatatcctaattaatagatacaattgccttcttaggactctatccatgcgcggcaatcatcttgaagcttatcaactcaaacccgatgtcgtacacaagtcgtattgtcggaatcggctgtatcacttaacccagtcagactcggacttagccgatcccagtcgtagccgatccggactccagccgattcttactctgtttccgcgacaatccttatcttcggttccgcttcgatttaatcttcatatccgatattgatattaccaaatttggtcgttaacacatgccccccaagtccgggatatttggtaatgtttcggatttgccgcgtatcgacttcgagtaagtttggcactctgccattttctgacggttatcctcagtgctttaaatactaaccgccgccctggaaaatctttaccccattacttccgttttcaccaccgaagccaattttgttctcttcctctccggcgatttctctgacgcacaaagcgatccccaggcggcttcatctccggctagatctacgcctgcggcgatgtcgtcctccgccagcccgtctgccacgccgtcggcgagtacactgaggtaagtcccggtcggctagatcccctttcttagcatcagatcgattttctctcgccttatattgctttccctttctcgattactttggatttgtagcatctctccaacctagttgcaattcccagcctatcgcatgaaaactactactttctcggcccagtcggcaaccctgatcccacagagttctttattggtgaaaccaataggattccttttagattggccaacccagatctaggtcactggaaaaacaccttcaaatcctggccatccctcgagaaaactcgacccgagaaaagttggatcacatggttcaagagcatgtcggctagcaaaagagttcattgggacgagattggaatcggccaagcactcgatctcaccatagccaactcagctaaggatgagcccctaatggcaactgcctcttatttctggtccaacaccatcaacgccttcttgttcaaccaagggccgatgaccccaactctcatagatatcatcatgatcacgggtctggatgtcaccttatcggctaactctatgagcttgaacacgaagaaccaatacgacttcaagaccaagagcataggcggctggtcaggctatgtagcagcatacatgggccagggttccgtcacccctcgagaacatgtggctttcttgctaatgtggctagagaaattcctcttttgtggatcaagctgtggccctacaaccaattggcagtttgtagccgaagccttagaagcaaagaaacaatttcctttaagaaaaatacttctcggctacttgtaccaaatgctaaacaatgcatcggctaagttagctgtcggctcagtagtcggagcaggtggaccatgatggctattgcagtcctggctgaatttggtagtcatgaagtttgtcaattggccatctgtaacagaagctgaatttccaagactggagccgattgtagacaatgatggagaagaacgtactcatcggagatgcacatcttacggagaatatgcctccataccaaccgatgcagaagcaaagctatcggccgagctgcttaaagactggttctgcaatttttatgagggtttccaaaaacatactcaagtttggttcctctatgaagattcaacacttctagaaaatccattggacttcatattcgaagacatcaacaatgaaagatatcagaaacccagagaaatttcttcagctgcaatcagtccatgtatccttcctgtcggcattcatcaaggaagaaacatctaagtctcctatgaattttatcatccaataagttctgccaggcagtttggaatgggccaactcccaatcggcttattctttgaagataagatccagtgctgaggggaaatttcgtcaaccttaatgatggatcggctgcttaacctccaaggaccccctctaggcagcattgataatatagagctggtaaccttcaggagcagagcattcgacagatggtggagtgaatggaaactgcatctattccatcaatcggcctctatgtatatgacagatctctttccagatgttgtccctcaggtatgtcttaatttactcaatttcatttgaatagttgcttagccgactaaccttgactaactttcctttcgacctgcagacaacagagttctctcctcctcgccaaagtaacagtggcaggaacattgaatatgcctcgggattaattccaaatggaggtggaccatctcctcctgtcatcggctatgatgcccccaagacttcagctcttcttcaagggctcatcagagaaccagccgatgccggcaagaaaagaaaaaccagatcatcggctgtagatacttcagccccagctccaaagaagaaaaccaagacaaagataactaagccatctgatgatctgcctgccctagatccatccattgaacaagctctggatgaagaggaaattgaagaagacgttgaccaagccgcagccaaagtaagcgacacagaaagaacaccatcggcttcacccaagcagacccctccaactccttctgctccagctcacttttcaagagtaagcagctctctttgatcctttttgcaatcattttactttatggccgattactcacagattttgtagttgtagaaaaagaagactgctgtgaagaagaaatcggctataatgacatcttaattctttcattagttgatctcagccgattttgtctaacacttgtctcttttacagtctcctcctccttctcctgtacaacagtcatcaagtgaccagactccatcagctgtagggattcaccatgttgaagaagaagtccaaccgactgctcctgctatcctggtaagcttttctttgacacaaaatacccagatcggctatgtctatttgacctctaacttctctttaaatcattattgcatgtcttagccgatcttttctcttttgacattagagactatcttgatgaaggagaagaggataccacaagcaaagctttagcccccttatccgatgatgtgaagaaaattcttgaagatatctctcatcggctagaggcatcatcgttagacagcttagtggttgattgtggctcaattaggactcggctacatgagattcaagctctgatcccagatgagctagccgatgtcctaactccagctgtctatctcgagcagcatcaattcaagctggagaaggccaagctgagactagtcgagcgtcgggagcgcaaagacatcgaggccacaatttaggccaatcggcagcttgttcatgaagagaaggccaagcttgatcagttatctgaaggtccgatcaagtctaatattgatcggcttgaagctcgaaagattgagctcctggcacaacttcaagaatgcagtgccaatctggacatggaacataaaaagctagccgatctcccaaaatctgttgaaaagcagaaagcaagactaaaatcggctataaaaaatgttgctgatctaaccaagtctttaaaagtcatccctggaaccgatgctcaagatgcccaagccatcgaagaagtagaacaaattaggcaaagagctatatcggctatccagcgctatttgtctcggtaactttctgtgtaatagaccttagaaatttttgtaatcggctaagatactactgatgtttatcttgataatcctttgtgccgattaatataacttccaaatttgctcaaaaattgtcaaaatttgtaactggtgtatatatgtgcccccctaattttacaatgtcaaaagcattgatttaattatagtttaaaacttagggcgatatagcaatatccgccattgtatatcggcaaaccacaaccgattacaacataaaaacaactaaggacgatataacaatatcggccattgtaaatcggcaaacctcaaccgattacaacataaaaacaactaagggcccgattataacataaaaacaactaagggcgatataacaatatcggccattgtaaatcggcaaacctcaaccgattacaacataaaaacaactaagggcccgattataacataaaaacaactaagggcgatataacaatatcggccattgtaaatcggcaaacctcaactgattacaacataaaaacaactaagggcgatataacaatatcgcccatcccaaggcgatgcaaacccatcggctatcatgtatcggcaacactaaccgatcatgcattaacccaaacacttgggtaatatttctgcaagtacttaccattgagcgctcgtccatagacttcgccatgaagcccttgcaacatatatgcccccttagacacaaccttatagatttggaacggtcgttcccaattcggtgaccatttgccgaatttgttatcccgagttccaatcggcaaaatcaacttccatacaagttcaccttccgaaaaagtcttgggtaccacttgcttgttatagtgtcgagcaactcgttccttatctttggtaacttttgcaagggctcgcaaacgcgactgaactaagtcctccctctcatcggccataaggttataatactcatcggctgtcaaaccatcttgcaattctattcttctcgaaccgattttaacttcccatggtaatacagccgcatgcccataaacaagcttataaggaggaacttgaatcgatccatgacaagccatccgataagaccacaatgcttcggctaaacgagtatgccaatgccgaggataatcagaaattttcctcttaatcaacttgatcatgcttttgctagatgcctcggcctgcccattagcttgtgtataatatggtgaagaattcaacaatttgatacccatgctatcggcaaactgaacaaactcatcggacacgaagattgaaccttgatcggttgtaatggtttgaggaataccaaatcgatagattatatgttcttgaacaaattgtatagcatccccagaatcaaccttcttcaaaggaatcgcctctatccacttggtaaaataatcggtcgccaccaatataaacttatgccctttacttgacggtggattaatcatgccgatcatatcaattccccaacctcgaaatggccatggtttaataataggattcatagccgacgccggtgctctctagatcgccccaaatttctgacaatcttgacatcccttgtaatatctgaaacaatcctccagcatcgtcggccaaaaatatccagcacgtcgaagcaaccacttcattttatgagccgattgatgagtggcacatatcccttcatgaacttcaccgattgcaagtttagcctgatcggcactaaaacatttgagcaacaccccatcaatcgtccgataataaagctcattatctaacaaagtatacttcaacgctttatatcttaacttccaagaagccgattgagacagattctgtaaatactgatggacatcatatctccaatcatcggctgttatggcagcaacttcaatcttaacatctttgatcatcggcttatatcccgatgccccttgggctaaatcattagatattccttaatattatctaaagctttctgctgctctgtcccccaagtaaactgttgatcggccttcaatctcaacaacggtgtaaaaggctctaaccttccggacaaattagaaataaaccttctaacaaaattaatcttgccgatcatctcctgcaattttgtcttgttctctgtaggcttaatcttcttgatcgcattgacacttctttgagttatttcaattcccctctcatgaacaagaaatcccaagaactggccagccgatacgccaagagcacactttatcggattcatcttcaagccatatttttcctagttctctcaaaaacttttctcaaattggctatgtggttcgctatttccttagacttaataaccacatcatcaatatagacttcgaccaaccagccgatcagatcatgataaatatagttcatggccctttgatatgtggctccagcactttttaatccaaaagtcattactacccattcaaataagccgattgcaccaggacatctaaaagccgtcttataaatatcttccttagccataaagatctgattatatcccacatttccatccataaaactcaatatcttatgtcctgaagcagcatcaaccaactgatcggctactggcattggatactcgtcctttggggtagctttattcaaatctctaaaatcaatgcacaccctcacattgccgttcttcttgataacatgaactatgctagaaacccactcagcatatcggcaaggacgaataaaaccagcatcatataaacgcttaatctccgccttcacaggttcgagcatatcggctttgcatcttctcggaggctgctggtgcggtctaacccctagtttgataggtagtcgatgttcgacaatcgatcggctaagtcctggcatctcataatactcccaagcgaagcaatctctaaattctttctagagctctatcagcttggttctaaactctggagataaattcttactaataaatgtcggccttggccgatcgcttggacctatatctatttcttcgaaatcatcggccgacattaaaccttgaccttgtttgtcatcgagatcatctactgtatccttggtgtagacgtttgaaccctccacaacgccttcaaaataatagcctgggttctccatcttcaattgggttctccatcttcaattggctgtatatcagaatcggactattttagaaaatctccatcccaaacttttccagataagcaatcaagaccatccatctcccaaagagctaaattggcactggcaacattgactgacctgtcggttggcacgatctaaatcttgttgccttaccattgaatcaagcattgatgcatggttgaaggagtacaacaattggcatgaatccaatccctaccaagcaacaagttgtaagaacccttccgatcgatgacaaaaaaggtagtagggatggttgtgctgccgactgtcagctcaacatttagaacacccttggtttccgatggattgccaccaaagtctttgagcaccatgtttgtcttgatgagatcttcagcgtttctgcccaacttctagaacgtagcttaaggcatcaaatttactgcagccccaccatcgatcatcatcttagacatcggcttcccattgacatagccatttatatacaatggtttagcatgccgattttctgtcccctcaggcttctcaaagattgcttgttctggtgatagaaccaacttagccgattcttcttctactttgtcaacatcggtttgtttgatctcgaattcggctggcaaggtaaaaaccatgttaactgatgccgttacaacactattcccttttgccaacttcttcgcctcgtcggctgtggcgtcatcggcttcaggagcttgattcttaacgcgccactcctgcctcggctttgtcttcagccgatgactgatttcctgctcaacctcctaaaagcattctctattcctcaacctttgaacccttctcttttgattttttgtaaaaataccagaaggacaccactgaatcttcctgtctccatcatccttttggctatagtcttggttcaccgggcccaacctttgatgaataggaactcttgtttgcttcagccgattgcctccatcatacgatcggcttgatctccctgcaacattactgcacccaggacaatcctcgatagatggcagcctcataccctcattatagcagaacctaaataactcacaaccccaatgaggatcaaaaccaccattatcttcttcataacgcctctcctgttgcttgtcgtacttcctttgatacttgtttataatcttagccgaattcacctgaaaacctcttgtacgtcctccattagctgttcggccagctgtgtgcaccatgtttacaggaaaaggattaccatcaaccttcatcggcctcttggaatcatcaaatttgatcttgcctccttcaatggctactagaatttgttgcctgaagacttgtaatcattagtagaatgagacccagagttatgccacttgcaataccttcttttgcctaattcctcggccgatggaa

SEQ ID NO: 65601 - DNA, 4937 bp, Oryza sativa
  unsure (1)..(4937): unsure at all n locations
aggtgctcgttacatgatgactatcgttgataattattcacgaaaagtttggccttatttcttgaagcacaaatatcaagcttttgatgtgtttaaagagtggaaaactatggttgaaagacaaactgaaaggaaggtgaaaatccattcgtactgacaatgggatggagttctgttctaagatatttaaatcatattgcaagtctgaaagcattgtgcgtcactacaccgttcctcacacacctcaacaaaacggcgtagctgagcgtatgaacaggacaattatatcaaaggcccattgtatgttgtttaatgcaggtttgcctaaacagttttgggcggaagccgtttccactgcttgttatcttatcaatcgatcacccagttatgccattgataagaagactccaattgaggtatggtctagttccccagcaaattattcagacttaagagtatttggttgtactacttatgctcatgttgataatggtaaattggagcctagagctattaagtgcatttttcttggttatccgtctggtgtgaaaggctataagttatggtgtcctgaaaccaaaaaggttgtgattagtagaaatgttgtcttccatgaatcagttatgttacataacaaaccttctactaatgttcctgttgagagtcaggagaaagcaagtgtgcaggtggagcacttgatcagttcagggcatgcaccagaaaaagaagatgttgctattaaccaagatgcacctgttattgaagattcatattcttctactattcagcagtctccaaaacgttctattgcaaaagaacagcccaaaagaaatattaaacctcctcgaagatatattgaagaagcgaacatagttgcttatgctttgagtgtggcagaagaaattgaaggtaatgcagaaccttctacatattttgaggctattgtttctgatgattgcaatagatggataactgctatgcatgatgaaatggagtcacttgaaaagaatcatacttggaaatagggaagntggccaaacgaaaaacactcctatccgctcaagtggatcttcaaaagacaggaaggtatatctacaagtgatgaggcaagatacaaagcaaggttagttgctaaaggttatagccagattccaggtattgatttcaatgatgtcttttcccctgttgtgaagcacagttcaattcgcactatactcagtattgttgcaatgcatgattatgaactagagcaaatggatgttaagactgcatttttatatggggagttagaagaggacatttatatggagcaactgaaggttttgatgttcctggaaaagagaacctagtctgtaggttgaagaaatctctttatgggctaaagcagtcacctagatagtggtataagagatttgactctttcatgctttctcagaagtttagaagatccaattatgatagctgtgtttatctcaaaattgttgatggttcagctatatatttgcttctttatgtcgatgatatgttgattgctgcaaaagacaaatcagagatagcaaagttgaaggcacaattgagtagtgaatttgatatgaaggatttaggtgcagcgaagaaaattctcggtatggaaattactagagaaagacattctggcaagttatatcttagtcagaaaggttatattgaaaaagttcttcgtcgtttcaatatgcatgatgcaaaaccagtgagtactcctttagctgcacatttcagattatcttcagatttatatccacagtcagattatgatattgagtacatgtctagagttccttattcaagtgcagttggttcacttatgtatgccatggtatgttctcgtcctgacttatcacatgcattgagtgttgtcagtagatacatggctaatcctggcaaagagcattggaaagctgttcaatgaattttcagatacctacgtggtacatctagtgcttgtttgtagtttgggagatctagagatggacttgttggttatgtggattcagattttgctggagatttggataggagaagatcgctcacaggttatgttttcactattggaggatgtgctgttagttggaaggcaagtttgcaagcaactgttgccttatctactactgaagcagagtatatggctatttctgaagcttgtaaaaaagctatttggcttagaggtttgtacactgagctttgtggagttacgtcttgcattaatatattttgtgatagtcaaagtgcaatatgccttacaaagtatcagatgttccatgagagaacaaagcatattgatgtgagaaatcactttattcgaggtgtgattgctgaaggtgatgtcaaggtatgcaagataagtactcatgataacccagctgatatgatgacaaagccagttcctactactaagtttgagctttgctcaagtttggttggtgttacagtatagtcttagagactatttggcgcgcggtgattttacctacatgaggtatctttggtgattgatgtttttatgctacaagaggaaattcgtctcaaggtggagattgttaaatatgtgatccgaattttgggcccacaatatattcggattagtttcctagtaggacttcatgtctatcctattatgtgtccttctattatcccctatatatactcttgtaagccatacgggaaggggtgacgttcccattgtgattcccctacgtttgtaatcaactcctcaatagtgatcattgccggtcggcgcccgtggttttttcccgcaagggttttccacgtaaaaattcgtgtctccgttgtgcatctattttcataacacacaattatatttacagatttaaggttctaactgcagcagctgacagataattacacacatgtttcaacttgagtagcgacagtttatttttcagcagcttgtaccagtctttccattttttccacaatgggaaattcattccaataagtaggaacatcaattgatcaattccattgatcaacaatgggagagataacgttgctgcaaaatgttgttgatcaatcacaagtatcctctgcagtcatgtcatgtaggaaaaacatcattgaaatggaagtgctagctgtgattctcttatgatggagcatgaacgagatcaaagacatcgcagttcacacgaaaataaaaaggattttaaaaaagtgaagcagtttaagctccagcatgttattctttagcttacaacctgggactagctttctgcttaaagtcaaggccttggatcatcggcttcatccttcttgtagcagctcacaccaaccggacgatcgactttactggagtttatcttgagaaagggtaggtaggtaatacattctaccatgagacacaaatcacacaattaataacccatcagttgcagatttggtaacgatcctgcaaggaagtcacaccacagagagagtcagcataaggatagtggttagcatttcattcgaaatcaatcatgtataatgatgttacaaaccatgatgactcatctggtcctgaatctgttactttaagcacagcagcctagcgactgcagattgatgggcctttggttctagcaaacaaaagataatagtaataaaaaatgttatgtattggttggataatatgtagaccacagcattccatagtcaagtttggcataagatgattagaaggaactacgtatactcaaactacatgcaatggagctatgagtttccagagaaatgttaatacaattcaagtaccgcgacagttagttctacaaatttaagctgctgtccatatcagacgcattaatatatatttttttatttattttagataatattataatttattatttattcgtagtaaagcacgtgcattcagcttgcataatagtaatggctacagtagatataactaaattcttttgtacccccaaatgcaattcaaaaatttgaagtgtttaggtcacaccactgcacaagtgagttatcgatgtgcattgtactctgtacatataatcgtattaatggttgactagagattctatacaccacactgcaaacttttagcaataaatcgcggtacatgcttaagccgagagttgccttttagggcacccaccaaattaaattgagctcctggctatctattatattatcaaaacagctatgaaaggaggcaccacgtttgctgtggatgctcgaaattcccatattaatcggagaaaaagaaaagaagagtcaatctaaaaataactgaaattcggaattaaaaatatgcaatattgatagatgagtccatataggaacccaatacgtgattaattaaaatttggaataataataaaataaattccaaaattagaaaaacaaaaaaagaagagttcgagtacgtaggtgacggagcgtggggctcctcaccgggagaccgcgcaggcccccctttgccggttcggccggggactcagggtgaaattctaagctctctgtatgtggaaggttcgcgaccgtcgaaagagcataagacacgggcgatgtatacaggttcgggccgctgagaagcgtaataccctactcctgtgttttgggggatctgtgtatgaaggagctacaaagtatgagccagcccctcccttgttctgggttccgaatctggaaaagtccagtcctcctctaagtgggcaaggtcctccttttatatcttaaggggataccacatgcaccatctccctctcttctgtggggacttactctaccttttcataaatggacggagatttgtatagttgccgtccgaatgaccttctgataggacggcccatacctacctccacttccgccggaagcaggtgcgacgtgggattatggctgtctgctgacgacatgaccagtgtcagactggtcac

SEQ ID NO: 65602 - DNA, 12543 bp, Oryza sativa
gcaatcaataggggggaattattccccgtgattccctctccctggattcgtttgaaacccccccttttccccccccggggcctttaaaaaaaattttcctctcccttggattcgtttggaaaccctcccctaatcccgccgacgccattgatggaacccgagaacgccgcgccggtttccttcccctccggccgctctctcccccttccaaccctacttaaaccctccccgcacctcctccgtccgtttccgcctctcaccgcccttcctcctcgccggaatcgagctcgcgccgtcgctctctctctcctccgtcgctgacgacctccggccggctttctccgctcgccgggaccgtctcccgcctcagcgctgcctccttcggcttcgccgcatcctcgccgacctcgtccacctctccgtttcggtcgccgaccaccggagctccgccgtccccgacaacccgagccgcgccaccgcctccctctgctccggccgcctcctccgtcgccgccgtcgccccggggtgagccatggaccgtcgcctcctttcccccttccctcccctctctcggccgccgctccgccgcgtctatggccgccgccggcgaccatcggggcgcgggcgcgccgcctcccgccaaccgcgccggcgtggccgccctcgtgcgcgccgagtggctgccgcgtggggcccggccgtcagccgcccgcgccatcgggtgcggctgacgcgtggggcccacggcgccggccggtgtgagcccgggtgcacccggtccaccgtggactgtgaggctgccacgtgggccccactccagtggacccggtccgcgcgcccctccccctcggctgatgcaataaacccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatgtggagtttgttagagtaaaagccttttcttttccgttggtcgtgtagacgctgcagcttcggaagatccgctcttcgtggaggttgaagccgacgtttgggaaagtgagcaaggcaagtcacatcatccttgagaatattgaatcccagtttataaaattattttgatttaaattattgcattatcgctttacttaaattcccgcgttatcactgttttatctagccatgcctatttacctttgttatgaccttattattgttattgttattattaccttgttcaccctagaataaacaaaaccccaactagtggacactctactcatggtaccactagtatgaatttaggtagatgcttcgccgcttaattaggtaacattaggtggttttacaactctagactttgggatattcatatcgcctggacactatggaatggttggattattgtggaattggattcacacctccccctctattcaaaatcctcaaaatggttttaggttgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacaaagtcgggggtcaatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtctatggctaggatgggttggaaactatgtcacgtcttccgtccgtataccatggtggtatgtggcacgtggttacatgtgaggaagatctgtcttgtgggtaaagatgtacacctctgatcagagtataacctattcgaatagccgcgcccttggttatgggcaagccgagcaatgtatccaagttagtgttttaattttaaaacctgcttaacaactgaaatgtggaaatagttggcctgggttggcttgggacgagttgggacccagggtcgagttgccagttcggtctgaatcatcgtaggccttgggttaaggcaggttcgtgtgggttcacggccttgattaataatcttgtatagctctaggatcgtatttacaaaatagctttgagcaactaagtgtcttttaatgctgtttactgcaaaccctaaccctttatattataacccccttgtactcccttgcatttattctgcacttatgggtgtgtcttgttgagtacgttggttgtactcagtcttgctcaatttttcccaaacccagaaaaggagcccctggatgatgaaggctttggtgtttagctcgtgcctgccatcaagcgcctgtggtcatcgccctagtcttccgctgtttcccgtttgtcttcttgtgtgctgggccttcgccgcccatgtaataaagtaactatttatgcttccgcttgataaactctgaattgtatcaactttcagtgtaccttgcctcctgggacaaggaataatacacgcacgtaaggaacgcccgttgggttatttccggtcgtgacaagttggtatcagagcccccttgaccctaggacgagccttagatcccaagccttagcaatattttcgaaataaaaatcctttcttatttgtgaaaatcctctagtctctctctgtcctgctgcttcatttatcgccaaaatctaatctttaaaatgttgcttttctcttttgtctttttgtttgtagatggccggcagcatcaaccgtcgtggtctggacctgactagcttcgttttggagctgcggggcatgtgcgttgtcctggggtatccgcatggagtggattaccagggcaagcagctcccggagcaggagggtgacgatgtagagccccatgctgcttgggaggtcactgcagtgatcctcactggctcacctgagaggacttcgttggcagtcaccgcgggaggagattctttctctgccgcttgccagaacgccgcactcctcgccatcggcactcttcaccagcgctacccggacgagttgcagcactcgccctaccgctaccaccctcgtcgcggaggagcccgcgactacgccaccttcagggatgctagctcggaggatgacgctaccatcatgcacctggcacgcatggtggaggcgtacgacgcggctcgtatcgacttccatcagatggtgcgccgcgggttggtcgagaacaacatgaagatcctggagctgcgacaggagaatctgcagctgaagaaggacctagacgcagtggaggcgcagctgtgtcagctcaagatcgcccagggagaggtctgtcgccccaagcgccgccgcgtctgccgcagcctgaagatcaccgcccgcaagagtacctccaggcctgagcttgttcgtcagtccctagcgtggacctgctttgtcgagacccctcgtgccgagcccgcgcccttggttcctcaggaggagggagcctctggcgtgggtagcacgaaagatgcgctactgctcaccttccgccctggcccgtcgcagaagtagacgagcagttagtaggcttgcacgtgtgttcttctcgttggtctttctgcttgagtcgtgtggggcatggttataccggtgtggggtataactgtatcggagcctgtctttattttatttgcttaagcaacttgaaccttaatgaaccaatttaatagcagtaataaattcaagaattatggtagtcgtggctagttagttttaatagtcagctctctctgtttgccggttctgtgtgggattttgagattgtgacaaccaggagaagtgctgctaccggtgaaggcagtcaccccgaaggcagcaaccacaacaaccatggcagcccacctccacctcctcccctgcctccaccaccaccaccagacaccaactccatcctcacccaaatcctcgcccagctggccaacatgacgactgctttcctccaccacatccaaaatccgccacagcatcatgctccacctccaccaccacccccacaacactctaaactcgctgagttcctccgcatccgtccgcctaccttctctaactccaataaccccgtggatgctttggattggttgcatgccatggggaaaaagttagacaccgtgcagtgcaacgatgaggagaaagtcatctttgccgctcaccaactgcaggggcccgcatctctatggtgggaccactaccaggctacgcagccagaaggacagcctattacttgggcccgtttcaccgccgctttccggaggacccatgtgcccgccggagtcatggcccttaagaaaagggaattccgagagttgaagcaaggcaaccgctctgtgatggagtatttgcatgagtttaacaacctggccaggtacgccccggaggatgttcgtgaagatgaggagaagcaagagaagttcttggcaggaatggaccctgagctgtccgtgcgtctggtctccggggactatctggatttccagcgtttggtggacaagagcatccgcttggaagccaagcacaaggaactggagtcgcacaagcgtcgcctgacgaatttccgcaaccaacagggggctaaccaaaggatccgctacaccaatccctatccagggggatcctcctcgcagcagcagcaacagcagcagcaacctcgctccgtgccccaacctcaattcgtggtgcgcgtcccacagccgcagcagcagcagagtgtcacatcctgatttttgtttcaggatttataaattatttaataaattaataatagaatttatattaaatgatctttaatttacaagtgaagttaaatgtgggaaataaaattttctaaatataaagcgtcgatggatttaatttttaaattctccatgattaagtcaactctctgaaattttctcggatttttcagagctcaattcctaaatgatacaaagaacagttcagtaattatttgatcattaatgatctaattatatttgttaagagcttttcttgtttaaaaatccttaaattataaattgttgtttaaaaggaattattagaaatgatcttaaaagcctaaaagagaagatctaattttaatttgctaaatctcaatataaaattgggctagataaaattttgttaaataatttgcttaattctataattcctagatttttctgggatttatttgagctaaggaagtatttttaataaatggaattgcatttcatgaataatttaaattgaaaaaggtttttaaaagtctgttttggctttgggccgaaagccggcccaaaaccctctctctctctttccctcggcccagtccgccgcgccccttcctcctctctctctcagccgctgacagatgggccccatctgtcggagccgtcttcctcctcgcgccgccgccgccgcccgaaccctagccgagccgtgcgccgccgctttccaattcggccgcgtctttccttctccggccgaatcttttgaggggaaatgatcttcgagatctcctcttccttttctcttatagaaactccggtcaatttcgtttggaaatcgacggattcgaggtcgattcggatcgacttttctccctccaaccccgacctttccttctcgccgccggtcgccgtgggccttcgccgccgcctccttgcccctttataaggatccccgagctctcctctacccgccacctccctcgccttcgtctctcgccgtcggaagcgccctagcgtcgtgtgacctagcgccgccgtcgtcgccgctccagctgtgcgccgccgccgttccggtcgtcgtcgtcgctcgggaagatcgccattgtgatcgccaagtcgccgccgtcctcgtccaccgcttcgccaccgccggagaccgccggagcaccgtcgccgccgtcgacccgatctccgccgccgcttcttcctcgtcgccggcgccgtccgttgcttttctgccgccgttttggtcaccggtaagttcgccgcaccgcgctctacgtcctggtgccctccgttctcgtcgtcgcgccgtcgttcgccggcgagcttgcgctcccgagctgccgccggtgctgacgtcatcgctgccgtcatcgctgacgtcatcgttgccgttccccgtgagccggtcgtggaccgtttgatctcggccgtccgttttggatagggttgatctcggccgtccgttcccgtgaaccgctgccgtgcgcccagtccaccgcaaaccctagccgctgacgcaataaatccctttttccttttcaaaaataattcattattgcgtcataattcaattaaaatccatataagtgttttaatccgatttaatctttaaaaattcataactaattcatttgaactcagtttaatgtggttcaagttgcaaaaattttataaaataaagatctacatattaaaattgtccataaattgaattaaatttatttaattctttttaaatgggctttaattagatttaatcttgtaaaattcataataaattcatatgaagtcagaatgaggccgttcaagtctcataattcatctaaaattataatctacatgtttgtttactttttatgtattgtttatttggtgtttattagtctttttcttggttttgcgtgttagcttgtcgtttccatcgttgcgaaggttcgcgagtgcaccggaagtgttcaagaagattaattgaagaccgattattgcaaggcaagtcacacagatcccaaacacaattcctttgagcatgttgatcctatattcaaattctctatttatttcaactgtgcatttatttttgaatgtcactgggtggtgtgaacctattctttgttatggcccttttgtacttgattactttattccttgataccttgggtgattataacttgactagttgggctatatatatattggttcaactagatattagatataattgcttagccatgcttagaaacattagcacactattgggataacttattattcactattatttaatggtggcttaatgatagttcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagccagcatgggcaacggctttacctttcgtatagcatggttcattgcagagcaccagactgagaagtggcggagataagcccacgggggtcgctggggagtccatgcctctggtttttgaggggggtgattatgatccaggaatggtgcactgtggtggattgtgttgtgcgaggggtaatgtcacagctcctttccgaggtaccgtggtggtactgaggcacatggtgacatgatgtggggctgtgtcttctgggtacagtggtacacctctggccagagtaaaactattcgaatagccgtgcccgcggttatgggcgggttgagcaatgtttttcgtgattagtctcacacctctcacaataattatggatgctataactggtaataatttgtttagctcctggtttggagttagatctgtacagccgggtatggttgttcagaatggttgggcctgtgcagcatgggtgtgctgttcagtgttgataaaatttctgattaattactccactgttttacttctcttaaatgttttgctaaatgctgcttttgcaaatgagcctatattatgccatcctttggtatcctcgtgcacttgcatatttgctgtgtggcttgctgagtatgtcatatgctcattcttgcaataatcaatcaacctcagttgaagaaaaagaatccagaaggagaagacgtttggcttataccccagttgagctgcctgtgggagtggagccagagcttcgctagattttattttccgctgcagttttcttcatggtgaggactaagtgcctcttaagtaagtatttatcgttttagttaatttgatgaatctgtatattaaattgtcaatttgtgtacctcggctgattcctggacgatgttttcatgcacaaataagttcggaaattactagtgaatttccgggcgtgacacagagtcagcaagggacccgtgcgccccatcctcctacgccagccgtgcagcctggacaaggccgcagagacgttcaatgtcagcagcgtctgtgcttcaactgcttcgagcccgggcactttgcggataaatgcccaaagccgaggcgccagcaaggccaagcgcctccccgccccaacaacggtggtaaggatgtcattcggggtcgtgtgaaccacgtgaccgccgaggatgtgctgacaactccagacgtcatcgtgggtacgttcctcattcattctatccctgctaccattttgttggactctggagcttcccactcgtttatatctgtgccattcatggggagaaatcaattgggggtagaaaggcttagaaaccctctgctcatcaccacccctggaggggttatgacagcaaagtattatagccctgccgttcctatagaaatccagggaattccttttccctcagatctgattcttctagacaccaagaacttggatgtgatccttgggatgaattggttggctcaattccaaggagtagtggattgcgcaagacgcactgtcactctgtaccgagggccggaacaaccggttgttttctttgcacccccaacctctgtcggcagttccgaacttcatcagataggactgtcggaaaccctcatcgtcagtgagttcggagatgtgtttccggaagaactacctggtatgccgcccaagcgagagattgagttccggatagatcttgctcgaggaaccactcctctgtacaagcgaccctaccgcatggcagcaaatgaactagtcgaagtcaagaaacagttggaagagttgaaagaaaaggggtatatacggccgagcacttccccctagggtgctcccgtgttttttgtggaaaagaaggacaagacaaagaggatgtgtgttgactacagagctctcaatgaagttactatcaaaaataagtaccctcttccccggatcgatgatctgttcgatcagcttaaaggtgccactgtcttttcaaaaatcgatcttcgctccggatatcaccagttgcgtattcgtgaagaagatatcccgaagaccgcgttcaccacgcgatacgggctgtatgaattcacggtgatgtcgttcggtctgactaatgctcctgccttcttcatgaacttaatgaacaaagtgttcatggaatacttggataagtttgttgtggtcttcatcgacgacatcctggtgtactcacaatcagaggaagaccatcagcagcatctccgtctggtgttgggaaagttgcggaaacatcaactgtatgccaagcttagcaagtgtgagttctagttgtccgaagtcaagttcttagggcacgtgatctctgctaaaggagttgccgtggatcctgaaacagtgaccgccgtcactgattggaagcaacccaagacagtcactcaggttcgcagctttttgggtttggccgggtactaccgaagattcatcgagaatttctccaaaattgccagacccatgacgcagttgctgaagaaggaagaaaaaattgtgtggagcccgcaatgcgagaaggcgttccaaactctcaaagagaagctggtttcctcgctagtgttaatcttaccggatactcgcaaggacttcctggtgtactgtgacgcttcgcgccaaggattggggtgcgtgctcatgcaggaaggtcatgtggtagcctatgcctcccggcagcttcggcctcatgaaggcaactaccctaccaatgatttggtgttggccgctgtggttcatgctctaaaaatctggcggcattatctcattgggaatcgctgcgaaatatataccgatcataagagtttgaaatacatctttatccaatcggatctgaatcttcggcagagaagatggttagagctcatcaaggattatgatgtgggaatccactatcaccctggtaaggccaacgtggtcgccgacgctctaagtcgaaaaagccattgcaacactcttggcgtccgtgacattccatcggaacttaatcaacagatggaagccctgaacctaaacatcgttagccatggattcttggctacgctggaagccaagcctaccttgctcgatcaaatccgcgaggctcagaagaatgatccagatatgcatgggatcctcaagaatatgaaacaaggtaaagccgctggtttcacagaagatgaacatggagccctatggaacggaaatcgtgtatgcgttccagacgacagggaacttaaacagttgatacttcaggaagctcacgaaagtccctattccatccatcctggcagcactaagatgtgcttggacttgaaagaaaaatattggtgggttagtatgaagcgggaaattgcagagttcgtggccctttgtgatgtgtgccagcgtgtcaaggcggagcaccagcgaccggccggacttctccaacctctacaagtaccagaatggaaatgggatgaaattgggatggatttcatcaccggacttccaaaaacccaaggcggttatgactctatatgggtagtcgtggatcgactaaccaaggtagcacggtttattcctgtgaagaccacctatggagggagcaaactagccgaactctacttcgctaggatcgtgagtctccatggcgttcctaagaaaattgtatctgatagaggaagccaattcacctctcacttctggaagaagctccaagaagagttgggtacccgcttaaatttcagcaccgcgtatcacccacagacagatggacagaccgagcgtctaaatcagatcctagaagatatgctccgtgcctgtgttctagattttgggaagacctgggataagagtctcccctatgccgagttctcctacaataacagctaccaagccagcatacaaatggcaccctatgaagcgttgtatggacgcaaatgccggacaccgctattgtgggaccaagttggggaaagccaagtgttcgggaccgatatcttgagagaagctgaagcgaaagtcagaaccattcgggagaatctaaaggtggcccagtctcggcagaagagttatgcagataaccgacgccgtaacctggaattcgcagtggatgactttgtgtatctccgggtcacgccgctgcgaggcgtacgctggtttcagacgaaagggaagctcgcacctcggtttgtgggtcctttccgtatcattgctcgacgcggagaagtcgcttaccagttggagctgcccgcctccttgggcaacgtgcatgatgtgttccatgtgtcgcaactcaagaaatgccttcgagtgccgtccgagcaggccgactcagagcagattgaagttcgcgaagacttgacctacgtagagagactagtgaaaatcctggacaacatggagcgcaggaccaggaaccgggtaatccgtttttgcaaggtccaatggagcaaccacgccgaggaagaagctacttgggagcgtgaagacgagctgaaggcagcccatcccgatctcttcgccagttcttccgaatcacggcgtcgagattccgtttaaggggggtaggtttgtcacgtcccaaaacgactctaaaatacatcctctaaattatgcctagaataattaaaatctgtgtgaaagcctccaacaattaaaatgtgcaaagttaaaagtcaaataaggcttagaggatttttgtatatttcctaaaagcctaaaatgtgtaaataaattttagtggaattttcagagcacaaataataattaagaagaaataaacaaagttaaaatgattttataaaaagaaaaaccctaaaatccctccttctctctaatgggccgaattcggcccatctccctccccctctttctcctcttcccgcggcccattcggcctccctccccgcgcgcgcgccgctgacgggcgggcccacccgccaccctcgctgacgggtggggcccacccgtcatccccttcctcccgccgctcccgccgccgccgccgccgaatccgccgcatcccgtcgtccccgcgtgcaatcaataggggggaattattccccgtgattccctctcccttggattcgtttggaaaccctccgctaatcccgccgacgccattgatggaacccgagaacgccgcgccggtttccttcccctccggccgctctctcccccttccaaccctacttaaaccctccccgcacctcctccgtccgtttccgcctctcaccg

SEQ ID NO: 65603 - DNA, 5166 bp, Oryza sativa
aggccgatcttatactgtccggggggccgcctgcaaatgggcggcgagggggggcagggaattttgcaggcggcccccttgccgccctccgctagggcgattttgcactgtgcggggggccgcctgcaaatgggcggcgagggggcatggaattttgcaggcggccccctggccgccctgggggagggcgattttgtactgtgctctatattttttttttatataaatatcaatagttatcaaatctttttatattgaaaactatacaagattaaaatctccaagactggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggtgagggatcgacgctccgtgagaggaagagctggcgaacgcgcccgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtacgtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgctcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccagatggactagcatcagcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaagccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacacctgctcctatcaacacacattatttcataccgatgcacttgtgtgccttgagcaacaactctatgtctcgtgcctttttgattttatcttccatgtacttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagatccataagatgtttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcgaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacattcttccttcatgcacctcacttcatacacataatttgttgacttgatcaccctaaactctctctgcaatgaaactgcccaatgcttcaccgcctccttcatctcatccttatgagcataccttgcaccctcaattacctcgttctccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactcaaatgttctctccgcaggcctatcgatgcccttagatgtcattacaaaatctgacagatcaacaccatctggaccaaatctaatatttccttcaccgtgaactatctgaaatatgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgcagtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgtttttttggatttttagtgaatataatgaaatttgacaggggaggggctgggctttataggggggaggcaaaaatcgccctcccccagggcggcaagggggccgcctgcaaaattccatgccccctcgccgcccatttgcaggcggccccccgcacagtacaaaatcgccctcgcggagggcggcaagggggccgcctggaaaattccatgccccccctcggctcccatttg

SEQ ID NO: 65604 - DNA, 9239 bp, Oryza sativa
gatgctcataggggtaagatgtgtgtatatgttcataagggcgagtgtgcacgtgttatttgcatcttgcatttgtaatgtgtatcaaaaaaagaaatactgctttatgaccgagtagaaggtttaggtgaccgatggattagaaaaaaaaaacaagttaaaccgttagagaactgataaatagcacagttgaatactgcacgagaaaaatcctgtagtaagtatcgtagcgtaaattttaagagggcactgtagtacaggttttttttatcgatgtcttaattctgcaacagtacaggatatgtcctgatggtcaaatttgtagtccttatacttaacaccttgagagtaattttagcacagagctcaaataacgtaatttattcaactatgataaattaaaagtcttctattgattgggccacttgcccatagcaattatattttttatatttctcctcaacgaaggcttttatcttcctctcgtatatatcttaggtgatttggacataaatacaactactccattcatttcatattaataataagatgttttaatatttttttttcaaacttctataactttatcaagtttacatatagaacatatcaatattttcaacacaaaacaaatatactaataaaatttattaaaattaatttggtattgcagatgttgctaaaatttcaataaacttaatcaaatttaaaaagtttgattaaaagttaattaaataatcttctcataatatgacggatggagttagatgtgagtataacgagtcgtggggacgcgcggcgtgggtcgcacgagagccaggtttggtgtgcggacttttcattagtggtcactgtctttcagatttttgtctgtcggctagctctgtttgcggctggatacgtatatcgccggtctgtcttgttgtcctcctgtcctgctccgatacaggcagtggattagtccctcatccagggtgagagatatgcttttgatgttagaatttgtttcttctttccagccggtgggctatatcaacacgactctatttgatgagcgatcactccaagtgattggcaaatgttttatccggagtgcgtccagcggaggtagggatgaaaaccgattgattacggtaagaaactaactctatcatatttattttcataattatttttcagaatcgaaatcaaaatcgaaaaccggatatgaaaataaaaccgaatattatcgaaaacaaatacggaacgaatacgaagcgaaacaaatacggtgacgaatattaatcggaatataaaaacccctcactactacacaaatattttttgttgtacgagaccccataatttttacaaatggaccataacttgccgcgtcggcatttacacatacgactgcttaagacgccaaaataagctcatttttgcatgtggaccactcaagagccctgatgaggacatcactacctcggatacagacaacaatcctccaacggtcattcaaggaccgataacaagagctagtgcgcggcaattaaatttagaggtgagctcgttcctatgttcttctttgtatgaattcgagaatagaggggacaaggaaacacttggagaaggacttagagccatggaggatcatcgaggacgtctaagtcaaggtggagacccaaaccaaatcgacctcgggtgcaattcggagtccagaaccagtctgcattaaaacggaagcccaggtcgcatacgcgctcggattggggcgttctttatatggatggaaagctaagaagataacctttccaatggttttggtcccatgtccaaattcttttcgagtcaatgggaatcgaccgaataagttgacatccagaatctgtcccggtgctacgtcaccgtatttgggcctttgggccgtgtatcgtgttggaacccattagggttgcgtcgagaggggattgtacgaccctaaactctatatatcagtaccagatatccacagatccaaaaactgctctacgcagtgatcattacatgaagaaagctacgacactactttcaagcccacagagtcacggttgtctcctccttccctctcggcgaagttgtgagaaacaaaggcgttgtcggccgcattgcgaaatgggtagtcgagctaagtcagtttgatgtccactttgcaccacgaacagccatcaagtcccaagtacatgctgattttatagctgactggaccatgcctgacaatcaatcagacaactagatcgacaacgaaacatggacaatggcattcgacggtgcactcaacagccaaggagcaggggcaggattcatcttgacatctccctccggagatcaattcaagcacgcaatccacctcaacttcaggacgaccaataacacatccgagtacgaaggactactcgccgggataagaagagcagccgcacttggggtcaaacgactgatcttgaaaggggactccgagctagtcgcgaactaggtacacaaagattataaatgctctaaccccgagttatccaagtacctcgcagaagtcaggaagctggagaaaaggttcgatgggatcgtggttcgacacgtataccgcaaggacaacatcgagccagatgacctagcacgacgtgcgtccaggcgagaaccactcgagcccggcacctttctggacatcctgacaaagccatcagtgaaagaggcaatcggcgagatcaacacagccgtccccgacatcaactcggaggccaaagaggcggaatgcgccatcgccgatatcgagaccacagacgactggcgcaccccactgatcaaattcattaacagcgaagagttgcccgaggacgacgtagaggccgagaaaataacccgtaaagcaaaaatctactgcacgatcggcaacaatctatacaagaaagcgccaaacggagtacttctcaaatgcgtcttgtccgacgacagcagacacctcctcctcgatatacatgaaggcatctgtgggtcacatgccgccggtcgcgcattggtcaggaaagcctttcgacaagggtttttctggccaaccgccctcaaagacgcatgtgacatggtctagtggtgtgaagcctgccaattccacaacaagcacacaaaatcacttgcacaagtgctccagaccatccctcttacttggccgttctcgtgctgggggctagatatactcgggccattccagcgaggacagggcggctacaagttcctattcgtggcgatcgacaaattcaataaatggatcgaagcagttcccacgggggaaatcaaagccgccaacgccatcaagttcatcaagggaatattttgcagatacggactaccgcatcgcatcattactgacaactgctcccagttcatcagcaccgatttccaggattactgcatcgggctgggagtcaaaatatgcttcgcttcgtttcccatcctcaaagtatcggactagtcaagagggcaaacggcatagtactacaagggaccaagacccgtgtctacgacaggctcatgacacatgacaacaaatgggtcgaagaactcccatcagtactatgggccatacgcaccacaccaacaacgtccaacaagaaaacacccttcttcctcgtgtacggctccgaggccatgctccctagtgagctacgacatcagagtacacgagcacagaagtattccgacgaggaacaggaggagcagcgaaacgacgatgtgaatctactcgaggaacatcgcgagcgagttgccgttcgagcagccgcctacctacaagcccttcgccgctaccacgagaagcgcatccgagcccgcatactttcgatcgacgactacgtcctccgaagggttcaaagccaagtagggcgaaacaagctctcacccaaatgggaaggaccatacacgatcacacaagtcttgcgatcaggcgcattcaaaattgcagacggcgatggccacgagttggcaaactcatggaacattgaccaactacgtaaattctatgtatgagtcaataccatccatatctgtaagacaacttacatcatcaataaagcctattttcaggcgcatattacaatcacagtgttcctgcctgatgatccctcactcagacgacacctagcgttgacacctatcctcatgtccctttacgccatgctgacaaggcctccgagaaacctaagggatcttcggctggggacgcccagagccgataaggccttgtcggattttgtagagacgaaagaccatgtcagacctggtcgtgtaagagttctccccatgcgtattaaccaagccgcgtaatcggaaatgaactttccaacttcacggctgggggctaggattagtgcttgttcaaccgaggcaggtcaaaggtctaagagccttgtcccccgagaagaattctccaacggcaaggctgggggctagagagagtgtacaactcaaacgactggccaaagtcggaaactaaggaggcactcttacacactatatccagagtaagaagggctcattaagatagatttcttttctatttcataagatacttcttacaatttcacacaagtccaaaaccatattacacttttccccaagatgtctatcgcagggtgcaaaggctaccaggaaggccaacgctagtccatcgactggaaaactttttccgtcagcggtgccatcgacttcgccaggtcatctatctccgcaggagtcctccgagaacgtgaaaaaccttcccggaggaactcgaggtgcagctgcggacggtgatcccgtatacaggccaacacgtgccccccggcataccggcttgagcggtgacactcctgcttcaaggccccgtcgatgcgtcaaccaatggcttcaagctgagcgcaggccccgttcaaccacgagatgtatctggccgccgattcttcggggtcgccacgaggtactcggagctccctacagaccctcgacatggacgtgcagcaactcttcagatacgagtcgaaccacacctcgcgacccctgagtgcctccacggcctggtcttttttcatctcaaccatcgccctctcgagttatgcgacttcacactttgtcttccaatattggatgcgacggttttggtcagcaagtctaccctcgagatctgctcttccattccgagaacacaaaaatcaagttaccccgggaagaagaataaaagaaatggaaacaaagatcaccaacctaaggaggtcatcgccacacccatttccacgggtgagtttcgtcccatctcgtcctgcgacacaggcgtttggagggcaatcgccggaacgaccactggtaactcggctgcccacgctgctggacatcctcgacatcgacatccctacaaacgacaaccaaaaatactcaggaccagggtgccaacagagatcaaggcagcgattgcgcgaagaaaggcagtcgaagccgacaaatcttatacaaagtgtagtcgattacagaggagctgaggccctactcttcaaagaacgggagaacagactctcccagttcgccaatctcctccatcacacccttacgagcgtcgttggcggccccccgatcaaagatctaccgaagatcgagtttggggtgcgccaaccttacgcacgctaggacgtgacaggccccggtgtaaatcccgtttgacgcctcctccacgatcctggccgcatgtttggagggtatcgcctccattgccgtagccagttccgcaagcgaggacgtcagcgagaactcgtcggggttcgccgggatggttgtcgtgacgccacactccccgacgagctgatgaagaccggtgtaggtgacccgcagcgacccacggatctccgacaagttgttctcgagctccgacatccggacctcgagtccccgccgttgccgttcgttaccggccaccagctccctcattttctggaggtcctcgcgagcctccgccaggtcgtgttacagcttgtcggcacgcttgttcgccgatgacgctgccactgccttcgcctcttgatctcgcaacttatgccgcgagtgccagcctcgaggatgcgcttcatctcagcttgaagctcctcccaggtgaggacatcagccggcggtccacgagtaggtccgaggccgctggatggcccgctcggcatcgcttcacggctctttgacacgaccacgacatcggttgaggccgccgcaggagacgctctggaggcccctccggacctgtcctgcgccgctctcgcctgcgccgacctgcaaaagatcctcacgtccggccctcaaaacaagccgccagaagataaacaaggaaaggatctcgacttccgtttacatacttctcgcctagcgtcaccagctttctctgtcgcggaggtggcggagacgcgtccacggcctgggtaaatcgagcgcgagttgagggcggcacttttcgaatacgaaattaaggagtcaagggacttaccggtggggaggatgctttccggcggctaccgagcacggaggtgaacgttcttcgcattttcgggacacggcttccactagtcgcggcagcagcggccacgtcggacatctcccgagcgacgctctccttcagtgaggccgccgcctggtggtccgcgagcggtccaatgacgtcagtcagagggagagcctacaccacatgaagtcattttccaacccgtgaagcaaaaatagcgaggttgccgaatacactcacgttgattgcggcttcgcgctcggtcgcctccttctcacaaagaggcacggggatgtcgcttgccgttgtcgggccgctaatcatcaattggccgacgcggcactccacggtagcgctactcaagcctgcagatcgagaacagaatttgataaatcaggaagaacatgatcagaagggaatcaatttaactaaaaaggaaaataccccgaggagaaacccgggtcgcgtcctccggcccggaatagtcaaaggctgggtgggctcgagcctggagtggctggatccgcctaccaacgaagtcggtagcgacttcataccccgacaaacctcgtactcggaggtcgtcgatggcatcgatgaagcactggagtgaaggggccaagacaggctttgcggtccaagacgaaattttgtcttgttgttcctcgggaacaacaaagacagggtccgaattctttatctgaagatagaaccacctcgcccgccatttgctacgagaagaagggcactagaacgggatatagcgcgacttcaaaccatcctgaagtcggaacccgacgcatctggacaccctgttggattccatccaacgcaactcatagtaaaagcggaagagatcgaggaagggctctaccccaatgtaggcctcacaaaggtgcggaaaaatactaaggaaggcaatggaattggggttcaagtggagcagagaaaggccgtagaagttcagaaccaatagaagaaattcagaaggtggagggagaaaaccacaaagaatgtaatccttgatcgcaaccatgtgacccaggacaggctggggttcagtacctcctacttctctctccatgactccatgaccgggaagggcgccatcttcctggagcttcttcagcgacgcgttggtggaagtagacgtgccgagatccatcgccgactacagatcgctggaggaagggcggagattgacaagctagggtttttacggaggcggggaagacgagggacgcctggaggttggaaagttttctcacaacaggcggacttcaaaatgaatccccaaaactcccctaaatagacacgcttcgcatggcgcgaatttgaagggaaggagagagagatgcccgccggaattttctgggtctgttacgcgcggcggtttcttggacttcagtttaaattcactcatgaccgttgggcttcacatggtgttcttgattatgtcttgtctctacggtttccacaccgagaacgacatcagcttcgacatcagaagtcgcgattggtcacacgagttcatttaagcagaagtcgggggctactgtcagggttacgggttagggataccccttacccttcgatatatctcacgtatcgatatggcatgcccgcgcatacatggacactctctgtatgagttaaggaaatccttcgcggaattggcagacgaaaagagacctactcggacaaggctaggttctcaacgtatcgtgtacggttcgacgtctccgagtcctgcttggagattgcttgacccgcgatataaaagggaccccctgggagaacctggggggacggaatctctcacagccaacaccactgccacagtctacgaagtcagagcccgcggaagccagatcgccgggaggtctagtcggattaactcgattacgatctcgtcggtttcatcgagttccatcgttccctttgtaacctgtgatttccatgatataatcccataccaactgcattagggctattacctatcaaggggcctgaaccagtataattttcgtcttctgtttgcttgatgtcgtattacgtggacccttgtatcaacgtaccccaatactctctatatccggtctacaggtatcacccgtcgacaccgccatctttaggtttttgggttttgcttagattattctgtcaagaacagtttcgccgctagatcggtttgtagaaccccaaatttgtgtgcttaatcgttcatatgcaatttggttgcaatatatcttgttcttgcttgtgttcttcgattcgcatgcagggattagccttctcggcgaggtcaaccggatttcggcacggttgataaccagaggagacgtggtactgcgattgcggggctcagtagcgtgttcgttcagaagccagatcgagttgtgtcgtgactctgcccaaatcgactgttgatcaatacctatcggtagatcgggacctaactccctcatcaagcccgcatggaaaaatgaaattttccatacgggcatcttaaggagccgtatgcgaaaataaaatttaaaaatttgaaactagtttattgtagacccccgattttggaaatcggaaatcttctgtgtttatccgtaccaatccctggatcagtagttggtacacacatacatagttggatcacaacatatcacgaatgaattcaggctaaaagggttaaatacttacattagggccaggtaggccaacaact

SEQ ID NO: 65605 - DNA, 1277 bp, Oryza sativa
cccgattaccaatatggttttctttgagcaacaatagtaagtgtgacctgtctgtatcctgcatgtcactttctttattgaataaatgctgtaactctgactttttgcatgtaatctgtatgtttatgggcaacaacttttccaatggcattccttttgacattccacatcatgttggatgcagcatgttgattctaatgcaggactgccagtcttagcagttgattcaatgaattgccagtcttagcagttgattcaatgaattgttgttatagtctgggtcagtcaacgtaccattttgtctatgcaataccatttcaaactagactagttaaccaatgttatgtaaaactcttgtgaaacatctgatctgatttagccaacatgagcatagtaaactgaactttccagggatcttaatttctcataacaagaactctgtatattcaacttagtgaattcgccgagaggcaattaccgaactaactttatgcttctgcaatctgcagatgatgaagacattaaggcagaggggagcggggaacaggaagctgctggtgaagcgaagccgtgaaatacctgagagttttagaacgctatgcttgacttgtttgtgacgctgccaggtcttaagatttttttggtgtaaactctggagagtggatcactgccactaaagtaaagtagtagttatggtttagtagctccattttgttaaaaaactttgtgcattgcacactgttctgttatgtgaatcgccatatttgcatcaaccattgcaaagctatccagccattctgtgtttcatacttttactcatagcggtttggtggcatgttccatttgccttgtactttggaacttgcataattgttcgtgactgtaaaaataaactgaagtatccagcttgctcaatccatattgttactgcctgatctacatgttatacaactaatcatggagatcactgacaatttgttttctagggaattcaaaaatctcaaaactattgatgatcatgtaagcagataaccatattcttgcattgatttaacaaattgtaaggtcacaagaagatgtagatcttcacaaagatgacagaatattgctctcaggggcagtgacaacgagttcggcaaatgcaaactcctgctcccttttgcttaaactctctgttacagctgccatgaagaagctttgcccagtttcctcacaattcaatggagaagacactcctatgatggctcaaagtggtgtccattttagagactgctact

SEQ ID NO: 65606 - DNA, 1181 bp, Oryza sativa
  unsure (1)..(1181): unsure at all n locations
catacctttggttccaagagcttggacgcatagtgaataaaggtcgggttgaaggggcgcagtcagctggcagcttcttggccggcatcatcaaatgataaagtcttggataagaatctacaacgcagtggaacgcccttgttgacgattctatactacgacggcatctagggctcctcgaataatgcgatatcccacaccgagtaaatccttaacccttcctcctcttactaatactacataatgttcttgtaaattatggccaataccaggtatataagcagcgatttcaaatcctacggttaattgtactctggcaattttccgtaaggcatagttgggtttttttggggttatagtggaaaagtcgacagataagtctcccttcctgtccctctacagaactatacatgagatttccacctcatacggctcctcgttcaattctttcgaagagatccttttcctcgttcgagagtctccgcccgaccaacctcgctaacttgcgggacatgaacttacatgtttccaggcaggtaacgtatagtaaggcatgcagcctctgccttacttcctagcaatgtattttctaacgaggannnnnnnnnnnnnnnnnnnnnnnnnngaccgggggggggggggggcatttagactgagtgtctctacctggggtgggtttaaccccctctaggaaaactagagcctataccggttgctatctaatctttcatgacgtgaaattgaactaccaaaaccattaaaaaatgctttgccgacggcactgtctagaatggctcgtggtcaaagatgataattaattgcgtgcaagtaaactaacgtcgttcgttcggcgaccccgcctcacttcacttaacagaaagggggcctattgagaattacgagatttactgcttacacgggatttatggacaaaagttaagcaagagtacttcactgaaaaagcaaaaaattcactggtaccgctttactactcatgattggtacagccttttcttttcctgtattaactcgccaatcaacgaaaatgggcactacgaaagctgtttagtcaatcctgcacaaaaataacgagcgagtaactcacactatttcggcgtaggcctcccaaaaggtaacggaggcgtgcaaaggtttgaaaaaaaatgaaaactgctactaga

SEQ ID NO: 65607 - DNA, 696 bp, Oryza sativa
aatctccattctacaatgataaaatgaaattattattgtttacatatatgacaggagctagttattgaacgaaacaaatcgaactcaaagatacttacaaaatccatgcgctcaaaagagagacgtcgagggcgtccagatggtacagatcgaagacatccttgaaatggagccagagaacatcttctccttgcaagaagtcggggtttctgatcctcactccgaacatctctctacccttggcgctcatttccatgtaccattcatggaatttgtacatctgtgtcggtagggactgcagctactcaggcgagacaagcggtttaccgagttcaaacttgtatgccactttcgccttcgggattggtgcggctccaatcagctgatccatagttagaccggtatctgaaatgaaatccgttattccaaaattttctccggtcaccaacggctcgacctcttggtttgtttgttctccaagctgaaggactggtttggacttcttgtgataggctttctgaagtgttcggtcatagtctgatatcttaaaggcctccttgtttgctatggacattcccttgaagaagttcttcacgctcgggtcaataggtatcttcttttcaggactccgaggcttgagttgtctcttcacttctcctaccatataagcatcaagctcctcttgactgcaatcgt

SEQ ID NO: 65608 - DNA, 3482 bp, Oryza sativa
gggatccccctcctcatcgcgatcagccatctgtgcatacaaaaaatatttgttaggtctataggtcatattcgctaagcgtaatattaaaactctactaatcttatattaaatctctaataatcttatattaaaattgtagtaatcatatatgctaagtctaacaatcttatattaaaactctaataatcttatattaaaattataataatcatatgctaagtctaacaattttaaattaaatcgctactaatcttatattaaaattgtaataatcatatatatatatatatatatatatatatatatatatatatatatatatatatatatatgctaagtctaacaatcttatattaaatcgctactaatcttatattaaaattgtaataatcatatatgctaagtctaacaatcttatattaaatctctactaatcttatattaaatctctactaatcttatattaaaattgtaataatcatatatgctaattctaacaatcttatattcaaactctaataatcttatattaaaattgtaataatcatatatgctaagtctaacaatcttatattcaaactctaataatcttatattaaaattgtaataatcatatatgctaagtctaacaatcttatattaaatcactactaatctttgtcacgcccggaaatgtcacgcccggaaattcactagtaatttccgaccttatttgtgcataaaatcctcgtccaggaatcagccgaggtacacaaactgacaatttaatatacaaatccatcataataataacgttacacacttacaaaagaaaagaaaacagcagcggaataacggtctagcgatggcttcagctccattcccacaggcagctcaactggggtataagccaaacgtcttctccttctggatcctttttcttcaactgaggttcatttattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacaacacacccatgctgcacaggcccaaccatcctgaacaaccatacccggctgtacagatctaactccaaaccaggagctaaacaaattattaccagttatagcatcaataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcacaacacaactcaccacagtgcaccattcctggatcataatcacccccttataaaacaaggcatggactccccagcgacccccgtgggcttatctccgccacttctcagtctggtgctccgcaatgaatcatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatctagctgaaccaatatataaagcccaactagtcaagttataataacccaaggtatcaaggaataaagtaatcaatgcaaattggccataacaaaggaacagattcacaccacccagtgacattcgaaaataaatgcacagttgaaataaatagagaatttaaatataggatcaacatgctcaaaggattgtgtttagaatctgtgtgacttgccttgcaataattggtcttcaattaatcttcttgaatacttccggcgcactcacgaaccttcgcaacgacggaaacgacaagctaacacgcaaaacgaagaaaaagactaataaaaaccaaataaacagtacatataaagtaaacaaacatgtagatctcgattttagatgaatttagcaacttgaaccactcaaaaccgagttacgatgatttagttatgaatttccgaagatttaatctattagaaaaacaggaaaaagaaaaacgatgatgacgtcatgatgacctcatcaatggccggaccaagatggcgacctcgccggagattggatggtcggctgcgactttggaggacatgtacacgtagaggacgacgagacgaacccaacggtactcaccctcgaaccaaacgacgaacgacgacggccggcgacgaggtctagcggcggcgcggcttcggtcgacggcggcgacggggctccggtgaccggcgacagcggggagagagcggccgagcttgcccacacctcggcgcacattacggcggtgacggcgaccggcggcgacgactgaggcggcggcgcgacgcggatggagctcggccggcgacaacggcggggtggagcacgtggcggcggcgctacgaggcacgggagagggggcaaacgaaagaggaggactagggggtcctatttatagccatgggaggccgggatcgagcccacaacgacgggaaaaactcaggaaagtttagatcttcgccggaaaaaggaaaggttgaaccgcgaaattggaaaggatttccatataaacttttggggatttcttggggacaaggaagaggagattgagaggattccattcccgcaaccaattcggaaaaaggagcaacgatgaggttggattttggaaggggatcggcggcaacaggcacggcacggctcggctatggctctggctctgtccagagctggaagatgaacagtagcgcagggagagaaagtagacttctttccgggcttttcttttctcagcctgattagaagagggagcaaaacaggactttggctgagagaagaagagaggatgcaggctcgggttgggccggcggaagagagaggaaggaaaggaatgggccgattcagcctaagacaagggaggagaattttattactttcccaattaaaataatcacttaaatgatctttgaattgttaaaaatacttccaatgctcaaataatttcaagaaaaatcctgaaaatacttggacactcaaagtacttaacaaaattacaattagaccatttaatgattagtttaatatgtgggtaattactgaaatgctctttgtatgattaaaaattaggaattgagctccgaaaaatccgagaatattccagagagtataattaaccatggagaat

SEQ ID NO: 65609 - DNA, 1108 bp, Oryza sativa
ataggaattacaggtgggccccacccgtcagcgagggtggcgggcgggcccgcccgtcagcggcacgcgcgcgggaaggaggccgattgggccgcgggggagaggagagagagggagggaggtgggccgagccggcccaagaggggaagggggaaaaaaggactttttagggcttttctttttataaaaccattttaactttgtttatttcttaataattattatttgtgctctgaaaattccactaaaatttgagggctccttttagaccaaggagaatttaacaaaaattctccgggccacattcgaatttttcttgtacgtattttaatgtttgccaatttcttttcgaattttaattaattctattattccttttagaaaatgaattttatttcggaatgaatttatcaggacgtgacaaatccaccccccttacaagaatctcatccccgagattcgaggaggctagcaagaagataggttgggcggtcttctcttcttgtctgacttcttccgtcgcgtcttctataacgaacttgcctagcaaaacttctccactctggactgcttgtctcgatctcctgttgcagatggaatcttctgttcacccgacttgtccctggttgcacctttaactgactcagactaggctgtggtagttgaggatggggcttcagtcctagaacttcttatcattcatatctttggcgtcaacctcatacaagttaccaccttcatgacatgcgtcgacatcagctttgtcattactaggataccatgcttgtcatcatgagaataccatgcttgtcatttacttctaacttgccaccaactgcctcatattagctttcctggtctccgggtgcaagctacttctgctattcgatgcaagggtcggtaactttgcctttgaattatgtttctaagaagaaccaacttatcccacttgacatgctttgacgtctccccaaatgactttactgctggacttgttatggtctgatcgttatcctgccaaatctgaagcttcgttgttagatgcgattttaatctgacctccatagactatcttcgagcatatcacttggttcataactgggaatag

SEQ ID NO: 65610 - DNA, 25551 bp, Oryza sativa
tgtttgaggtagtaggagagagtgatagtgatgatagtgccagtgattctgattatgttgatagtgactatgatttgtctgattctgatgatgacttgtatgtggacaatattgatgtggaggtagaagacttaactggaaagaagaaaaggaatagtaagaaagctagaggcagtgaactgaagggcaaagaaatagtagtttgtacaaattcagagggagatgatgaggactatgacactgatgaaggcttggaggcagctgattctgatggggataaaagtggagttaagtttaagtttaggtcatttagtaaggaggatgtcaataatccagtgtttaaggtgggcatggttttttcttgtgtagagttgcttaggaaggcaatcactgaatacagtatgaagaatagagtttatataaagcttcctaggaatgatcagcaaagacttagggctcactgtgcagagggttgcccttggaatttatatgcttcaaaggacagcagagctaatgctttcatggtgaagacctacaatggagagcacaaatgctagaaggaatggatcttgaaaaggtgcactgccaaatggttggctggagagtacattgatgcatttagagcaaatgagaagatgacacttggtggttttgccaagacagtgcagctggaatggaatctgacaccatctaggagcaaacttcagagagctaggaggttggctttcaaggccatatatggtgatgagatcaagcagtacaaccagctttaggattatggtgttgagctaaggaggtctaatccaggcagttgtttattcctgaacattagtgatggtgctttagcacattgtatatgtcacttgacgcatgcaaaagagggttcttaaagtgctgcagacctcttatttgtttggatgggtgccacataaagacaaaatttggtggttagattttgacagctgttggaattgatccaaatgattgcgtatatcctataccattagctgttgttgagactgaatctctaagctcttggaggtggtttctacagaccctgaaggaagatctaggcattgataatacttatccttggacaataatgatagacaagcagaaggtagttctctaagctcttgatttatttcttctaaatgtcaccaaactgttttgtgttaattgttgttcttggtttgtgcttgattgcagggtttgattccagctgtgcagcaaatttttctagactcagaacacaggttttgtgttagacacctctactccaactttcaagttcacttcaaaggtgaaaatctgaaaaaccagctctgggcatgtgctaggtctagttcagttatagagtgggtggcaaatatggaggaaatggctactctcaatcaggatgcacatgattggttgaaaaaaatggaacctagtacatgggttagagcatattttagtgacttcccaaagtgtgatatactcttgaacaatagttgtgaggtttttaacaaatacatcttggaggctagggaattaccaatgttaagtatgttggaaaagattaagcaacagttaatgactaggcactttaacaagcagaaggaggctgcagaacagtggaaaggtcctatatgccctaagattaggaaaaaagtgctaaagaatacagacctagctaacacatgctatgctcttccagctggcaaaggaatctttgaggtccaggatagaaactttaagtacattgttgatatcaatgcaaaacattgtgattgtaggaggtgggatctcacagggataccttgcagccatgcaatttctagcctcaggtaccagagaatcaatgctgagtcagtattgccagtttgttatagtgtacaagcattttcaaatgcatatgagttcaatatttggccctgtcaagacacagctaaatgggaaaagacaaatgggccacatgtgaagcctgctgtctatgaaaagaaagttggcaagccaacaaagtccaggaggaaagcaccacatgaggtccagggaaggcatgggccaaaaattagcaagcatggtgtggagatgcattgcaagtactgcaatgaggcaggccacaaccaaaggggttgcaagttgaaaaaagctggactcaggcccaatcagcaaccaaagaagtctattcaaaaccctgaagtcatcacaacagaggtaatgccatcttttattcaatgatttccttctaaaatcaaaacttccatttaccatgacttctctgtaggtgcaatctcaatctcaggtgcaaactcagtctcatgttgaatctcagtcccagcagttgctgacacaggttaacaatgcaatggtatctcagatgtttgaggagtcctcccaagttactcaaatgaacttggcacctaggcctctgcctgacaaccaatttgtcatggcaaacaaaccaacagccaggccaatgcctctaaccacaacagcaaaggaaggaaagctgagagcaacaaaaagaaaggctgcaggtgatggtcctgaaaagagagctaccaagaagaagtagaattgctgatagaactgcataagagctaggctagagagctatcagtactttcttttgtaatgacaaatgatagtgtcaatctgattatggctaccatgtctccttttataattatcgaagaaatggctggcatcttttattttgtaatgccaaactgaatccaggcattaactacatcttcctgttctggctacatattctcagaatgcaattactgattatagcttcaatttctcattctgtttaaattttgcaatgctctactgtcattttgtctgaactttgaaaagttctactgtttgatgtgcacgtgtattattctgagccatgcatgtgtaactgaacagattcaacagagactgatggatatgcacattatttgttcattgcaaacataagaaagttaaaaacttcatccaaaattcagaattgaaatataacattgcttattcacagcacattgcacattgcacttcatttgaaacatcacattttttttctgcattgtttttcctgaatacaaattcacttcacatagcacattgcatatacatcacttaaaccacagaacgatgcaaatacacagtagcagaccaactaaacacacaccaccagctaggaacagcttcaacaacaccatcatcttggtcaaaatgaaaatcatatcttccagctccttgaaatgtccaacatcgggttccttcttgaattcctgagcactgctcttcttcagctcatctccatccttcattttggcctctttcagcaactctgcacaggcagcttcataaatgaagccactcctcttcaggaatttgatgtaggcttcctcccaataccagaaattacaaccacttccatccttctatacatttcacagattgcaacatgtaaatttcaagcaaaatgacaaaaatccacaaagggcactttatcagaggcaagagatttatcacgtggtctggacatgtgaagaaaatgcgacctcgattagcttccgtggtcgcggttagctccaagatctgcttcaccccgcatgaagggcacttaatcagcgggattgagggcctcctcctcttgcgactcgagtggcttgagctgcttgcagaagccatgccgacgacgatgaacacacctcggccgagtgccctccctcgccgttgactctcagccggaagccctccctcgccgtcgactctcagccgccctcccacgccctcactcaccgtcgactctcagccgccctcccactccctcactcgccgtccaggggaaaagagagcagaaaagagagggctagggtttggagaattcgagggaactgaggggcttagatgaaaaagtgcacggtgcgggacggtgcagtgtggcatcacacgtgtcgcgacacgttgctgtccacgtatgcacgaaacgagtcaaagcgttctctggaccggattgatacaataaaacaagattagtgaccttgaccctgtgtttgtatgttcatggacctggatgaaacctcctcacaagtttaaggaccgccagtgcaatttactcttcttttagccaggttatctttcgttagaattactttcttgtgaagaaaccacataaagaccattgaattactttttttcgttagaattactttctttagatgaagtggatgaatgaagctaatatgtcaacaaacgattcatgaaaacataattaagacttttggccccaatagctatacatagctaggtatgtacgtactccctccggttccactgcacccctgctcagcttcactgttttctcgtgtaatagaaatcaccggacgttatgaccctgaaggcctgaacctggcatttctgggaagatggcaatcagcttccctcttttcttgagtccatcctctgttttttttccccctgtggtttcaatctgtacactaattaagaacagaggaagtatgcaagtctgtaaaatgcaaatttggaatggtgcatattatgtactacttgacaattagattacttaaatatctgcttggatgttttcataataaatgcttatcataaacactaaccaaagagtacaaatcagaaccaccttgctagatcaaatccctctcatgagtcatgagaatatattatgttggaagatcttatggtcatgaacccttgacatgttaattagcgcgcgcgtactacgaaataatacatgaatataatccgggttttgtggataatagtaaaatgttgcaacaaagccaaataatactgatgagattcggttgtatcactggtgaccttttatttcgtgattgaatcatcgctgtatgaaaaaaaaattcatacaactgaaattagtttgcgccaataaattatcatgggtagggagctacacaccaatgtgataaaccatgacatatgggtcttttccatgccaactaccatcagcacatctggcggatcagtaatcctcggttgagcaggcagacatctgactgttctgagatatcattttcctgatcccgcgcattccaatcagacattcatatttcaattgaaatggaattaaatgtgaaaaatacccccctacaaatcacttgtgtttcttctttgcctactactacttgatttcgtacattaaacctccacacaagacaatttctcctaacaattgtggttggtctctcgcaacctccttcctcccttctagtatctgccttcccaaatccctgtatgagctaagatgatggcagaacacgatggcacaacttgtgcgctagctgtaatttctataataccaacctatcgaggtggcatgagtttctattgtcccatgacgctggaggcccatgcagcactagaaattgaaataactaggtgaaataattgacaatgggactttggggaagttaggacataaattaacttgttgggaggattttctgtataaaattgagttgtagggggaaatagaaaaactagtgagttgtagggggttatttggaatttcactggaattaaattatgagcaaagaatggcggatttcttttttgaatatttaaatgtcatgattcagctcctgttgtttttgcgtgctctagggcgcataattcctctggaaactcaggatgtatcctggcagaataagagagagaatgtggggatacgtgttacggctactgtacaaaatacaacaacgatgaacccgatcaaagtgaggcgtgctccacgcatgccaggcgtgccaatgttcaccttgctggatccgaatgggcagatgtgctagctgtaaagggtgcgactatataagcactcgagaggaggctagggccgcatagaatttgtaaacagcaaactgaatccccaaactaatcctctgtctcctcaatctatctctgatttatttctgcagttaagggtaaatacaacaagacctagatccgggatttcaaaaaattcaccggttatagatatatattttggtccaaagttgtcaacgctggttcatttggtgcaaattaggagtaacatgcatccgaatggtgcttaactagtttctcttttgttcccgatctgcttaattaaatgcttagcgattaacaagcccaatatcttcttcaatcatgcaagaaattaagcgcatcgattttgcaagaattcaattacttcaaacttttcaattccatttaacagcctctgagccaatcaatgcttaacaaaaatgaatcaatgctattctgtaaccatcatgagcaggcatcatccatcaacaggattcaacaacaatcacattagccatggtacgtgtcagccggttgccacagatgtgcacgctggcgctcagctgccccagctcctcacttctttctcttagggttagatacagatggagtgggttactgatcatatcgatatagaacgctactagccacaacagataaggaattactaagctacctttattaatattatttcttgttcctaaattatcctttagaaatcaacggtgcatattatttcgttgaggtacctgtatatgttgatatgctgatatgagattgatcaggtagtgaccaacgcagtgcttaattagctttctcttgtgcttacgtttttcaaaaaataaataaatgaataaataattagctcagatttgtcattttggtcatatacaacggtcatgctatatagagtcagaacttttgaaactttaactatcattagtttttcaaatgctctatttaaaaagggaaaacaatagtatgcttagttttgccatgaaaaagtattatcatagtataaaaacttattagatattctaatacaaaattgatagtcaaagtttgaaaattgagagattttacggtctcgaggtaccacattttatctctcggtgtgtttggtacgtactaggagctacgggtacctctagtaactcttgaggactgtaaaatttctcattaaaatttcaactcaaattttgctctaaatattaatacttatgagttatgaccggatggagtatatgatacggatctgtatcctcaataaaaattttaactcaaattttgttctaaatattaagcacttatgaccggatggagtatatgatacggatccgtatcctcaataaaaatttcaactcaaattttgttctaaatattaagtacttatgaccggatggagtatatgatacggatccgtatcctcaatactagtgtatacacatcgttcttcatgcagtttgtccttgatatgaagttctgaaaaaaaaaaacttgcggcggttttttaacccattgacctgctctcttgtctgctctggactttcactacccacagatacacaccttcttctcttcttgcccgatcacctatcccttattgttacaagtctcattttatttttcttattaccccatcactgcatgctacaagtgataagctactgcttagctgtgaattctgttaagagtattatgtgtttaggggtatattagtaatttctcatatctattgtactcatatatgtcctttgggctaactcaatggcaattgttaatctccaaatcttatctcaaagtgacatggtatcagagccctaatccaaaatcgccactaaatccgtcatcaccggcgagccatcgtcgtcgtcctccgccgttaatcgttgaagcatcaagcaccagtttttggcctcaaccagcagcagtgaccggtcgttatatccagtactccgagactgccgcccgttgccgttcatcgcagccgctcgtcacggcgcctttttcatcgctgcaggtcgcggcactcgtccctgctgctcctccaccagtcgcatggtcgtcccgcgccatcctctcggccccaaccacgcggcgcttgtctcgctgcccgtcgcgtggatcgaagcaacctctgcgatctgtagcagcaacagcagcggcataccatcgtccagttcgccttcaacacttcaagcagtaaacaagtagcagcagcaaatcaaaatccccttttcatcatcattctctccaaatctggtgatgttctctggcaccgatcgaatctatgatccttgtcctcgagctcctcttttcttcaaacagtagcagcagtgaagttccaagatgcagcaacaagtctcattcccattgtgaatattctgttcttcacccagtggttatcctctccttctccatgttcattcactctctacactaattttgcatatttctgttgtggctctgtgctgctacagcctactatttgattagtagaggagtacatgccatatcatgacataattagtttcattgctcgtcataatcatcttgtgcagctgcctgttccctcaattaattcctactttcagtggtagaatttgttaaaatcgtccccttaatttatattgatccctactgtcaccatcagtggcttatgcatctatcaagggcagggcacttctttcgttgctcatttccatagcagtcaccaagctcatcgcctgtatatatcctcagcattgtgcttgcttgtacactgctgctgtcaaccatctagtagtatatatcctgtgtccttttgctagtatatcaatgtcttctacaaatcaatttcccatgtttcctataaaatctgtcaaagtccattgtattgttcagtccgtcgaagtcatgctagtcaatcttttcccagctccaagtcggagttggtcttcatcataatcatcataccatcgtcaactccatgtcggagttagtattcgtcttcagtttaccagctccatgcaccaccaccctcatcaatcagtgaaggactgaagaacagtctgtgaagttccttcaccatcattgtcaccgtctttgaatcaatgaaaagccaaagaacagtttgtgaaggcttctggtaccaagggctgaataacagtttgtgaaggctcgaggtccacttcattgaggaggggatggttttctcttgttcttcatccaagagcaatgcttcgacaacatctttaaatagggacttcgtatttatagtagtatattgtttatctagtgtttagtttcaaatgcaatgctattgtatatacattgcatttgagtggggctgttaagagtattatgtgtttaggggtatattagtaatttctcatatctattgtattcatatgtgccctttgggctaactcaatgactatggttaatccccaaatcttatctcaaagtgacacaagggagggattaggggaagcaagggattcattccgcacagggtttgagtgacaatgggaggattcactcaatccggtggtttgcttcccattggggatttaatctccaagaatcgaacatgccctaagggtgtctgccacagaaacacatggtaagcaagccagggtcctaagaagcagaggagcataaccaggacaagctgcagtatagatggccaaaaggcccgcccggcacggccaggcccaggcacggcccaccagccatcgagccggcacggcccggcggccgtgccggcccatgggctgcgcctcctgcccaggcacggcccaccagacgtcgggccggcccgaaggagcgggtggcccatcgtgctttttttaaataagtctattttctgtccctcctctatgggctgtgacatctatataacgaaaataagtctattttccatccctcctctttgggctgtgacatatatatatagtgaaaataagtctattttccgtccctcctctttgggctgacatatatatagctaaataagtctattttacgtccctattctttcaattgtggcatataatatgtctatttttactccctattgtttatgtgtcgggcctggcctgcggcccatcgtgccgtgccggtggagaggcccaggcacggcccggtgattgggccgggccggcacgagcccgacccttgacgggccgtgccatgcttgggccgggccaaaacgccatgccatgggccgggccgtcgggcctcgggccttttagccatgtataggctgcaacactaagttgatagttaggttaaacaaagaaactgggaattggtttgtgagcacgttcatggatgggcacaaccatgacctgatatctagctccgacctgacatgtgttatccggtgtcaacgtattgtcacctacgtgcctccttgcaaggtgggtatcaatgaagcactgagctgactttataaaaaaaaccaataggtgataaatatgcgaagggatatctggtctggtggtaatagattttcccagcaacaatcttacttttccggaatcccatatagtcatttttctcgtgtattagtggatctaggacatgatcctcacttatgttactattaaacactagaagaccaattgacagtggcgactcatagcgacgtgagaagcaggccacggcggccagtcgtcaacgcgtgcaaatgttggtcaagcctcctatttcttcagtcttccagatgctattgattctctttttctttcgaacagactttcttgtgtgtacatcttgattaatcttaagaacaaacaaactataatattgatgtatttgattttcatttattttaattaatcttaagaacaaacaaacaaacaaacaaactaaaatagtaaaaatctgaccattgattttcatttaaattggtgggtctattaattttgattgttagatttattttacaagaaaaaaaaatctccgcccggagtccggacgtcagccttcatgcgcacgtatgtacgatccctccaatgttccaaccaccgttcctctcttttttttaatccccataacaattaaaattaaatatttttatgggcctaaaaagcccattagcctattatatctagccaactctttatatattcaaaagtccattaaacttcgatcaaacgctcctatgctaccatgtggcatactataaacgctctcgagtcgccatgtgtcactctaataaaatagtaaaaatctgaccattaattttcatttaaattggtgggactattaattttgattgttagatttattttacaagaaaaaaaaatctccgcccggagtccggacgtcagccttcatgcgcacgtatgtacgatccctccaatgttccaaccaccgttcctctcttttttttaatccccataacaattaaaattaaatatttttatgggcctaaaaagcccattagcctattatatctagccaactctttatatattctctcctaataaatagtccattcaatatcaaataaatatttctaaacaatgtccagatttgttgttattggatatatcccatcatattctaatttgaatttttataggacggaggaagtatatagcactcttaaattagaggaaatcttaaagaaaaataataaaacattcgacaatcgaaattttaggttattagttctatctttttttttaaaaaaaaacatcccaaatctccctccgcactcccatgcggccttaaagcaaattaaccatcttataaatatttttaaaccacccagtgacacttctaaattagaaaaaatcataaaaatttaagaacaaaacatcaaactatggtttcgacgtaaatcgatggacatatcatttaggttgttattagatttttattttaaaaaactcccaaacctcatttcctccctccctgcccctacaatgttaatgacttaaaactacattaaatatcttataaatatttctaaaccactagcgttaaatgatattgttttttgtcataatgtgtaccacatctagtgttaattttttatagacaacataatgaaaataaaaacatgctcagttgaacatcatattgatcgtacaagcatgtaggttggaacaaagaatcttagaagtgaaacaatgatgaggtggccttaccaatataatgagtcaattccatataggaattaaaaatcatgttcatttatttctttttggtagaacttgctacgctccgttgtaaattcctaacatgtagtgtagaacaacttagaaatgtgtatttattacatgacctctatttttaatatttcttactctattgaagtgagataatttagaagagatgactttacctcatgtttgtaggctcgacccacttatgttttcaacccaaattacagagatcaaataatttcaaagatgcttcatagaatggaattctccaaatttctttaaaaaatggacatgaaaacaaacaaaatttatctatttttttaaaacaaattggttttaaaaaccattctaaatagaaatatttaaaatttttgctgcgctaatggaatgaaaatatgtaaaacatcaaatagcacctaacaaaaaaattggacattttgagcaaatgttggggggggtaagatatctacgtaggaagtcaaaattccaaaaatttactcatagaaactacacatattttcgacataatattttctcataaattgagaagtgtgcagtctcgagtaattttagtttagtatttatgtgctgaaggggtaatcagaagaaaattataaccagcattcaaaacacattaaataagttcaatttttattttatgtgcattacaaaggatatttgtaataaaattttacgtgcattaaaatggtgcacgcgcatgtgcgcgggctaccttcctagtttattgaaaaatctgaaaacctcaaacttttccatgtaataacaacataattttagcggtatatttttcaaaaatattctaaacaccaaaatgaaatgtttaaagaaacattttcacacagccacatattagtattgcttagcttccaaacatcctcaaacttttccatgtaatagaaacaaaattttaacggtataattttcaaaaataaattaagaaccacatatatattttttgtggaagtttaagaacatttcaatgatgatatctaaccttttccatatgtgttgtgttaattttgcacatgtacaagaacaaatggcctttggaggcaacggctctcatcggatggcctaataagccaaagaaaaaacctaaaatttgaattttcaaacttaattttgaaatttattttaagatattttcaacgtagtttctttcagcattgacttttaagtcacaagaacatatatataaaagttttacctataaattcatttttattttctaataagccgttttggcttactagaaaaaaaagcgaaacgatggggcccaacaatggaagtcaacaatcatcaaccgaatggagatggcaaaaggatactaatgtaagagtggcaaaatacatagaaatatttttggatgccaatagagagaacatagtagaaagatctctagtagaaatgagtggggaataggataagctcggagtgcaggtaatccatcttttctttgcttgtgtttaatttcaattcttagtgccttcgtctgcaaattaagagaatcaatcattgaagctcaaaagaacgcatcaactctatgttggacaggctgtggacaggtttttgactcaccttcgaaataaagtggagaaagtcgatcccacctccctttggtttgatcaaagtagtcaactacaggaatgtgtttgacttttacatttgaggaaccttgtacatgttccatgaatttttggtgcatgcccaccaaactgagctcttcaacagacccaaggaattccatgccctcaggcaaatcctctaaatttgtcaagcagatgagagcaaagttatagagatttggcatgctatgcttttcaatcactattgaactgacattttgcagctcagccaaagtaagtgtatgaagcttaggaaaccactctgcctgaaagagcaaggtttctccaatataatggttgaacagaccaagaagggtcaggttacagaaattagatagtgatggaagtggatctatgctcagcctgctattttcaagagtcaactccatgagggttagcctatttgcctcaaataggtcagagcctataaccctatcatggagtctacctttcacaaagagtatttcaaggttctgaggtgcaggatctagggcttctaagctgacatactcatcactattggcagttccaataagaaggttctttagaagctgcatctttctgatggatgcaaatagctttgtatagtggatattttttacgtctgtcaacttcaatgatctcagctgtgtaaagctggccaattgttccaccaaattgctgcttgcagaaatgcctgtgaggacatttagatccagtgatcgccataatccattggggactttgacacctgtgaagacatcttcgaggccaaaataagaagcaacagcctttccagcaatcagatggcgtagcatccttagcctggttacgccacgtggaagacttgctatttcagtaaggaagatgtccaaagttcggagattttggagcctgtcaatcgattcaggaagttgcttgatcttggttcgtcttaatcctaaataatgtaaattgaacaagttcccaatgtctctcggcagttttctgattggaacactacctagttccagaaccttcaggtacctagcagtccttgatacccattgcacttttgacacggaggaacaatcgatatcaaattgatagaaagaacgaacacgtgaagcatttatacttagctggactctgactgaattctcatgaattgataaccgacgaggctcgcactcaaccaccgatctctgagctttattatgtatcatgcagaatccttccttttcggatattgaaattgccagctccctgataatgtcatgcatctggagttcccatactcttccaagcttatttctccgagcaacttgaagcaggcagcgatctactagcttttctatgtactccattgcaatctcctccagtgtcatgttttttcttggttcaacaagaccttctactactaatagtttacatagccgcttcccgcgtatcatatagtcctctgggaagatactgcataaaaggaaacagttcttcaagtggaccggtagatgcttgtagcttaaaccaaggagtcgagtcaccatgctgagtccttggttatccaagcgattgtgcaactcccagttcagttgattatagaatttctcccactccatcaaatccagccgtttgaaggatagcaagttgcctactgccgttatagccaacggtagaccttcacacctgccaacaatctgtcttgctactcggtccattgcaggaggacatgtttgatcttcaccgtgccggaaagcccacatgcaaaagaggtcccaagactctgcctcatctaatcctcgtagttgaagacggcgcttgtcttctgccaaagaagcaacatcatttatgcgagtagtaattaccaccttacttctgatgctgctttcatctagaaagccttccaagctgaaccaaacatttgtatcccacacatcatccaagaccatcatgtatgtccttccctgcaaagtctcctggagcatcagcactacgccttcactactcatgcttcctaagtcagctgagcatgtatccttcaatgcacactgtataatcttcctcattatttcagtaatgtcatatgtttgagacacggtaacccagatctggcaatcaaaacggttcttgctagctttgctttcggaaacagttttgacaagagtagttttaccggaacctcccataccccatatggaaattattgagcatgatctttcatttgccattagcaactcttgcagcttctgtcgctcatttacaaaaccgacaagtttcttattatgcattatgtggtggagtgtgtgacctttgctatcttcatacctgatggagctggcactttcttcagataagtcaatattgtactgaagtttcaagtttcgaatattttggagacgattctgcacttctttgagttctgctgctattctgcgcaatggcatcacactttcagattttctgaagaagttcttcaacaattccacagatggggtttcttttctgccaaaataatagacaaattcatccaggatgtcttcaacttcaaatgctatctgctgaacttcctgcagaaaggtttcagcctgcctgctggagctttctttttcttggccatcttgcaggaaagattgcatcaacctaaactcacttctaatttgctttacaatgctttcaacctcaattaaaactgatacctccttccccagatgtgaaactaatgcctgcgtcagatgtgaccccaatattgatccaattttgcataggattccaaacaccacagactctgccattcagtgctcgatctctcagttcagatattttcaaatgcaagacctgaaacaaaatgaacaagcatccaataataaattttcatcctacaaattactttgtaccagagttcttgaaaaattgcattaagttaaaaaataacagaacggttgtcatttcagacttatttcacaaattttttggtgccagatgtatccatgtaacaattcaaataagaaaccggtgaagtttaagtggcatataaggaattttctcttcaaataaacagatgctacacaatctaatttctggtccaatcgaaggcaatatactctttctttttcagccttttttatgtaaaaaacatggaacccaaaccacaaaaccacctataagcctatacataagggagagaaacagactaaataaggcaagatagaacggagaaggtacatgaattacctgtgtttgctcgccgaagcttttctcgcagatgggaattgcaatggcaaagtagacgccctggaggcatttgatcgaacagttggcgggtggttgaactgacgaccggccagagtgtgcgccgtggtttgcacactatcaatgggaacctggtaaacccatagacacaccaataatagtgatgtcggtagtttatttagtgtttagcatctaataaaaagtggcaacttgcaccttcgaagaaattgagagcaagaaagctgcatgtttcctaccgaaatccccattcgagggacaaccgatcaagatgtcaattgcagcttggaaaggggaaatggtttaaatggagagagtgggactggcgtgtcagcctaggacaagcatataatatactccctccgtcccataatacaagagattttgactttttacttgcactgtttgtcccctcgccttattcaaataaaatgtgcaaatataaaaaatgaaaagttgtgcttaaagtactttggataataaagtaagtcacaaataaaataaataataatttcaaaattttttgaataagatgaatggtcaaacagtgcaagcaaaatgtcaaaatcccatatattacaagacggatggagtattttattaagagtgtatttttttaagttcattttgtcttaatatttatgttggccactttccattgagtaaatttcacggaacactacaattttcagggaatctgtatcactaccaaaccacattcaactatcggttacctgataagaaaggctcaccggtcagtgactagccgtatacccccccttgtgcgtctgatacgcaggcattcgctggagccgaagttagcgaatcagaaacgacaaaaaaaaaaaaaaaaccacgctaagcttttttcaggagtagcgtcaccagacccatgtgcacaacacgaagacaaccaactctttttgaagctcacgtttgcttgcctgcctacttcggtagttcggtcttttggttttcggcccaactcgagtttacgacgtatataagaagttccaaacctagtatttgcaatgatgctctgattttctgcatacatatacatgaatatattttttttatctaaagtgtgatttcaaatcttttattaaagaaattagttactataaattctattactagatataaattttatcttagggatgccaagtcttttataatattttcttattatggatgaaaacccacaatattttttaaaaattatttctatatgtattttatgtatgttaactttacatgtataaactttttatatgtaaactttatatgtacaaattttatgtatataaactttacatacacaaattattggtagaaaatagtttgcatacaaatcacaaagctgcatccgcccatgaacattttgcacttttgaaagatcatgggaaaaaaagaaaaacaaaaggtgcaaacaacgggagagggccaatgcaggaaaatgtccatccatttagccctaagaaaacttcaacgcatgcagaccatatgctgaaatccagaatgggagacggcccatgtgcttaaatgcagaaaatagaaatagcatgtttgcttgttagacttttcggaatcaaaccaagagaggaaacagaacgctatagttgaaagagaaagtgggacgttcgcgcgtgtgactaatcaggaatgcgcattagtcgttccgccgcttccttcctatatgccattcacccgtttgccccgaaaaattatgtagttgcaaacctaaaaactagtctatagtaagataaaaaaaatggggcaattacgcatctgagcttgttttgaagcctaactactaatttgaccctctttaatcaattttgtttattttacccttcttttcaaaattgaagatccaatcttaccctattctgttcagggtatataacggtgttaatttgagcaaaaaatgtctcttctacctttggtcatttgaccctatttaatgtctcttctacctttggtcatttgaccctattttatcagaattataaataaaatatatcaaaattttggatagcaaccaaaaaaaatataatctctttgccacggcggcggcgtcgccgacccggcggcggcgcacccacggaggaagacggaggcctccgcgcgcggggagggagggagtgagcggcgccctatgctcttcgccacggcatcgtcatcgtcattgctgaccatcggcggcgcgcgcatggaggaagatggagaacgacgcgcgcggggatggagggagcggtgccctgatctttgccacggtgtcgtcatcggtgtgcgtggaggaagacagaggctggcgcgctcggggagggagggagcggctccctgtgatcttcgccgcagcgtcgtcgtcgttgccgacccgggggcagtacgtgtgtggaggaaccgaggaagacagaggccggcacgcacggcgacagagggagcagtgccctgtgaggcgctggagctcgccggcgtgcggagggcgggcggcggcatcacgcgcacggagaaaggaggaggccggcgcaccgaggacgagcagtgacagcttggcgccgaaactcgccagctcacgggagaggggcgccgctagatctgcggcttgtacgcccagcctccgccggatccaccgccacaacttgagctccgccaccgttgctcctcctcgtcgtcatcaagctgccgccgctccttccgctcgtcgttgctgctggtccttctgctcgccgtagctgtcacctgtcctttctccgcgcgcaccgcctcctccgcgcacgggctgccacaggtctgctacctccgcgtgcgccaccacaggtccacgcccctccatcaccgctcgtctcaatcgtgtgccgccgccgccgccgatagacaagatagagacgggagtgaatggatagggttagatgtggatggggtttcttcagaatagtttggtcaatacgaataataattaaatttctttttttttcaaaaaaatgaaactttaacggtgtagtggaaacagggtcagacggagtattcatttttgaaaagcagggtcaaataagcaaactaaaaaagtaggatcagtttagtactccctccgtattttaatgtatgacgccgttgactttttagacaacgtttgaccatttgttttattcaaaatttttgtgcaaatatgaaaatatttatgtcatgcttaaagaacatttgatgatgaatcaagtcacaataaaataaatgataattatattaattttttgaataagacgaatggtcaaactttagataaaaagtcaacggcgtcatacattaaaatatggaggtagtatttatgcttccaaacggagccaaataagtaattgtgcctaaaaaaatagacttttaagatttgcactatatatttttccataagtaaaaaattttactactttcaagtatttgcactatatatttttccctgtttgcccttgccgaaattcttctactgttacaagttgaacttgttagtgtgctacggctgtatattttccaagtttgtcctttctgaattttgaaggcaaagtattatccttccggaaacctcattgatatagttttcatcccaacgtcttccgtgacttagaaaagtactgagtacagctttattgaaaaaaggcgtaatttggagaataggggatggtgacaaggtgtatatttggagagatcaatggatcccaaaggctgctgggttaaaggcaacaggcaagaaagagaaatcgagattaaagtgggtatctccactaatctttttctaggatcgaacagcaagaactaagccaaccagggagggtcaatggttgtagtatccaaaaccaaaacttttagcgaaattaaaagttaccctcgaatcgatgacacgtggtctgactagggtaaatgcgctggtctaaccgcctggacaccattggtctaaccgtagtagtcactccagctgtctgaccgctgtaatcagccgccatcgcctatagccgccgccggtctgaccgccgttaacctgccggtctaaccagtccgacgccattcgtctttgccagtggaccgctgagcctgagcaaacacaaatcgaagaactctcaaagtcgatcgcaactttattactcagatctgtgtttacaaagtgcaacaacagtgctcctcacgaaatgtcggctaaactcgaaaccctagctatcctctcaactcaatgctctcttaaacgataccaggaggccacaccctccctctctatatatacacgaggtaggcagcctaaagccacgaaccaaacttgtacaagatgttctaatcctctaggaaaccttctcgtacaagaaactaactttacaaactccaattgtaccaaatttagacaccctccaattcgaccagtcagatcgtgggctggccggtctgaccggtagcacctgcccagtttgaccggacccgacaatctagcagtatctgttcatcacctgcaaatcactttgccaataatctccaaatattaaaaccaataatcttatatgccaattgttcatcacagaataagaatcaaacacactttgattttacacttctacaatcatgatgctgattaaatcctaaaagtcaagccttcaccgagaatatctgaagattttgttacctggcattacgagaaaaatggtatcttttcaatatgcagtgcttataaattggtgctagcagaaagagaactaaaagatggaagttcttgtagcaatgctactgatgggagtagacattgctggtacatggtttggacagcaaacgtgccctagaaagttagagtgttcgcctaccgcatcgcacgagacaatctccctacttaggccaataagtttcaaaggcaattagtgacataagaaaagtgcacgatttgtggatttgaaattgagaattttcacacaatggttagatgtacaaaaagcgaaagctctgcgacatgctctgtgcaggatttgggctctcctaggggaaagctcttttaatttttttggcgtgattgctggaaaggttgtctatccttcttatccttcttagctctgtaccaactaactcttgtcatatccttgtgctgttttggggagcttatagtatttacgtaatgatattgtccatggcaaaggtgaggagatggtggcaagatctgcaatgttcttacagagttaccatgactcttttgcacaagccgtggtacaagaacctggtaaaaaggtaaggcagttttgagtgcagtataaattaattccccaaacccgaagataaatagaactttgggcgtgggttgcagctcatgggaattgccagaactggttgggccaagattaatgttgatggtgcttttttgcaggctcatgcaatgtggtatagttctggttcagtcttgttatcatatttgaagtacattcgccacggggcagcggtggaaaaattagaattgttagcttgcagagatcaaggctggcctcaccaacgagcacagatcgcggctggcgagcaagccgaggatggctttccgtccctctcccagctgccaccaccttcacctccccttccggtgacgacctcgaggctggccatcgagcttcgacggggactagatcggggcgtcagcgcgctgcggccgtcctgtccacgtcgcgagcgtcctctgccgacagcctccagatcaaggcgacggtcgtcgagctcgatcaaggcgacggttgtcgagctctccggaggatcgagagatggcgacgaggtcggtggtgggcagcgggggatggcgacgagccccgcggaaacgcagagccgagggtcgtgaccttcttggcagtgtggagaaggggatgacagcaagctcctcggtgcggcgcggagctgggaagacgggggatgatgggctcccttttcggtcatcgagacgggctccatttcctcatcacccttctccctttccctacccaggcggtttctccctttcccttcctaggcggcacaggcaatggcaagccatgccctccacaacgcctctcctgccttctctccccatgccaccaaccctcgaacaggctgaagaacgagtgaccatctttggttccgcattcttcgtgggaccgcacgaggatgatgtggcagcgaatctttgatgtggatggccaaggccgaacgccaactatatgcattatgcattatgaatggacttaatagatggcaggcagtaccgcggtagaggcggccatgcgtaggtacctagatgagctaccgcgcgcgccgactgcatcgacgacctaccgtacgatcgagttcattgccctggaagtcgcacgtactcggactctcgaagcagcatgttagctcgttccttgacacactgcaggtggctctgtatatttatctgaagagctgccgttgatatttgcactgctctagcatttgtgagttagtagctcttatatactagcacatcatgtcgcgcattcaccacactcgttctaaaatcatgttattcgttctaaaatcatgttatgtggtagagtggcaatctatatatctcttttaggtttctggttgctcgtaaaaaaacatgtatcggataagtgatattgtatatgctgaaataataaatgatttaaactttaaatatatgcaaacttttacatctgtatgagttatagtcctatagttgttttcgtcattacataattaacccccttatcctctccttattttttttgtgtgcacctttatatccgccacgcatatattttgtaagtttttaaggaatattttagttttgttttaaattagtgtggaagtcattaaacttatatttgggagaccacgacctcctcgttcgaaagaatatgtaggtccatatagcaatttttatctcaaacacattaataattgatttttagaaacataattaattatatgaatatacattttgaatatgctcttaatagttcgatcttgccaaaaatagtttttcactataggtgcaaatggtaaaattatatatgtaactttatatcctctacttattctctagctttctctttcttttctacctttcctgttccagtagtttccgaaagcctcttgaataactttttttaccatctgtcaaattcagtggcgaagattcattcactatcttttatctttttaaaatctgtagtttgtgataaatttgatattaaatttataatactgtgatgcatcatcttaaatctatatttttgtgataatttgattaatatacctatagttttatgaaatttacttaaaacaaagaaacaaccatcagtgtctgcttggaaggcctgttttggacctaaaatcaacgtacatgacagccccagaaattgttcaagttgggctgaagaacgttgtttagatgggtcatttctagaattacaatcccgagttgatcccaactaccaaaaagaaatatctcctggagtcgtgaagggctactccgctctccttgtggcttcatggaggccatcgcccgcaaggaagaatcgataaatcatcttattacagccttcacgattatgtcattacaaccatgagtccttatcaggaccttgccatggactgatggttgtaacgacatgaattgctgatgccactcattccaaagccggggctgtttctgttgtcccagtgggatgttcatcaacactgaaattataaaaaattcatctctcaagacttttgtgtgctctaattaacccccaagtctcttttgcagctgaggctatgttgtagccaaattgaagggaactgaaaaatgattgggaggggttcatatatagagctgagagacagtgagaccagaggcgatcaacattacagggatgagatcatgagagagcaatgacccaccctgtactattgcacgatcaactaagtgatgaatggagctaatatatcaacatgcttttcactgaaaaataattatgggtcttgatccactaggcactagatatatacatagctaggtagtaacatgttgttcgctttgggtcatataatgctgtaatcagatcgcagggaaatgtgtaacttttagcaactactacctccatctatctatctatctatacctatactaattgagcactttctcggagcttccacgttaatcagattaatctggccattgattaactagatcgtaaaatcatgaccatagattaaatattataaccactagccgtcaacctgtgcgttgcacgggttactgtgactaataattaaaatattattactttcactggataatgataaaatatgttactttgaatgaagctgatagttgccaaaatcttaattagtaatttcatatataatccattctaatatttcttctattactctattttttcaaaattacataatttaaaatttcaatattagaaatatagatttatactcgttttgttgctcttgttagcatttgctataaaataatttagcaattttgaattaataagtacagaaataaacttagtttggagttaagctttttcatgatttaatgattcctatattcataataattaaatatcaagttgtattctgtgtggagtctcaattataacatcttcataatttaattttaaaattgctaactaaaaatattatactcggtttga

SEQ ID NO: 65611 - DNA, 23781 bp, Oryza sativa
gcagtattagctagcaaaagaaaagcattattactgctgcatcatgaatccatgcatgcatgcaactgatgaatgattaacaacatgcaggcatggggtagtgctcttgatttgatttgcatattgattagtagtttccatgtggctgtgttgaacatcatttcaattctctgaatgaattggtactacatgcatgcatgcatggctgtgtttccctcttcttctttttttttttttggtttggccttcaattcatttggttgggcatcaacgtgttcagtagtgtgtacatagttacatgggcatgtgaacctgtacaaattgtcatcaacgatattgacagtgcttgctatctgtaataatctctacatgtgagcttcataatcttcttcttttgttctctctccccttttcttctagctctctgctgctttctgttagcatgtgatcctagggattaactgttcttgtgtaattgtcttgtcagtagctagctcctgatggtaataaatttgctgctagaaacaccacattaatcatgcattcaagtctctggtggctcagcaacgccggtgtgcgaccaagcgtacacgcatctactggagaatgtactgttgctgcactgcatccagctaattaattactagctaattaccagttgattccaattatgagcgcaatttggttaagtaattaaggctggtacacgtagtaccacagctagctagcttacacaagtgacagctactgtacttttttttttcggttgctcatcacacgtcgagaaaatgacaaggcagattggcaatacaccacactgctttgtcggtagctttagaattgccaacgaggaaaagtaccagacacgtattgccaccaaattttgtaattcctgtaaaaaaaactgaactgtttcctatgcaattcgggcgaaattctgtaatgatatgggtagcaggaagtagaaaagaagcatgtcattttcgaattgtgatcatggctcctgttagatgattaattaatctcaccaaccatgaattaataataggcactgttgctacgtgactcaattgctagtagcttctgtttatgaatttagttgcacttctttttcggacaaactaggagataacaaaggttattaatcagttgatgcgaacaagcatatctttgatgtgatgtttcgtttttatcagttaagttaaatgacgatattagtagtaccatgctaccaaaatgtacgacaattagtggaatgtcagcgacagtctaattgattaagaagcatgattaattagtcagactactaaaacaactatttcgtttttcatgtggcaaataattatgttttttttagaaaatgaaggtatcttaaattcatcactctacgttaacacgatttatcttatgcctacgctagaaagacagccccatgtgtcatcctctgaggatatgttacttttaatggaaatatgaagagtacagatgctgcatgattgtttatcacagtaagtttggattacatgagatcaatcagtccaaaaaatagtttttctgtgattacatgattgagagcaaaacaaacagtacagtgggggcacagagttagctctcaagtccttcttgtttatggtgagctcacttctggcaaaaagccaacccgtgacaaacctaactgcatcatcaccacattacttcttggttggtgattgcaatttataagtggattaagcactaaattaattctagcaactaaatctgctactttagtatcatgccctcaacccctgagcaccaggtttgagtggtctttaatttgcaagtattgctttgtatttagctgttctagacttctagtactagaaatgaatatataaatggtcactgcaatgatgtgctataagctgattctttcggtacacgctgtagaacactcgtgaattcttgagttgatgttgaaacttacaagagcagctagattccttgatcgatcaacctctcaacatgcttctggagaaccatgcaggtgtgcaaacttgtacctgatgctatgttcagattgaggcttccgcttccgttctggagaggaaagctaaaaaggtaaagagacgtacagcaattgttacttaccggctaatttatttgttttcttgaagagacatagagaaaaagaaggatatcattacattccaaggcacttcagacgaaaggttgccgcttctgtggttcgtgctccatacttcatactcacatagatgatagatcacatgccatagaccatattcatattttggttccatgttgcagcttgacaactaatattttccttctcagaacacgaaatgtgatgcgatcatttggccaagtgaccagtcccatcttttacatgattgttgttcatatctgtggttctgagagatatcttgaaacaatagcagagtcatcagttcacacgttgcataccataatggacttgagctcaccatcagctgctccactgattgctatgccgttgtccctgacatccatcaagtatgacagtgaatcctgcgttactatctcacctgggatcagcaccgggatacctggtggataagggcagataagctcaccacaaatctcaccaaggctatcctcgatggacactctcctcttctttaaaaagaaggcctcccttggtgtcaacttgatggagaacttgtccagtgggctactagcaggattctcttttctggaactggacccattttcagagaagtatttttctgacagatgctttacagaatgtacaagcctctgaacatcatgccttctggtccctaagttgactgcaaatgtcacggcctgtgtaccgaccagctcagatacaatttgatgctcctcagctaaaaaatcatctgcttcatatccagataattgcagatctgaagcacttaatgtgatacgcaagggatcaatagcaggaaaatcagaaagaaagcttgataagtccaaaacagatattcctgggataatcctcagctgatgttttgtttctaaagccatagatactggttcatcaaaagattctgcattctcactcagctgagcccttgcggcatccaaagaagagagtagaaggtaacttgggcttgagctctggagcaattggaggcattggcttactttatctgcatccacaagatctccagccatgtgaagcattgaggactgtgtaagcgagcacagaaccttgtgtgtggattgcacaaccaagtcggcaccttgctcagttgcgctgcttggaaaatttctgtgaaacctgaaatgggcaccatgcgcctcgtcaactataacaggaatgccttgcaggtggcaaacattgacaattccttgtatattgctgcatatgccatgataggttggtgatgtaacaagaacagcacctaccttctttctgtcctcctccagttccttaaccactttatccacctgcgatggggtaatacccccagcaatgtcccacccggaattgtactcaggtactatatatttgggcacagcaccagacaaaaccagtgcagagatcactgaaatatgacaatttcgaggtatgatgaggtagtcaccaggggaacaggtagccatcactgaggcctggattccacatgtacttccattgaccaggaaccatgttttaaatgatccaaatagttcagctgctcgcttctgagcatctaaaatcacacctttaggggagaagagatcatcaagctcaggtagctcaggtaagtcatgcaaaaatgtccttgagccaataagttctgacaatgaaggaggagaagctttccctctattatgtccaggaaagtgaaagcaagaaacatcttgatttgcagttgatttcagtgcctgaatcagaggggcagtaccagctttgacaactgctgaaggttcagcatgtgaaccattagtagtagacgttcttggagtgtcccatgaagtggcacattgtactacaacatgccgcatgattgattcctacgggataacagatgcgcgtcattgcatataatagaaggaccaagaatgccatgcacttcattaatcagtgatcaaaagctgcaaagtagatagtttaacttactaaccatggcctgtgttggtaaagcagacgaaaaaaaaacaaaggcagcagccttcagacaagttaaagcttatataaaacaatgtgtatggtacaaaggagcttggctgcattgtgtgagaaattcatggaaggaagacaacaaaatcttcacatgttgcacagctaagtaatgcacatgagcatatatacattaagtgtgcttggaagggagtggtaatagactcatagcttcagcagagaacctgattttattggaatgcttggggccattttataaagcacaggttactgccgactggatcctttctaattcataaatagccattctagcaataacgaaataaataataatagatctatgggttcatcgttattagagctccgagctcatgagcaattctacaaacagcttgtgagcactccactccactacgttacccaaatacggggatacgaatacggatacacgatatgaggatacaacacgttcttaaaaacaccgatatggggatacgtctatttatatttaaaataataaaaagatatagagcgaatacatgaattttaattattaattatgtacttaataactacaagactgtgaatagagatagatagtcatatggcatgatatcaattgatcaatacaccagtagtcaaaaaatgatcaatacaccaaaatcttttagtactatctcagatcagcctataatctgtctgctatctcaggagatgaggctaaccatgaagctcctatggatattgtgctcccatgcctggtcactagtgaatctacagactgcagccacatagccgcaagcagtatccagtagtatgtatgtgctagagatgcactgccacttaagcattcaatttcagaactaactcatcgcccatcggatctaggagaagagataacacttgtactaagatgagaagggaaaacccacaagaaaatcaatcaagacttaaatggggaagaaccagatatggcgtactaatggcgttgggcctcgcggccggtgattcctgaagacgttgcgcccggtggaggagatgaaacaaccggcgactggcggagtccctatgctcagcggcagcgacgctgcgacccttggttggcgatggtggcgccgccggcggctagcggaggccctgcgcctcggggagggatgcgacggtgggtaggatgctcgaactgcgtcgggatgggaacaatagcaggcggcgctccctctcccgtgcgtgggtttggattcgattgcagggaggagtaagaggattgagctgaccttgtgtgtgctggaggcggcgccgttgcccttgttcttgggcacgccagccacggtggagcaaggggagtaggcggccaagctcaccatcccggcaccacctcctcctctccggcgaccgccgccgccgccgccgagctgaacgggctgcaggctgcagaggaggagacgcgggagataagaagatgacaaggagattagatgggaggcgactaatcggcaattatgtttgggcctcaatagctaatgaagcccagcccaacaagctggcccgactaatggtccttctgcaactattttacatgccaaacctgtgtttgtcaggtatacattttattcagaaataacgtgttttcttctttgcggattttgcatgtccaggttcagcgaaattcaggtacatcttgttcaggcttaatctatttccacacacagattttgcagtaaaacctgcatccaatttgagacaccaccagacagtaaacttcagattctgctataaatctgagaatgaagaacaagcacagtcctattttgcaaggctttcttccatcttgtaataattccaaaatttctacaactaaattacaaagtacaatttaagcttcattcattcttcagatgtcttacaagaacacgtatacaacagcagagatgccggtcgctgcatggaatttacctgacaaatctgagtacaactagctagcaaagcactataaaatgtgcccgcgtaatttggctcttcttctgatagaaattaatcaatagtaagctattctatttctactggatttgatcaggcacttgtcaggctcccgaacaatgtaaatctcatccccgacactaccgtacagatcctggttcctgtgccatctccacaacgcatgcgtctcgttcttcacctgcaaaatccaaagatttttcatctcatctcatcaatggtgacatttctacttcatgaagcatctgaagagttttttttttttacctcaagaatgccatggccgaagctgctctcccggtaggcgctgtagtcgggctgccggtcccagcagaagctgccggcggcggggccggaggtgaagttgaagccgcagaagccgccgcccatgaaggggtccggcgtggacagcgggtcagggcagcgccccggctcgtcggcgtagctggtggccatcttctcgcggttgccgccgtcgccgacggagatgtgcacggggccgcacgggtccagcgtgtagttgaacacccggttcgaacgctcgtaagcatgcacctgagtgacacccacagttcatcagagaattcagagaagaagcaaaatgttcagaatatgttcggatgagtcgcttacatggccggtgaagacgacgtcgacggcgtaggagtagaggagctcctccatggccactcgcatgcactctgcttccctgtagtgagctttgaaggtgctgtaccatggcgcatgccagccggctatcacccagggggtcaccgacctgtccacctttgccaagtctttctccagccatttgtactgcttccctgaattcgttatgcaggtgaaggttttaaatccattcaagattcagcttcattttctgacattattatgtttctttactgaatgtttatactcagtaggtgtgtgtttctttcctgaatgtttactctgatgtcctaactgaattcaactgaatcatgtcactgaagcatataaaatcactattgtgcaattcaatcttcaaaaagatgttttcattgcatgaggtgatatctctttgttactgcaacatggtgggatgttcagatgctgaattgaatgtatacctgatttactgtaatcagcataagccgcgagcatgatgaaatggatgcctccagcatcgaaagagtagtagaatggagagaatgatccactctccgtcgatgggaacgagaatctggagctgtaagaagcgaacgtcttgttatcgatctgctcctcaatctcatggttcccttccaccaccatcatcggaatcctcgacgtcactggctccatgtaccttcagttagacatcacaaatcaatttatgaacaatcgctaaatgttaagagtttcagaaaaaaaaggttcagtgctaaatgttaagagtttcagaacaaagatccagtgctaaatgttcagagtttcaggaaaaaaaaagattcagtgctaaatgtgcagagtttcagaaaaaaaagattcagtgcaaaatgtgcagagtttcagaaaaagattcagtggtaagtgttcagagttttaggaaaaagattcaatgctaaatgtaaaaaaaaaaagattcagtttttgggttagtgactgatcactaccttccccagtaatcccagcgcggctgatacgtctcatggatgggcgtggagttggcgaaggagcaggagtagcagtctgtgccggtgccattggtgaggtacaggttggcgtagctgacgtcgccgaggaggaggaccaggtcgggctggttgctcaccatgtgctcgacggtggaggtggtgttgtacgtcagtccaaggtccccgacgatggcgatcttccccgggtagctcctcggcccgacggccggcatcgtgcggaacgcgtggatgtcgctcatcgccgccgggatcgccgggtcgccgcactggtagaagtactctgtccctggctcaagccctgcagatcgcacacttgtttgagcaaagaaatccaaagctgcaacgaaagctgaagtgaagtggatcttaccttggaggcggacatggtggatgatggcggaggtgtagttgaggaggccgtcgaaggggtagagctggctgtacacgagggcgtcgccggtggcgcggcggacgagcgagtcggcggcgaggccgtagcggacgacgctggcgaccgccgtggggtcgagcggctcgacggcggcgcccatctggaagtcccccgtgacccaggagacccaggcggaggagggcgcggcggagagcgcgacggcgatctgctccggcgcccaccccttgacccgccgctgcacccgcgggtccgtgtccggcaggtccaccgcgtggcccctgtcccgcggcggcaccgtcaccggccgcgtcggcccggccaacgtcgacgacggcgcagcctccgccgcggccgccaccgccgcggcggcgagcagcagcagtgagaccctcatccgcattgtgagatggcgcgagatcgatgggcgggtagcgtgaggaatcagtgcgaatttggagggaaatttataggagccgaattgggacaagatgggcggcggccggcgtgtccgctctgctcaccatcgcctgtttggaacgagaaagttgatgcagatatgtaaagggaaagtgattatcctctaacttcgtacaatcgtacctgcatctaaatagtcataaaaaattttaaaaaatttgacaagttaaattaatataaaatatatatcacttcacacacatacaaattaaaatttaacttctataaattataacaaaaataacaaatatagatgtgaacgtacgataactattttcaatttaatttgttctttttgttacaatttatagaagtcgaatttgatattacatgtttattatggatgatatatttcatattaatttatattgttgttttttaaaataaaattttgataactatttagatgatatacaaataatgggaggatatcccatcgaggaatgaatctatatcattttttgaattcttttcccaggtggatgaattcatctcgatttatgcgaaattcactaaatatcctcctgttttcagaaataaaagaatggattcagcagagatcacatacggtgtactccctccgacaaaccctgatttccgtgtccaacgtttgaccgtccgtcttatttaaaaaaaatttaaatgataagtcacgcataaaatattaatcatgttttatcatctaacaataatgaaaatactaattataaaaaaatttcatataagacggacagtcaaacgttgacacgggaagccacagtttgccttttttttttttgacggggacggagggagtagaagacagttgcaatttctttcatatctgaaatggataatgtcgccggtgccgttacggaagttgtgagcgcacgtcgccggacttgcgcttttggatggttgcgaggaatattccgtcgtcagcagagtagatgcctgagccgcgcggcgacggcggcgcgattggccggtcggccggtccaagtgcttgggccgtttcgggaatctcgtcatgccgacccatgggaaagcttttcttacttcgctgggcatgcgtatgcatatgcatgtgtcgctgccgccgcctaccgggatgctctagacggttgaagaatttcaacaaggatatgcagtcgtgatctctctctctgcttctttttctgcttgcgtttgcgtttgcatggctaaaaaattcagcaatggaggcgcagcgccacgttgattgtttcatcacgttgctctcctttacttcttgactagggagactgagaaatttgcagctagaatgggcagatttgaaaacttatctgaaaatttcataaaattccgtccaaaattgctcccgtcggccgatccacgagacccatgggctggatcacaagccacgttgggccgggccgtatttttatctaccaagaaaagcaccaagttgcgggcaattttttttaacgactctgaaaaatttttggatctcgtggtcgtaacaagaaaaaaaattataccaccacacacataccgacagctctaaaatacaaacacagaagaatactaccatcagactagacgctgctaagagtgacccgaccgccactagacaatgttgacggcattcctcttcctccgccgccattgttctctgctctctgcttctgcttctctctgacaatgttgacggcagttgcgggaaaaaattgttcagtccctagaaaagaaaaaggccaatttagctttcttatatatacttgctccattttgttaatatattgacaccgttaacttttcaacgcatgtttaaggggtggatcaggaacaaaaagaaaattagggagggctcaattacgtagtttcttcaacctccagccatttaggaacttttagtctatcattcatgataaaaaaatcgaaggaggtattctaagggtatccatgcgtcttgtgagtgtagggataactcaattctccctgcatccacgttggatccgcccctgcatgtttactcatttgtcttatttaaaaattttatgcaaaaaatatatgatacatgaatcatgtttaaagtattttaaatgatgaaataactcacgacaaaataaattataattacacaatttttttcaataaaacgaatgaacaagtaaaaaaattaacgatatcatcgtatattaaaatacaaaggtagtagctcgaatacgagtcatattcctcaaccgcaaaaaaagatactactccctccgtttcaaaatgtttgacgccgttgactttttagtatatgtttgactgttcgtcttattaaaaaaattatgaaatatgtaaaaatatatgtgtacatgaaagtatatttaacaatgaatcaaatgatataaaaagaataaataattatttaatttttttaaataagataaatgatcaaacacgtactaaaaagtcaatggtgtcaaacatttcgaaacggagggagtatatcactgttttgagagtggtttgcactgatatttccccggttatctgagcccttgtgttttagatgaagggcccagattaggcctaacgcaccactctgcactggtaatacttccgtggatccgcatcgtcctccttccttgtcgagccgagcagcgcatcatctccatcccgcctcaactccgccgctcgatcgcctccacccgccgccgttccgtctacctctccgacccccggcgggcgccgccgccgccgccgcgcctaccatggtaacctcctgcccccaccttatcccgttccctttctctacttacgcctctctccggatctggcctctgggccggcgccgcatttcccctttccgcccaccgcgacgaggcctcctggacccgccagatctcgcctcgaaacctgaacccttcctctggtctactccacggtatattgatggatcgacggagcccttccgataaccgatcacggattctagaaggatgggatgagattgtttgtcgctttggttcgagattgcattttttttttaaaatcagattatttgtggcgtttgctttggaagtatgggtgagtgctcatgtgtttgtgctattgtaggctaatacgctgcgattgtatctcacttgcataaggaacactctggaggctgccatgtgcctgcaggtcaaggatcaccattcctttgcattctgatcaccatgttctccatgctgaaatttgccttcatagatcattttctgtcttctgtcctccatgagtgtaatttaatttgcgtgtgtgtttgctttacctccagaatttcccttgccaagaggtcgagaggcacaacaaaccggaggtggagctaaagtaagtcgtgcttcaaactgaattttgtttattcaatgctttagttatgaccatgaccaagagaaaatgttgcactgatgttttagtttgagaaactggactttcagcatgtagtcgaaaatcaacatataattcactattgtaatgcaatataatgtattgtaaagagaacgatcttcttctcctttttttttcctgtgcatttgttgggttctgttttccaaggtgtttcctcatgaacccattctctaaacagtcataaatttttccaagttaatttcataagatgtatacaaaagaccaccaattctatcattggctccttttatcctttatatatttgtgggaaccctgtatttctatgttaccacacttagtgagaatagacactgaacttgtaattatacacgccaatgctgactaatatatttggtctaaaacatatcttgctatacaaatatttttttcctgtagggtttcatgatttccttttgtttttatacccttccttgaagttcgtatacctctattcttccctcacaatttattcttattgctttttacttcgttttgcaggactagccctgaacttctgctgaacccagtaaggaatctctcagcatcatctccaattcagtctatgattcacctgattatttaacacactagtgtagaattttgatttaatgactcattaattacactcaattcacttctaagttaaaatattttctctactggattatctagggtacgccagaaatcacatatgctagaagcaaatgctactccattaattaagtgaaaaactgacaacacatgatgacggagttctgattttatctttctaacaacacatgccattgtaccatgatggaactaatgtattttgacatttgtttcaaaaattgttgtcaatgtttgcgccacgcttatgactatgatactttatgatttaaatacatgcgtataaggaatttaggatcgaaggtgaacagtgcactttgacatagagtacatggcataaggcaggagcagtttctggtgacatgtctgatatccctcatattatgtgacccttatgaactctactaaattttttgttgaaggtgactgatttagaatgatctgctgccgtttggctgtttactggcagatatagcctacgccattctccaaattctgcttgtttggagagacattttctctagatgcctctagtctcttaagaattatgactcatagaactataatattttgcttcaaaacaggtgctcatttgccgtaatgaagcagaaaagtgtttgatagagacttcaatcaactctattcgtattagcatgaaggtaatcatgaaattatgattggatattactatgcttattgggataatatcagtcaatcatttgtcatctggtataccatcatatgtttttctctttattgtttgacaggtcaaacaggcagatgagctagaaaatattcttgcaaagaagtttcttaggtttttatcaatgagagcagaagcattccaagtgctgaggagaaaaccagttcaggtggttttccttcttgatgatctgtttcaatgctctttagccaattttatacgttttctgttatctgctgaaagtattaggagtagactgcattttgtcaagtcagagcattgcatgacatcactggtctaacttggttttgttcattttcagggttatgatatcagtttcctgataacaaactaccactgtgaggacatgcacaagcataagctcatagatttcattgttcagtttatggaggtaaggaaaaatgttttccttggctttcccatttgctacagtttgtgactttatactcatatcacatattctgatttgtgctgtaggacatcgacaaggagatcagtgagctaaagctttcggtaaatacacgtggtcggttagtggcaactgaattcctgaagcagttcatatgacacattcttggcgatctttggaaaacataaaaccctagcattgttagctatgctgtcttggcctttggcgagcaaatctggaaggatctttccaccactttgttttccttttgtaaatgcgttgacaaggatatgtgaattcttgatccaactagacctcattggcagctaaaatctgcccaggcaagagagatgaggggaaacaaagtcatggtcagtaggttgagatagattttttggccttttggttcaagaatcctgtactgtgccggccaagttttattggaatgtggaatgtcaaaattggggctgattctgattctgatatgtcaaaattggaatgtgaaaatcagagacgcttgttgtctctgattctgatttcagttccatggcaggctgccttagctgcgtaaatatatttcactgttcaatctattagcctcaacagttgccgtgaattcctggtgaagcaatctatttgtgcatacatacatgaatttgaccaagctaactgtcaacatctatgcatgaatgaacatctcgacgatgtgtcgatgtccacgaacgtcgttaacctggagaacaagatgtccatgcagagacagaggaaaaaaaggtcaaaccaccccttggccagcttatctccagctccggcttcaaaaaaaggtgtccgcttcacacgcaacggatcgaatgtgcttaacttttatgtgtgattcattagcagaaaatctgaaattttcagtgaaggaaccaggggaagaaagggctaaggttttccctatacgaagatttgtttagctgctgatgaattgatttcttcaccatatggccacattagcttcactgtgcatacatacacgcatgataaggagaagagagccattgttgttgactgagaaggagatacgcatgcattcatgtgggtggaaaaattgaggttaaatgggggtcggagttttgttctccgaccccttttgcaccttttgaaaatggcgttactccttcaagctcgctgtcgccgctgcggttcgtcaagagtgcgagctaacaatggcggcaattcaggcttgcaacatctgaaaagaaggcttgcacaataaaccagaatacatactgagtttattcagacaaattaaacaatccatcgaatcccgatttcagcaagctagcagagcattaattcatttcagtaggaaaacttatcttccgtttcagatcaacagctctgcatggtggtatgcagcatctgaaaagaaagcttttgcatagtaaaccactgaatagcaacatctgaaaagaaagcttttgcacagtaaaccagaatatattctaagttattcacacaaataaaacgatccatcctagcccggttttagcaaagctaacagagcattcatttcagtaggaaactttcctccttttcagattttcagatcaaggcctgaatagaggcatggccgcagcccacaagttcaattcagttttcagatcaacaaccctgcatggcgacatgaactgataccagattcataaccatttcaccatatatcatccctggcttttatactcctcaaaactacaaatgcacacactagtacatcaacccaacaccacaagttagagcaaggattccaagcatcacattcaccaataccttcgctctgcactgacatttggtaagtctacgagtcttggtaacgagcactttgagttgcatgccccaggttaactgtttcagcctttgtagtgaagctgagattgtagaatctggttgtcttccagcaacctgtcgtactccaggagaagctcctccgactgcttctgtagggcgttcacatgggcctccgcttccaacaccttcctctcgtgatcttcagactccgatttcagcttcttcatactctcgtttagcttagcaatctcctggtggagcttcttgatttcactggaagatttctcctccttttcacggaataaccggttctccatttgaagtttctcgacctcctctcttgatgtgttggctgctttcctcagtgtaatcagttttcggaggtagtggtgcaaccggtcaatgacaaatgcaaggaatagagtaaatcctgcagtgagagaccagctgttagaatctatcatgcctgccatatttaacaatgaacacatatcctgaattcctgattacacctagagataagtgctatacttttggttgaagataataatactaaacttgcataaagctttctgtaagagtatcccatcagttgcaaatgtactgattaaattgttcagaaaaacaacctggcataacataatgcatggaggccaacttttatcagttcaggtctgaaactcctaaccttctacaaggaaagagaccagattggacagacagcttcaaaggtcagacaacatgctatgtattttatttcagccaaactgccttaattactttatttgtgactagatgatttattggttaatagcacttagggtaggaactctagttgtgagtacagtgtgtgtacatgagtccttgtatgaacaggctgacaaagtgacagtccacctttattagttgcctgggtatagtactctgtagatccaacaaatcctccaatgcataaatccatatcaattccaaatgggtacatcatactgaccctaaggcataaacatgaaacgtgtaataggtttgtcatctcttattattctacattgacagtttgcatattagtatcatgattcctaacttgtactagtaaataaaattactaacctaagaatgatactatgtaccaaaatgaccaaataaaagcaaaaggtactacagttactgaaaatgtgattttctttcttaagctgttgcttgatataacctccatgtgacttctgaaatatgcttgcagtacaatactcactcaacttactagttcgtacaatgtgatcacatactgacatagtgacacttgccattctagttcttgaatacttccttcgcgtttgccacaatgtggtttatcagattaatagagcaaaaaagcatggaaacagaagtgatgagactgatattctaaatggccaccaaacagtagactatagttaaagaacaaatgatttctcactccatgctaccataatttttttatcacctagatggagcatgaaagcagcaaaaacctgatgcaagcctaaagcaataggagtccttattgtatccaacccagtccactacagtaacatggtactactgtttctttaccagttgaccacacaagggacctggcataaatgcaaagtgcaatttgctcattaagaattgaacatacacaacattcttcaatgataggatcataacttcctgcttctagtttaaaatgtataatgtaaactctctagcttctgtaaaccttagaagttaaaacaatatttggtttgcacaattatcgacctcctccatcattaagagcacttgctacacttcatccaagtagtagtaactagtaagttgagtagtaaagaatcaagaatgatgaaatggcgagctcaccgatgagggaggcctcgaggaggtgagtccgccatagcacctggtccatggggctgacggtgccgagcttgaggcccctgttctggatcttgaggatgctggcgacgctggacatgaggatcaccgagagcgtgcaggccagcgtcttcaccgtcgccgggcccttccccgtcttcgcctgctccacgccgcgcatcgccacctcccgcagcggccccaccttcaccatcagcagcagcgccaccgccgcctccgccaacaccaccaagaacagcagctgaatcatcctcccaaaaccaacccttcctctcctctcctctcctccaatctttttcttctactgttccgccctgagaaagctgggggttttaccaaaacgaagaccagctttgctcaatttcttcagcatcaaatcgaggaaccggtgcaggaatcgaggttgctttgcaataactccacaccccaaatgctgaagcactcctggtaaaacctcggttctgacggggaggagtggggaagaaatcgcaaatttaatgggaaaatttggagattgacaagaacctgccacctttcttggcctgcaaaagggtagctcatcagcaatcaagagaccaaacccaaaagggggaagcaaatggaaaatttcgagaggagtgaagaaacgaagaaagaaacccaccttgccttctcttgccaagaaccaacccaatagctcaatctcaaaccaatcaagagtctgtagccgtgtgggcagattatggtacgatgctaaagaagaactaattaactagtaaaggcgccgaggcattagagtagagtagagagagatggcggcggcgaaaggcgacgagcaggaaggcggcgtgcaagcagctcactcagctggaagagagagagagagagagagagagagagaggagtgtgaaagttcatggcccctgctgcctgctccgtgctctttttgtgattgataatggcgcttaacgctgctaatcctaaagttgcagggacatgcttaactttcaagagattttaaaaagctgctacgagcaatgcattagcaaactttactgaaaacaacctttctttcttccatttagataagtatatgtgtttgtgttaaagtaggtggttttttaacaacagctcacacctttgtagaatgtaaatttcatgctaggttcctctggcaaaacggcggtgggatacgaaactatgaacccataaaaacacttcgaaaatcgaaagaaatttgtgtatacaaagaaattcgtgcaagtctttctgcactagtagaagtagaactgtacaagtactgccctggctattcttttttattctttcatctgctgtatttttggacgattctgtaacgtgccagtacggggacttgcaccgtgctctgccaatttgaccaagtgtgattcctgcattgtcggcagatttctggtttacaccctgcatttctctcctctctgtaaaacgacggcttatctcatcgtcgtcatttgtgaaagaccaagaacagctatagagggggggtgaatatagcaattcaaatcttgcccccgaaaatactcatcaagccggatttctcaaaatccttactagaatcgcggctattagaagccggatctagaaaagaagagagaaaaagaagagagaaggaattcccgaaactagaggaggaagagaaaaggaattcccgaaactagaagagaggtgagaaagagagagcaaaactcatcatcgcaaagttcaaattgcaagcggaatttaaattgcggaatttaaatggacaaggcaaaaatgaaatccttcaaatcatttcatttataggtgatgcaaaataaccgctcaactaggagcaaacatacaccttcagaggaacattaacacaaacttaaaatctctcggacaaacacactccaaactaatcctaatacaaaagcctctcgggcaaacacactccaaactcacacggaaactctctcaccgagcatctcaaaatgattaccaaaaggagcaacctccacccttgcatccatctctctatttatagcctaagacccctaagacattgtctcaaatacccctagggcgaaaccctaacttagaacagatctggtccatccattgttccttctactcaaaggaaaagctccagatgattgccacctcatcgacccgaaccctcacatggtcttcttgctgatgaatccgcgtgctctccgtcttgacgaatccaaacttgccacgttgcccagccgcgtcgtgcgcgttccgtctccttttcctcagcgcgcgctcgccagcgcccaaccagcccgaagccgccacgcgtcccgctgagccgctcccgcgcgcgcttgcaaaatcgcgtgtgggtcccgcgctcctgcacccgcctccgatcgagtcacgcgaaacggaggttgccgcgtacggttttcccgcgcgcgtccttgcgcatgcaagctgcctgcacctcctgagcccatgcgccatgggccgccgtcttgggccgtcgctgcttggacgatgcaggcctgccgagccgagccattcaccatcttgggccacgtggaacggctggattggcttggcctccctgccaaccaatcacagcgcacatgcacagctagctagcttgacttttccaccgagccatgctagtagcaaccagtacagtgcaagctcctccttgcacaagtacagtacgtgtacatgcatgtatgctacctacagcaagtactgtagcagcaatgcacttgcacagtcccttctgatttcttcgcgaatccgatgcttgcacacttgaccttgtgaagcctgttgcaaagacctcctcacacggtgttcgtccaccgtgtgcaaccttgtgtccaatcttgtcacccggcatccttgatcgctttggacctcaactcctccttgagtctagtcccgatccgccgttgaccaagatcgaccccgatcacctgcacacacatgaaccaaacaaccgttgtcttggcacagatgtcgcaacctgaccaacgttagtccacacacacacttcttgcacatccggtacttgtcaatttcccatcacaaaagaactataaccacacatggtttcacaatctcccccttgatgggaacattgacaatctcaagcaaaattttgaaaatttgatttttgattcacaaagcaaaccattttgcaaaagcgaactttggtcattttgaaatcgcgaaaaatcaagaccaagtgacaagaagaaaaagggatgcaaatgcaaatgcaagaatgctccccctatgtgccaaactccccctttcaccaagatttaaagcaagttttaattttcaataagtgcaaatttctctccccctttgtcaatgatgccatcaagatcaaaagagacaaaaatgcaagataaaaatgagatgaaacttgcaaattttaggttttgagagctttgagagttatctaaaggcatcaaaaggtagacatggatcacacagatacaagcatgtgctcaagcctagctaagcatgtgcataagaagtatgaaacaagtcatgaatatcaagttagtatcgccagcaagcaaaaagctttcaagtgaattagtgatttagtgtgcaaagctatttctagaagaagcttaaaagaaagcaaaccagctcataatcatgcaagatttacataatcaaagcaatgaacccatgctaatgtgctaatgcccagttcataaagagtatcaacatgataacaaagcatagaacatgagcttttaatcttttctcatgacttttatttttatgatttttttttaatttctttaaagacaatagcacaatcacgacggtccacctgatcttatcagtcagcaagtgatggttgtgccaaacactgccgtctgacctcaatcaagttttccagctagagttcccattacaggctgtctcagtgctatcttcggcactactcatgcgtaaacgcactcagtagcccggacaaaaacagagataaaacttgtaaagcatgattgatacaaagtatagacgcataagcatgagcattcataagcatgtactgacagttattgcgaaaagaatgtaaacatggcatgagtatgagatggatacttcaatttaaacaaacttctagagcaagcattgcacattgattgagttcaaatgaatagttaatttaagcaggtttcaacacgcttgaacagcataacatgatcacacaagctacttaagcaaatgaaagctagacaagagatcaaactagcataagagtgatacatccatagcatagtgatgaccaagagataacaagcaaagctcaattgaagagtgtataatacaatgcataaagtaaacatgatgcaatatgttacaaatgcatgcaaaagaaaaacaactccccctcaaatcaagccataggggtggatcacccctaactcactccgcaagaactcaaaacgagagcgatcaagtggttttgtaaaaatgtctgccaattgtttttcagattcaacaaattctagcacaatggtacctttctcaacattgtctcggagaaagtggtaccgtatctcaatgtgcttggtcctggagtgttgaactggattttttgcaatattgattgcacttgtattatcacaaagcagaggaacaccagagaaagacagaccataatctttcagagttgaaatcatccaaagaacttgactacatgcactagcagcagctacgtactcagcctcagctgttgattgagcaacagaagactgcttacgagaggaccaagagaccaaagaagtgccaagaaaatgacaagtgccagaagtacttttgcgatcaatcttacacccagcaaaatcagcatctgaaaaagctcgaactgaaagggcagaagagcaggagtaccaaataccgtactcaagtgtagacttgatgtagcggaagatgcgcttgactgcttggcgatgtgatgttcttggagaagcctgaaacctcgcgcacaggcacacggagaagtggatgtccggccttgacgcagtcaggtagaggagggagccgatcatgcttctgtactcgcgctggtcaacttcttcaccgtcctcatcaggaccaagcgatgaagtagttgccatgggagtggcgattggcttgcagtcggccatgtcgaacttcttcaggagctctttggagtacttggtctgatgtacaaagattccttccttggtttgcttgatttgaagtccaaggaagaaagtcagctctcccatcatgctcatttcaaattccctgctcatcacatcagaaaactgggcaacaagtgcatgagaggagccaccaaatatgatgtcatcaacatatatctggacaagaagaaaatcaataccactatgaagagtaaaaagagttttatcaacagcccccatttcaaaaccattttgaagcaaaaaggttttcaatctttcataccaggctctgggagcttgttttaaaccataaagagctttttcaagtttgaacacatgatttggaaattttggattttcaaaaccaggaggttgtttgacatagacctcttcctcaataactccattcagaaaagcacttttcacatccatttgaaaaagcttgaaaccttttgaagcagcaaaagccaaaagaattcgaatagcttctaatctagcaactggtgcaaaagtttcttcaaagtccaagccctcaacttgggtgaaaccctgtgcaaccagtctggctttgtttcgaacaattgaaccatcttcacctagtttgtttttgaaaacccattttgttccaatcacattaaaacccaagggaggttctaccaaagaccaaactttgtttctttcaaaattttctaactcttcatgcatggcattaacccaattctcatcagataaagcatgacaaacatttttgggctcaaaagaggcaacaaaagctgaattgacaagttcataagaccgatttctagttaccctttcacccaggcctccgatcatcgagtcaggcggatgtcggttctggatgtgtcggggagctgtcggtcctgatgtgccaccatcaatctcctcagctgctgaagatgatgtagttggtgcatctcctgaaggtgatgtagtcgaaggagaaccggtttcttgcactggtggtgtactgtctagaggtggaggaatagaatca

SEQ ID NO: 65612 - DNA, 4852 bp, Oryza sativa
aacatctaaccattgatttttacttaactcggtggacccatcagttttgaccattagtttaaattctcatctctccaccctaatatacgatggttgcatgatttggtcccaccaaaataattagttaagacttaagagcaaacaaacgcagagaatcagttatttctctcccaaaaaaatcaccgcagtattaattcttggaaagaaaaccgacgttgtaggtttaatgcaggagcctgggtgtgtgcttccatcatccaaaaaattataccatcgaaaactttttaagtgaatatcacctttgcatcaaaaaagtgaatatcactaactgctctaaactatttacagagttaggttcggattcatgaatattgccctcaatagttagtttctgaattttcatgtttctgtttgattaccagggcctgatgaaattttcacggatgctaaatctcactatatcaaattctcatctctcctccgtaatatatgacggtttcatgctttggtcccaccaaaataattaattaggagtaaacaaatgcagagaatcagttgtttctctcccaaaaaaaatcaacaaataaattttcagatgcaaagccataggaaaagaaagcaatgcgcctctagcttactttttcaaccaatatcaacgacatccatctacattttttctggaacaagcagcaacaaccaaggttgaaacaatcctaatcgtatcaaacaggcgagtgatgcaagcagcaacttccatctttttattgtttgatctcttaacatagccttccactcctctatttttttaagcatataatttcgcttttttacctacaattttatactacgtactccttggtgatgttgttcgtattctgatctgtcgctactagcttctacaacaaagcgatatatcaaagctcttgcctcttggacaatatattcactaattaacatcgggtatttgggtgctgtcagtttaattttgagcacttagtcaagacgtcttgatgctgcgtgctttgccaccagaaatttgttaattgattttttggataatcattttggaagggtaatgcatgccgcttttttaggagaaacatattacaaacacatgagtttatatacacacgcgtacacttatccatagaaaacatattcgagagactgagccaatgatatatcttcaaattagtgaagtcatcataaacgcctcgctattgataggaacgttgtctactacaagaataattagccataaatatgagacccatgtcaagtctagatcttaaacctaggtgggtaagttccaccataggtaactaaccagccacactcactaattgcagataatgtacgtggagcccctcttccctctccttaactccttttttccatacattatttgagataaatgtagtatataaataataaataaactattgtaatttttaaattatatatacaatttttttattcgaccacaattatattctttagaattaaatcagttcatatcgatttgaccgattgcgttatatctcacagccaaaaaaaacacgaaaacatatgttatagtgtcatatatcacattataatcataaataactagaattagctctaatatgtttgaaaataaagtttactaaattatattatttaccattaacttaatattaactatactttaatctgtaaaataaaattatattttaggtcatatttttattcttggtctgtaatccaaacggacgtgaaaattataaaaaaagatgacagtatggagtatatatcactatatattctttatcggttataataatatgtaccattaaattagatttacaatataacaagaaatatgtcatatctttgcgctttacatggcatttgagaattataacaaaacgtgaaaaaacaatttagtgatatgggtaatatcatcacataaatatgcttactatgtagggtgcactctatttggcccatatcagttcacaaatatgcgcgactgaattagatttacaatatcaacaagtagcaagtcacatccggggccttgcatggcaatcgagaattatgacaaatcatgataaaaaataacaatatggattatatgatcatataaatatacttatcatgtggattctaatctatccggactatacggggataatctaaaatgtcaattcaatttaccaaatcatgtataagttgtacgttttgtagactacaccctaaatattaagtaaaataatggattgagtacacgtcgtgttttctctcctttgatttctattaaatacgtatggtgtgtgggtattttgtatatactaagtttggttaattagggaacataaacaatactaaagttatatatgagaattcatgcattaaaaatacacttcataacaagaacgtacttaacaaaaatgtactttagtctatggtgcttcaatatttataaattctctaaacatactaattatttctgctcttatttcaaactaaattcattttctccacataatataagagatcatatgagaaaaaaagaggagggagaagaagtaaatagatgtctgccattaaacagatagaataaagacatctataacatacaagaaaatttgttgattaaggtttataaactccaaatgtaagatatgctaatttctaaaaaaaacacacacatggtacacataatagttccatatgaagcaacactattgttgtgaaacaatagtttctcataaattaaaaaccacatggtttaaataaatttgatttagaatttatatgttgaaaggtaattagaagaaaattaaaagcgacgttcacaacaatctcaaataaattattgataaaaaacatgttcagaatagattaaaaaaatattttaagaaatactcatccacacataagtattcataattaaaattcaagcaacattaaataaggtgtcccgcacatgtgcgcgggcaacctttctagttctaacaaaagagcaaacttaggaagccaaaacaactctagctagtctggttcatggatgatcctccaatggatgatcaggagccacatgcgtatatgcagcttctggtgcagcctagctatgcactgcagaagtagctgaagggcagcttgggcctcgagtagtcggcggagaggatcttgccggcgacgacggcgttggcggcgtcggtgtagtgcacgccgtcccagctcacgaacttgctgccgtcctcgcacacccggtaccccgccccgaggcagctcacgttgaagtcgtagttgtacggcggcccggcatggccgcagcacgccattagcggctcctcgaaccctacaaaaaaaaacgtttgcatcttcttcgccatcaggagatcatcaatggcgtattaattagtcatcatctgcaggacacgatcgatcgattcgagatctcgattgggctagctagctctctcaccgtagctggagtggttggcgatgaggtcgtacttgatggcgaggatgtcggtgaagacgatcgttgcgcccctgagctgcgagctgagctggtcgcagatggaggagagctggctgttgaactcgtaggccccggcgttgagcgttttcaggcagccgctggggtcgaggtcgccgtcgtcggccctcggcacggcgagcttctggggcaggcagccgagaggccccgttccatggatccacaggttcttggctccattgtaatacaaactctgcacacacgtacgatttcagaattaattagcactgacacactgacacaaatcaaacatgaacactgtaaattcaacgattaagggagtgtttagatccaggggtgtacactgtaaagttacactgtaaagtacaccgtaaagttttgatgtgtcacatcggatattatatacggtgtcgcataggtattcgagcactaataaaaaaactaattacagaatctgtcagtaaaccgcaagacgaatttattaagcctaattaatacatcattagcaaatatttactaaaacaccatattgtcaaatcataaagcaattatgtttaaaagattcatctggcaaattagtcacaatatatgtaattagttatttttttagcctatatttaatactttatacaggtattcaaacgttcgatgtgatatggtgaaaaattttaaggctagaatgtaaacagggcctaaggttcacatgtatgtactatgtacctggatggcatccttgatctcggagaggatggccggaaacctctggcggacgacgtcgtcgtaggggaggccgccggcggagaaggcggcggagaggtcgttctggccgatgtcgatgaggtagagcgcgttgcggaagccgtcggcgtcgacggggacggcctcgccgcggctagcgagctcgagggagcgctgcttgaagtggatgaactgctgcacctggatgtgcagggagaatgcggcgttgcggggcgccgtggcggcgccggagatggcgaagttggcgccattggtgaagtcggtgcccaggggctccaggtacgggctcaggtagctcatgttcaggctctcacctgcacgtaacgtttggtgcatacacattgcaaaccaagtataattaattatacacaagcttaaaaaaaaaacataacgcgtgttccaatatatgctcaaaactacttcaaacatgcatatacttagtatacagcagggttttcaatttccaaataaggtttttgccggtggtgaccaaaatttccaaaatcatcaaaaatttgggttttttttgaccgaaattatttaaaaatttgattaattttgaatgaatttgaataaaatttg

SEQ ID NO: 65613 - DNA, 3482 bp, Oryza sativa
ctgaggcaatgagacaacgagaaggaccaggagcagaagagtcgaagttagcaaagaaaactcgaccaactcgagaaatgtcaaaaacaggagattcagaagcatcaagaactcgagacctgtcctttttgaaacgaacttccagattttcatcacagagttgtgaaacagagagcaaattgtacttaagcttacttactagtgccacatctttcagcatgaatttgtcattgaccttgattgttcctttagccatcacgcgtccactgctcgcatccccaaaagtgatggtctcatcaccggatgcacgagtgagagaagtaaaccacttggcttcaccggtcatgtggcgtgagcaaccggagtccacaagccaagaattacttctccctactccaaaatcctacaagaaagacacagcagatctcgatgattcagtactggggttagtgaaaaatgacttaggaatccagtactgaaccatgcgagaagtacaagcatctttagtgttatgagcagaattatatgcaagatgaccatgtctgttttgccccaaccctgctaggtcacgtcgagggtgcacatctcggcgaggaaagcgagatacaccacttgaacgacaatgacacgcacactcgaacctctcaggactctagtagctcttctagtcctaagacgttcttgtcgctcttttctagcctttctaaagcagaaacctaccaaatgaccagctttcccacaataggtgcactcatacttggttttctctacaggcttggtttgtctctggtttgcttgtgctcaacttgttttggatttttgggtctaggtaactctacaggcttagacttgctagtcataggtaccatctttggttctgaggttttgggtgtactagaactagtgtttccaatgaaacctgcagacttgaaggttataggtttttgagctagttctatcatcccatctgtgacacctaaaatctcatgggtacctatcctcaaagactcagcaaaatcatagcctataccttgattgtttatggacactttggattggtctaggatcatgttcaactttttctttccttgagcaaacctctctaaagattgttgtaggtatgaattctctttcttagcagactcaagatcaactttcagagaaatgcatgaagaacaagaatcaatagatttgatagaatcaatgacagttttagcatcttttagttcagtttccaggatagcacaattagcacatgaagaatgaataggttccttagtagcaaaagattctaacaaatcattcttggtcttaagcatggcaacttgttgtcttaattcatcattgtcactagtgagaatgggacaattttcacacctaccaatcctatcatgaacaaatttttcttttagttctttcaattccatctcaagcaaacccatatcaactttcatttcatagcaagtagagcaagcagcactagcactagaaggattcccagctcctaaagcacatgatttcaacttatccttgaggagattaatttcagaaagatatgaagcacaagtagaacaggtatcctcctcaggaatcatggatcgaagcctagcaatttctagcgccattccatcattttcagattttagtttctcaattttatacttagaagacctatacttatcactaatttcaatcatcaagtgtgccattctttctttgcttagttcatcatcaacagagtcattatctgagcaagaatcatcacaaagagaaccatccaaggaagggatatcatcaagacatacctcaggatgctccgatgagtcatccttatcctcaagcgccatgagacacaggttgatgaagtcctcgttgttggcgagacagcacatcccggagaagtccttgtcccccttttcttgatcatcgtcgtcggagtcgatgtcgctaagctgcacctcctcaagagccgccaagaccttgtggatcgccttcttcatcaaatccttcttcccctttcgcccttgtccctcgggcttcttggtcgtcttgtcactcttcttcttcaacttgggacaattcactcttttgtggttaggctctccacactcaaaacacacaaatggttcattggtttttcctctttttctatctctcacatttttgtaagctcttgagaattttctagcaaaaagagcaagatcatcttcagggatcttctctaattgctcctcagtgactgagtgtaaagcggcaagagagaagccaccatacacaaaagctgagtcattagaagaagtactaccagagggatcagctaccaaagccatcgagtgtttgaggcctttccgatggaaaacatccatctcatgggtttttagctttgagtaaagcttgtccatggtaaggtcactcagaggtgcactctctgtgatggaagtaactttcatttcccaaacaccataatcaagacaattcaaaagatggcgagcattatcattatcagaaaattcttttccaacagatctcaacttcgaaataatttctccaaaacgtttgaaataagaatcaatggactctcctgggtgcatctcaaatctttgatattctttatgaaattgattctgacgaaccaattgaatatcattgtttccctcatggaaattgcacagagcagtccacatgtcatgagcggacttgtggtgttgaacacgattaaattcaccagaagaaattccaccaatgattgcatttcttgcacgataattaaaatcaacctgagccatatttgcaggcgtgatgtcagcatcatcgggcacagtgtaaggagatttaaccttattccacacattatgcccttgcgactggaggtaggcctccattcgtgccttccaaatgacaaaattgtgtccatcgaaaacaaatggtttcgcagagtatttttcctccatagctgcgttcgttgccacggttaggttacaacgaacttaaccgggctctgataccaattgaaagaccaagaacagctatagagggggggtgaatatagcaattcaaatcttgcccccgaaaatactcatcaagccggatttctcaaaatccttactagaatcgcggctattagaagccggatctagaaaagaagagagaaaaagaagagagaaggaattcccgaaactagaggaggaagagaaaaggaattcccgaaactagaagagaggtgagaaagagagagcaaaactcatcatcgcaaagttcaaattgcaagcggaatttaaattgcggaatttaaatggacaaggcaaaaatgaaatccttcaaatcatttcatttataggtgatgcaaaataaccgctcaactaggagcaaacatacaccttcagaggaacattaacacaaacttaaaatctctcggacaaacacactccaaactaatcctaatacaaaagcctctcgggcaaacacactccaaactcacacgg

SEQ ID NO: 65614 - DNA, 7418 bp, Oryza sativa
gagatttaacgtgggaaaccctccaaaaacaggagagaaaaaaccacgtgtgccagccagcagaatatgtttactatatctgaggtgaggttacatcgccgtaaggcggcttacaagaggtatatatatggtggaactctaaaagggatgacgggcaggcctccaggcgacgctccagaccaagcctcccgacgacgggcctccgctccgctacggcagaagctggcatttattaagtgcaaataaatttggaccacaactcaacaacaccaaacagaagatcgactttagtggagtttatcttgagaaaaggtaggtaggtaatacattctaccatgagatacaatcacacaattaataacccaacaattgcagattcggtaacgatcctacaaggaagtcacaccatagagagagtaagcataaggatagtggctagaatttcattcgaaatcaatcatcaagcacgcgttacaaaccatgatgacaactctcatttggtcctgaaactgctactccaagcacagcagcctactgattgcagattgacgatgaggagactttggttctggttttgcctctgattctggcaaacaaaagaaaagaaaatttatatgtattgaatatataggggtgaatatccaatgcgactcctgaagtttctcttcgggctcaatttagtcatcgatgtttcaaatcgtccaaacaagtccttcaaattaattatttgggttaatatagtccttggacccacaaaaatgccacatgagtatgtcaagtcatcctcgcatgcagcggtatgaatgaaattaccattctacccttatataccatatagaaaagaaagaaatgtaaagacaagcgctgcgttagttagctctgcgaatttaaagtgttgtccatatcaaacgcttaaagggaaatgatcaatgagtattggttcaaagtagaagggaataagttcaccaagtggcttcgatcatgactaatacagctttgccataataattgcatgatgccacacttggcgactaaatgaagtcaattaattacatagtcgacccggcaaaaattaattacatagtccaaactagcaagcataatcacaggaagagatcatcatatataaggaatagctactggagatattactaaattcctttgtatgcgattagatacccaaatgcaactcaaagtttaaagggtttagatgacacagctgaagaagtgagttatgaatgcgcattgtactctatgtacaaataatcatattaatggttgactaggggttctagacaccacgctcgaaacttttaccactaaatcgtacacggttaagaaactgaagattaccttcatagcaggcatctagttctttattctcgatgtcatccagacgttgctgcaggctcggtggaagcaaatttataccagaacaataacgaatttcaagagatgtaagagatgagtatgcttgaggccccttcggcaaggataccaggcctgggcaattaacaagtctgaggtgttgcagcgacgggagctctcctaagcaagattccagtgatttcaagctcccgcaatagctgatatttaatgctcgaacggcatccagctttcctgagagtgactgaagtttttcacagcgtacaatatccaatttcttgatggacggaggaagatggagaaccttcaaacgattgcaatactctattactagagattctaggcgtggaaggacgcgatcgttggtctcgctggtggaccctgatattaacgatgacttgtccggctgtgcgaagctttctgcactcaccaacatcgtcgtatcctgctgctgattgaatatgatggacctcaggtcatggcagtccgtaatttgtaatagcttgagagacgtcggtaggttggggacctctacaaaagaataacaacggcgtatctgcagggactccaaacgtggcaggagttcacttggtgctagtgtagattgcccacgagcttgtgtgagtcctgtcagattcttgcattgaagaatatgtaacttcctcaaggaaaccaagccctggaacacctcttctggccagtcgacaagcgcatcgacttcccaaatattcagatctaggagctgaacaaaacatgtccacagagccaacgcacttgggtaagagaataaaaggttgcagccagttaagtccataagttccaggggagatttatgattccatttctcatcctcaatcaccaattcactcgaatcttgttgcttggccaccggtgctgtttctgtgtcatcagttgacaaatgcaggtggagactggacaatgaagtaatatatctgctggctgcctgtagggatatttgctgattgacttcatatatgtttaagtctctcagctttggtgcttcaggtagagtagtcaactctgggcaccgtctaatatctaatttgtaaagctgaggaaatgttacctcctcccttggagttccatcgactgcctcccatttctgaaagatatccaaaccatataattccatttccttcaatgctggaaatgcagaatgacacacggtgctaactccgccagacaattctgaaatcacatttgacgcttttggtaaggcagttagcctaggacaacttttgattatcagcttttcaacctcaggaaatatcagctcttctccttttacctcatttgtgtcccaccatgtctcaaaatttctcatactggccaaggtaagctccttcagtctgcaaaatgtaaaggaggtgtatatgtcacagttgaacaagcaatttaaaccatccagtccttcaaggcaaagaacttctagagctggcagctgccacagtggaggaagcttctcgagatttttgcaaccatctaacacaagcttcaccatgtcccgcagtttattcatccatgttggacatgtactgctcccacagtgaagtatactcagaaccttgagcccctcgtgaggcgtgagaccttccagcacctctttatgattattactctgtgcctccttgtacttctgaccagtccatcttaagctcaattcggtcagtttttccttctttccgagatttgctgcttttgcatcagcttttgtcacatttccagttttcttagctctagtcgaccaccaaggtccaactgccgcagctctcccaaatcactgcagccagagcaagaaccggctacaaaacatgtaagcgtctgtaggcaagtgaggtgtccgaggtccggaggcatgctttttaacctccaacatccgtgagtgtacaagtgacggagggcggtcatgtacttcattccgtttgggagttgacaaagacagtcacaaatggaaaggttcaatgtttgcagatgatataggatgcttatgtcttcaggaagtgcttcaattttactgtatgacaaatcaagatacctcaggtgatgaagatattttggtttcaggaatgaatctccccccatctttaaagctcgcaatgaactgtattttgatatttctcgcgaggaacgtatcaattcttcttgcgaggaacatatcaatgtttggatacctggatatactttctttaggaaaatgacacctgagaaaaacaagtggcgagcggaataaggaaaatcatcacttttactaagttctgtagctatagtagcgcattcttttcccatggaagattgtgcaacatcatgcataaggtcatggatcttacaagtaatcttagagcactttatatcatggaactcaaatgggatccccttcacatcctgaaaaaatgaccttgacaccaactcactgaaaattcttttaccaatgatttcagggcactctccttgtttctccgggataaaaccattggccatccataactggatcagcatttccacgtcgatctcatgatccttgggaaaaatagcacagaaggaaaaacattgccgcatatatgatggcaagcaattgtaactgagtttgagtattggtaaaattccattttcctcatcgcaaattgtgcttctgctcaatatagcgtcccattctttcttggtggtcttcgtacgcagtgtagagcccaatgctgttgcagctaaaggggaaccagaacatttcttggcaatatcaccaaccatttcgagtagctcaggaggaggcctttcttgttctgaattgaaagcacttctcttgataatttcctcaatgaagctttcattcaggttcttgagatcataaacttcttgagctggagccattagttgagcaactgcttgatcacgagttgttgtcaaaactgagctaccgctgccaccatgcttaaggttgtacttgagtgcttcccacttactggcatcacggttccagacatcatccaaaatgaggaggtacctctgcccactcacaacttctttaagttcatcctgtggtaactttttggcccctccattatcattcttcttattcatttctttgggagctgcttcaactattctttttgccagcgaatccacatcgaagttgtcagagacacacaaccagagcagcaactgaaaatgcttctgaatttcagggtcattgtaaacgagctgcgctaaggtggtcttgcccatcccccccattcctacaatgggaataacagtgagatccccattgctggcttgagcaagcaatcgattgacaatctcctctttgtctttctttcttgacttgttggcaatgtccatagaaaggttggagattttagaatccgtctttctccatttgatggaggacattggtggctctggtcggaacttaaacctaaaggcattcatctctgcaattaggacttcaatggcattcaggatcatcctgagcttgttgcccatcctataacgaaacagaatacggttgtgagtaggaatgagctttataacaacaatgctgccgagcttcttgtagtgccccttggccttggctttgcggcggagtgcctcgtacttgaactcgtcgaagacatcattggcctggtaggccaccttccggagctcctcaagccatgctttcgccccttccctgtgttttgccgcctgctcctcggcgtcggcgatgacgtcgaggatggcgggcagcttgcgtttgagaatctcatgctgctcctccatgccctccatgaccttgtactgctccaggaggtagctggaggccttgtccttcaccatggacagcagtggcccgaccaccatggtggccatcagctctgccatcggaaggatctcctagagctaagaacacacgaacagaacacagggaagcacaataagcaaggagtgtgagcagcagctgctttttgtgggaaatggaaactgaaggaatgtgtttaactgaatgcaactagctagtattaagagttgctgcctggaatgaaagtgtttgattggaatgaagaagtaagcaagtacagtacagtgcagtaagcttccgagaactgggcgacgatagagatagaaaactggagtgcgcgggagagaagccggtcggtcggcgcaagcgcaaccacgaagtactgacgatagctgagaagaagctgggatgctcaccggtgtggtgccctgtcgttcttgtgttcctccgtcgaccggaactcaacggcgaattgggcttggccggttcgtggagagcaaggttggagctgctcggacccgtctcaaattaaggcggcgcttgacggacgagctcagcagcctgcagccgcaagcgcgtcactcgccgctgtagcccgtagccttgcacttgatcagctccagtctcgaaaggagagagagcctcgcacagttgcacctgtcggtggagaaaagaagcaaacaacgttggtttgtctctgtggccttgtcgataaaatcatggagaagtatccactgcaaatagcacaagtgggataagcaatcaacaacgtcgggtacagtcgttcagacatcaggtcgctttaagctattactagcagatggcaaaaatatctccaaaatacattgtactctgtgtaccattaaaaaaacaaattttgaggaggatgactcctaaaatactgaacacccagctcgatgatttgcacaaaattaattactgaactatgaacctttttttttaggaagagatgcatctcctgtttctgttagagaaatgcagcattacaattgttcagcgaagcgaaaacaaaagacgggctacaggtcgccatccggggcgccaccaccagatgccatccctcagccaatcagttcagaacaagctaggattaagttaagcaagcacagaatttaggcatccccaggcacaacatctgggtttacaacttcagccatacaaagactttcactctaggtggtatttgattctccacattttcttataggggaattgcatgttgtgcattttcaaagccctataaaaaaacttaactgtgaacacaccattctttgttaatctccaactcagcttgtcattttcttttgttaagggcagcctattaatctcattgcaaattcttctccactttaccctctttgaaatctaacttctaagcctttttgttttagctttgcaattgttacatgtttttttagagttatattatacagctcaggaaagctttctcctagaaacttgctcctacccaccagtcttcccaaatctccattttccacttttttttctcacaaaaatttagaaacagatatttttaatctccatcagacctgaccaaaagtatgaatcacccactctatgttttccgtaagagtgttttgatttttaaatatttgtttctcaatacctcttgccataagccatctatggtttccaacttccaatgaactatgaccatagcatcagaagtagcaatttcagatcgctgtggccttatcgaggaagaaggggatacaatcatggagagagagagagagaggatgtatccactacaaatggcacaagtgggataagcaatcaacaatgtcgggttcagtcgttcagacatcaggtcgctttaagctattattactagcagatggcaaaaatgtctccaaaatacattgcactctttgtcccatgaaaaaccaaattttgaggatgaatatagacatagtatatatctatattcatctctataattttattttgttttttaagtatagagggaatacgaagaaagcttttcattatccatttccttctactcgggactcaggagtccactattcaaactgaagcggcttcagaccttaggtcactttagagtaagggcctgtttggcacagctccagctccaactccacccctcctggagctggagctcagccaaacagtttcagcttcaccaaaactgggagtggagctgggtggagctctcttacaaaatgaactggagttg

SEQ ID NO: 65615 - DNA, 30190 bp, Oryza sativa
gaagagagaagggagggaaggaaatgggctagggtttcagcggccgaggagagagagagagggggggtttgtttcctcgatctcgacgctcggccgtccgatcaaaaccctagagatcggacggccagagtcggccgggtcgaaatcggcccaagagggatcgagagcgaggccacttttctggcccaagcctaggttgcggcctggggagggaaagcgcgcccgcgcgagcgcaaaaggccatgggctgaccggcaagggccggaaagaagtctatttttggtccctcgggccgaagaaaaagagaagaagttcatttttagtactttatttttttagaagcatttacaattatattacaattatagttattaaatgtatttatttctaagcaaacctgcaaacctaaaaggaaggattttctttctttttctgattaaataattgttaaatgatgtttgtattattaaaattagcaattaagctttgaaattttcaataaaattccaaagagcgtaactaatcatggagaatttaataaaaataaatttaaccatgacattttatttctcacacttgctttacttgtaaattttgtttaattatacacatacctacttaaaaataccaaatattgcagcaaatttgtattttaactaattgcatatttttctgatctgtacgtttcctgttgcaacgcatgggcacttttgctagtactcccttcattttataacgtaagactttctagcattgcccacatacatatagatgttaatgaatcaaacacatgcatatgtctagattaattaacatcaaaataaatatggccaatactagaaagtcttacaatgtgaaacgaatgaaatacttaattaatcatagaaaattgcgttttccatgccgagaggatgagttccccaactcaaccaaatgaaaacagccggtggtggacttggtaaagtaaagatagcaagccaaccaaaccggtgatagacttgtactagttatagatggccaaaaggtccgaggcccgacggcccggcccatggcactccattttggcccggcccaagcacggcatggcccgatagaggtcgggcccatgccggcccggcccaaccatctgaccgtgcctaggcctctccacaagcacgttgggctggcccggcacaatgggccggtagctaggcccgatacacaaaaaaaataggagagtaaaaatagacatattatatgccataaacaaaaaaatatgtacctataatagactttttttatctatacatatgtcagcccaaagaggagggacgaaaaatagacttattttagctatacatatgtcagcccaaagaggagggaagaaagatagacttattttagctatacatatgtaagtccaaagaggaggaactaaaaatagacttattttaaaaaagacccgatgggccacccatgcctacgggccggtacggcacagcccgacagctggtgggccgtggctgggctggaagtgcagcccatgggccggatcggcccggcacgaagtgccgatcgggccgtgcccggcccgatggctgctgggccgtgtctgggccgggccgtgccgggcgggccttttggccatctataactagtactaggactagtagtactccaaatcagtactactagtaatcaccttgagtccttgacgccgcgtctagggtttcttcgatccacttgacgccgcgtcgcaggcactcctcgtcttcctcggtcgaagaaaagcggcggcggcggcggcggcggcggaagctgccgccttccttcaccccaaggcccaacagatcgaggacgctgacattatgttgcagctacctttctcccccaaagagagttggagttcaccaggcaagctgttcttttttactttcgtctccccttgttcctcgatcgatctaacagtcgcccatcgccgcctccgcctcgtctcccctatcgcttgtcctccacctaacccagcccgacggtgaaccggggaaactggggctggccttggatgacgtcgtttggttcgtcgcagaaggagacccgtctccttcttggtgtagtcgtcgtgccttgccggggcggggccagcagatgggcaggcctagggctgaattcatcaattttagttattattaggcatcatatgtttcaaaattttcatagaatttgaagccaaggcctctaaactaattaccctatgtctggagttcttgcatgtacgattacgattaggagggtggagtgggaggggaaaaggataaagcggggtggagtgggaggggaaaagaataaagcccccaaaactacaactaagcaatctgcacccatacaagcatccagatccattctaatgctcagatataaaactcactacacaagtggatctaccttaatacttataagccacaggctgaacatttaatttacttcatactagttagtttcacggatgaacatgaaccagatgtatgttcagctgtcgaccagccttcttttcgccacggaatctgcctggcactttctttgctctccgctgtgctgctctgtacactcctatgtgaccactgattgcacgtccttctgtttcactgcaaagccacagggattaatgtctgaaaaagcttgctcaactatgggcatggtggagtgctagcctcaacttttttttttagaaatgagatcattatatatcggagaaagcctaacacaatcagaaacccaacttacacacgcacccgcacactggggacactccagcttacaaccaagttctgaaacatttcactaacatctaaggccctgtttgtttcagcttaagattattgtaatctagattattaaatcagattactctaagctagattattataagctgacataaaataagctacgagttggttggttctctagattattagaggcatctaagggtagtgggtctttatccactcaataatctgttaaaagctcctctagaggagattattggaatatagtaatctggcttatagattataataatttagcataataatctacttgtttgtttcagcttactcctaataatccagattataataatcctaagctgaatcaaacagggcctaactccagcaccactcctggaaacagagagagacagcaaacttctagctcctacagaccacccaaagctagcctgaaatagcagccaactgttttaccctggttgcctggccgatccaagtttgtaccaactagcctattattacctccgtcttgtccaactatatgcagggactaaggaactggcaacttcaccggaccatcaaccttgacattaatccacctgtattattacccgctaccattcctttcgttagagctctgatgcatggttttgcagtgtttctttactgtttatgacaccacacttttttttattttgcttaattcagtcaattcagccattgggcacgtgcggaaaattaggaggagggctggtcattttctctcaagaagctccaagaataaggctgctcacagtaaggggggacagacaaccaagtcattgatctcaggtccgctggcttcccttatatgcatatcttcttttcacctctatttgagaactaacacgtgttttatagtgttttaaaccaggcgacttacattcgggctctattcaagatgtctgggctactctcagcgctgaagttgcatcaaaattgtctaaaagcgttgtttctctggctttgtctgatggtgatatatgttaccgttatacatacattcacaaatttatattttaatagtgtccccggttataaatggtttaacctgcaatcttgtgtaggaaacataccgatatatgcatgctcaggcacagctatcagttgccaggaggggtctggtacaatttttctgacttcggctagtttggttagagctttctatgatactgaagaaatttatgataacttaaaggttggtgctgctagtcatcctttactaattttcgcttgtttgcttaggatatttgtgacttgtttcttgctttgtcattatagattgaagtgcgccatgaaggcaatgaagtgtacaagggttatttggcaaaatatgatttagacaagaactttgctgttgtctacaccatggagtctcttgatgttcatgttgtactttccgaacatttgaaggataggtatgccaaaaagaagctagtagctgtatcgcgtaacaagtatggcggattaattaccaaaagtgtgatggtgggtagtcatcataattcaaacagatctgaagtttgccatgacatttcggtgatggctgaggtacactcgcattaatacaagcacattttgacacttttctgttaccatatgcgctaaactttatcagagcctataaaaatggtctttttttttctatgcaactcttgttcaatatcactttgttttgttgaaatgtaacccttgttgaccatcactttatatttgtgttaggactgggaaggtggacctctctttgactttgatgggaaatttgttggcatgaataagtttttggctatggatacaacctttatcctgtcatggatgtcaattctcattatctttaagcattatttgccaaccctgcaaaacaggattcttaaacggttacaaaatttgaaaagagtcaggtatgccttactgatgtttgcctctcgctggttcacccacttttttctatcctcttaccctacatgagtttatatacagtaggctgatttgcatgcaaacacatatgagctcttatatgttctgcaatgatctggatcaatagctgttggttcttagccacctgtaccaaggcagttgacgtccatttgtgtgtatcacagtcagtgcagtcaaaagtgttaaacaagccctcctccccttttaggtcttaagtgcaactgtgcaaggtgctagggcacacaagtgctcactctagaggaaaaacagtgaggaagaaaaaaaaaaggatgaataggctaagctgagcttctcatcctgcctcctttggccaccttcctcgcctgtcagtgagcttggtccaaaagctactgctttgccctcctaggaagcactgtgagctcggtctggcagctgtgcgagcttggtctggctaggttagagggaaaggagaagggataggggcatgcatggttgtcattatcgtgctgagggaatagtagaggggcaatgtgtggcacacaacgagagaaccgtgctgctgaacagaggataacgccttgatgcgtccttgtctgatttatggtttttgaagaagcaaacggaggtgaatgagcactgtgggctgtttggttgattgagaggtaggactagtgggctagttcatatttgtcagatgcacgcctgttttccccatttgctcttttcgcctaaggtgacaagatgacagcgtgcattcgtttttcacttgaaccaataataattttgctgtataaattagtcatatttcttgtttccattggtgaagcctgttttgtctaatttaaaggaaatgtgcacactaaagggattatgatatttcacagttctggtgatcttttgatgctcaacttaccccttgttttcttgaaatgtgggtacaaacccacacaacttgggatcctcttttctctctctgttttacccttgcctatgatgctaccgtggtaggtttttgtactgtgttgcatattaatgcactggtatgacctgttttacctttgggttgttgttcttctgcagggatggagagggaccgggtgagctatctgactgtcatccagaaggtgagcatagtgccataccttgcatatattgtggttatctgtaatgtatctatttttaaggttctcactggtggtgcgggattagcttttacatttgaagtttctattttatatgaacttatcacatctaatagtagtgtatttcagtgctaatcagtaatcatttggccttgtgcagcaccagttcatagaggtggtctcgataaggaacacgttgagtatctaaactccttgggttatcccaagccaccagtaaacgtgttagatggtgagtcgatgtttgtaaatttgctaacttattgcgcaccacaccttttgtacactattgactattctaccatgtatcttcttccagatggcttgatattggcttattcttttgaggagaattttggctttgtatatggtgaagtcattaaaaagtttccttgtgacatacatcaaagtgttgttgcacttgcttcattcaaaggtgattttacactaaataatataatgtgctattcatatttgcatttggtcctcactaataaacaataatcaaaactatgcatgtgtgcaggagaaaggagatttttcgcatgcacgggtttttttatagaatggaagggatgtacaattattctgacatcagcgagcttggttgcagagtctggtgacagaaacaagattgatgaaaacttgagggtgggtgctaattaattagctcctcctacttattctgctctttgtttaagtctcactcacttcattaatttatttgcagattgaagtgttgcttccaaacgaacaacgcagacaaggaacattacagcattatagtttacactacaatgttgctctagtcagtgtcaacgacatggatttccatgctcgtccagcaaatatgaagcttgacaatgagtgtccacctcaagtagcagctctagggcgttgcttcgaatcaggcaaaataatggctgtatgtggggatttggttgactggactggcacacttgattgcaatttccttatacgttcctcatgcaaaactactaaggtatgtaccgctagctagctgttgatttaaaatttcttgtctatttatacacggtgattgattacaaatgacaatttgtccatgtcactcaacgtaggctggaatcggaggacctcttattggtttggatgggaaagttattggcatgaacttttatgataaaaaaataggaaccccttacatgccatgggatgtaattcttaaaattctggcatgttttgagaatgaaaggtatttgcggatttcttctctcttttggttattcaagtgcttgccatctgatgtcttcatgttatttttttttttaaaaaaagacttggctgtaagatttgctaaatataattcaatggtgtgcttggcagtagtgctgctgaagttggcaatggtagtgatccatctgatgcgcctggctggaaaatccctggagatggcagtgtcaagctaaacaggttttctgatattatatatatatatatatatatatatatatatatatataacagtgccaagttacgtctcaaaatcctcatcacattgcgtatattgaactacatacaggtggcctgtgcccttgccatattggcgtcctcatgacgatgtggaagagcaagaacccccagagggctgtgaataccagtgcacatacagaaatggtgaaagatggtgctaccggtagaatatgttcgttctactcctctctctctctctctctctctctctctctagtagccctgtaatgttactacatgtcccttgccgtgttttgttttggtgtgtatcgcactgggagttgaagaacattcagctatggtgatgctgagatgttaaatacaatgttaagtaaaagtagcgtgtctatcttggatatatcctatttgttttttaaaaaaatcccaaagtatttggcaggacgggaagtgccaaagcttccaacttgaaacgtattgaatttcgctttgtggatgctgcacgagtaaaaccgatattgtgcattatgtgtttgtgtggaaatataaggggtgggtggcaggggatgctcatgagatggtcgtctagcaatgtgtacttgaaattgctacgggttttattaaaactcagataattgctgtgggcctcatggttcagtccatggacagatttcattaaatattggctcattattactacttgtaatcgtaatcgtgcatgcgcattgtactccctcattttcatactacaagtcgttacttactttttttttgggtcaaatttcttgactaagtttaaaaaaaaatatatattagtatttttaccaaaaacaaacatattgttaaaatatattcaatgtgagattaaatgaaagtactccctctgttttaggttataagacgttttgactttggttaaagttaaacaagtttatagataaatatagtaatatttataatacaaaattagtttcattaaatcaataattgaatatatttttataataaatttgtcttgggttgaaaatgatattgtttttttctacaaacttaatcaaactggaagcagtttgattttgactaaagttaaaacatctgataacctgaaacggaggtaatttgctactccttccgctccaaaatataaggcacatgcatacaactacccttaacccaaagacaagaaacaaattaccctaataaatataatgcatgcatccaataaaattagagatgttaagggtgaaggatttaaaaaagtaataatttaatggggaagatgttctagttaattatatgcatacatgcatgtcttatattacggaacatctaaaaaaaagtagttgtgtcttatattatggaatggatgaagtaatttttatataaactttgtcaaatttaacaaagtttgactaagaaaaaaagtcaaataacttataatatgaaacggtgagagtatgtcttaagcatattacacgtagacaatagtttattttcttttttagtcaacttgtattatctatttttaggcttgagttcatttctatgtgttcccaacccatttctctcgtattccatgtgcatgcttttcaaacggttaaacaatgcgtttttgcaaaaaagtttctatacgaaagttgcttaaaaaatcatatggattcatttttgataaaaaaattagctaatacttaattattttatgcattatcggacctctatgtttttccgtgcgcagcagctgcattcccaacttatggaaactaacacagccttagtattaactacttggatttcatataaaaagtgcaatagaaaaaaaaaactggcataattttatgtgaaccaattatggtcaaccaaccaacagatagtgttgctaggagtttgggggcttgctagggacgcgcggcgttttttttttctttttgcgccactttttttttgctttttcctttttttttcgtgcccctcccctcacgcgttttcctgattttttgtttttttttcattaattagccggcacagcgctagagagggagaggagcgcgatagagaccgtcacctcagtggagggagagcagcaagcgtgccgggagcccgggaggagttcaatggaaataaattgctaatcgggcggagcttacggttgttactcttacttgttagtttaagtgtgttggcttaatgagcatgtgcttaagaaggagagaacaagcaggagcggtaggatgaaatagacggcagatatggcagaactgcacgcccgtgacgtttctttggtaagtcagacgatccgagttcatccaaagctggtatgagtctgaccgtctatgcatataatccattgcaaacttccaatatttccatcacatcaaaaattttctacacacacaaacttctaatttttccgtcacatcgttttaattttaaccaaattttcaattttagcgtgaactaaacacaccctaatacactaatgtcaattgaaatgctgaaaaaaatcctagccactttactaatgtgccaataattcatcaattacagctacatgcttggcaatattattatttagagaagaaaatatttgcaataataaggttgtgtttgacttcagatccaaaattttataaagttgtatgttcctagcttcacgaattcacggaactgaatatgtgataccgtaacaattagatggattatttaacatgcaaattttaaatttagtgtggatctgagatctggagtagccaaacggatctaaggttgatgcattgacaactctaagctgcgatgcctaatgtcgacgtatggctacaaaattaacaattaaacatgcttgttttcgtgctaaatgccaacactatcaagattaaccgcctagagcaatggatcaaaataagttggagttggaagtactaccttcccattttttttcttccatttcaatatttcccgagataatatttgcgagaaaaaaatattactccctccatttttttcattttatgctggttttcataaaataaaacaaaatgtaaactaattaatgacttaacatacaaacagggataatataataccctattatgattccagtttatatctatttgtcacataaattttcgttcgttgtccccgtgcacaatcatcgagcccacacatcaatagcatcattacacaaacatatctttgtgatcaaacttatccacaataacattaactggtgcaatacacgggcaatgtgtcttttaaaaacatggaaacaaaatatgccataattagaactccaaaccatatataagtcgataataataattattactatgattgatttcgaaatttttttaattttagaaaatatagagtgactataaatattagaactgcttaggagtatatattgcttgtatagtccatccgtttcaatcaaacatttttaactttgattattaataaaaaagatcaatcatgtaaaattaatgttcctagatttatcattaaacaaattatcgtaatatacaactctttttatttaaaatattttattttatagatattattagttaaagtagtatctcggagactgtgtcaagatctaaaaaacaattatatattttaagacagagaaagtacgtactcactcagatcaataagagcaggtataatagtaggctaagccagctgtaaacaattatatattttaagtcagagaaagtacgactcagattaataatgcccgatattttcctcgggactgcctatacatttgtcgggtgattttttaacaagaaatcacccagattttttttacacttagatttatatccaacggactacaaaataaaataacaaatacaaatttacttattcaacatttttatcaaaattatagtgcacttatatgtcatatcaactaaatttacatatgtagttttagttatataggactgtaattttatattttaaatccttacatgtcatatcaactgaatttacaaatgtaattttagttatataggactgaaactttatacaattatagtgtaattacattgtaacttacatataattacagtataattatagtgtaacttacatgtaacttcaatgtaacttttaaaacaccgctagtcatacgaaatagtcatcacgggagatctctcacccgtattaaagtagtattatcgttcaatcactttcgttctatacagtggcaaagctaaaaaattaaagatgcgtacaataccctcacttagttatcagtgccttgccctaatcagatgctaatcggtaggttgaaaaaacgtcaaattttaagtaaaaaatttgacgacagatttataggaaaactgttttcctcgggcttcggacgccgacgggaaggattctcgataacttccctcctttcctcaattccgctctgcacggacggatttttcatatccttggactcttccgaagttccaaaacaaaacaaaaaaaaaagaaaaaaacagaaacaaacaaacaaatccgtaaatccccgaaattccctacgaaaaacccagtcattacctacatcaggactccaccgaacgcaagacaagagtaaaacggaagcaactcccagcaacagatcgtcacggacatggacagtacacgaagactatagctgtgtttgcaatcccattttcccaacccctctccctcgttttccgcgcgcacgctttttaaactattaaacggtgtattttttgcaaaatgtttctatacgaaatttgtttaaaaaaattatattgatctattttttttaaaaaatagtaaatacttaattaatcacgcggtaatgaatcactccgttttcaatgcagggagtttagttcccagcatcctatatccgaacacagccggtaccagatgtgtcgatgccgtcttccatcaggacctgatctggctcgccccatatcgcacctttggttgctaagagcatctctaacagtctttttaaatcggactctccaaaacacgtatataaccagctttctaattgaattgtaagccaaactcatttatcactccaacagcctctccatctacgccttccattctgaatctatgacactgggacccacgcgtcagcatcaactccctcgtccctccttcctctttctccctcctccaatcctcttcctcttttcccccaacgtagatggctacagcgagcatggcgtcggaagaggaggacgtcgacggcgacggcgacgatggaggcgaggcggccggcgccgaagaggggtccggccccttcttccccatcctgctcttccctcgtcgccgtatgcagctatgcatcagctacgttctgaattcacaaaactgaaatgatacaagaaagatatcagcacaatgccatgctagaaaagaatgaaaagcatgaacaaatgcactcaggttgagaagaaagaagaatataccgatctcgatttcaacaagcttaacagagacaagaaaaacatgaacaaaaaaagaagttcacctttctgccatctaccagatggaaagaaccgggaagccataaatcctattcagtaccctttttctaatccgaattcccaattgctaatcgagacaaacaagcagcgcagaacagacggctacagagattaaggtcgtacctttgcaaatctgcagagcgcggatgcgcagattgcggaagcccccggcgacgacgtcaaaggttgtcgtcgatgacgccggagtagaacaagagggacggcgactgggagaggtccagctcgaggatcccggggaagcgcgcggcgaggcagcgtagcatggccgggtcggggcgcgcgcgcaggcgccaccgatcggagctctagacccgtagccagtggagcacgtcgtcggtgagcacatcgttgatgagcgcgccgccggatacgatgcccggagacgatggcagtggtgctcgaaactgatgggagaggaagagagtgcgggaggagagagagagaggagggagagagtggggccacgattggcaagccaatttggactggccaaatttagccattgaggagccagtttggccagccatatggcttagctatccatttagtaaaattgttggagtttgtttttgtctataattattaaattttaatttgaaaagtgaaatagtcaatctgttggagatgctctaatctggcttagctcggctcgccatcgacgccagactgaaggtgcaaaaggttggcgccggtgccggctgcctccattttagcggctcctttttccgtggaccatttctttcgtcggaactacgggatccagccgcgtgttgccgcgtgaaaacgagagaggagaaacgggaaaatagaatgaccacagtgggtcccaccgtatgtgtatgtgtcttgtatttttccttttaataaatccaccgcacttttgcacatcttaaagcatgcttctacacatctgggtacagtgccatttacgatgatgttgcaaactactcataattacaatttatagtaaatggtcatatatacttccaaaatacatcatatacacgtacaggctacaaatttacaccatactaagtcacaatataagaacttctatagcccgcccaaccacttatccaatcttgtccccagccatttcattcatttactgagcatcaccaacagattggctaaatcattcacgataccagaagtttaggaatttttttaaaaaaaaacatgctccatcagtatccctgaacgtcattcaaaatttagccactcccatccccgcgtttctcgctctcgtcttgtagttgtagggggcagggctcgctaccaaaatctattcacgcgcttcttcccgcaaagctcgtgaaatggtcgaggtcgtccgccgatgccaccatccaatctccactgcagcttaccggaatgaaagggcaaattccataagcaccgcagctgcatcgagctgctccgctgctgaccacatcttcccagaaaaccggacggaaatcatagccccgagggcttgattcgtcacgccgacgactcccctcatggcatagatggccatatggcccaagacccacggcccggcccgaagcccgcaattttggcccggtccaagcacagcccgggccgtgcctgggctgcaccctcggcacggtgggccggcccggcaaggcccgatcaaataaaataaaagaattttgctgatttatttattgctatatccaatttatggaattgatacaccgtttaattgatactatcatttagcaaaatgaaacatagcatatgcatccatctttcggctcgagaatttcacgggatagagatatggtataagaaataggctattaagtaactctaaatgaattgttttagctccggttcgtgaaggaccagagaagctttctagttatgaatcgggtatagaaccccctttatagcttcatgctgtttgaatagttccaattaatggaatcgaagtcattacacgagtgagtttagcaagtggaatatctgactttgaaggagctgctgcaagttctcgaattgtagttgtcaattctggaatactttaattaactatttgattgaattttcccttccttttatcctcccgtcttatatgggggataggcccccataccttatatctgtatatggagagtatacttgaaatataaattgatttaaatagaaaacctttgtatatattctatattattaaaacaaagtctaaaaaatatatataatatgttaaaaaactcttgtcttatcgcgaaatgtttcaaaagagcataaaatttattttaagaactaagaataagaaaagagtataaaacaaatggaaaatgtgcgatatgttgggaatagctccgcggaagaaaatctaaagttcttatgtatagaacttttttaaccatgggtcgcttctagtagcgattatgaattgctctcaccgctctttctatttctattttctattctttctattctactatatagaaatagaaagaattatatagaaatagaaagaatagaaagactctttcttacaagagtttcttacaggagtgaaacaaaattaaagaaagatcggttcaaatccgatagtcgtcttttttctctatcaatgttccatgaacaaaaatacctctttttctccgaactcactaacctctagaaacatctcaaatacaaatcccttttcgatatatttctatatactgtatccatgtatacaggatccgctatatctgctttggcactggaatgctcacttcgtgcctatcgcgctatttctacataattgtcccttatcttatattgttttcttctcgtcctctgtgtaaatagcctaatatgggttcacaatcaataacatcttcaccatcgagagtaacgatcagtcgaagaacaccatgcattgatgggtgctgagggcccatattgactatcatgagatcttttcttgtaagcagtagactcatatcctttattccttaattcattattccatgaaaatggattattccatgaattcctcaaaacgaggctcatcaaaatgcaaaatctaatactactataagactactaataaaataagaaaaaaattcgaacgattcttattccatatcctttataaacgaatttccctaaaaagtaggggatgatccgtgaattaacctaaccatcaactaaaaaaaatcctacaaaagcataatggaaaagtaggaaggactcaaaatagaaaaaactcacattgggtttagggataattaggctcgaactgatgacttccaccacgtcaaggtgacactctaccgctgagttatatcccttcccttttatccactagttcccctctctttagtttaacaggatagaacagtttgattgctgacaaggctcataaccgtggggttgcgggtttactgattactagaatttttttgttagaatccaaaagttctttactaactagaaagaaaaacgaatacctactgcttattgcaaattattcctgattttaaaccagagtagattttcgtgatgtgattcccgctaaaagcatacatgtactgtaatgcgcttccccatgggtatctggtaaccacgtatgtaggggtataatcggcaatttgacaacataagcaataaggaagccaaaataaaatagtatttccaatgttgcagtgagccctctcccccttccattagaagaggtttttgtccctccaccttcgttgaaggctgtttatcggaagaacccgtactttcctctgggcatcgtatcaaaaatcgccattcctgagattaaccacccgccgggggagtttataaacaaaaaaatattgctaattccatcttctatactgagatataccaaaaaagtatagtgatgccaaatagacttatataatcgtataaggcaaggtccaagacaagaggtatacaaaatagacttattttccagccatttaaacacagctcacagagttgagggaccaaaaatagactttttctgttatacctgaacatccgtcgcctctccccaaagctcatacgcatcctcgatttgtcccgccgccatcccgattcaaccatttggccgctgtccggacgacgccacaccgccgcctgacatattgtctgctcgacgcctccctgtaccggccgctcgccgtcgtccgagaacacacaggcgacaacagggtgaggcgaccgcccagaaccatcagagacgaccaggcgactggtcacggtgtctacgattcagcggatttaatttgtcgatggagagttcctccatcaaatcaatttagctattctgaaattgttcctgctactgctggtgctgaataatctactggatgttgctgctaaatgtgctgctactgtatgctggtgtttctgttgctaaatgctgatagttcgttgctgctgataaatgcagctggaaatgttgttgatgatgcttgctggtttttgttggtgcttaactgatgttgatattgctaatctgatgatgttgatctggaagctagctgctgatgatgctaatgatgttattgatctgatcatctgaatgctgctgctacctgctcatcttatttatgctgcttgtccttgtatatgctactgctgagcaacgggtggacgccgggaggagcgcccggccgatcaagatcacgcgggacaaaaaaaataaaactgatttatcttgattagttcatatgcggcccacttttttatgttttgggagtcatttttaggtattctcttggatagatcaatatattcacccctcaaattttatttaggaatcctaataactaaattttagggatagaattttcatagtctcttggtgatgctctaattctttttttttcactctatctttaatccctcaaagaaacaacagaaaaacagaaagttaaataaattttcttcgttatattttaggagagccatggaggagtccctactaaaaagttaaatcgatttcattcattatctcatcttttgtcaattgtcatcgttagcctcgcagcgactcgtgatgctacaaacaatctcactacattggtggcgaccgaatcaatccaaaaatctctgtattccctatggcgagcaaattaggaatgcaccaaacatcttgggaagaatgacttctcttatagccagaggcgttcgagaaggtaaagactaatttgaaaaaaagaaagaaagaaagcaatggccaacatgtactcccctcttccagatggagagaagagggaaacactagacgacttgagcaatatgagatagaaatggaggattaccatgtaagtctctttgtatctgtttagtcagtacattatttctgcataaagtgcaggcagctgtctctgggagactgggaaaatatcaagaaagaaaggcgaaggcttcttgttgaagaagctgaggataaacagcagggatggtttgtggtagatgagaaaaagggttatacaaatcttaataactcgcaacataggggccacagaatgtcttatcaaccacacgaggagattccactttcaagagttaaatagaactaagttgaatacttgtatttagagaacatatttgttaggaagaaaatacttcatggctcatgatagagccgacaagaaagttggagtgacaatctcagaactacacatgatagtgatctgatctatgcctattgttgctgcttctcaaaaataccgatgctcaagtaaaccaccaaaaaagaacttacttgagtctatgaatggtgctaatcagcagtaaaggtcaccaaaaatcttacttgagcctatgattgctactaatctgcggtgaaaatcaccaaaatgttgctgctggcctgctgtttctcaagccacaaaaaagggaacttgtaacatttgctttgctccttcttaggatgggcgttgctgcctatgggaacttccctcccttcttccttgaagcaatcttcttcttggctgcatctgacttcggcagcatcgcattcagcataccatccatatgagatgttaacagtgccaccttgatctcatagccaccaaggtacaaattgagctctttcacacaagtcccagcgattagtcccataacttttccttttaggctgaagaccggagaacccactaatctgcaatgcccattgaaacccttctcggcatagtggcacgttcccaggaagtagcactcagaaccattgatatggttgcgtcgaaggtcgagtgcagcggttgattctgatatgacaaagcctgggatgtggtatgcagaggttgctgaagaaggggcaaaaacgacaataggttcgggcataacctgaccacgcatcttcttgattggtctgcagtctgtgtgccttttcgtcctaagagacagaacgtatccccagaagcaaaagccgaggcttcccgttcgatctgatcaaagaaacagatcttgagggtatcctctctgcctgatgcaaatgacgattgggtcaacacgtaagtgtactttccctttgatttcaacacgcatccgctgcaatattcaccattggcgtcacggactacgaccatcgatttccttgctctcttctctaccggaatgtccatgagttctacagattgcgagaggaagtaacataaggacaagtactaaagtaggtctaccggaatgtccatgagttctacagattgcgagaggaagtaatgtaaggagaagtactaaagtaggtactagatatggggcaagatgcaacacggggaagcagcacacgcaccttcaccttcaaggagtggaggagcagcaggtgaccgggccatttctcctccggcggcgacggcgaaaggataaggcggcgcaactctttggtgcgggagcgggaggaggggggattagagagagcgaggcagccgcagaaaagaaaacctagtggccaatatggacaaagggaacatgggatgggccgggatcgccaatcgaaggccgcaatgggtaaccagagcaggacggataaggcgcacggggatgaataagtttatccaaggtccctgaacttgtcaacaaaatctgattttcgctcttcaaacgaaaaaaaatacaacggtgcctcaaccatcaaaaccggtgcaatataggtcccataacgatgtggatggcagttttaactggcatggtgcctaaatggttaattcgattcggttttaatctgatttggcattgacgtggcatatgaagcaaaatttaacaattttaaaaataaaataaaatatatgggcacacatgtcagttgaacgaataaatctaaaataatgggttatttaacttttgaccacttttaagatatgacaattaattattttccactcgctgtctatgacatgtgggttctatggcaaatcatttatcactatccataagagtagcaaataattaattgttccaaaaaaaataatgggcaccacttcctccacgtcatctcctctcttttctgtcttctgctcgccaacgccgctggagaacgggagagtggtggaggtcaggggccagatcaccaggtttcatgcgccttcttcttcatctactcggcggcggcgcttgcattcctcagctcgaatgcagcgcacaacgcgcacccgtcggcgagcgcgcgcggagaaggacaagggcggcggccaccggccggcggggagaagggcagggggcggcagccatcgggcggggagggtggcgagcgtgtgcggagagggaggaggccggcgagtgcgcgcgggccacgccccgtcctccgagttggatagtatagagaggtatactgcgtaacgtgggacgattgtattgagcctcaggggaccggtatatataggagtacatgtgaaggagataaggaaagattatagataaggaagtaatccacacaaatcaatcatatcctaatacatttctaactaccatatactttaacatccccccgcagtccaagcgtgagcagcgcggacacttggactggagaagaaaccggcgagagtgctcaatatcgatgatagccctttgtgccgtagacgatgtagccgagatgaagttgtcgtagtcgtagtagcctgtcgtcgctgatattgatgcagcacaagtcacccaatagtgtgcggttgtggttcgtggcaaggatcacggcgccaagcatgagagtgtgcgggtgtaggcgaaaagccaacaaacacgatgaccaaaaggaaaaaaaaataaagaaaaagtgaaagtgcatctacgacccctcatttattttggtgttaatgacaacacaattagaggttcactaatgctctttgttgagatagatgcaaggataaaaaggaatggaacttgagtttaaaagcattgcggcatcttttgtggtaattgtcttctaatccatgtatatcttgtgttcttgagtatcaggatgccgaactattaagagggataccacatgcatataattggtagaacactagtgctcaaaatcctgcttttgaagtgttcttgttcttctcctgtcggactatccgatataaggtcggattgtctgatacattggactatctgaaatttctcagaactttactctctgtgttgaattgctttttattcctcttgagtgattttttttatgtcaaatcagactatccgatgtgatcggactatccgatgatacagagactccgaaattcaatggaacttgagtctctgtgagaggatgaaattcatgattcaaaaataacggactatccgatatggcatcggactatccaatcgatcggattgtccgaaattctccagaatttcgttctctgtctctggcttgcttggggtcaaaaacatcagactatccgatgtcacctcaaaaatattctctcccaacggccacattttggggatctataaataccccccacctaacccttttctagggttacccaactcattcatttacattcactttgggttgagcttggtgctaaggtgctttgaatctttgagctctttctccctcaatcaaatccctcctcattctttgtgtggtggatctttgtggttgtggatttggtgtttgagggcctagtgtgtgtttcactcgatcttgagcactagggtttgaccaagagttatgtggtgtttgttactcttggaggttgaggactcctagacggctaggtgtcactcccgagccaccgatctacgtgtggttggccgggagaagtttgtgaatgccggatctcgcctccgcaaggaaagagataccccttagtggaaggaggagtgcttagtgcaacctcttgaggaaagggttagcaaagacccggctcttagtgagctcctcaacagagagtagaatcccctcaaggatttgaactccgggaacaactcggtgaacttcatcgttggtgatatctcttctccccctatttagctttgctttttgtgccgctatagatctagtcgctgtttacgccatactcttgtttgtgcactagatctacttgttctgtttctttagtggatcagacagtctgatccaacatcagactatctgatattgactgtggatcagactttccgaccctaactcaattttagcttccgcataaagttttaaattagcctattcacccccctctaggcctaattgaccctttcaaaaagaaatttaaaaaaaaacactatggtaatcacggtgtgaagacgttggtgatgacgggcagacggtgatgtcgacaatgttgttgtaggctggggcagcaaaacaacaacatccttgatctcggtgaaacgacggcgtgggcgacgcaaaccgatctctgatcgaaaaaaaaacagcagcagcggctcagctctttcgtgtctcctgacgcactaaccggatgcagccatgcatgcatgccatggaggcacacaaattagaaccatgcatcttcgttacccatcgttgcatgcaccaaccagttacacctaaaagcctaaactgataaggaaagacggacaattcactttatacactccaacactccccctcacgcgagatcccctcaagtctcaagcgtggaatattggagtgggctacaattattttatttaattacgtgccagtcaggattcgaactcgagatatctggctctgataccatgttagatagtatagagaggtatactgcgtaatgtgggacgattgtattgagcctcaggaggccggtatatatagaagtacatgtagagaagataaggaagtaatccagacgaatcaatcctattctagtacgtttctaacatcatatgctctaacactccgctgccgctgcaggccacgccggctcctctcccccgcgacgccacccaaagttgctgcaggcgttgtcgccgcagccgttgcgagaaacttcggtcgccaccgccaccgaaagctcctgcagacgttgtcatcgtcgtcgccgcagccgtctcgcgaagctgctgcagtcgttaccaccatcgttttcatgtgaatcaatcgccttctccttcctggattcgccgatgaggatgtacggactcgccggattccttcatcctgctgctcctgcttcgcttccttgtagccgccgcccgccgtcgacatgaagcatgtgaatgaagcatgctgcagccacgcctgatgtaccaagacactgatgaaggcttccacggattgtttgattgaatcaattcgctactagttgggagtagtagttgaaggttctgacagattcgtcgatttggtgattatttttttcttgtatttttctgttcttttttccttctgtatgtatgcagttgtttataaaaactgggtactacattaatttctttggaggagtaataaaattgtgccaagatttgtcatccgaccagtgtgagttagcagcttccatctaaatcctaatatatcatattttttcatctcaggcagagatgcacaagtgcacaaccaaacatgtaagatgtgaggctgccaattcagatgaagaccgactcaaattagtcacgtaggcgccacgtcagctaaaatcgtcatccaaacaactaggggatatatattgcaccagttttaacagttgagggatccgttgtatctggttttccggttgaaggacgtatattgaattccttgacaagttaagggacctcagatgaacttacgccgcacggagatgctccagtccgtgtgaaggaataagtctactttgcctccctccactcctttccctgttgaatcacatccctcaacatgcaaaaccaagtataacccgtcctccaactcataaaaccgttgcaaatcgactcctccaacagtttcgtcctacgtggcatgttcaaccctgttgactggctgagtcagcacgtggaccccacatgtcagtgtcatgtagagaaccctaaaagtgagggtaaaattgcaaaccctaaaaagtaggggtaaaacagctgttggaattaaaagtgggggtatggatgcaattgccccctacttcttctatttgcactataaaaaatatacatttgatagaactattaatttttattttattttttaggtgacctataatagatattatttattagaagatttacattgccatatatttctatgcaacaaaacttatatatatacatgtttatgttttcacgtttcactcatatttgtattatattccatgttcttatttgaaacatatattttatttgtatttcccaaacatagtaacataaatatttgcatgtattaaatatttgacttattttttttctcatcaactaaaatacattcaagtaattatttgtttgatacagtcatcctatgagttgcatataattgactgaagtctgaaggtattgttatgaactttaaaaaaactagaggtaccactttgttaattaacataatatctaggtctgtacacattcgagaattgcggtcgtacttgttcgcttgtcacaagtacttggcaatgcatatggaaaccaagacagtactagcccgcccggaaatcaaccaaatattatgtaccgtcccaatctaagtataaagcattttaaccagattgtaagcaaggataagcaaagctaaattatctgggtttctatagttgaattatgcctacataaaatgggatatttgaatagaagggttataaataaataatttgtaaagtataggcttaaaatgatcaagaggtggacaataacttgccttgcttgatgtactgagatggattgatattatctagtaagtcagaagaatcctcaagacctagggttaaatataaaattcaaattcaaaagaaattcaaatgaaatccaaaaatagggcaaaataacataaaatgagaatagcaaaaaaaaagctttagaaggtagagaatgattttagaagaattttggtctaagtttcattagaattgggtttatatttaaaagatatgggcttctaaagtttcgaattcaaattaaaccgggaaattactaaagagtactgtgcgtgggtcccactggccagtctctctctttcttctcttcttctaccgccagccgttccccaattgcgaccggcggcgctagggttgcggattgcggcggcaatagaggggaaaagtgggtacgggcggagaggggaggctgctagggttctccggcgatggtgagcggcagcggagggttcaatttcatctgtggacggcatagcggctagggtggcggcggtataatggtgtcgtgaaggtgatcttagatttggttgttagacacaataggacatgggtgctggaagcttcactagggttcatgggatgggttgatggctatgccgaccgtcggcaaggtgtggagggcatgcggccgtgagcgccatcatcgggggcgatcgagttcggccgatagccgtgtaggtgatgcaatggtgcaatgcgactggaaaaatggaacctaggtggtatgtagatgctagaaaacggaagaactcaccgagttggcttgaaatggcgagatgcggtcgagaaaactcctcggcggcaaaaacagggcatagagggacgacggagctcggtcggacgcgacgaggtgaaagtccacgcagggctccggctaagcttcggatttgtagaacatgactcaacgaatgtgtttggttgattggataggacggaggttgggcggagtggtggggaagtagtcgcgcacaaggtgctcaaccggcggacagtggtggttgatggggcaaatggagaggcagggctttgggggtagtgtggtaatggttgatgttagagcatcaccaacagattatctataattttctcctaaaaatttgcttttgggtttcctaaactgaaaataggaagtgaaaaaactcctctctccaacagataacctaaattcaatccccaaaacttaaaagtgggcccgtctgttaaactaccaagaaaaattccatcttttttttctttcacgcgcagaaagatcgctatctcccacgcgcgggaatgaaggagagagaggcgggattgcgtgattggaagcgactttcacgcccgcatataaacggagcgaggaaccggtggaagggaactccaaaacttaggtaggagagcaagggatctgttggagctgatttttggactaaaatccctcaaaattagttttgggaatcatataggtagactgttggtgatactcttaatcgatgatggatgagtgagggcttggggtcctatttatagggcttgggcgagcagatgagctcgagcgccatcaacgcaattgatgagctcggtgttcgggcatggcaggggtggcagagggctgagagagggaagggaagagcaaattgagtggcgggacatcatgttcaaacatttactgacgacagtggggtttaatcgggggcgaagacaagcggcggcgagctggcgtcctcccgggctcgacgcacggcggcggcgaggggtaaaacagtcggcttggcggcgttcggttcgagttgagagaaggaaaagtgactgtcgacttttaccccaaacgcgtggcagaatttggtcgttttatccccggtagaagcaaactcagtcttggcgtcagcatcgggtgggcacgcacggcggcaggcggtgttaagctgcggcggcggccgtcccggtttctcctccgacgagattagtgcagcggtatatggttgaggctcactggacggcggatggcatgcacggggcgccaaggcagcgcggctaggggtggccacggttgtgacaggacacgtgtcgcacaagagattaagtctttcgcaggagcgtaagacttcagtcttaccaaattttcttccggaaaattgatggggaggccacggttttagagggttgtggtccccaaggacctaacttagactttgccaaagtttaggtggaggttgggctgctgttgtcgggctgaccattttatcgaacacctagagtgtgatgaacagtaaattcagaaattttgaatattttgcctaaaaggaatagaaattatctaaggcctttggatgggttttgctaagtttttgcactatagcaatgtctcactagaattagggtaatctaaggaaattttctaagttttgaattttgaaagaaatttgctaaaaaaattagggtttttgggtaggatggtataaagttggttttaaaggaattctaaaggggtattacttgaaccaaagaccaaggttaaaaaggaacttttaaaaaaaactttgattaattcaagtaaaaaaccaacataatgcagttaaattttagattaaaatttgaggatgttacaatgatgcatacctgcttgatatcctggagaagagattgcaccttgccaccgccatttgcacctgcatctgtaactccaacagtgcttacctgaacataagagttagcaacaagccccatcgtacatctagttcgctatcatcaaacaaatccttgagatttgataataacatatttccagcagtgaactgtgattacaagcattcagtttatatttagaacgtttaggtttttaaggtgcaaaattactaactggccatcaggaatcttaattggtgaaagcagcaagctttctggatggaggatgagccacatcatccagaatagaagaaccgttggatggatctagtaaaagaaaatacaccgttgaatctatacatatgtaatatatgttggacctatcaagaccctcatttatgagaatagaaatccattggaccaatcaagaagcttctggacaaaaaagttgacactatgtttggttaattaatctctagattaaataaagaaaaaaaaataaggctcagctataaattcatactgaatttattaacctctatgattatcctccataagtgatttgtagcaaattagcattagatcacgttccatttctccatatgcaatgactcagcatctatgatgcactgatacttcactttcttgccgtaccggtatccgatacgtccgatactccgtcgatacatatgcttgggatgttttttgaattatagagaaaaacaaagaaaaaacaattgctaacaagttccctttaaaaacatgtcaaaacgtatgtttggaatgtttttgaattaaacgtatgtttataatgtttttgtaaaggacgtaactacagagctagtgctaaaccagataccaagaggcaccatccacctatactttaaatacaattttttcttcaattactcatccgatctacaatccgattacaccgttgtgttcgtaacaattaaatctttacaacaagatctcacatgattatattttgataaaaaatcacaaattacttttatgatatgtctaaattacttttagatttcactaagttacttcttagatatataaaactaaattcagtaaaacctaaaattaatttacatatattataatagtaacttagaacaaaacgaagataactttagcatgtcatttgaagtaaatccgttgtatagataaaaacacacacacacacacacacacacacacacacacatatatatatatatatatatatatatatatatatatatatatatatgtatatatactggatttttcacattttggtccttttgaaaaacttatttcgcaagtagacccctagaaaaacttatcccaaaaatggtcctttttggggcgccagcctctttggcgccgtccccctgccgacgtggcggggcgatgctgaggtggctagggggagtgcgccagagtggctggtgcccccccccccccgaatttttttatttttgttttatttgtttgatatttttttcacgcttagggacacacaagaaccaaccatagaaaaattgaactcaaatgaatgtaatatgtgacatgtagaatttttcctctcctctcctctctccgaacgagtgcagaggagagagatgtgcaacttttttatttttattttatttttttgatatttttttcacacttaggaactcacaggaaccaaccatgtaaaaaataaactcaaacggacgaaatatgtggcatatggaattttccaaagctccaccgaaaaacttctttcctcaaaaacacaatcttgcaagcggaatttggaggttttaatatcgccgaacccggcaaagcgggggagaatcggatgtaactttttctgtagatgtccgtgcatatattatttgcctgattccgagtccgtatgagaaagttatgcctattttaatagatgacatattttgtccatttcgatagagttttggaaaattctacatgtcacatattttgtccgtttgagtttattttttatacggttggttcctatgttctcctaagtgtgaaaaaaatatcaaaaaaataaaataaaaataaaaaaattgcatctctatgtactttttaacttatatatgtcatttcatgtggttatattttgaattagattaagtaatttcatatagtggtagagtgcattatgtttaacatgctgatcaaagggttttactaaaagagttatggtctaattttagtgaaagtgcaaagtagactaagtggtatgctagatattttcagacttagctaagtggtagttcgagtttaaatttttttttgtggttggttgtatcgtgatcctgagtgtgaaaaaacatccgaaaaaataaaataaaaatgacactgttgcaactccatacagagaaacaggaatggaggcggcggcgccagccatgctggcgccctccttcctggggcgg

SEQ ID NO: 65616 - DNA, 641 bp, Oryza sativa
aaacaaaaatcaggatgtgacaatcttatattaaaactgtaataaacatatatatatatatatatatatatatatatatatatatatatatatatatatatatatatatatatatatatatatatgctaagtctaacaatcttatattaaatctctaataatataataatcttatattaaaactctaataatctaataatcttatattaaaactctaataatcttatattaaatctctaacaatcacttctttacatcacttgcctgcgcgaattcctttgatggctagctaccacttcggcttgagggacgacgacgacatcttctctgcaacattactaggaaaatgtattagtctaaacgggccaagttacatatgttgtatttcacgttttaacctatatatataatcatatatgtatgctaagtttaataatcgtttaattatctcgttcgtacacgtttcgctcgcgttcgttcacatacttttagtacaagtgcattcacgttcgtaagcgtttcgttcacgttcgttcgcattcgttaacgtttcgttcacgttcgttcgcgtttcgttcacattcgctcgcgttcgttaacgtttcgttcacgtttgttcgcgttcgttcacgttcattaat

SEQ ID NO: 65617 - DNA, 1283 bp, Oryza sativa
tggtataggtcgtgtttagttctttggccaaaatttttttgagtgtatggacacacatttaaagtattaaacgtagactaataaaaaacacattactgattctgcctgtaaactgcaagacgaatttattaagcctaattaattcgtcgttagcaaatgtttactgtagcatcacattcttaaatcatggcgcaattaggcttgaaagattcatctcgcaatttacatgcaaattgtacaattggttttttttgtccacatttaatgatccatgcacatgtgtccaaacatttgatgtaacatttttgtaacacccgtatttctgttgcttttatttaaaaagttgtcatttacaaatttggagttaaatttggttcttaattgatttttgtgccaaaatggatctcaaatcctctcctagaaattcccttcaatttctgtgaaaccctagtccaaattcaaattcaaatcctttcaaaatctcctcaaaattcaactctacaaatctctggaaaaaggtgaaagttcactgttcaactgggccgccctcccctttcttttttctcggcccaactcccctccatcctctcctctgttcttctccccttagcaggccggcccagcccagcccgcaactcctcaccttcttcctccttgagccagcctcatccacgcacacaaggtgttcgacagaatgccgacccaagacgccgcaccgttttcgtgtcgtggcagcgccgcgtcgcactcccgtgcaccgcgtgtcgtgccaagaccacctccgcaccaagccgaggccgcgccacaccaaaatcgcgtcgcgccaagccgtcctcgccccggtttctgttgacggtcattatcgatcagtttcgaccgtcaatattactaaaacaggagagaactagtgatgcttgcaatgcataaatatgttagaatagtaatattctactagtattaggtcttctaaccttttgcagagaatgacaataaagtggaggagaatcgacatcaacaccaacgataaaacaatcggacgatgtcgagaaccagacttatatatgaatgggccaagaagtcagaattgacacgatgaattgggctaaaattcacaagtctgcggagtggagcaatagaggacgtcgccagccgaagatgggctggtttgggccagcccatggttcggccgaaccagggggttcggccaaacccccatctccaccgttgaggccagggtttggcatggacgtccaagattgcaccccaatgacggttggagggta

SEQ ID NO: 65618 - DNA, 5669 bp, Oryza sativa
acacgcatgcaggcaccacaccaacatgatcaaatccaatttcccaatctccattcttgattgggagtaagcagtccactccaacagacacaattttatacattcacacacagtgcttcgttgttttatatacatatagttgcaaatatcccagtttcttccacactattgcttgtcaaccccagtagtgctaccaatggcgtcggctttgttcctttggctttcatggcttgtgctctccctcctctccatctacctcctcgatctcctcgcacactcccgccgccgcctcccgccgggaccccgccctctcccgctcatcggcagcctccacctgctcggcgaccagccacaccgctcgctcgccggcctcgccaagacgtacggcccgctcatgtcgctccgcctgggcgcggtcaccacggtggtcgtctcctcgccggacgtcgcccgcgagttcctgcagaagcacgacgccgtcttcgccacccggtccgcccccgacgccgccggtgaccacacaaggaactccgtcccgtggcttcccccggggccgcggtggcgcgagctccgcaagatcatggcgacggagctgttagcgacgcaccggctcgatgcgctccacgagctccggcaggagaaggtgtcggagctggtggaccacgtcgcgaggctggcgcgcgacggcgcggcggtggacgtcggccgcgtggcgttcaccaccagcctgaacctcctctcgcgcaccatcttctcgcgcgacctgaccagcctcgacgaccgtggcgcgtccaaggagttccagcaggtggtcacggacatcatgggggcggccggaagccccaacctgtcggacttcttcccggcgctcgccgccgccgacctgcagggctggcgccggcggctggccgggctgttcgagcggctgcaccgggtgttcgacgcagagatcgagcatcgcaggcgtgtcgccggagaggagcatgggaaggtgaaggacgactttctgagggtgctcctgaggctcgccgcccgcgacgacgacacggcggggctcgacgacgacacgctccggtcagttttcacggtaaggacatgctccctctgaccaaaatataaaaacctcgattttctagtgaatctgaataatctatccaaaataatggtaaatgtcttgtagaattttaggttcttatattttaccacgaagagagggttcagctttttcacatgctgaaacgtctagcgagttccattgtagctactgtaggtaaacagaaacagcaatagttaaattaggtttgctgtcaatgtcgcatacttccgttttttaacccatattgttgttaacttatcgttgttgaatttagttccacgtcggtaattgataatgggatagcacaacttaaaaagtgagggcagtaattatccaagactagtctcactagtactagagaaacaattttcctgaatgagctatttagtttacagacgaacccttaagaagcctgtaggtgaaaatcgcatgccaaaataaaccgattttcttatttttgcatgcgggcattgttggcctcttaaaaatatacttacaagtcaatccttcatcctcttttccctcctctacacttcaaaattcaaaatttcatcctctttttcctcctcaacacttcaaaattcaaaatttcaccttgcgggcctcttgaaaacatgcctacaagtctatccttcctccacttatccctcctcgacacctcaaaattttatctcatccacccatccacgtcattatcctttctatcctctctctcactctctatcctcttccactctctcacctctctctcccgcggccggcgtgggcgcggccagcggcaccgcgcggcttggcggcgtccttagcggcagcgaccgagagcggtgagctcggcagcgtgtgcgcgccgctgcggacgaccgcccctcacctgaatccagtagaggccgctgccccacgccccgatctggcggcgacggtcgtcccccgcccggatccgaaggcggtggcggcctcagcggcatgcgcgcggcggcgaccgagagcggcgggttcagcggcgcgtgcgcgcagcggcggcggtggtggcgggcgggcaggctcggacggtggggaggcaccggatccggctaccgcgacggcgacggcgacgatgacgatgacggagaccgcgatggcgacgacgacggcgaccgtgaggagggttttctttttttggatattttttttggttttttatttttgcgtgcgggcgacataaccaccccgcacgcgaaaatcgcgtgcgggtgcgccacccacacgtaaaaatagtgattttaaagacacttggttccagacagttggaagatccgcacgcgaaaatcacttttgaccgcacagaagaatcatttctctactagtgtgtttagggctgtataggtccaggacctaaagttgtgactccggttggtcctatggtagatcaggcccaatgtgacctggatggcccacggttggtgggccaggctacgcactctaataagtggtatcatagctcaggtttggaatccgcaatgatttctatgggtcacatgggttgatgtgacggaaaagattgttgacaaaagtatgatatttacacaaatatcagatggctacctcctcgtgtgcaaagtagagttttcacaaagtttggaatccgcaatgatttctatgggtcacatgggttgattgacggaagagattattgacaaaagtatgatatttacacaaatatcggacggctacctcctcatgtgcaaagtagagctttcacacgattattacgcgggtaatgctgcaggtggcttatctattctattttcctttctcttctctctcttttaaccactttttaaaaaaaaattagacaatttttccttctaaattaattatacgattcatgattcaatttcatcattacgttcgtcataactaaatctttataaattgattctgcttgattatatttatgagaaaatatataatatgattacagatctaatttaaacatttttatattatacacgaaacaatgagatgtaaatgttggaatattagaaaatactcaatgaaacattcaaagtacaatacgtgcaatatttctgaataaataagtaaaacattagaaaataatgaaacatccgatgacactacatgcaccattaacaaataaactattgaaacatcacaaaataattattgaaacattaaaaaacacacccggtgtgacatttaaaatagatccattataacacaaaacttaaaagatgcagcatagtcaaattctaattgtaacatttatttctcacacgtcaaacttttgttggagaaaagaacggtacaggtacaactgcactgaacccgtcccccaatttcttcttgtaaatacatatagttgcaaatatcccagtttcttccccagtactgcaatggcggctttgtttctttggctttcatggcttgtgctctctccctcctctccgtctacctcctcgacctcctcgcacaatcccgccgccgcctcccgccgggaccccaccctctcccgctcatcggcagcctccacttgctcggcgaccagccacaccgctcgctcgccggcctcgccaagacgtatggcccgctcatgtcgctccgcctgggcgcggtcaccacggtggtcgtctcctcgccggacgtcgcacgcgagttcctgcagaagcacgacgccgtcttcgccacccggtccgcccccgacgcctccggtgaccacgccaggaactccgtcgccttgctgcccaactcgccgcggtggcgcgagctccgcaagatcatggcgacggagctgttctcaacgagccggctcgacgcgctccatgagctccggcaggagaaggtggtggagctggtggaccacgtcgcgcggctggcgcgcgagggcgcggcggtggacgtcggccgcgtggcgttcaccacgagcctgaacctcctctcccacaccatcttctcacgcgacctgaccagcctcgacgaccatggcgcgtccaaggagttccagcaggtggtcacggacatcatgggggcagccggaagccccaacctatcggacttcttcccggcgctcgccgccgccgacctgcagggctggcgccggcggctggccgggctgttcgagcggctgcgccgggtgttcgacgcagagatcgaacatcgcaggcgtgtcgtcggaaaggagcatgggaaggtgaaggacgactttctgagggtgctcctgaggctcgccgcgcgcgatgacgacacggcaggcctccacgacgacgcgctccagtcaattttcacggtaaggacatactccctccgtcccataaaaccccattcctaccatctgtggcgaatccaggcctatttcgtggagtcgactgacccacaactttttaaaaaacatcgtataaactttgattttcatgtataaattcaaaagaatttagagaaatgaccccacttaaatacgaatcattagtaattaacccagaagcttaaatttttagctccgccactacctaccatctcaagaagagattagtgaagagtaaaaaattaaccaaaatacgtctcattattgaaaaaagtagtaatgttgatggtagataaagggtatttaagggagaaaatttctcgtcttatgtgccgaggttagatagaatattagaagttggtttttttgaataaaattcaaatttcagaagttgagttattttaatggaggaagtacatggtatttcctctgtccaaaatataaaagcctcgatttttttagtgaatctaaataatctatcgaaattaatggtaaatgtctcatcgaattttatgacgaagagggtgttcagctttttatgtgctgaaacgtctggcgagttccattatagctagtgtaggcaaccacaaacagcaatagttaaattaggtttgctgtcgatgtcgcatactccgttcggttttattttaattgacattttggacaatgatacggtctacaaagataatatatctttgaccttatttttctattataatatatacaataaataaatgcatgtataattttattatagtgttttgaaagacaaatctatatatgttgttctagtttttttaaacaaaatatttttaaagttattgatggtcaaagttataaaagtttgacctcaaccttgtccaaagcgtcaattattatagaatcggagggaatactcgttccttttttagccgatactgttgttaacttattattgggtttagtcccgcatcgataattaatgatgatgaagcataacataaaagatagggggtagtccttacctatcagatagtcttttgggctgtgtaggtccagaacttaaagttatggctttgattgggtctgtggtggaacaggacgatcatacatcaccagtccttaactttttcaaatcgttcaatttacatcccttagttcaacatcttagttctaagaaatacgcatgtagctcggaaatcttaattcgttatctcttcaatattatagactataggagatagcttagagcttaaacacaatcatttatacaaagcatataatgggcctgttcgg

SEQ ID NO: 65619 - DNA, 1232 bp, Oryza sativa
ttagctcttctttgatgattccctgcatcatgcctctattccggtatgacttgctgagtacagtgggtagtactcagtcttgctctaattttcccaaccccagagcacgagtatgtgtcagacgaaggtttctccgaggagtaggcttcgtccgtgccgtcgaggatgcctgtggagtggtgttcccgctgcagttctagtcaaggcttagcttctgttgtctttctttctttccgctgcatttatgtaagacttttatgatgtttgtaagacgtggatctgaatgtcaacattgtcgtctgtgtaccccggccggtcctggacggggattttaatgcacattctgcttggaattctattcgggaatttctgggcgtggcaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgctcgtttaagtgagatttgtcaaaaacaagtcagtccagggttttagtaaaactgttgagatttattcgtcagtcagttgggatttgatgggtgaaatgcattaggtcctagctcaagaacatgggtagcaaggtatttatgctcttattgttattattagtatgtatctaatttccccattattttatcgttatgtgagtctgtcttatttattcgctctcatgcaaaatgatctatgcataaaatttcgctcttattcgattcgcttatttgagtcttttattgctttatttaaatttggatttgagcatgcattgatcctactcctttgtcttctctagatggccggccactcacccaaccaccgtggagaaggcatgatcgactttgtggcagagttggcacgtatgacactggtggtgggctaccccaacgcgccagagtacacgacggttccaccgctcagtggcgagcttcctcaccgtgttcgcttggaggtccacggctacgtgggtacctgcctagctaatatggtggttgaggcatctggaggcacagcagatcacgcctgtcaggaggcagcatacctgatgatggccagactacgggagcgccacaactacatcttccacgacacggcgtaccgatttcaccctcgtcgagccagtggtgatgatgtcagtacctttcgtccg

SEQ ID NO: 65620 - DNA, 2730 bp, Oryza sativa
cttccgtatgtctccttcaaatagaaacccctataatcgcagctactgggatgagggcctgtttagatttcttggcaaaattttacaccctatcacatcgaatgtttggacacatgcatggagtattaaatataaatgaaaaaaaaaactaattacacatattgcgtgtaaattgcgagacgaatcttttaagcctaattacgtcatgatttgacaatgtggtggtacagtaaatatttgctaatgacggattaattaggcttaataaatttgtctcgcggtttataggcggattctgcaattagttttgttattagactatgtttaatacttcaaatatatgtccgtacattcaatgttacaagctaaaactttagcagcatatgccatgctagccttcgtactactactttgtaaggaatttttttttcagattagagtttctatctagactctattttgggcctgttcactttgatgccattttcaaccttaccaaattttagtaaagttaccaaaaatatggctacatttaatttgctgccaaattttgttaactatataagaaatccttaccaggttttttttagcatcaaatttaacaggcgcttggatactgaaagattggaattcagttttctaccctttgcgaatttgcgaatcagaacagcaaaaacctaagcaaaccctagctccggcgatgcctcccgctgccgccgcggaggcggagatctccccgccgcccccggcggccgacgggggggccatagcggatacggcggaggctggtgtcgcggctgagaaggagagtgacgggatgaaggtggaggatcgcggcgaggtggtctcccaggaggccacggcggtgaagccggatgaggcggaggagcccgaggaggatcctgaggaagtcggcgagggggccgaggaggcgccggcggcgggtcctggagacgtcgcggccgccgcggctgagtcggggcccgtcgcgatggaggccggtgatggggagccggcgctggaggtggccattactgcccatgagccggtggaagaggagcccaaggatgtaatggagacgggcgaggaagcaatagagccggaggaggatgaggaaccagaagaggcagaggtagaggaggatgaggaaccagaagagttggagatggaggaggaggaacctgaagatgcagattcagaggagtcgatggaggaggaggcaggctcagaggtctctgaagaagaagctgcggcggatggtacgtagaacctatgcattttgattgtgtagtttcttaatttcttagtgcaatggtaacttctatttggtagaatcggcaaagacagggagaggcagagggaggcctggcctcccctaaccgaataatatttgtcgagtagctgctaagcactcttgtaatttatatatggtgtctaattgctgcgtgttagactttacatgccaatatgctagtctgcaaaaagcattgaggcctggcctcccaaccgaataatatctgtcgagtacctgctaagcactcctataattatatatggtgattaattgctgcgcgttagattttacatgccaatatgctagtctgcaacaaacaatccatccctaaaaaaagaaaaaaacaatgaaagaatcttaaagcggaattgctaggcctcttggctgttactaagtaattcattatctgataaaaaagcaaaagcatgaacttagcctctaatatccatttatttgtaaccacagatttacctcgccactataatttcgattcctaaaatcttagcatgttatatactccatcggtctcaaaataagttatttctggagttcaaaatttgtcccaaaatatgctgatttctatccatatttttatactgggtccacaaatagggcatttctatctattcaataccatttacctacctaccgtattaattctcttcatactaatttgaatcccgattgataggaatcaatttattatgagaccaagggagtacatcttgtgttccgccggtgataaatggtagacgaaaaatactatattgtccaaatatagatatgttgatatgatttgttatccatggaaaatgattgaaatttccatgtattgtcatgctaaatttctactatcatcgtcagtcggtatgtaaggaatgttgccccctgcatgtttaaatcctggctctgccactgactcgtagttggaactgataaggttgaggggctattcagttgaatgaacaagattttgatgcgtactgcatgaatattcggatacttgttggatggtaccaactagtctttacttttaaaattacagatttatttgcttattgagagggaacagttgagtcaaaagggctgtaatgctgtatggtgtgaaaacagctgcttgctaatttatctttgcccaatatcaacattttgtcagcctgttacacaaggttggtttccggccaaaacctcaagtgttatctgaaaccatatcttatgatggctaaacccttcagttttgttttatttgttcagtaataccacatgttagaatctaatttgaggtgcaaatagtagcaggggtctctactgactatatttttttatagatattaaaatctctttaactaatttcaaagattattatgctgagatgagcattatgtacgagaatatttctatttcattgtttcttgtgccctaccttctatgtccaa

SEQ ID NO: 65621 - DNA, 4493 bp, Oryza sativa
attgttgcagaaccgtgaaatgtgctttacggaataaattgttgtttaccgtcattattgctttccttccgagagtcccctttccccgtagtctcccatcatggcgtgattcgggcaccccgattgggcaaaggtctttaataaattctatgcagaattcaatgacctcctgtgttccataccccttggcgatgcttgcctctggacgagcatggttatgaacatacttctttagaacgcccatgtacctctcgaaaagaaacatgttgtgtaggtacacaggtccaagaatacagatctctttgacaaggtgacaaagcagatgcgtcattatattgaaaaatgaaggtggaaatatcaactcaaagctgacaagacattgcatcacatcattttgaagggcttctaatctatccagatcaatgatcttatgtgaaattgcgttcatgaaagcacatagctttgttattgttgcccgaacattgtcaggaaggataccccgaattataactggtagcagctatgtcataaacacgtgacagtcatgagactttaggtttgtgaacttcttctccttcgtgcttattattcgctttatattcgaggggtatccagacggtactttgatgctctccaagcattcaaacatactttccctctctgccttgctaagagtgtagctggctggactcaagtaatggcttcctttcttctttggttccaggtgaaggtcgtcgcgttgttccatatgcttcagatcattacgtgctttcagtgtatctttcgacttcccaaatacacctaggaagccaagcaggtttacgcaaaggttcttagtgatgtgcatcacgtcaattgcgtagcggacgtccaagaattcccaatagggtaactcccaaaaaatagagttcttccacatcgccgtgtgatcatcttcgctctctataggttagctgccatgccccctttccaaacactactttaagatatttcaccatagcaaacactgctttcccgctgcgatgtttaggcttcgtacggtggtctgccttatgtttgaagtgctttcctttcttccatacagggtggtttgcaacaaggaattgacgatagcccatgtacacaaccttcctacaatgctttagatgcgtactttcactttcatccatacagtgagtgcaagccttgtacaccttgtttgactacatggatagattgttaagtgcaagctaatcgttgatggttacgaacagcagcgctcataggttaaactcctcctgtttgtcctcatcccacacggggacaccttctttcttccacaacaatttcagatcttcgaccagtggtcttaggtacacatcaatgtcattaccaggttgcttggggccttgaataataatcggcatcattatgtacttccttttcatgcatagccaaggggggaggttgtagatacacatagtaataggccaagtgcaatggccgctgctcatctctccaaaaggattcatgccgtccgtacttaaaccgaaccttatgtttcgttctgtcgatgtttcaccactacgaaccatcggcggggtgtctcagcatcccgtcttgttgacgttcttctgcgtaccaacgcatcattctagcatgtcccttgttcctgaacaaacgccttagccatggtaatatagggaaataccacatcaccttagcaggaattatcttcttcgttggctgcctgtcaacttcacctggatcatctcgtctaatcttgtatcgtagtgctttacaaacagggcatgcttctaggttctcgtactcctcaccacgatataggatacaatcgttcggacatgcgtggatcttctgaaattctagtcctagagggcagactatcttcttagcctcgtacgttgtctcgggcaatttgtttccctccagaagaatgttcttgacgagtttcaataaatcgccaaatgtcttgtcactaacactatttttggccttccattgcaagaattacagagtggtacccaactttttgtgcccctgttcgcaacctgggtacaacggcgttctgtggtcctctaacatacgctccaatgtatggtcttacttttcactttcacagtccttcttgacgtcctgcaacatctgaccaagatcatctgcagcgtcgttatcgtcaacatccccgtccacctcgcccgttctatttccttcaaatccagcgtactgagcccagtccggaatgttctcgtcttccatttcatcttcttccatttgaaccccttgctctcagtgcgatgtctaacaattatagcttggtatgaaccccgagtacaagtggaaatgaatagtccttgatgttgaatactccttctagttcttgcacttattgcatggacaacaaataaaacccttatgtttgttagcatcggccactctcaaaaaaataatccacgccatcaataaactctttcgaccgctggtcagcgtacatccattgcggatccatttacatgaaatgcaaaaaaaaaatcataaaaatattcaacgaaaatgaaacccactaaacagtgatataataatgacatatcaatattcatagaataattattttttaattatttttgaagttttaaacaaatatttaatgtattgtactccttttaattttcaatttagcttgttttctattattttagattaattttcaatatattttccttctcaactattatataaaaccttttataaaattgtaaataaacaaaatttctatgtattcttcttacctacactgattttctctctcatcaacttccaacaaagttttagatacaataatgtgtacgaaacataggtccaaatgtaatataacaacaaaaaaaacattggaggataaagttgctaaccttttagacacctccgattgtatataatcaccaaaataaattcacaagaaattttgacatgaccttccctcttgtttgaagaattttgaagcttggctcgggctggaggaggaagaagatatatataaaggggttgatatttagtcccggttggttactaaccggagctaaaaatccccgggatctttaggcccggttggtaacaccaaccggaactaaagttaggatctttagtttcggtttgtgttaccaaccggtagtaaagatcccggggggctgacaaggtctgacagcatatgaaccgggactaaagatcaaatagtccctttgctcttattaattgggactaaaaattctttttagtcctggttttcagtggaactcagactattatggattttggccgactgacgaaagatagtttctccaccggtgtgatctaatgactatatcacaacaagccttgttggggacggagtcttccaagtctattagactcaaggagtgggtacaagatgttgaattgttaatgctggtggattcactgaacaaacatcaaacaactttcattcagttataatcagaaggaaaaccaccagaatttcaacaatataaattatctcggagaatagatcgaccatagtactctttcttcgcctttgtcgtttcgtcaaattaattatcgataccacgatatgacaaatcaaatttagttcatctatctatctatcttctatctatctatctatctattatatattaaaagtccatgaaacatcctgaaaacgctcctaagtcgacacctggcacccctaaaaacgctcccaagctgctaagtggcgctctaataaattagataaacatctaaccattgatttttacttaactcggtggacccatcagttttgaccattagattaaattctcatctctccaccctaatatacgatggttgcatgatttggtcccaccaaaataattagttaagacttaagagcaaacaaacgcagagaatcagttatttctctcccaaaaaaatcaccgcagtattaattcttggaaagaaaaccgacgttgtaggtttaatgcaggagcctgggtgtgtgcttccatcatccaaaaaattataccatcgaaaactttttaagtgaatatcacctttgcatcaaaaaagtgaatatcactaactgctctaaactatttacagagttaggttcggattcatgaatattgccctcaatagttagtttctgaattttcatgtttctgtttgattaccagggcctgatgaaattttcacggatgctaaatctcactatatcaaattctcatctctcctccgtaatatatgacggtttcatgctttggtcccaccaaaataattaattaggagtaaacaaatgcagagaatcagttgtttctctcccaaaaaaaatcaacaaataaattttcagatgcaaagccataggaaaagaaagcaatgcgcctctagcttactttttcaaccaatatcaacgacatccatctacattttttctggaacaagcagcaacaaccaaggttgaaacaatcctaatcgtatca

SEQ ID NO: 65622 - DNA, 2525 bp, Oryza sativa
cccatcccactcacccctcaaccaaacacccctaaaagtgggttcgtcccatcccatccactcaaccaaatactaccttatattacgggacggaaggagtagtcatcagtctttggagcaatttgcagaggtaggctgacaggagttgtcacttttctttcggactttcagcacgaatgacctaaagggccccatcccatcagtcctgcgggcagctgatcaagcatcctgtcaccataccacagacgaaacacaacacttttccactcacttttatgttttctggtatacattggtttccattaattggttgtttcaggttcccctgatcgatcagtgcatgcgttctttttttgtgtttgcgcgttccttttgtttggccaattgtgcaatgctagtcccgtgctgtcgataccttcattcaccctcttgagggttcttcctatcgattcgttttgggaaaatatatgaaatatcgtcacacctagttttggccagtagaagatctcccggggtctatcaatgttctaacttgccgagatcttgtcgagagccagaactatttattctggaaaaagtttatgtataccctcaaatttaaaaaccaagagaatttctttctcaaccaccctcttggataatcaagatggaatagatacaataaacattagtgtgatatggtaacagaataaatacgcgactaaaaaccgatgaagtaccaacatgtcaccttagtctcaaacatagctacctagaacaagtaaaagatgatttttactctattactctccgtgctacccctagtggatcctcactctactagccatctagaaaccacactacccctagtgggtcctcactctactagccatccagaaaccacaccccactcacagtatccttaatcccatcaatcccatgcatttatgagggggtattttagagttttcatcctaatccttatgccctaaaatgctagtattacgaagtatattgctatgttttatgatagagggagtaacttcggtaaaaaaattataagctcacacctaatgctatatgttatttatatatggattattagacatattacaaacatttgtttatagagataactaaaatattatataaaaacaagaaaaaaagcttagaccaagttatatacataagcactgtagtttaaagtttttggagaaatcgtagtttgacaatcatgataaacttaatccataagtccataggctgaaaataactcaatcttattcgttgcatatatcttttcctccttttaccatctccgcgtggcaaaaatataaactatctactagaatggaatgagcagatccattcattaacgaaacagaaaaacatatgtttccaaataatgcctccttttttttgtgaattactaataatgccttcttggagacattatttgttgagagagagagagagagagagaggggttcatacaaaactaactatcgctgatagcgtatttgattggacctctctacaatggttctcacatgaccctatatatagtgacattataatgtagataatttttgttggttctgttttaggttgccacagaattttttattacttccaagttttcattaataaaaacacttacggggaaaacaccagtggtgtggtggtggagtcgtgggtgcaccgtgcatgactatacccaccagggttcaaattttggtgtccacgaatattacgcacatgtaagtggattttcaacaggattttagtgagattaggaatgcgttgttggcttccgtctcttagagcatgtgtaaatacaatttgaaagagaatttgttatctcaaaagtgctactcgctaatgaaaaaaatactgaaaaggattcctcgaccactttccgcaataatattatcgagttcatatctttgtcaagttgctgattgtttcatgtatattaattagccgtttcaaccattaattacattgacatctaaaactcgatgtcaattttgttcctagaattgaaacatgtatactatgttataatataaatttgaaaaaaatataatttaatgtgtgtcattaccaatatgaaacaaaatgttggaatatagagacaagcaatacaaattcattgaaactaaaactcgcactaaattcataataaacttgaaagttttagtgttgggcaaaatttaggttatgcatgtgtaacagtgtaagtttattaattagtcgaacgaaaaagaaggggaaaaaattcaggcgattgacaaataacaaataagttgttaccgtttttttccatataacttgatccagatcattaatataaacgtgatcatatgcattgtttatcatataaattaagaagcaatgaaccacatacacagtcaaacacagctgctaattaatcagagaaagaaaacgaagccgtttataattttcggagagacaagaaatgttacgatatactatagatgatacgttgcgcacgagcgcaatgtgattcgtgatcgattaaa

SEQ ID NO: 65623 - DNA, 12154 bp, Oryza sativa
ctgccaatgctctcatctatgaaggagtgtgtactgcctgagtcaatcaacataagaatctctgttccttgaacccatccccttaatctaatagatttggatgattctgtacccccacaaagcttgctgagatatagccatcaatcctccatcaattgcctctactgattcaatagggtctttagctgtcaggatgtcatcagaattacactcagagcgcattgcttccaataattcttggacaacatggagctggacagaagtagcacatttatggtctctcccccatctttcaccacagacaaaacaaagacccttagcccttctgtaagacttaagagaagcaaatttgtcctctctggacttagcagattccactccctttttgtcatcatgtgcactaacagctacagatctctgtcctggaggcactggcacataattgttgagttttggtactggcctgaacgcaatgtgattatcagaccttctgtgtgtagtagacttattactttccaggatttcttcttggagcaaggcaattgaacaagctgagtcaaggtcctggggtctctgtagcataactgcacccctgacatcatccctgagcccttcaatgaacttagtaacaaaatacacaggggtgagagcactgtcatatgccattagctggtgcatgatactgtcaaattgttcaacatattcagtgactgtgctgttctgttgcgcatggaaccattttctaattagtgcttcctgtatatctctagtgaatctagcacagatcaagtcacacagagtttgccaagtaatacccataatttgagaacggatcgactgaagccaaaatgctgcattaccactgaaattgagtgtggccaccttgacccaatgcataggattaataccatagatatcaaagtattgctcacaattgctcttccacatctgtgggttctcaccatcaaacttagggcaagtcataggaggaagactagtactcagatcggtgtgatgctagaagaagttggtgattgcacagtagaatccggagaaaatggactaggtgagatgggaggaggattccgcttaccatgcaaccatggagttccttgtgctgaagcatctgcagcggtttcttgtttgatcgcgccaccttccatcagctccaccttgtggcttagtgtctgcacggactcgctgagtttttccaccttctcctccatcttgggaagacaaatctccaccatcttcttcagatcagcgagatcatcccgagtcctcgcctccgcctccattctcttcttctcattctcctcaatagttctcaacaagacatcaagtttactctcctgcgacatcctggaatttgtgagcgaacccaactagatctagaatcccccgctccttcccgaactcagttaaccaagagaaggcaagttgccttattgtggaatctgttctaagaacaattccaatcctccccctggaattttacaaccgcgccaaggaattcttggagcgtagaggctctgataccaattgttaacgaacttgcacaggaaaagcaatccagaatgaacgcacggattagaacacgaaggaattggcaactctattactgagatatttctccgattccgacaggaatggagccaccgccgcctacgccaccatggtcgccaaagacagagttcacctcgtgttctctctctcttatcttcctcacctactcagttctttcccctctcgcacgaagaactattacaggaattagacttaattacacggcccagtcaggcccatagtacttcaggtttatcttgacgggccttgttgcacggcgcaccacttctccttcagctgcttcaagttcatcttccctccttccggaatcagcatcatctccagcgtcttctgcaactgacttagcgccctcggacagtggttgctccttgacacggacgtgactgggattcgacggcgctccgacgacgcggcgctctcccctccggcgaccgtctcctccgctggccaccttctcacttttgagtctctcttccttctcctctcttcttcctatcctacctagggtttggttcttggtccttgtttcttggtttatctccgtctccaactgcaagggctcctcctcatccaccatcaagaacaaggccttgaacatggtgctgcttgtcgattgcgtatgaagaacccaactgctggttgcggctatgcccagctcctcaaatcagatttgagccgattgtgaattggtgatggatttgggttcactgttatgccatttttttacacggtccacacggaagcgagctcaactcggaaatatatctgtctatccactatacatgatttctatatcttcttaaaattcaggcaactcaagattcacatctactatacaattgattctgaaactttgtgcattataatgttcattgcgttatgtctagtagaaggaaaaagaataattggatggtagtagttttgttttcttctctatttctgtgataggtaaactgatgtctactcactgattttccttgcagactccttgaaattgactggtagggatgttccatagaatttctttgatggtagcagtttcgtgatggtgtcatttatagactaattaactatccaatgaagggtattactgatgtgtcattttagggatgttgggagaagtttggattttgttgtgcatttagactaatcaatcatcgaagtcgccacagatggattcaacttgctcagtatcagtgtctactgatgtgtgtgctaaagaaaccagtggccactaattaaccatcgaatgaatgattaattttggataataacactatgcctccaactgaaaatagcttatttcttgatcaggtgtaattgttgacattgtgacatgtcagatcttcaacaatgcctgaatgcagttcattcagccatctttaacaacctttcaagcagttaaatggaatcagaacaatctttttattatatcatataattggaatattacaagcatttcctgtaattttggctggcactacattggcatcaactttcttgatccaggaagttgtaacatgcgtgtatattgttttctagttttctctgaaatggactaatggtacttttgatcttgctcctacgctgccgtcacagggtactagcactactggttttaggtaaatagtggtaaccaaatgtactaatagtagtaatacaagtccagatcataaagagagctagcaatacgctcctatattccctgccaatagctgctatagtccctgtcaaaacgaacacagagtttctaagagagggattggaagaaacaagggatttagtccccacagggtttgagtgaaattggggggattcactcaatccctccctggtttgcttccccttaggatttaatccctagcaaccgaacaaggcctgagggattagaatccatcttccgctttcagcgtgcggttctccaaattgttttatttgcgtactgcagagcttctgagtcagccgtgtcggggagggattatttcaactctaaaagttcattcattacaatgtttatatcctcagtcaaattgctgcagtcgtatgcgtaatgataacatatgcaaatctgacgacgcgaaatctaaaatgcgtgcggtttgaaaggcttgctcgaggtttatccttttgaatatggggagagcaaagtcatcgtctctcactcggtccaaaaccatgtcggacttctgagttctgacttctgtactgcttttatatgcgggctgcggtgagtccccccggctgtaattgtactttgttgtcgttgtttgttcttctcttctcggctgctccggtgctcccgttcccaaatatcattcgcgtattttgcttataaccatagaccatcggttaagagttactaataacttctcatttgcggatggaggagatagaaggtaatttgctggagtcctcgattggatggctggcggataccatagtggagaacctggacaacgacaagtttggcgcgtggattagccaggtcgggctcgccgatgacaccgaaaagctccggtctgaggtcgagagggtggaggtggtggtcggtgctgtcaaggggagggcgatcgcgaacaaaccgctggcccgatcactcggtcgtctaagggaggtgctgtacgacgccgacgacgcggtcgacgagctcgaatactacaggctccagcatcagctccaaggaggtaaagcgtgtacataaaaaatacattgttcttcccttcttcgtaacgcaggacgtcgtacgtactttctctgtttcatattataagaattttttatattacccatatgcctagaatctttaacatccatctatatgaactagcaaggtggcctacgcaattgcgcggatagtatccatacaaaattatttacatatgagtttacttaaaatttgttaaatagcttccttgtatattaggactttaaaagactaaccttatcatctctatttttctaattttatagttttttaaagtcacacttgccgctacctcttgctctttttcacccatttatttgcttgttcgatctactacggcatctattcgtcctcctttgaactttaaaatagaaccttataaattttagacttaatcaactcattggctttcatttttataatttttagaagtcccatcaaacgccgccactctactccacttatgcccgtccgtctccttctctctttatcgtcatttgggttttaaaattcaaatataatgatcgtcggtgttcacttttaactttgtagaagtcccaccaaaccgtcagcagcttagccattatactcctatatggcccgcccgatgtcttcccttttaattgtcattgtgattttaaaattcgaacatgattctcattatggtttatttttttactttcctgctaaccatcgtgtttgtgctgcttaacaggttacccgtcattgggattctatttgtggttttgtttattgtttttacccttgttgtcttccctctttaatatcattgaggtttatttttttactttctagaaatccagccaaccaccgtgatcgtactacttaacggcctatccgtcgtccctccttttgatcgccattgggattctatttgggttttgtttatagtttttagatgtcccatcaactgctgtcacttaattcctttacgactttgttgcttcttccctctttattgttattcgtcattgttgcgttttatagatggatggtgtttattgaaaatttcatattttttattccgatattatattatttataaattatatttatacttgaactcctataattatttttatattttcagaatttaatttgatttttatttcaaattttaattaaacttatgttatttttattttatattttattctgaattctaattaatattgtattaggttcttatatggactcttcatttaatattgcttatttttagtttcgaatttcaattatttttaatttgtattcctacttaaactcttatgtcctttatttttctaattttgggttttattttatttttattctaaattttaattaatatcgtattggattcttatatgtaatcttctttcaatattacttattgtttattccgaattttagttatttttaaaatgtattcctacttgcacgcctaatgttacgttcctggtccatttgctcatgcataatgatattcttacattgttttattccaactgtattggttatttgatttttttttatttctaccttgagttaacgtgtcctacactggttagatttgtactctgtatttgattacaggatctccatgcaaatatgtccgactcctaatcctaatcataaaggtttaattaacttgccatcactctatatagaatataggtcggtcccaattttctgtagtcgttttctagttggactccaatatttttcatgtgttaatctgcaccattgaaaaatctaaacagctataatctaacgatcaaaatagtttctctttttcttcgattaatgtggaaatttctagcccccacagcgaacgtggtgtcttcttttagagctattttaataatataatagatagaatagatagatgtggacaatgctagaaagtcttgtaacctgaaaagaggtagtacacttgattccaatttccgttgcacgttttaatcttggttcagattcatgcgcggatgaacatggagtagagcaagcagcgagaccgagttgcaacgctggcatagcgagtagcagtggtggcaaaaaacgatccaaggcttgggaggacttcgatatcacggaaaaggaaaacggaaaggcggtgaaggccagatgtatccactgtcacacggtggtcaagtgcggttccgacaaagggacgtcagttttacacaaccatctgaagagtgacaattgtaagaagaaacgtgaagcaattggtccgccaccagacccttccaggtatactaccaatctgtgaatgatagctaaaaagagacaccatactgcctttagatttctagaaattcccatatctatctatctatctatatatataaaaaaagacaacacgatagctatgaaggctagaaattcccatgttggctatgaaaaagaaaagaatagtacaaatagaaatacaatctaaaaaacaattgaaattcgaaattaaaaataagtaatattggaagaagaatccatataagaatccataaattaaatttcagaaaaaattctgaaattagaaaaagaaagaagaaagttcaagtaggaataaattttgaaataactaaaattcaaaataaaaaataaaaaaaaatcctaaatcagaaaaataaaaaagcgagtttttgtacgaatacaatttataaatgactaagattttgttcaagtaggaatacagtattaaaaataataattaaaattcggaattaaacataagcaatattggaataagagtccttataataatgcattaatactttattaattaaaattcggaataaaaattagaaaattatgaaaagaaaaataaaaaagagagttttagtaggaatataattttgaaataactaaaattcgaaatagaaaatagtgaaaaaaaacaatcaatctagaacccaacacgagtttaattaaaatttaaaataaaaaataaaataaattcttatattaggaaaagaaatgagagtttaagaggaatacaatttttaaataactaaaatttagtcaatgtaagaatacaatctaataaataactgaattaagaattaaaaataagcaatactgaaaaaagagtccatataagaacataatatgtgattaattaaaatccaaaatattttttctgggatttgaaaaggaaaaaaaaaagagtttgagtaggaatacaattttgaaatgactaaaattcgaaataaaagaatattattgaaataataatcgaacacaacacgagtttaattaaaattcaaaataaacaataaaataaattcctaaattagaaaaaaaattaagtagaaatacaatttataaataacttaaatttggaatagaaataacgaaagttgaaaaaaaacagtccttctaaagcccaactcgggattgaatttgttagggttacagataaggcatacctcatgtcctacgacttacgagatatatcgattaggtataccttcgcgtatatggattgttcctgtaaatgtcacatggaaactacttcaaattatagaaaatatctctacgggtcaagtgatttccaaaatcctactcggaaaggatagagtttctgttatactgtaccaggtccgatatcctcaagcttttcttggggggcaagatgatccacggtataaaagggacccctgggaggggttcagggaatcgtatctcatcttcaacacacctcccgaagtttatgaagccggagtacacggagccaactcagtgggagatctcgtcgaatctctcgactacgatctcgtcggtaccatctgtttcgactactctctttgtaatgtgttctcatcatcatcaattccatataaactggactagggctattacctgataagggccctgaaccagtataatctttgtcttttgtctgcttgatgtcgtactacatagaccctcgttccaatgtaccccaatactctacttatccggtctacgagtatcactcgtcgacagatttaaatttagaattaaaacaaaattaaattcaaaattagactagaaaaaatgcccatgcgttggaacgggtaaacaaaaattatatccaagataaaaatattatctgattagggtttagtttttcatgatatgagccctttaagaaaatatattctgaaataaagaaagaaagttctaaaaaaagaaaagaaaaatcgaaaggaaaaaaaaggccttgtcggacccccgccggcttgctagggtattcacgcacatagcccatgaagcgcgcgcggcccagcaatgctgcggtccaagggattttggactatttgccactttcccggatggcgtgttctcaaatgccactcttccaaagaactttgctttttttaccattggagagagatgatttctttctcattggccatttttgagctggtgaggcgctacgtcaccagatatgagggcaaaatgaccattttgcctttcttcttcctccagcttggggtctctctccttcaaccttcttcctgcgcatgagctggtgatgccatcaccaccaatgccaaaccatcaagccaaggccaggacgacgtgaagaggacctcgagcgtcccgctgccgaatggctatggaggagacgaacggcccctggctcttctaccacccaatgtgcaccctcacctcctgcatcgggcagcgaacaatgaggcaggggaagccctaaggctgggtctgacgcagccgtcgacgtcgggggagagtggagaagatccgagaggaggacgacgctctgtgctcagaggacaacgatgacatcgatgatggagtgaggcaccagcaatggcatcacattgccggacagccatgcccgctgatccttgatgacgttggcagtaggaatagaggaggggctggggatgtagggagtcgagtgagggagggaggagcacaaggcggggagctcgccggagcctaagcagctcactggcaaggaaaaggaaagatgtaaaagggactgaggaaggggaggagaaatgaattaagaagaaggacaagatagtcattttgcccttagatcaggtgacgtggcgtctgccaggctcaaaaatggcacacgagcaggagcccaccgctactcctcgcaaataaatatgcatatctatttctaatgtgatgctaattttatttcatatcatattttagggtctcaaatatcacaaatataaatatgcaacgctaatttaaatatacatatgtagaaatgaaaacaacacaatttagtttttttattttacaccattatattagatttattatttaaaaataaaaaaattatcgtatatacggatacatgagaaacatatagctattaaccagaaaaagtactccatacgtacatatgatttaaagaacaatgatgattacgtatcatttgccggaacaatagaaaacatacttataataaagccaaaaagattgggagtcctaaaaatagaattttgttcaatttaaagataaaatataataatcttgaaatttacacaaatataatataaaatgtccaatcaatgctttttaagtgttctatcttttaaattattttaaaattatatatccaatttgtgatcccgttgtattcctttaaatcaataaattgataatgtctatagcccaaaatacatcaaaacatatggaaccgacaagtaataattaacgctatgataataatttcacatcatatcttaggtgtaaaaaaacttgatgaatatacaatgctaatttaaatgtacatacgtattctccaaattactaaaggtgtctcatgtcgttagaaagaataggtgttgaaaagaaaccagacactgaactaacgtgcattacactatagatatctgtcaaaaatataatacggtactttggagattatcgtgctagtattttaaaaaattactttgtctcagttacatataaattattctattgttttagaataaaatttaactcctccgatttatgtgacagaggaagtataagtaatataaatcatctttggctagatgaagtagtatcattagctattgcccacattgatatagatgttaatgaatctagacacctatgtgtctagattgataggtgtctagattcattaacatttatataaatgtgggcaatgctagaaagtcttataatataaaatggatgaagtatatttttaatagaaaatatattttagaaatatataataaaattaaaatgctacttaaagtaatctatggcatacaaaataaaaaatgttatataagttcggaaactcgaaaaattttaaaaatagaatcacacataatacaaatagctacgaaccaactccattattgtgacacgtttgtttctaagaaatttaaggatatacagtttctagtagtaatacgaccaaaccagttattaacaaatacacgtttaaaatagattaaataaatatttcaaaaatatcatccacacataaatattcgtaataaaaattctaacaacattaaacaacatgtccgtgcgtatacacaggctacattcctagtaactataataagtccatttgccctttggtatggattaatagtcaactaatgcattaaagattttactatgaccactactaataaaaaaagggtgcgataagagtaatttgaggatgatgtaacccgctttaaaaattttatttctatataaggaacatctttttaagttatcgcatatgtagatgcgttttagcgcgtcagccattatgatgtagatcatggtaataaaagtcaaatataaaaacggagaattgaagctctgtaatcttcaatagaatgtttacgtagccacataaggcacgtacttcctccgttccacaatataagtcattctagcatttactatattcatattgatgttaatgaatctagatctagattcattaacatcaatatgaatgtgggaaatggtaaaatgacttacattatgaaacggagggagtagctcttaattccgctgagttaaccgtctgcgtttatctgcttaagatcgtgttatatcgctgactttgctaattgccgaaccacgatcacattcttttgcagtgccggtgagggtgcaccaaatgcacctggtaattcagttggcagaaaaaggatgaggatggatggcacttcaacactccacgaggcagttagcacgcatccttggaacaggggtgaactctccaacatgatccaacatatgactcatcagttacaagaggctgtaaatggggttatgaggctatgtgggtatgcaagtttaaatcagaggtgtgagagtacacccctggccccaaatgcaataacatcatcttatcctcttgagcccaaaatgtatgggagagatgcagagatggaatccatcaaaaatctaatcatgggaaataaatccaatgacataaccgtcctaccaattgtaggcataggagggatagggaaaaccactctgtcccaacatgtttataatgatccggaaatcggaaatcagtttgagatcaagatatgggtccatgtatctgataaatttgatgtggttaggatcacaagggagattttagggtgtgtctccaaccgaagttaccaaggaataagcaactttaacatgcttcagcaggatcttgagaaacacatgaaatctaagaagtttctgattgttttggatgatgtctgggatgtcactacagaagactgttggaacaaactactgggtcctttaagacctaatcatgtgaatgcatcagaagtgacaggtaatatgatcattgtgacaactcgaatactgactgtcgctcaaaggtgtggaacggcaggatcaataaattta

SEQ ID NO: 65624 - DNA, 5541 bp, Oryza sativa
tttctttttataaaccttttcaactttgtttatttcttaataattattatttgtgctctgaaaattccactaaaatttgagggctccttttagaccaaggagaatttaacaaaaattctccgggccatatttgaatttttcttgtacgtattttagtgtttgccaatttcttttcgaattttaattaattctattattccttttagaagatgatttttattttgggatgaatttatcaggacgtgacaccctacaaccaactggcagtttgtagccgaggccttggaatcaaagagacaattccccttaggcaagattctcctcggctatttgtaccaaatgctgaacaatgcatcggctaagatagccgtcggctcagtagttggagcaggtggaccatggtggctgttgcaatcttggttgaatctaatggtcatgaaattcgtcaatcggccatccgtgacagaagccgaatttccaagactggagccgattgtggaagatgatggagaggaacgcacccattgtagatgtacatcttatggagaatatgcttccacaccagccgatgcaggagcaaagctatcagctgaactgctcaaggactggttctgcagtttttatgatggctttcagaaagacactcagatttggttcccctatgaagactcgactctcctggaaaatccatcggactttagatttgaggatatcaatcatgaaagataccaaaagtccagagaagttttctcggctgcaatcagtccatgcatcatccctgttggcattcatcaaggaagaaatatccatgtttcttatgagttttatcacccgatgagctctgccagacaacttgcgatgggtcaattaccaatcggcttgttctttgccgataaaatccaatgccgaggggaaatttcatcaactttgatggaccgactgctcaatctccaagggccttctcttggcagtattgaaaatatagagctggccaggttcaggagcagatcatttgacagatggtggggtgaatggaagttgcatctgttccaccaaccggcctcaatgtacatgacagacctctttcctgatgttatacctcaggtaaacggggattctcattaatttcattcgaacaattatcaaccaattcataacttaactaattttctcttatgttttgcagacaacagaatcctcgcctccacatcaaagcaatagtggcagagatatcgaatatgccccaggtttaattccaaatggaggtgggcccatctcctcctgtcatcggctataatgcccccaagacttcaactcttcttcaagggctcatcagagaaccagccgatgctagtaaaaagagaagaaccaggtcatcggttgtggacacatcttctccagccccaaagaagaaggctaaattaaagaaacctaatccagccgatgatctgcctgcccttgatccatccgttgaacaagctctagaagaagaagagatcggagaggatgttgatcaagctgcaaatgaagtaagtgatactgaaagaacaccatcggcttcacccaagcaaactcctccaactccttctgccccagctcatttctctagggtaaatatctttccctaattcccttttataaccattttatccttagccgattatccattaatcttgtctttgcagaaaaagagaattgctgtgaagaaaaaatcgacagcaccatctctcaaaccggctccactagtaagatgttcttaaacttttcactagtcgatctcagccgatattgtctaatacttgtctttttcagcctcctcctccttcttctcctgtccagcaatcatcaagcgataaaactccatcggctgtagggagtcaccatattcaagaagaagtacaaccagctgctcctgctatcccagtaagtttcttttaagcaccaagtcttagatcggctatatctgtttgtcatctaattgtctttaaatttctcttttgtaggctttagccgatctgttttcttttgatatcaaagattactttgatgagacagaagaagaaactacaagtaaggctctagcccctttggacgacactgtcaagaaaacacttgaagacatatcccttcagctagaatcttcctggataatctggtggctgattgtggttcaatccgggcacgatttgctgaaatccaagcctcaattctggacgatctggtaaacaccatcactccagccgtgtaccttgaacaacaccaatttaagctagagaaggctaagcaacggatagccgatcggcgagaacggaaaaacattgaagctactatccaagccaatcagcagcttgtgcatgaagagaaagccaagttagatcaactctatgttgggccaattcagtcgaatatagatcggcttgaagctcgcaaaattgatttaacagctcaactcgaagaatgcaacgccgagctggatctagaaaagcaaaagctatccgatctaccaaatgccattgaagaacaaaagtccagattgagatcggctatcaagaatgtggctgacatgaccaagtctctcaaggttatccctggaaccgatgctcaagatgcccaagccatcaaagaagtagagcaaattaggcaacgggctgtttcggctatccagtgttttttgtctcagtaacattctgtgtaatagaatctaggaatttttgtaatcggctaagaaactctgactctttatgtaactcatcttaataacttttatgccgattcaatgtaactccacattttgctcgaaaatttgcaatttctcatatatatgtgcccccttaattttataatgtcaaaagcattgataaaattataaaatcaactaagggcgatataatccatatcggccattgtacatcggcaaaccacaaccgattacaataggaaaacaactaagggcgatataaccatatcggccattgtacatcggcaaaccacaaccgattacaataggaaaacaactaagggcgatataaccatatcggccatctcaaggcaatgcaaatacatcggctatcatgtatcggcaacaccagccgatcatgtattaacccaaacacttgggtaatatttcttcaagtacttgccatttagcgctcgtccatagatttctccatcgagtccttgcaacatgtaagctcccttagacacaaccttatagatttggaacggtccttcccaattcggtgaccacttgccgaatttgttatccccagtcccaatcggcaaaatcaacttccataaaagttcaccttccgaaaaagtcttgggtaccactttcatgttgtaatgccgagcaactcgttccttatccttggtaaccttcgcaatggctcttaatctagattgaaccaagtcttctctttcatcgaccatgagataataatattcatcggctgtcaaatcattttgcaactctgttctctgtgaaccgattctaacctcccatggtaaaatagcctcatgtccataaacaagcttataaggagggacttagatcgacccatgacaagccatccgataagaccacaatgcttcggcaaatcgagtatgccactgccgaggataatcagaaatctttctcttaatcaacttgatcagactcttgttagatgcctcggcctgcccattagcttgtgcataatatggtgaagaattcaacaatttgatacccatctatcgacaaactgaacaaactcatcggacacgaagattgaaccttgattggttgtaatggtttgaggaatatcaaaacgaaagattatatgctcttgaacaaactgtatagcatccccggaatcaactttcttcaaaggaatcgcctctacccacttagtaaaataatcagttgctaccaatataaacttatgccctttactcgatggtggattaataataccgatcatatcaattccccaacctctaaacggccatggtttaatgataggattcatagccgacgccggtgctctctgagttgctccaaatttctgacaatcttgacatccgttgcaatatttgaaacaatcttccacaatagtcggccagaaataccccgcacgtcgtagcaaccacttcatcttatgagccgattgatgagtaccacaaattccttcgtgaacctcaccgattgcaaccttagcttgatcggcactcaaacacttaagcaacaccccgtcaatcgtccgataataaagctcatcatccaacaaagtgtacttcaacgctttgtaacgcaatttctgagaagccgattgagatggattttgtaaatatcgatgtacatcatatctccaatcatcggctgttaatgcagcaacctcaaccctgacatctttcatcatcggcttatatcccgacgccccttgggccaaatcattggcttcaatattttgttctcgagatacatgcctcaaagtaaccagccaaaattccttcatcaactctcggcacttctcgttataaaccattaatgtatcattcttgcactcatattcccctgccaattgacaaatcactagcaaagaatctcccataatctcaatagcatcggcctcaacttccttgagtaactgcaaccctttgagaactgcttcatactcaacctgattattagttgcataaggtttaataatataaccaaactcaaaacttgccccccaaggggaaattataaccaagccgataccacaaccatgagtgcatactgatccatcaaagaacaaagtccatggcacaacctcaaccgagccgattgaatcatcatgatgttcaacaataaaatcggttatagcttgtcccttgactgccttcggtgactcataccgaagatcaaattctgttaaggaaaatatccactttccaacccttcctttcaaaattggagccgataacatgtacttgacgacatcggctttgcatatgacagtgcattcgttggacaatagataatgccttaaccttgtactagaaaaatacaagcacaagcataacttctccataggggaatatctagtttctgcatccaagagccgacgacttagatagaacacaaccctttcctttccttctagctcctgaattaataccgagccgattgacttctcaccggctgacagatataatctaaaaggtatccctttctgtggaggaatcaaaactggaggagagctgagatattccttaatactatccaaagctttctgttgctctgcccccaaagtaaacttttgattggctttcaatctcaacaatggtgtgaaaggttctaatcttccagacaaattagaaataaaccttctaacaaaatttatcttgctgatcatctcctgtaactccgtcttgttctctaggggctgaattttcttgattgcattaatactcctttgagttacctcaacccccctctcatgaacaagaaatctcaaaaatttgccagccgatacaccgaaagcacattttgtcggattcatttacaagccatatttt

SEQ ID NO: 65625 - DNA, 15601 bp, Oryza sativa
ggtcctaccttcagtatgcagagttcactatactcactgaccacaagagcttgatgaatcttactgatcagcgcttgcatactccttggcaacaaaaggcctatacaaagttgctagggctgcagttcaaaatttgttacaagaaaggaatccacaatgaagcagctgatgcccggtccagatgtgaccataactcttctttggaggtggttgctatttcggtttgtaagcccacttggctggaagaggttgttaatgggtatttgaaggatgccaaggctacttagttactgtctgaattagccattcactctaaggctgactctccataccaacttaaggatggtcttattcgatacagaggacgaatctggttgggacagaatattgagttgcaatagaaaatttttagtgccttgcatgacagtagcatcggtgggcattccggatttcctgtgacttatcgaaggatcaaggccctttttgcttggcctggtatgaagaaacagatcaagctcaaggtgaaggagtgctctatttgtcagcaagcgaagccggatcgttctaagtaccccgggttattgcaacccttgccggttccattgggagcttggcaaattgtcacgatggattttatcgaagggcttccaacctccaggcgattcaactgtattatggtggtggttgataagctatctaggtatgcccattttttacggctagctcatccattatctgccgcagacgttgctcagttgtacatggaaggagtttttagactgcatggtttacccctggccatagtttctgatagagatcgcatctttactagccacttttggaagcagctgtttaacagtgtgggcactaaacttcatatgagtactgcataccaccctcagacggatggacagactgaacgtgtgaatcagtgcttggagacttatttgcgttgttttactcattcctgtccaactaaatggtccacctggctatatttgggctgagtattggtacaatactagctatcactccacactgaataaaacccctttcgaagtattgtatgggcatattcctaaccaattgggcattactgttaactcttgtgaacttccaaatgtccagcagttgttgaatgaatgagggttaatgatacaactcttgcagcaacatttgaacagagcacaacagtttatgaagagccaagctgacaagaaaagaagttttagagcttttgcagtgggagattgggtctatttgaagttacagccatatgtccaaacttcagtagcagccagggctaatcacaagctgagtttcaagttctttggtccttatgaaattcaagagaagattggtgttgtagcataccgtttagtccttccggcgagcagctctattcaccctgtttttcatgtctcgcagctcaaagcagctcaaggttttaaaggggatgcttctgttcatcttcctgttcagtcttctactaaacaagttcctgtggctattctggatactagggtgcgcaagtcaggtatgtctgttattcctcaggtgcttatacattggtctgatgatgtgatcgccaatgcaacttgggaagacttggaagatcttcgtactcgtttcccaagagcactggcttgggggcaatccagttttcaaggggggaacattgtcaaggctgcgttgggtgctgatgctgacattgccaaggaggagaagatcgaagggagaggtagtagacttaaaagggggaatgttcgtttaagtggaccagaatgggcattgtaagcctgagtggttatcggcccaagtgccagactgtaagcgtgtgtggggagtgagtgggagtgataaaactaaacacacaactcctgtaaacctttttatcgatttagaacttggtagtggcgattggcggcggcggaattcgttggaaatccccgtcgatatatcttgtgtgtctccagttctgaatcctactttacgcagctatcatgagggcgagagggtggcaccattccacgatggcagcagcacctctgcacgaaggcgacaaccaccacacatgggagaggaccgggattaaccactgatgaggacattgaggtggcagctatgttggaaactgggcaacgatgatattgtttgtgatctgcgaatataaccaaaatggttttctcacactagatgatgattagggaggaagaacgtgaaagcggcgcaggtgcttaccacgatagagaggtggcagcaatgccgggtggttgacaacaagttgatggcgatggtggatggcttgatggaagacggcgcaggaagtggggaagacgacagaggtggatggcataacagtgctgcgccattcgctggtaattgagagatctcccaacgatggtagcagtgctggaaatgagacgaccatcatgccggctcgatcttcccatggagcagctcgtgcttgcgatgacagcggcaacattggtgctcactcgatcggactgcaacacaaccgcgtctactcgatgtcccgaggcaggaacctaggccggattatagtgagcagcaatagcagcaagacatggtccggtggacgacgatggagagagaggcggcagtgcaagttcgcagcgaacggccggtggagggatgcaggcgtgtcgccggaggtgaggaagatgcatgggaggtggccttggccttggtgttgaccggcggcggcgacggcacggtgtggcaggaacggtggtctgcaaagggaaaaggagggggtgctggatctacttatagaggaggacagggagttgagcggccagccggaagatgtttattcatttttttagctgagacgatggaaattgaggtgactgactgatgatggttactcattttttggctttggtggagaaaattgatggaggggtttcgccggggatttggctggtgatgtgatggcacggccggggctagctgaagcgcgcaggcgggctggttcgaactgcatgcgaggaaatgagatatggggcttcggcctcctgctgatgggacttcggcctcctgctggccagaggaagaagatgaccgatcgagaaggaagaaagaaaagatgaacagccgggagacaagatccaactcatcaaaagagattcaattttcggcattcaacaagtgaaattgatgatggagaggaaaggattagggaatttctgttagcttcagctataatcatgtgtcgtattatcggttactgtaacgtgtctagtgttgtcgtttcttcagtttcgtcagactctgtttcggcgtctgtttctctgtttctttttcctgtaagccgagtcttccgggtcgtgcgtcgtgtgcgagtcatccggatttcagtgtcgtggtcgcatcgtcgtggatgatggcgtagtggtgtcagtttgagtctgtacatatttgctatatatatgagcatcagaaaacgtcgctggttggttcgcgacaccaaaaactctgttcgtgttcatcgtctttccaattcagagaattcgcgtgagagagagagtgaggattcacaatcttgggctttgctatcatttggtatcagagccatgtccgctcccgccagcggttcgtctcgcactcaccggcgaacaggccgccggctctcgccgtctccgccgcgcgtgagcgggcgacagctcgtcgtgcagcggattgttaaggaagatggctccgtctactatccaatactcagacgctcaaattactccgattgggcggtgttgatgcgagtcaatctccaggctcaaggtctgtgggatgctgtcgacaccggcgatgtcccgtatcaggaagattgccaggcgctttcagccatcttgcgagcggtgccggctgagatggtccggccgcttgccgagaaggacagcgccaaagacgcctgggatgcgctcaaatccatgcgagtaggcgcagatcgtgttaaggagtcccgagcacagaagctgcgccaaacttttgagtccatgcgattcaagaatggcgaacacctggaggatttcagccttcgtctccagtccttggagatgatctgtctgaagagaaggttgtttgaaaattgcttcgcgtcgttccccggaggtatcgccaaatggctctatcgattgaaaccttgattgatctcactgtttgatgaatttttataccaaaattcatagaaaaaataatatatcattgggcattaatttgcagcccaattttacgaaatacacgtgaaacatgtctctacgacatgtgggaccagaaaattcaaatatcatacaatgttcaaacatattcaaaattggactcgttttgttgtatgttttgattggaaaataatggttccaacagaattcatatttgatatatgattagggagatataaacatttgaaggagatcaaccagtgttaacctcgtatatccttaatttgtttgctgctcctcaccggttggtaattatccttatggcagtgtttggcaaatgtctaaaggaaatgatttcccactcatctttaaatcctaaccatttattctccctcatccatttaatcctaacccttcattcatttcctaatcccaatcccacccctcatttcccattatccaaacacaccctatgaggtgtgggatccaccgtcaattagccaagttaatcctcgtgattatctccagcacacacacgttctttttatctggagcacaaaattctttttatcacgcgcaggtcgttggattaacagacgcgctggcttatccagagaattaacgcttgatttcgctggcttgctgaaatctcggaagggattaggcgaggactccgtcgcctctactcttatataaggcgctgtccctcacgacgcaggaggtgggagaaaatccccggcgcagaggcggctggcagaggagaagacgtaggtaggcaactatgctgtgtgctctgatctgcttatagtttcacaaacccatatccaacatatacacaatttacacgtcgtcaccgagaagcacacatagacggcggaccgctgcgcggctcagcagcaatatgccttagagagccgccggcgctgatggcatctctgccggcgagtcgtccgtcctgaataacaagcagatcgatcttgtttttcgtcaagaaaatatcatcagtggtgtgcagacgagtccgatcctcgtggggttggaccgtctaagttatcaaatattggagttggatatttatttgtataaacttaggatgagtttgagccttattggcatcagaccaaccatgatttacacatatttatattctcgttcatgataaaaaatcggatgcgcatatttataaacttgggatgagtttgagccttattggcatcggaccaaccataatttatgcatattgatgttctcgctcatgataaaatatcggatgtgcatatttacttgtataaacttgggatgagtttgagtctaatcggcatcggaccaaccatgatttatacatatttatattcataccggaacaattatagatttgccttgtgcatgtcatgtgcgggagcaattccttctctctctaaattctaccagatggatgggagcaactctcaaaattcttgaagacaacaaaaacaatgctcgccaggagggcaaggcatgcagatttacaacacacgtggacatcatggccgagtgtcgacgagatgaaatggccaatttatcaatatttgtgctatgtccgagaccgacgagtccggataacatattggctaaagctgacaaggctgcagtcattaactcattccatttgtctatgaccgacgaggttagatgaaaccatggccgagtgtcgacaaggccaggtcactatactattaacacgtctaaaatggacgggaactggatataccgttgctgggcaccgacgaggcaaaagcaatcacaaaatccatgtttgatgaaggccggggcacatgagtgggcaccgatgaggcaaaggtcacccgcttcaccaaattccctccgtatactaacatgatgatagtgtattgtgactgggttttggcaaaacaaagccatcagttccacattcactatattcaccgttaaatctgaaccaacctcaaccttcggcgagcaaccaaattttgatgttgacgatcacaaagcgcagcttaatcggaggtgttccataggctcgctcctatagatgtaattaaccggccgcctcattgctagcgccgggaatcagcggactgcacggaatctcctgtcaagatacctctccattaagcattcctcacgaaggcaaaaggcgaactcctacaggagccctcatgtatttgtaaacattcatgttaatgaatcatgattaataaaaaggcaatacagggtttccctattttctgtgtgttcgttgttttgttttcatcaaacactgaccttgctttctattgaggatctgactggccggcttctcaccgtcgacgatcaccccgactctgatggcgaggacgcgggtcaggtgctcttcagcgaaaaggaggcccctgctcactcaaacaaggaagctgggcagaactcagccggggggagggcgtccagctcacggcaaccacaccgcagcaggcgcgagcgcgacggcaacggctccgacggcaagtcaggttcgtcccaagcggcaaaccgcaatgtgtccaaggacaaatgccggtactgtggcaaacttggtcactgggccaaggactgttgcaaggcgaagcgagaccgcgagaaactggctcaggcaaaccttctcatcaccgagcctgctcaagccgcggacgaaggggagccgacactgctgatggcgcaagtgtgcgagcttgcccctgctaccgatcctgtcattactgacggggaggtgacactgaaggaggaacgtgctcacgtttctcttcaggatgaaggaaagcccgttgatctagactggatccttgacacgggcgcttcaaatcacatgacgggctaccgtgatgtgttctccgagcttcacaccaccgtgcgcggcactgtcaagtttggtgatgcgtcgagagtctggattgaaggacgaggcatggtgctgttcgcttgcaagaatggtgaccactgcgcgctcactagcgtctactacatccccaagcttcggagcaacatggtcagccttggctagcttgatgaggcgcattgcaagacggtgatcgaggatggtgttctcactttgcatgatccacagcgacagctgctgtgtagggtgcgccaaggagttgggcgcctctacgttctccacgtcgagctggcgcaaccggtttcccttctcgcaaaggggaaggatcaagcctgggtctggcacgctagataccgtgtcacgcccagaaatttcgaatagaattccaagcagaatgtgcattaaaatccccgtccaggaccggccggggtacacaaacgacaaagttgacatacagatccacgtcttacaaacattataaaagttttacataaatgcagcggaaaaacaaaagataactggagctaagccttgacttgaactacagcgggaacaccactccacaggcatcctcgatggcacggacgaagcctactcctcggagaaaccaccatctgacgcatactcaaactctggggtttggggaaaatagagcaagactgagtactacccactgtactcagcaagtcataccggaatagggctatgatgcagggaattatcaagggatagctataatggttcatttgcataaaacgggcatttataaacagaagttgaaagcagtaaagcagttgtaacaattaatcaatattaatcatccactgtccaacgctataccatattgcaacaggcccaaccatccacctatactatccaatttcattagactaaactagggtgagactaatcacggtgaatctggttgatcgcccataaccatgggcacggctatttgaatagttttactctgattagaggtgtacaactgtacccacaagacacaaccccacgacacgttttcgtgcgccggcatgccaccacgacatactagaaagaggccgtgacaggacccttcgcataaccccctctaaccaagcacaccacacctcaggtttcacccccactcctcgcaaggccgtgggcagtcccctctcgtgcctagatgaatccggaagccgcataggccatcgcaggacccatccaaactccatcacgcccacccttgcctggatgcgtcaggtagaggaaagctacactacaagcccagccgttgcccacactggcttgtggtaagtatgataagttcttacagggcatcccgcgaaccggtccttaactgctatgggtgcgaccaacaaaaccatgcacccacagcccaccatgtgatttattttaattaaccaataccgaagcggtggcactaatccaacattaccattagaatctacagtctatacattaataggattttcccctttgtgtgctagttgaacaaagcatggctaagcaatccctagtccaatatctagtcatgttataacccaagctaacaaaggagcatggtaccaaaatagcatggctgtaacagtaggtaaacatcccatagtattattgtaaaacaatgcagtatttgaaggaaaacattagaacatttgcaatataggatcaacatgttcaagtgacaggcatgacttgccttgctctgctgctggaggaacctcggtgactatctcgaagtacaccggagcgttggaagagctggaatctaagcgacatacaaagcaaacaatacaaacaggctataagactactgaaacagagaacaaaaccatttttaatggattctacacatttttcttgatttactgagacttgaatgggcttaaacggagctcggatgaattagttatgaattttagaagattcactgtgtttttacaataaacagaaaaatccttaattgaattattgcacaataaatgcctagggctgacgtcatcaaagggagcgggcggcgccgacatgcttggcccgcatgtcagcggcgcaaggggagagggagggggcgccggcacgtgggccccacgggtcagcggcacaaagcggccggtccaccgtggaccgggaccacgcgggtggtccaccgccggtccacgggaccgatggtccggatcggcctcgggccgatcggacggcgcggggagcagccgccgggttcggctcggcttcaaagccggccggccggccatggctagaggcggcggcgtgcacgaccaccggcggcgaccggtggcggcggacggcgcaaaggcggcagcgcacagctggagcaacggcgcggccaaaagcgacggcgcacgcgggaaggggaaggaaaggaagggggagggagtcctcaccagagagggcggcggcgaccggcggcggaaaacgagggaggcggcgaagtccggcgatgccgaggtgcggacgagcgacggcgacacctaggggaggggaggagaggaattagggcggaggaaaaaaccccacggcggccgtccatgttggctggagttgaaggggagaggggactcaccggcgacgcgagggaaatggggtctcggtgggattccggtgacgcaaggcggcggttgggaaagatcttgtggcggcgaagctagtggtggcggcggcttagcgcggcggtggcacgcggctggagtgcggtggcaagcggcggcgctggcggagagcggcgcgagctcggtaggaagcacgggagggagcggcgagagcggaaagggaaagaggaggctcgggggagcgatttataggtgcgggacgggtggaaacggccgggaaagcctcctatttgaccggcgacgtggggtggagagagagataatggggggattcaaaatgcgaatcccgccccttgcgagcgcgcgcgggccgggagacgcgggggagagggcggcgacgtgggaaggacgcgggggcggcgcggcgtgggcgcgggaggagcggaggaggtgggcgcggcggtttcggcggcggttgccgacgtcgggcgggcggccgggggaaggggacgaccccgactggtgggacccacctgtcggcgtcccggagagagagggaggggcggcttgggccggcccacaaggaggaaaagggcgcgcgcggcggcgggcggactgggccgacggcccaagaagaggaaaaaggagggaaaagaaaaagaaaaggaagaaaggatttttcctggatttaaaattgcatgtgctcaattttaattggttaaaattatttctagggctctcaaaattccactaaaaatcttgttagcaaatttcgacatgtagaactcaagaaaaattctaatgccaattccgattattatttgcattggtttattagggtttactcttgcttttacaccgatattttcttgggaccatttataaattcaatttaggcttaggaggagaacttcagggtgtgacatacgggcacctcaacttcgacgctctccgctcactggcgagccgcggcatggtgcgcggcattcccactctggagcgggttaccaaggtctgcgacggctgcctaataagcaagcagcgacgagcgccgttcccaacggcggcattgcatcgcgccactatccatcttgatctggtgcacggggacatctgtggacccatcacatcgtcgacacatggcagtaaaaaatacttcctacttctgattgatgatctaactcgctacatgtggttgtttctgttaacatcaaaaagcgaggctcccgctaccatcaagcggttcaaggcaggagtggaggtggagaccggctgcaagctgcgcgttctccacactgatcgaggaggggaattcacctctgtcgagttcgggctatactgcacgaacgaaggcgtcgccaggcagctaacgacgccatactctccacagcaaaacagcgtcatcgagcaccgcaaccaaacggttgtggccatggccagatgcatgatgaaggccaagaacatgccgggggagttctagggcgaggcggtcaccactgccgtctacatcctcaaccgggcgccgacaaagagcgtccgcgacaagacaccgttcgagtcatggcacggtcaaacacctgttgtgcactactttcacacatttggctgcgtcgtctacgtcaaggaggtgaaaccacacatcaagaacttgatgatcggagcaaggtgatggtctttctcggctacgagccgggttcaaaggcatatcgtatatacgacccggtggccaagcgcatcgtcgtgagccgtgacgccgtgttcgatgaggcggcatcatggccatgggcgtcacccggggaggaggacgggggaacgtctcctcaggaaaccttcaccgtgcgctacgaggtagtggcggtggacgtgccgtcccgccactccgactccatgtcgtcgccggctcacatgggaacaccagtgccatcaatctctgcgtcaccgggtgtcctagcggtggagtttgtgtcgctgcctgcggaaacacctgatgtcgacgacgacagcacagggccacgtcgtttttggatggtggccaaaatccttgacactacctcgccaattgagctcgactccgacgagcttcatgtggctgctgccgaggaaccaagcaaccacgctgaggcggcacaggacgcactctggatgcgagcgatgcaggagtaactcaagtccatcgaggagaacaacacgtggactctcgctgatctccctgctgacaagcgtcccattggcctgaaatgggtgttcaagctcaagaaggacgagacgggcgcaattgtcaagcacaaggcccgcctggtcgctaagggttacgttcagcggcaggggattgatttcgacgaagtattcgcccctgtcgccagaatggaatccgtgcggctgctactcgccattgcagctcaccttgggtcgtctgtgcatcacatgaatgtgaagtcagccttcctgaacggagagctagaggaggaggtgtacgtcgcccagccactaggcttcatcgacgacaagcacccacatcaagtcctgcgcctaaacagagcactttatggtctgcgtcaagctcctcgtgcctggaacgcgaagctggatgttagtcttcatgaactcgggttcacacggggcatcacagaacatgctgtgtacacgcgcgggaccgggaacgcgcggctaattatcggcatatacgtcgacgatctcatcatcaccggcgctcactctaaaacaattcagagtttcaaggaggagatgcactccctattccggatgagtgatcttggattactcagctactacctcggcatcgaggttcatcaaggcaacgatgggatcacaataaaccaatccacttatgcgcagaagcttttgaagatgggtggcctggcggcttcagcttccgttccaatggaacccagattgaaactgacgaagaacagcgatcgaccaagtgttgattcaaccttttatcgcggcttagtggggagtttgcggtacctggtgcattcacggccagacattgctttcgcggtgggttacgtcagccgattcatggagtcaccgcgcaatgatcatctcacggcggtgaagcacattctgcgctatgttgcaggtactatgaactatggttgcaaatttgtaaattcaggagaagagggaatccatttgctaggattttctgacagtgatttggggggagatgcgcacgatcggaagagtacctgtggtgctctcttcttcctcggctcaagcccgattgtatggcagtcccagaagcagaaagtggtcgctctttcctccagtaaagctgaatatatcgccgccactggagcagcgtgtctcggcatatggctggctcgattgctagctgaggtgctgggaagtgatccagggaaggctctcctcaaggtcgacaacaagtcggcgatctccctgtgcaagaatccggttttccatgaccggagtaaacacatcgatacaaggtaccactttatcaggcaatgcattgaggagaaaaagttgaggtggagttcgttccttcggacgaataggttgccgacattctcacgaagccactcggacgaatcaagtttcaagagtttcgcagtcaggcgggcgtcgtgcatattgtcacccggcgacaggattagggggagtttgttagcttcagctataatcctgtgccgtattatcggttactgtaacgcgtctagtgttgctgtttcttcagtttcgttagactctgtttcggcgtctgtttctctgtttctttttcctgtaagccgagtcttccgggtcgtgtgtcgtgtgcgagtcatccggatttcagcatcgtggtcgcatcgtcgtggatgatggcgtagtggtgtcagtttgagtctgtacatatttgctatatatatgagcatcagaaaacgtcgctggtttgttcgcgacaccaaaaactctattcgtgttcatcgtctttccaattcagagaattcgcgtgagagagagatagtgaggattcacaatcttgggctttgctatcaatttcgacgaagaagcagaaaagaagcatgtgcaacgaggggccacgaccacgacacaagatggaaaaatggatcaagctcatcaggaatgtttaacttttggtattgaagagagaaactgatggagcagaagaagaagaagaagaagaagaagaagaagggatcagtgaggagattggaagagacgttgctgcttaatttcatgcagcaggagaaacgttccttcattgcagaccaaacagaaacgacgtcgccgtgtccctgccgtggcgaggatggcggcatgggctggcctggaaccagggacaggtagcgtgtgctgctgggtgcaaagaagagaaagagagatcgatagagagagagagatacagaaaaattgaacttggaggcatcgggaacaacaagaaaagcaaaaaagaaaagaaaataataaaaagagaggaaaaaggtaaggagaaatgaggaacaagaaggataatagggttctcaatctagaaaaattcctcaagaatcccaatcctgtaaattatttggatttgttcaggagttttttggatagagaataattcacataattgagctccacttccaaacttaaataaaaatcaaataactccaattaatgaacgataaaataaaatgtataattagtttatttagtcaaattaaacactttttaattttcagaattttcattaagccatttcagacgaataaacacgaatgtgaatttttgaaattaggcaaattaagaaatacgaaaaatgggacgtaacacggcagcttccactcaggatgggaatggttaagtttggcccatttaaccactgaacctatccacaaatatgttttattgggcctttaggttgattcaaaactctaaatggggcaaatggtttgaacccttgaaacctaggaaacatcggattgatccagaccaccatcaacatcttgttctcgaggacctcgggtcctccttggcatggcggcagcgctccagcaccgtcttgttctcaagtcctcatcctccttggcgtggcggtgacgctccggcgacaagtaggtagtgctagtcctcaagagcgatggggaagaaagggaagtgggagagagaggaggaagaagagttgatcgttgacatgtgggatccatatgggtctcactcgtcacgctagcttgaattagacactataatgtcttgggacctcgagtataccggttttgcaagataaaaatgcattatatatggtactgcggtcgaaggacgtaattcaaacttggcgtcaagataaaggaccacaagtgaacttagtccactcagtaaataagcatgcatagcatacgctgggccaaaccggggcaaccatccatctgatcagtaagcatgcaatattggctactgggccgggcccaaaaaactcatcctattaattagtagtaatatatttcgatcaattttgctatatatttgtcgacaaattttctcctaaaaatttgacagatgtaattacagtacaatcacagtgtaattacactgtaacttgcatgtaattacactgtaactatagtgtaacttgtatgtaactttcaaaaatctctctgtaatatgttatttcggtaaaatagaggttgtgggaacaaatccttacacatatatatgcgctgtgatttttttcttcctcaccaaaacaaatcttgtaatagatttaactgttcaaaattacatgaaacttatatacaagtaacattgtagttacatgcaagctacaatgtaaatacatataagttacagtgtaattacactacgattgtaatataattacatttgttaaatttttaggagaaaatttgtcgacaaatgttactaagaaaatctgactaaagtgctccactaataataaaaaaataataaaatttattggtagttaggtaagtggtgttgaaaacgggagtacaagtttt

SEQ ID NO: 65626 - DNA, 35818 bp, Oryza sativa
catgtcgaccgtcgggacgacgacgccccgcccgcgccgacagaacacggcggccgcagctgccgccgccgcctcccggcggccgcattccggcgcagcagcagccggcaccaccatggcgttaatgttgctgctgtggctgcttctgatgctgctcctgcacttgtgctgttgtgcagatggtggcattgttggtaaaggcgatatatataaggaattggttgtcatatgtgttcatgtggagattcctgtggaaatgctgaccataggttctgcatttgacctggtgtccttaagctcgatagtaattattatgcaactttagtttaagtgttttatatataaacttgggaatgatcgatcagacctaggaggtagctagttagacggcctctccaatcatctgaattgcaggccgttaattattatataatcttatgccgctggctagcttgtgtacgtccatatacatatagaaaattttggacacatcggatgtttgacactataattaaaagtattaaacgtagactaatgacaaaacctatttcataacactggactaattcgcgagacgaatctattgtgtctaattaattcatgattagcctatgtgatgctacagtaaacattctctaattatggattaattagactaaaaaaattgtaaagcagattagctctcatttatacaattagttttataagtagtctatgtttaatactctaaattagtgtcaaacatccaatgtgagaggatacaaacacccgtggacgtcaacaacaggatgatgatcttatgtggctagctgtcaaatgggggcctaaattctagccgacgtaaataatcactgcttttgcttaagggttgaggtcgatcaccacgaaaaatgtgaacttgcaatttttttagggaacctcaaacgcgctgtgtttttttttttgttagtcactactagagaaccccacatctctcggttcgcaaccccctttactcccgggtaacgaaccgggagagagaatccgggactaaagatcgtcccggtttgagtcaccaaaccgggagtaaaaataaaaacgccacgtgacgctttctgttttcttttctttttttattgttttttgctaattttatattgatttcacaccgagctcaaccacacagacaaaatcatcaacaaattgacatcacagattcatcttcaacttcatagaaacatctaaaaatcatcaacaaattcacatcacaaaatcatccacagattcacaaaaacatgtaaaaatcactcacaaatttacatcacaaaatcatccccaaaatcatcgccaagtcgtcgctttcggattgcccgccgcgtgtgcgccgccgccagctgccttcccatttgcgccgcctcctcctcccggcgcgcccgccgcttcctcctcccggcgcccgctgcttccaccgccgcgccatcgcccgctcccgtgcgcgggccgccggctccctacactgcagcgcaggccaccactgctcccgcccggccggccgccacgcccgctcggccgccgccactaccgcccggctggcgccgccactccagagaggggaatggggaggaatgggaggggaaggggagaggaagggaaagagatggagaaggagatggaggccagcgcttttaatgaggggagcagagaggaagatgacgttgtttaatgaaagcaagggggagggataatcggccggataagatccagatcgatggcgtcgggctcggggtgctctttgggtcccggttggtataaaacaaccgggacaaaatgtctacttttagtctcagttgtttataccaaccgggactaaaaataatttgggtctgtctcaaacctaacaacttcttgaaccgggactaaaaatgatctttagtcctggttggtaaccccagctgggactaaagatcaaaattttttagtcccggttctatttccggttcctattagaatcgagtctattgtggaaatcggccgacccaacaaagatcacttctccagtagtgagggttggcaactaatccccgcacaaacaaaacggagcgactcattagcacgtgattaattaggtattagctattttttaaaataaattaatataatttttttaaaaaaacttttgtatataatttttttaaaaatacaccgtttaatagttttgggaaatgtgcgtgaaactcatcaaacgaacacagccaataggctgcgttcgttccgttgcgctgggaattaatctcttcggcacgtaaaacagagcgatttattagcatatagttaattaagtattagcttttttaaaaaataaaaggattaatgtgaatttttttattaacttacatacataaattttttgtaaaaaatacaccgtttaatagtttataaagaagagcttgagttgagaaagccaacaaaaagaatacaaccatatatagaagtaaccataaactaacagcgttgcagaggatcatccaaatcctgaagactgaagaagctgtcaatttatggtgtattagctagataggtccgctctattgccgtcctcagctagttttagccgatctcatatttgtttaagcagccggactgccgagcatatatgcataatatattttctgacggctggggttcatgcactgccatgcatctggtcgacgagtccatggcatgcatgaatcatggcatctggtcgatgagtccatggcatgcatgaatgtgtgagtaatatattggtgcttccagatgacacggcaggggaaagggagaagagaacatactactgtatatattatgcattcactatttgtacccaaaaagagaaaccctgtcctcactgttagcctgtccaagcttatgctggtttggcgtttctgtgtccacattttcttcttactggcctgctaggctgcgaggatactgcttctttgctcttatttttttcttcttaagaaatggatctgtctgtttcaatagccgacatatgcgtttaagaaatctgtgtcaagcttttgcaccggcttccgtgtataatgtttgaccgtccgttttatttcaaaattttataatttttttaaaaaaattaagtcacacataaagtactattcatgttttatcatctaataataataaaaatactaatgatagaaacaatctaataagatggattgttaaacattagacagggaaactcacaactgcacttaaaattggacgcaggaagtatgctcttttttttaaaaaaaaaaaaactatagtttgtttgctatcaagcgatgtatatattgtacgaattaccactagtaggaaaaccattttcctagacaaattactaccatttttctagcctgcaagatgggaaggggaggctatatggccgaccgcctgggaaattggtgatagcataatgtgaagaaacacaattatgcaatggcattttattgaacttgcattttttgattgcaatttgtaaaatcaattgcttgttaatggaaaaatataatgtagagtattcctcattttcctatcaagataaaaaatcacatatattttggttccaaaattttactatacatcgatcggtgatggaaaatatggacgatatcgtaaattttgatcagtgataggtgacagcataatttacgacggagtgtcacaggtccaatttccctagattctagtggcacactactacagaccctatttttccgtgcggttgaatcgattatcccgtgcggtggctcggcctgcctgcagcgcctcgtctgggaaaatcggtattttcgcgtgcgggcgggccgaccgcacgagataatcgattatcccgtgcggtccgttaatcggttatctcgtgcggtgcagtaaggaggactgcacgggataatctattatcccgtgcggtcaaattataccgactgcatgggataataggttattccccacggctagcatgtgctagggcaaccgcacgagataattcgtgccgtcggtttgtgcgctaagatcaaacgtgcattcatagagatgggaaaggagaataaatattatgctaattagatgtctcctttctcatgaataaagtagtaggtatttggtgttttactttccaatcatgtaagcacttgctatgaataatgtggctcattggtgttaaccccaatgtttgccaagtttgttttgtttatgttcaataaagttcaggttttgaataagtgtgggaagatatcccagcttctgacgtgcatatagtctgaaaattgctgaacatctgatgtgcatcaaactctacagaaaattgtagagtgattgggcactcgagtggttcggccgaaccaacactgaccccaatcaccctcaatttccacaggtaagcaggtgagcacgtctattatctgtatatctctaccatgatatggtactagagctggaaattcagaaaatgattggttcaagcataattgaaaagataaaatctccaactaatgaaattctttctatgattaaccttgtatattttttattctcagctgaacttgtacttgtgaacaatcatccatgtttagggaaccttatgcatctaggtaattgctatatgtgagatgattaaagatgaaagaaattcttgcaatatttgtcataacttatgggaatttgtttttcaaaataaaattttgttttaaaagctcattcctctaattgactttactctatacctaccaaggccatatgcaagtatatcaatgataaaccttattatgcatatgactgcttagcattatattgagctttatcaaatgtatgtgactcgtgttagatatcattcatactctcaagatcaaggggtcatttccattttttccacatatataattaagctaagcttctacattggaaattggcttcccacaaaaattccattcaaataaactcctactttagactatgctttcttctcctagaaaatccttggcaaaaataaaaaaaatgagaaaaggagggaaaggcatggctatgaaaaaaaaagaaagaaataaagcttgctctcaaaacaatgagcatgaaaatggagaaggtatagtagaaaggataattatttctttattccatcattccataaaatatttttgcttttccattttccaccacaaataaagacccttgatctaggagtatgactgatgatcttcttgagtccatatttttggctttgcaatatatatgatgcaggtatgtcacaattttatccctgccgagctccacatatcagccttagaataggaaaaagttcagacacaatttgccttggtgaggacccacaaagacagaatacttgagtgacaagagagaaagtcaatatgagaaaaagagctagtttgcgaaaattcataaaatcccatgagtttgacaagtggaacaagaagggctggaatcgagatcgttccatttatcaattactcaagatggtaagttagccactgatagagttcacaggtgcaggtatggctttgaataatttatatgcttgaattatatcttggagaaattcattctacactaacctttactcagggacgagtaaagagctaagtgtggggggttttgttggcagttattaaatgccgattctataccgccaacatctgcataaagtacagataataaaacatccaacatagtgataggtgttaaatctcacatattccacaagtgttggtgtatattggtatgcaggtgttaaaccctgaagatgggaggggaaacaaacaaaagtgaggagaaacatgtatccacacaaggatgggttgtgaacttcatcaaaataccagagaatcagcccaaaactctgagaaatggatagaggagaaccaggaccatttacccccaagtaccccacccaatggcgcagcgatcttggagatcggcatcatcttctccaactccggccgccgagctccatcttcgatttctccctctccggtgagtcccaatccgattccctgccatggtagcctcgcatggacctctctaacacgaaagacatgaatgcatggtagtcctttgaagaaatcgagccatcgttgttcatccaaggtgaagcgccactgccgagacatttcgcgagccatcgtcgacgaccaagcttggccgacctcatccgtgcgccaggatgccgccgtgcgtcatcaccgtcggcggtgaacccctgcgatgcgacgctgccccgccgtggccgagccatcccggctcgggccagccgccgtcgcgaggaagaatggggaaaagaaaagaagagagagaggaagaacagtatgtgtccaggggcattttggtacttacacagctctttctctctccattttgaccggaaataataaaataatgggaggactgtccagcaacttattaccactttttgcagtgcccacgagcaaatacacgatcttcgggtgtctcatagcaaaggtcgcaatctttcggtgtcctgtagcaaattttgccatgattttcacatgcatggatcttctgaacacctagagataatggacatatcaatttcttcgcttgataagtgtttgtcggcaggaggttcgacttaggaagcataactctcaaaatatccatcaaatcattgaagcttgtgtccgatcatccatgtctggccttcaatctgagaagttcaagcacagagcgcaacaccgtatagtccttgtcgcatcctttcgcttcgtcgtaaagaagatccttcgctgttttttcaacgcttcccaattgtccaaccctcgtcttctaccagttaggacctctggttcaacatgccgcaacatatcttccagatcaaaatcaatatctgcatcgtctatactagagtcaccgcattccgggatggttccctgtgacatgtcttcgattataatattttacgcatcaccaaagcagaaatcatcagcctcttcgttacgaccaccgacttccccgtgaaaagtctatatctcgtagagagaatcccttatatgccactagaatttgaccagttcccttatatgccactcaaaattagcttctcccttatatgccactagttcaagtttttccacccttttatgccactcctaccactatagtgttagttgactgttagtcaaaggttagtttttttcgtaaatgactaatatgccctctcaactaaaaaatgtgtaaacttcaaaaaaatcataactaatttattttaaatcctctttgagtgaacaaaattttgtcaggaccagtgaaaaatgctctttatattaaaaatattgttggaaaactgcatgtttcatacttacattgaaaatttatttgcgatggtaatggctaaaattgcacgcgatgtagaaaaaatcaattttcatatgttgtatcccgtagctatattagtactaaaatacctattattggttgtagactaattctcaagggcaaatgcgtctttttacaatcaagttaacggtcaactgacggtggactgacggcaatggcataaaagggagaagaaacttgaaccggtggcacaaaagggataagccaatttgaagtggcatataaggaagccggttaatttagagtggcatataagagattctctctatctcgtaacccttcttaaatcctcgctctacgatgtgcgacaatacttaattcagatcttgcaatctttgcatgggcaaaaaatgcccctcaaattctccctcacagcatgtgcctttgccagctcaacgaatttgcctgcttccttcaagaacgtaggatgagttctttttgtgttgtacattcatgtccgatccatgacctagaatacagcttgtcatgaatacatccatgcccgattcaaaaatgagtgtatttaaacagagggaactaatcaaatagtaaattaaagttttatggacaatttaaacgagcgtacagaattttaaccattaatataatattgtccatttctaaaaaatgaaaaaaagtccttttatccgaatgaaaataaatttaatggaggcaaacccaacttttcaatttggatactaaatacttttaaaaacatgtaatggaaacattatacattagctaaaatataaaaaaaacaaaaagtgcctacactattccatttataaaagtgcaagtttcttcgaattgcaccgacgaaaacttacaaaaatggaagcaaataaaggagaagaacaagctctacaccttttatatggaacccaatcaaagatttgaggtcgaaaaccttcccccctaatttgtgggtgtttaggagagagaaaacaccgacatatatggcaacggtcgggctgggggtttatatagccccccgaccatcgcaagcggtcaccttacgtgggctgcacgggtggcgccggtcttcggcttgttctaggcggagctacttatggcccgcctggaagctataggggccggcgtccaagaaaatctcgcgtgtagtagtggcatgtggccgatatcgtgagtaccattgatatttatataaagtagcatatttgtagtgacatggatctaattaacccttttatttaaccaatcacttgtctttttacgctgattttatcggggcaaacagtggttgtgtgcttcgtgcgatgtggggaggagtggacttttgtcaagttttgggatatactccgatcctgatgtcctacattttttaaacccacatagtctaggaagaaaatagcgtgttttaggtgctctttgtctaggtttacaagcaaatacagtaagccaaaaaatctaaatctaaacaacagctttttcatttgtttttttttctaaaaccatgagtcactctatcactgttaaaccaaaagttagttaggccgaagaaacatttttaccttacgtgaagtaaaagtgtgactctaacattaaacttaagattttttttcagggattaaacttaagactttaaattcactaggttgtaaatcacataagctaaaaggataacttaaaatttctcaaaaaaagaaaggataacttaaaagcctataaatcaatctaaacaaaaaaaaaacccttaaataggtctcgaggcaacacgaagcctttgtatccagattttccataaaagatgctctacgggcctaaacttgtgtgcagatttcagcccaacgtccgcacggagcttaattagttcccaccacccacttgagccgccgccgctattcatccatggagccggcggcgacggtagcaatggatggatggtcggggccttgccgagtgccggatggtggcggtggccggagtcggaagagcgccggcgtacgtgggtggggagtaatttctgatccgtggatgcacaaccaccgtacgtgccagtaacgtataccgctccactttggtgcctgtttgggaaaagcgctgccccaaaagtccacagtttctaagaatatgtagttatatattctcaaaaatgaactaagaaattagaagctgaaggagctgggttttcagagcttttctagattctcaaaagctggttaccaaacagctgcttattagaatctaaagctccgtcaaacaggcgcttttatctccgctgttgagtacttcattttcaggtcatctaatcgctggagtcgtttgacgattgcaaggtacgtacatgtaggctcgagctaattaagctgcagctagctagccagctcaagccactacataccatttgagtgttctggtagtgattttggaggatttcaattaccaatattttttttatagaaccctgtggttcatagaaaaggaaagaacattttttggtaggattgtattccgacggcttaatttcgtataagaaaataagaaagaaggtttgatcttttgatgattttcattcctgtgggattagagaagaaaaaaagtccattttactgccccaaactaattcaatggatcacttaactccctaaactattttttaggctcattttaccccttgaactattaaaaatggttcactttactccttaataacatttcctttttttgttactttttatacaagttttattttaagctgaaatttgttagagtaatagttgacaccattaccaaagtttaaaaatattttgaaattttttttcatggtgttagcttgaactttaaaattttgatgtttaaatcagtttggagtggattcaacctatgcaaacagtgaggaaaaaaatcataaaagaatgtaagatgtaggttgtggatgcatttttattctaccaatttttcagtgcaaaatatgacttatacaatgagaactaaagaagagaaatagcgttaggggagtgaagcaaacatttttaatagtttagggtgtaaaatgagccaaaatatagggttaagtgcttcagtaaaatagtttgggggagtaaaataaactttttcattagaggaactcaatatttcaattcttgcgttattctattttttgtgtttttcctgtcctgtttttcacagataaactaaatacttacaaatatttggtatgtctgcactgtgctctgtggatcatgttctccgtgatcatcgatctctgtcaggcaagacgccaagaacacatccaccaaatctttgacccccgggagagaccatgccaagaaccacactccccaacacggacagaacacagaagatgcccctcggcaacagcgcgcggcgcagctaaaataaaattccttatcccctttgtgctcacatgtgcattgcatatatgcagccttgctgctcgcctgcaatgcaagtatgcaacctgtgatcctcctcctcttctcagtcagaggtgagccccctcctgtgacccctccaatgccgttcacatgatctcactctctctcgctctcactgtcgcacacattgagcagtgtgactcagtgagccacctctgcctttttacatgaccatgctgctcttgtcctagctgcacatttcacacttcacatggcaacagaagcagcagcaacagcaagatgtcttcttcttcctcttctttctcctctccaatctccacacaagcagcagcaactcatctttgctgctcttctccttctcttcttcttctcttcactccagagtttgcactgctatgctgctgctggttacaatgagcagcaggaagctgatagggtggccttcctccccgggcagccaagcagcccgaaggtctctcagttctcaggctacatcactgtgaacaggcagaatggcagggcactcttctactggttctttgaggcccaggcactgccctctcagaagcctctcctgctctggctcaatggaggttgtgcaataatgtctgaatcatttacttctgcaatagaaatgtgaactttttggtacacatttgttacatgagtgcatatgtgcatgcagggccaggttgctcatcagttggatatggagctgcctctgaactagggcccctcagagttagcagaaatggagctgggcttgagttcaacaaatttgcatggaacaaaggttgtgcaaaaactaagcatttttgtttcttataattgttccaattggtttgagcaaattaataaaatgctatacgcatgtcactgtttttcacattgttcttgccagaggccaatttgctgttcttggagtccccagttggggttggcttctcctacaccaacacatcctctgacctcaccaaactgaatgatggttttgtaggtaattcagtattgttattggtaaagtatatttttcttgaccattgtttgtcacatttgagatgtttttggcgccttccttccttgtagccgaggacgcatataatttcctggtaaattggttggacagatttccacagtacaaagaccatgaattctatatttcaggagagagctatgcaggtaattcttcacatgaacatgaaagtcgtctcttgcccccttggccttctttttgttgttttgattagaacaaccaaccttgaaattgtagcctacatgtctgaaaaggttcaggaaatgatgctaatgcatcaaattcagattatagttgacctttccaattaggaatttattagtaatacttgtatctattccgtaataaccatgaattggctttgagataaactaattcaaatttttactagatttgagccaatagttcagattatgcatataagatagtttgctgagccctaatatgtctactacaagtttctagaagttcaaaattttagttgcaggtaatatagtgatctgtcctgtaaccataaaaaaaaagcatatttaggtgcttaggaagaaggatatcataatccgtgaaaatagaagcaaagtgaatatgtcctggttaacatcatgacttgacatcattttcatactatttagatatgaaggcgtgtcctcattttccaaaatgaaatgtttcattcctgcaagatcctcatcccattgagcactactagtggtattgactggtcatactagaattatgtgatatctcatatgcggtagtaaaaaagatgccctataattccttttccctgtacatcaccaacaagaattttcgaattaatgcaggtcactatgtgccacagcttgcagaccttgtctatgagaggaacaaagacaagaaggccaacagatatatcaaactgaaagggttcattgtgagtacatccattcactgattagtttgccagtattgctggtttggcttcattctttcatatttcaaaactggatggcaatattatttggtaaagtccattttaatggactcaaaaactcttcgttaagaatccgagagctgaaagtacatttcacctataatattttagcaacatattgacagtaatgatgatgctttttctagataatggtctttaatttagataaaaatcagtggaacatcagaaaagagtatttcatctattattgaaggtccaacaggaaaaataaaatcttgcagttctcgaaataagttctaaactttctggaatcataacattggtacttgggcccaaatacaggttggtaatccacttactgatgatcagtacgactcaaaaggtcttgttgaatatgcttggagccacgcagttgtgtcagatggaatttatgagcgcgtcaagaaggtgtgcaacttcaagatctcaaactggacgaatgattgcaatgaagccatgagtagtattttcagacaataccaagagattgacatctacaatatctatgcacccaagtgcaatcttgctcaaacatcaagagtagctgctttcgatcacgcactcgaagcaagcgatcaggttgatgacaaatagttcaaattagttctgcttctgaaattctaaggcttgttgtttgacttggtaggaacaattcagtaggaggattaggatgttctcaggatatgacgcgtgctactcatcatatgctgagaagtacttcaacaagccagacgtgcagaaagcattccatgcaaatgcaaatgggatgctccctggaaaatggaaggtttgcaggtgaattggcttcttttctttctttttttttaacttaagaatcggcttaaatttcttccactaaaaatatttagagtggcaactgtagatttgttaaactcttaaaattttatattttcttttaaatctgaagtccttctctattgcatattcagctatacatatacgaggggcatatatggaccctttttgggcctagaaccacacacacatgtacacagcccacacccacaaatatacactgcccaacagtccccctcaagatgggcgataaatatctatcatgcccatctcgctacatgacgacatacactatttaacacctaaagccttcgttaaacaatcaaccacttgttctctagaattcacaaagtttaacttcaaggttttgtcatctatcctttctttaataaagaagcgatcggtctccacatgttttgttcgatcatgttggactgaattgttagcaatattaatggctgatttgctgtcgcaccataacttcatgggaatgtttatcatcaacttcaattcagttagaagatctcttacccataacaactcgctcaaactaatcgacattgacttgtattctgcctcagcagttgaacgagacaccaccaattgtttcttgcttctccaagatactaaattgccacgaacaaatacacaatagcctgatattgaccttctatcatcaagacagttgccctgatctgcatcacagtatccctccacatcaagatgtcaattttcttgaaccataagcccttacctaggcttcccttcaaatatctcaaaattctatacacagcatccatgtgaccacttctaggatctgttacgaatctgcttgcgagtttgggaatttaggattagaggagcagattcgaacagagagaaaggggtaggaggaaggggaagaacagaagagagaacttggagcaggggaagatgcagtagttagggaggaatagttttctgttcacttgttcgatgccttttcccctctgctcactcgtgcttatatactcgcacgtttacattctggacctaagcccattccggcccagttactctcacattaggcctgcgtactcttgctggtcgcgtcttcattggattacttgccgtgagtaatgtcggacctggtacagtaccggtgacattcccctcttcttcagaaacggcttgtccccaagccggtgcttcagggaaacgcgcacgcagtgcagcaccatcctcccaggttgcttcagcggacgtctgaccagaccaacgaatcttgagttgttccacagctccagcgcctttcttgactgcacgacgagcaagaatttgaactggtagcgcttcatcttcagttaacgctggcaggtcttgaatcgacgagtcaggagctggtgaagaagcctgacagagctgtgagacatgtactactggatgaatagcacaagttgtcggtagttgcaggcgataagccacgcttccaatgcgcgccaagatctgaaagggaccaaaataacggaaagccaatttgtgattagaacgtcctgtcaaggagaactgagcatgcggctgtgccttcaggaacacccagtcaccaacttcaaactcacgatcagaacgtttcttgtcagcctggaacttcatacgttgctgagctcgtaacagatgttgtcgcagcaaactggtaatcacttcccgttccttcagccagtcttgcaaatctggaacagcacactcaaagcgatcgagcacaccaaaatgccgaggagaatgaccatataatacctcaaatggtgatttgtccagagccgaatggaaggcagtattgtaccagaattccgccaaagcgagccaacgataccacctcttagggcaagcgtgcacaaagcatctcaaaaaggtttccaagcactgatttacccattcggtttggccgtccgtttgaggatggactgtttgccaagcatgcttgggcactggaagaggctgtaagaaacctgggtaccgaacccgttctgctttggcctgtttacagatggaacaagccgacacaaactggcgcacagcttttctgagtccaggccaagcaaataacttattcactcgactgaaggttgcctgagtaccagaatgacccccaattgctgcattgtgcagtgcagtcagaaccttagtctgtaactccacattgttacccaaccaaatccttcccttatggtagataatgccattctgtaatctgtactcagggagcgcctctggacttaacgagagcttagtcaacagttgagaggaaacttgatcctgagcatatcccagctgcacatctgccaaccaaactggaatacaggaagacaccgcactgagttgaaacacatcggttgactgattgcgtgacaaagcatcggcggctttattttccagtcccttcttatagacaattcttcttatagacaattctgtattgtaaaccaagcagtttggtcagagcacgctgttgccaaggtgttactaatctttgatcatccaaatgaatcaaactgcgctggtcagtacggattataaactctccaaactgcaagtaagagcgccattgttccacagcgagaagaatcgccaagcactccttctcgtaagtggacagcccttgatttcgaggccccaaagatttactgagaaaggctaacggatgaccagcttgcatcagcacagcgccaacacccttatcacacgcatcagtctcaatttcaaaaactttggagaaatccggtagtgctaggacaggagccgaaactagagcttccttcaaggcatcaaaagacgcttgatgctccgacgtccaaacaaacaccacattcttcttgagcagatcagtaaggggcctgctgataataccaaaagagcgtacaaacttccgatagtaccccgcaagacccaaaaatcctcgcacttccttcacattacagggtactgcccagttgcgcaccgcttgaatattctttgagtcagtggccacaccttctgcactaataacatgcccaagatatgttagacttgcacgggcgaacgagcatttgcttctcttgaccttaagttgatgatcagttagcaattgaaacacccgtcgcagcaaggctacatggtcgtccaaattttgactatagattaagatgtcatctataaacaccaacactcctttgcgaagcaatggagctaagatctgattcatcaatccttggaaggtagccggggctccggtaaggccgtaggacataaccctgaattcgtagtgtccattgtgcgtcttaaacgctgttttgtgctcatcttctgggcgcatccggatctgatgatagccagctcttaaatccaaactcgtgaataaacaggagcccgccaattcatcaagcaactcatcgataattggcaaagggtagcgattcttgactgtaattgcattaaggtggcggtagtcaatacagaatcgccaagtaaggtccttcttaagcaccagcagaacaggtgatgaaaaaggactagagctgggttgtatgattccctgttggagcatatccgcaacttgccgttcaatctcatctttttgagctggattatatcgataaggtcgcaagttaacaggttttgctcctggcagtaaaggaattgaatggtcaaagaccctggccggtggtaaaccttgtggctcatcaaagacatgaacaaattctttcaacaactggtcgacagcctgaggtacttctgtatttgttgtttccttgatcagagaacacaactcaaccacttgcatcacagcttcccgatgaatcagtccttgaacttgattgacagatagagatgtacagctgctaatatcagctctaacacctcgcaaacaaacatccttttgtgcatgtttaaatctcagagtcttagccctccaatcaatttgcataggactgtgttgctcaagccaatccattccaagtattacgtcataacttccaagaggtaacactttcaggttgttctgaaaagaaacaccctgaaccagccaaagacaattctgcatttctttgttacattggagtattcccccatcagcaacccgaactcgaaaagattgcacagttttctgattgcctcttatcttgcctgccatttcttcagatataaagctatgagtgctgccagagtctacaagcatcattatctcatactgttgtattaatccttgcagcctcaaagttccagaagattcagtccctagcatagcttctttagaaatctgacagacttcgctaacagtttcagaagccctttctgtcagctcatcagttccagcggatttggtttccccatccgattcctcaagcaggtcgagtaactcctccacaacatgtaactgcacagttggcccacacttatgttccctactccatttttccccacaagtgtgacacaatcccttagccttgcgataagcacatagtgctgccactcgatcctccagaggctgagttctgtcatcaactcgcccaccagctcgcccaggagtgaaagcaacattccccacagtacgctgtccgacccgatgagaaaaacctccatcaatccgacgcgaatcccgtcgtcccgcttccaacacctcttcctgtaaacaagcaaggtccacagcagtatccaaatcgtttggacgatgtaaaattacggctgcgcgaacttcaggtttcagtccatcaaggaattcagtaatgaagaatactgaattccaggatggatgatgagcatagagttgatgcatcagctcattgaatttttctgcataactaagaacggttccctcctgcctaagcctcttgaactgtctaatgagactctgaaattcctccctcccgaacttagcacaaacagcctccgagaaatcattccaccccatcaattccacatgagcattggtggattgcaaccacactagagcactccccgaaaattgcaaagcagcaaccccaacccacacatccgggctaatcccacttactcggaaataagtttcgcatttcattttccaggctctagggttctctccttcaaattgtgggcaatctactctagcattacccccatggaatcccttggccgggagagacgttggagagaaatcatctccagacgccttcccccgattcatcgttgcaacgttgcggcctcacggccctgaactcgcgtccgcccctttggaggccgtctcctcctccttcggcaccgtcggcgtgggtagaagagggggcagatccgctggcttgacggcgagaattggattgcgggatatccgctccacttgctggcgcaggtcgccgaggtcgtcccgcatctccgtcatggccttgtccaccgccggtttccagctcgcgagctccaccaccataggcttgatttcctccaaggatcccatcgaagcttggatggcggtattctgcttctggattgtcgccatggccgccgcgagttccgccaattgttgctccatctcttgggacttgagttgcgcacgggaatagtatctaggtttgtcgaggtactccaggatggatggctctgatacctattgttacgaatctgcttgcgagtttgggaatttaggattagaggagcagattcgaacagagagaaaggggtaggaggaaggggaagaacagaagagagaacttggagcaggggaagatgcagtagttagggaggaatagttttctgttcacttgttcgatgccttttcccctctgctcactcgtgcttatatactcgcacgtttacattctggacctaagcccattccggcccagttactctcacattaggcctgcgtactcttgctggtcgcgtcttcattggattacttgccgtgagtaatgtcggacctggtacagtaccggtgacaggattatgcatatactgacttatcacacttacagcatgggttatatcaggtcttgtatgacacaagtatatcacctgtcccacaagtctttgataactctctttatttactgggtctcctaattcagcacacaacttatggttttgttcaatttgtgtagaggctggtcgacaaccaagcatacctgtgtcactgagtagatctaacgcatactttcattgtgaaagtactatccctctaggagatcttgcaatctcaatgcctaagtatttcagctgacccaaattcttaagttcaaattccttacttagattttcttttaatcttgctatctctatagaatcatccccaatgataatcatgtcatccacatacacggcaaagatagtagcgtgacatcccttatgatgatagaatgatgtatgatccccattacattgcttataacccatgccacatattcatagtgaaaaaaacgtgaccggtagatgacccggtcaccatgctggttcactggtttcacggttcaaccgtgaaccggtcggtcgaaccgcagtttactaagtacatgtaatatatatgtaatatatgtatttctgtactgtcacatacatttggatggtaggatggctacgggagttggcttgtaaccgatcgactcggggtcgactccccaccagtgcacatttccttcgatttttgctaaaaaaatcaagcctgtggacatgtatggcccaaaacacactaactcggcccagtttgtcttagtccgatccgaccaaagacggttttatgcctggttcatcgcaaaaccggctagtttaggcggttgaaagtggttcaaatgcatgtccggtctttctattcgaccgaaccgtgccaacctccagttccggttgaaccgccgatccggtccggttttttacactaggcacgcattacacgttgaaaacaatcaaaccattctcctggtgattgtttgagaccatataaagatttcttcaacctcaacacttttttccttcagtttgtgaagtgctaaatccaggtgggatatccatatacaccacttcttgaaggtctccatgtaaaaatgcatttttgacatctaattgatgcagtgaccaatcaaaattagttgtacaagtttcatcataatcaattccatatgtttgactataccccttagcaacaagccttgctttctacctttccttctttccattaaggttttgctttattgtatatacccacttacagttgacaactttcttcccttcaggaaatggtacaagattccatgttttgttcttctcaagagcctctagatcatccagcatagtttgatgtcattttggatcttgctttgcttctctccaattctttagaattcccactaaatctaccgatgctacaaaggccttatatgtagatgacaaagagtcataagaaatatagttggatatgttattctcatcattaccctcatcttgagcttcaaaaccatatcttagggaggtttacctacattgctttttacaccctttctgacggcaattggtaagttagattcttcttctctaacttcatcctcttctccccctaactccaaaggcacttgcacatgacttgcatctcccactacttaattatcctctacaacttattggatcactggaaatcttgccctccttttgtaaacttgaagattttcctcttcatgtggctttctcaactcttgctcttatataggatcattcatatcaactgggatttggccaatcacaacttttttctccttcgcttggtcatcttccttggaacccattattttatcctccctttgtttatcatgattacactagttgaattatcaagatcaacaaaaaaaagaacttaaatctattttctcatcataaaatggaacaaattctctaaaagtaacatccgtacttacaaatgttcattgttctgatggactccaacacttataccccttctggccagaggaataacctatgaagatcaagttttgcaacataaggtctgttgtttctgacaaagcatgtgcaaccaaacacctttggtggaagaacaaatacattcttgtgaaatatcatctcatatggtgtcttcatcccaagtattcccgatggtgtacgattgataagatatgttgctgccattacagccacactccacaagaatttaggtacattcatagtatacatcaatgaacgagctgtctccaaatgatgatgatttttcttctcagccaccccattttgtggaggagtatcaggacaagaagtttgatgtaatattccttctgatgaaagaaagttactaaattcttatttatatactcccctccattgtcagttctaataaactaaacccgagcattaaaatgatttttaatgtatgcataaaaattctgaaaacatttaagcataaaaattctggaagcatttaagcacctcgtccttgtgcctcataagatatatccatgtcatgcgagagtagcaatcaataaaggtgacaaaatacttcattccactcatagaaaccacaggtgaggtccaaatatctgagtgaattagcataaagggcaacatacttcggagtcctctactcacatatgacatttttgtatgtttcccatactcacaagcatcacatactaacttatgtttatccactctactgaactctactggaaatattttacttataatttcaaaagatatatgtcccaatcgacagtgcaaaaataacaccttagctcttcttcacttgtggaagccatcaaagctagacacatggcttcattagtccttccccgatccaaatacgaaagtccatcatgcctgacaccaatcccaagtttcttccctgtttgcctctcctgaattaaacaattctcacgatcaagggagacttgacagtccatatgatcaacaagaaaactttttgaaaccaaattcactggaaaggaagaaatatataacactgatgataaagtgattgaaggagtacactgcactgtaccctctcccttaagtgggcatgatgttccatcggcaatttgaattgtttctttacgtgtaaatgggtatggtttatatgatgcaaatgccccacgcatactcgttacatgtgtaatgcactagagtctaatatccaatttggataagaaccattgatggacataaatgcttgatttgaattatctgaggtggaatgaacaaagttggtaacatcaacatttataggttcagaagaacccccttcaagagtgaccacattagctttgtgatcacctctgtactcatagcctctacctctgttatctctactttcataacctcttccacctcttgctcctcctctatcaccatttcttcctcttccataactaggcttgtgagaagcacgacaatcacacataagatgccccatttcaccacaattaaagcactctctagttttattaccttgtacaattgcataggtgggacttgatgaagacgatgtggcataggaaatagtttcttcttaagctcctcttgtgccatagttgcaatagccacatctaaggtaggaagagtggtttggtgaaacattgcatctcttcttcctttgaactccggatttaagcccttcaaaaactcaaggacccttttacgctctacccatttcttcatttttgctatgtaattagaatgctctaacccaagaggatcataataatctaaatcaaatcacaaacacttcaactctgcgacatattctgccataggcgctccccctgtttcaaagcacttatcttctcttgtgccaccatcattagcatcatattaccttcttctgagtatagattagtgagagttttccacatctcactcgcactagagatggtctcaacagttgtagcaatagcagggattagtgaggtcaactaccacgctaccactaaagagttggtagtacttcaagttttccattctacacttgtgctctcaggctccttcacttctcctatgacatatccttctaacccctttgtctttaaaatcaacattgctctccttgtccaactcaaataatttttgacaccctccaacttaatatcattttgcatcaactcaattttttgtactgattcagcatgaggaacaattgcattgatagtagtagaggtctcactgagtttctttgcaagcatatctaccaattttcccatcacctgttcaattccttgattttcccccattacagcaactacaactacatcccttctatttcttcccataacaacaatatcaagcaaaacatcagtagaatagttccaaccttcccaagtgattgatttaaccaccgcagtacagatcaagttacaatgaccaaattcctcaccttcttaagtgaccaacagaaccaagtgcagctctgcccccaaatctcgtgtgccccttcatttcttgttgtgagatctcaacctaaccttgcaatagcagacaaaagctacagcagctacacagcaaactaacccccccccctttttcttgcaacggcaacagcaaaagctcaccaaatcctcggcccacactcctctgcttcctccaccagtgcaccttggtgcatgcgctagcctctacctgtcctgctccctctggtcgccgtgagcccgtgagtccctgtactgccttcctggccgccgtctcctgcagcgcctttgcgtccctctcgcgacgctgctccagcgtgagcccgtcgtcccggcccttcaccgctggcttccgcgcctgcgccctctgccttccaacgcctccacgacgccggtgcgccacactcctgttgggctgtgtgtgtgttgtggcccaagaggcccatgtaccgatatgcttgcatatgtatagagtaagcaattgacagagggtgtgaagcttccagaaaaacaatcacaaatgtcttcatggtattagagcttggtcgccagcgactgcgtcgacactaaaccctagctggcggcggctatggccagagaagcgcggcgcaccggcggtgtacttaggggtgggcagaaaaagaccgagaccgagaaattcggtcatcaattcggtcctaggaggtgaaagaccgaattttgttcggtcaattcggttagtctcctcggttaaccgaatagaccaaaaagaccgaattaacaaaaaaaaagtataaatacaatctacaatccactaagttcaataggattaaactctaattttcacatccctacttcttctaggcatataacctaataagagtttttactcatacgtgcttacggatttttttttgtgatttttgtgttgaaaatttccattatttctctgcatatatgaaaatgttgctgaatttcggtcagaccgagaccgagaccgaaaagaccgagactgaatttgtcggtcctgacatttttgcgttgaaattcggtcttcacttttcaaagaccgaaataaccaaaaggccgaagaccgagaccgaaaatttcggttagaccgaacgcccacccctaggtgtactggcgtgtggtgctggagctcctgacgaggaagagagcgtgttgagggtggagacagtggcaactattgtggtgagggagcaaggcagcgacggttgctgtggtgagggagcgacagtgttgacggtggaggcaccggcagctgctgtggttgtgcttggaggaatccgacatggagagaaggtgtagctagctggaagcgccaacggcgaccgcatgcgcggagggcaagttgacgatggcgtgtggagtgaaggtgcgcttctactgttggcgattgtgtgtgtggagagaagatggtgatattgcttgctagcgtgtagaggtgctgattgagaaggtgcagctgccgcttgctgcttgagaaagtgttgcggatgctgcttgagaaggtgagaattttttctactgctactgttgagaaggtgaggatttggtcagattgaagtctcacagcaataaaagaaggggaacagattaacttgtggaggtgagaagaagggatatagctgctattaacttgctgtaatgcgggaaaatcaagggattgaacaggtgatgggtaaattggtagatatgcttgctaagaaacttagtgagacctctaataccagcaatgcgattgtttcgcatgctgaatcagtaaaaaaattgagttgatgcaaaatgatattaaattagaaggagtcaaaaattatttgagttggtgaaggagagcattattgatcttgaagacaaagggattagaaggatatgttacaggggagataaaggagcctgacagtacattaagtgttgagtggaagacttggagtactaccaactctttaatattagcgtggttgttaacttcacttatccctactgttacaacaactgttgagaccatctctagtgcaagtgagatgtggaaaactctcactaatttttactcgggagaaggaaatgtgatgctaatggtggaggcacaaaagaagataagtgctttgaaacagggggaacgttctgttgcagaatatgttgcagaactgaagcatttgtggttagatttggatcattatgatcctcttgggttagaacaccccgtttgtatagcaaaaatgagaaaatggattgagtgcagaagggtcattgacttcttgaagggcctaaattcggagtttgaagggagaagagatgcaatatttcatcaaaccactcttcctacgttgatgaggctattgcaactatggcacatggggagcttaagaagaaagtattgcctagtgtcacaccatcttcaccaaatcccacatatgtagttgcacaaagtaaaaagatcagggagtgcttcaattgtggtgagatgggacaccttatgcgtgattgtcgtgctccacacaagcctagttatgggagaggaagatatggtgataagggcggggcaagaggtggaagaggtcatgcgggtagaggtaacagaggtagaggctatgagtatagaggtgatcacaaagctaatgtagtcactcttgaagagggttcttctagacctacaaatgttgatgttgccaaccttgttcattccacttcacataactcaaaccaagcatttatgtccatcaatagatctctttcaaattggatactagactcgggtgtatccagacatgtcacgggtatgtgtggagaatttgcatcatataaaccatacccatttacatgaaaagaaagaattcaaacggctgatggaacatcatgcccagttaaaggagagggtacagtgcagtgtactccttcaatcactttatcatcagtgttatatattccttcctttccagtgaatttggtttcaaaaagttttcttgttgatcatatggactgttgggtctcttgatcgtgagaattgtttaattcaggagaggcaaacagggaagaaacttgggattggcatcagtcgtgatggactttggtacttggatcgaaaggggacaagtgaagatgtatgtcttgcattgatggcttccacaagtgaagaagagactaaggtattacttctacattgtcgactgaggcatatatcttttgaaactatgagtaagatgttccggcagaactgagtagattggataaacataagttagtatgtgatgcatgtgagtatgggaaacatacaagaacatcatatgtgagtaggggactccgaagtatattgccttatatgttgattcactcaaatgtatggatctcacccgtagtctctgtgagtggaatgaagtattttgttacatttattgattgctactctcgcatgtcatggttatatcttatgaggcataagaatgaggtgcttaaatgtttccagaacttttatacatatattaaaaatcattttaatgctaagattcagtttatcagaactgataatgtaggggagtatctgaatagtgaatttggtagacttctttcattggaaggaatattacatcagacttcttggcctgatacccctctgcaaaatggtgtcactgaaaggaaaaatcgtcgtattttggagataactcgttcattaatgtatgctatgaatgtacctaaatttctgtggagcgaggcaataatgacgacaacttatcttatcaaccgcacatcatcaaggatacttggaatgaatacaccatgtgagatgatattgggaaagaatgaatttattgttccacagctgcacttgctttgttagagatcatagaccttctgttggaaaacttgatcctcgagctgtcaaatgcttctttatatgctattcatctggccagaaggggtataagtgttggagtccatcagaacgacgaacctttgtaagtatggatgttacttttagagaatctatctcattttatggtgagaagacatatttaagttctttattcattgatcttgataattcaactagtggtcatgatagtcaacaaatggaaggtgaaatcttgggtccaaagggacataaactatcaaagaaagaaaagtttgtggttggttcaattccatgtcctatgagtagtcctattgcacaagagcaagaatggagtaagccatatgaagaggaaaatcttcaagtttacacaagtataacaaggtctccaataatccaacaagttgaagaggataatcaggtagtggaagatgtaagtcatgagtaagggactttggagtcagggggaggagacgaagaagttagagaagaatttaacttaccaattaccgtcagaaagggtgtaagaagcaatacagggaaacctccactaaggtatggttttgaagctcaagatgagggtgatgatgagaataacatatccaactatgtttcttatgactctttatcatctacatataaggcctttgtagcatcactagatccaatgcaaagtccaaacgattggagagaagcaaaacaagatccaaggtggcatcaagctatgctagatgaactagaggctcttaaaaagaacaaaacatggaatcttgtaccatttcctaaaggttgtatgtgtgttgtggcccaagagacccatgtacccatatgcttgtatatgtacagagtaaacaattgagagagggtatgaagcttctagaaaaacaatcacaaatgtcttcagctcgtccggccgcagcgccactgctgatatttcttaacgatattactagaaatataattcccagcaatggcgctataaatattctcggcctagaaccacacacacatgtacacagcccacacacacacatatacacagcccaacaaaatctaacagtagttgcaactctaaatgaaattctatctacacttaacagttcaatacactattgtcgtaaatcatacatttttattctgatatttagccatctttgtgaatattaggctaagtagacattaatatttatttgaattgtttaatttttgatttatcatgcagtgactccattctaaggtcatacaacttttcggtgctttctgtcttgccaatctattcgaagctcatcaaagcaggactcagaatttggctctacaggtgtgtttcctcttcctgtacctttagaccattttcctgttccaaatacatgcagacatgaacattttcatcacctatccaagcaagcatattttcccctgataacacttcttaaaacttatcagaaatataacgctgcttctatctgaattttaatccttcaaaacagctgctaaatagtgctgggaagtttaatacgagtaagattgttttgcatttagtggagatgccgacggtagggtcccagtgatcgggtcaaggtactgcgtggaagcgcttgggctgcatatcaagagggactggcaaccttggtacctgaacagacaggtctgaatttttgaactatcatcagtgatgttacattctagtagcaatgtagcactgatgtagttagtcaagttagttgatggatgtgaatctgtattctagtagcagtgtagcactgatctggaaatcacttgcaatataggttgcaggaagatttgtggagtacgatggcatgaccatggtgacgattagaggtgctggacatttggtaccccttaataaacctgaagaagggctcactctgattgacacatttcttcttgggtaaacagctcttaacacaccgatgaaaggtaaatttaggttaaaaggaagttgggactatttgtcctaaaagttgctcaatgagtgtcaaccattattgtttgagaaagaagtgtcaaccattattccaggagccatggcatagctgaaattattccttttaagggacagtttgaatttcagtctgatccttttgaatgctgctgttgcattctttcacttctttctatccagcctgaagctcttggtaacttttgttggtaaagcatctcaagtctcaagcaattacattgataagattgtgctaaacattcaaagaattaacaagggcaagttctagtctttgtttgaaaatatagggttgaaattatcattctcaacataaaactcaaacataaggaaaatatacagattaatgtatagggtggcatctagttgacacagacaattgcatacatgaagagcctacaatacatgtattgtttcatctatgtatgataatatcgatgacttattccttctttatttttatgtgtaagttttatctgggttgtatcatcggttgttttttgttggtagtcgcctgcctgaaagaaaggaattgattaccaccagtgcctgttctggcttgtcttgtggcactgcatgtccagctcctcttactgtggccattgtcaatccttgatactcaacaaatctcccagcaacctacattggatttgcataggtgaagaaattgtgcaatattacaaattgtaattcataattttacactttattttgattaatacacgtagatgacacggaatatgtaatagggtaacaacctgattgtttaggtaccatggttgccactgtgacttaacaggaaggccaagggcttctacgcagtaccgggatccaataactggaaccctgccatccacgtctccactgtaaaatcaaattgataattccctcgtgttggtcccaaattttgtgatgactttgatgaattcgaaattatacagaatttagtgagcataagtaaaagcaggtcctgaatgtaagtatgagtctacttgagtggcacttaaaaaatcactaaaccaactcatgacagtcaaaggcagggaaatgaaacaaacttttttgaaagcatgatgaagaaaaaatgagatataagggcaattgtcccttatagataatgtagtttgtagcataacataatatcttgatcaaattcttaaggcaaactagtatgcaagaaccaaacctgtagacccatattcgtaggccagccttgataagcttagagtaaataggaagaacagagaagaccgtgatgtcgtaattgtcgaatattgaataactgcaaatgtatggaggatgtcatttcttctatccatttagtatatctgatcaatcagaaattcacaaggaagctcatgcatatatgacctgcagatactccattttctgtccttgatcaatccactcgtattcgcatgaagtgatttctgcacatccatcttgttcatgtaatcttcgatatgtgacgaatagcacggatcataccctgagtacatcctcgtgcctttaagcctcttctgaaatttgcattcaattatcttcagttcattctgttttcatatttgctacagtacaaatactagttgttaagcattacagttaccttagcattcatatcagctgtactgtaggaggtggaaaagagggatgagtcatcagtgttgcacttaggtgcatacacattgaaaatatcgatcatatcgtactgatcatatatgtatcccattacatggttacactcattgctacggggtgataacctgaagtcgcaaacattgttgacatgcttatagagttgatctgagatcactgagtgactccaagcgaactcaactagtcccttgtagtcatagtaatcatcagtctctgcattgccaacctgcaaaatattgttggcatttgtgattggatcattgacagtttgttttgggagagcatactgaatgcataatatgcttaaattgaatggtatgaatgaggaaatgaaagtattataagataaaagaattgcttgtcagcgtttcaaactagaacaactcaataaacagagatccagcaaagcccacaaatacacaatcattcataaacatgttcgaggaaatagcactcacatataaggtctcaagctaatttccaatataacattctttcagcagaaatctgatgccaaaagaaaatttgatcagtttcataaggtacttacaataaatcctttcaaattgatatgctggtttgtttcaacatgcttgttgcgctcatacactacatcagcaagctgaggaacatagtgccctgttgcatcaaagttggtaagtgtctttccccacaaaataaaaagttggtaactgtcttattattcaaggttatgtttgcatgttgtgaaacacattggatgatgtggtttgcagcatatgccctgatacgtgtgtccactagatggccaccaatgtttaaatctgagtacttttgaccatatagtttgttgaataagccactctctcctttgacccttgataggactgttttgggtttagtgacagaagcaaacaaaaaatgagtattccaaccctaacaaaagatagctgtatttttcaacagaataacaaacatcaacttgttcaggacctaataaaggtggtatagtgggatccatgtattggtgtggactgaagacttcagggaataggatctggatgactacatgtattctaggctaaaccttttgactagagaatattgaggagtggaaagatggtggatttattcctgttttgcatgcttacactactcattaattaacaaaaggtgaaaatccggtatctttttctttttcttgtgggcttattcaacttttctatatttttgttggaagaaagggagctgtctgcacaatacctgcatagctctctccagagatgtagaagtcatggtttttgtactgaggaaacctcttgaaccaattcaccaagaaattgtaggtgtcctcagctgcgccgctcgaaaaatacagttaatgagcacaataacacaaatttttcagactttaagggaggtaagttgaagatcctgagactagataaataccgacaaaacggtcatcgatgctctctaggtcagacgaggtatttgtgtaggagaagccgactccaacaggagattccaagaacaacaaattggcctctgaaacatggagaggaacaattgcagattaattctgttagtcccacattgaccggtagcaactttacacatgacgtgacttcggagtgcaacatgatacgagcggtaaaagatgaacaataatatcgtaccgttattccatgcaaacttgttgaattccaaacctgttccatttccattgaccatgagaggacccaattcagaagctgctccatagcccacagatgagcaaccaggacctgaatatggaaattcagttgaatggcgatacaaaacaagaaacagtgaaagaaacacacatacaaaaatgacagggtaaatattctatgactacttagaaaggacgaactaaaccatcacacatcaggtgaataaacatatatagctgcagacaaatcaaagtacaactaatacttgtttgcttgctactgatcaatatgaatgaacaatccatcaagcaaagaaatgcatatgctcaatgcacaaatgacaacaacctccattaagccagagcaggagaggcttcttggaaggcagtgcctgagcctcaaagaaccagtagaagagtgccctgccattctggctgttcacagtgatgtagcctgagaactgagacatctgtgggctccttggctgcccagggaggaaggcaaccctatcagcctcctgctcatcctctgctgtgattgtctgcagcaatgagagagcaagcaagatgatgaagagtggatggtggcacagggatttgagccttggtgatgcacaagaggccataggatttttctcttttttttttttgttctcctcctcttgttctgttctgctctcctcagtgaaagagagtgcagaactctctgtgtccactaccagctcagtgtttggaggggggaagagatattgcagcatttgaacatatatagcaagttgtcatttgctggtatgtgtggcaattgagatacttttcttatgtgcaagtaagaaaatcagtattgttcccttcaaaaaagaaaatcagtattgtgcttgtaaaaagtccttgaccgatcagctgatagtgcagttaaaaaaatgtttaccccactgtaaatttgcactttccagtgtccacagagaagataagtttataaaaattctcaaaagaaaaaggtttagcacttgcgttggagaatatggtatatatcttttcaatattttgatattaactcagttgcatgattaaaaaaaagacaaatacatagctaaagcagttcgaacactatttaagcatgtatttatcattcacggattcactgaaatgcaattaagttctaacatagcccatttatatttattgattttctgagaacaaagaatcttcaagtttgaattttaacagacttttgccaatatgccaccaactaacctcacatgataataatcctttttgacattttccttcgtgagactataattaagttcagtcatgagcaacatgtgttccattttgtcggtctctcaaatctttagtatgaatcacaagccaatattaagtattgtctaaaaaagatttgagtgtttcttttcatattagtcgaatttaaggtcatcatgttgaaattcctttgtcatcttcatcgactttttcatcccctctaactgaatcaatccccatttggtcgccactacttccgcccctgaatgccacgatccctcgtcaccattgccaatgaggcacgccaatagggttgtaggtgggctagcatgcaaaatcatttctacaagcgatataagtgagttcacggattggctcacttattgggatacacccgcaccaattctctagcttgttctccacacatgtcatctcttcttggcactccatccccactccctacgcttcaattcgttgccaaactaaatttcatttagaattgtttccctctcctatctgaataatacctccatcccataataattgcatttctaccattctatttttttcccgaaaaattatatttgtgataagatgggacccaacaaatggaatgtgtaccctcaaccttccttttaattaagtttacaaatgaaatgtgtgcctcaaccttccttatataagtataggtatggaatatgcgcatgcagtgcagttattaaataggattactgtggtaaattatgtttgttatcaatctatctctattttttagaaatgcaattattatgggacggaggtaaactaaggcagaactcttgccttttgttaaaaaaaatctattcagaaatcataatatttattataggctggtttgccaaaagggaaatgtagcacctatttgctttgagaccagtaggagcaatctgcaaattggctagatcatgggccaggacaggagaaggctaaaatccagccggctatctcggcaaattgtaggcaaaatcttaccagtttatgctactactttacatgccaccaagaaggatcctggattctggtcgcttttcacatgattgctattgtcgcgaaatgacatcgattgcacaaattggagcaaaaataatgcccttcacaatgctcagcagtgattgtcttgttcgcaacacttgatgccgtttctgttgagttggctgggcaccgccacagccacacagccaacgacaaaataaaatttgtacaaaccaaacttctttcaaaaaaaaaaagcatgcaaatggctatgcaatttgtacaaaccaagcttgttttttttaaaaaaaactgtaccttgttatgaagagagattatcgaaaattgcagacgcaaatggctgcacatcattgttatgaagagaaagattgtaatgttcaaacgtcattttcgttggccccgggaa

SEQ ID NO: 65627 - DNA, 8534 bp, Oryza sativa
gattcattcggaaagtttccccctaacttcgccggcgcatcaatggcggccggatcttccgcgggcgattccccctcatccggccgttctctccccctcccaacactatataaacactccccgtgcctccctccaccgtttccgccactcgccgctctctctccccgtcggaatcgagctcgcgccgtcgttctctctctccgccgtcgccgccgagctccggtccccgccgtcgtcgccccggaccctctcccgtttcggcgtcgccttcttcgggttcgccgcaacctcgccgacctcgtccacccctctgtttcgcccgccgaccgccggaacgccgccgtcctcgtcgacccgagccgcgccgccgccttcctccgctccggtcgccgtcccgtcgtcgccgtcgacccggggtgagccgcggaccgccgttccacttcccccttccctcccctctctcgggcgctgctccgccgcgccggtggtcgccggcggcgaccatcggggcgcgggtgcgccgcctcccgtcggctgtgccggcgtggccgccttcgggcgcgccccgcggctgccatgtggggcccggccgtcagccgcccgcgccctcgggtgcggctgacgcgtgggacccacggcgccggccggtgtgagcccgggtgcacccagtccaccgtggaccgtggggctgccgcgtgggccccacccccgtggacccggtccgcgcgcccctcccctcggctgacgcaataaatccgattttaaattaaaatttaaatgaagaaattcgtaaatatccatttaaagagcatataaacttcaaatggccataacttggccatttgaactcggaattggaccgttcaagtctctaatttttccttaagaagccaagaacccatttttgtgctttgtttctgcttgttatatagagtttagtagagtaaaagccgtttcttttccgttggtcgtgtagacgctgcagcttcggaagatccgctcttcgtggaggttgaagccggcgtttgggaaagcgagcaaggcaagtcacatcatctttgaacatattgaatcccagtttgtaaaattatgttgatttaacttattgcattatcgctttatttaaattcccgcgttatcactgttttatttagccatgcctatttacctttgttatgaccttattattattgttattgttattattaccttgttcaccctagaataaacaaaaccccaactagtggaccctctactcatggtacccctagtataattttaggtagatgcttcgcttttaattaggtaacattaggcggttttacaactctagactttgggaatattcatatcacctggacactatggaatggtttggttattgtggaattggcttcacaccgctccttctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggaagaagtcgggggtcgatggacatctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgtccaagccgagcaatgtacccaagttagtgttttaattcttaaaatctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgcatagtactagaatcgtgtttgcaaaatagccctgagcaactaatgtctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagttcctggaggatgaaggcttcggtgtctagctcgtgcctgccgtcaagtgcctgtggtcgtcgccctagtcttccgctgtttctcgtttgtctttgtgtgtgctgggccttcgctgcccatgtaatagattaactatttacgcttccgcttgttaaactctgaattgtatcaacttttggtgtaccttgcctcctgggacaaggattaatgcacgcacgtaaggaacgcccgttgggttatttccggtcgtgacaagttggtatcagagcccccttgaccctaggacgagccgtagatcccaagcctttgcagtattttcgaaataaaaatcctctgttatttgtgaaaaccctctagtctttctctgtcttgctgcttcatttatcgccaaaatctgatttttttttaaatgttgcttttctttttgtttttgtttgtagatggccggtagcgtcacccgtcgtggtttggacatgactggtttcgtcttggagctgcggggcatgtgcgttgtcctggggtatccacatggagtggactaccagggcaggccgcttccggagcaggagggtgacgaagcagagccccacgctgcttgggaggtcactgcagtgatcctcgccggctctcccgagcggacttcgctggcagtcaccgcgggtggagattctttccccgccgcttgctagagcgccgctctcctcgccatcggcactcttcaccagcgctacccggacgagttgcagcactcgccctaccgctaccaccctcgccgcggaggagcccgcgactacgccaccttccgggatgctagctcggaggatgacgctaccatcatgcacctagcgcgcatggtggaggcgtacgacgcggctcgtatcgacttccatcagatggtgcgccgtgggatggtcgagaacaacatgaagatcctggagctgcgtcaagagaacctgcagctcaagaaggacctagacgcggtggaggcgcagctgcatcagctcaagatcgcccagggagaggtctgtcgccccaagcgtcgccgcgtctgccgcagccagaagatcaccgcccgcaagagcacctccaggcccgagcttgttcgtcagtccctggcgtggacctgcttcgtcgagacccctcgtgccgagtccgcgcccgtggttccccaggagggggaagcctccggcgttggtagcacggaggatgcgctgttgctcaccttccgtcctggcccgtcgcagcggtagacgagcagttagtaggcttgcgcgtgtgttctttctcgtttgtcttcttgttgggttgtgtggggcatggttatgccggtgtgtggcataactgtgtcggagcctgcctttattttatttgcctaagcaacttgaactttaatgaaccaatttaatagcagtaataaattcaagaattatggtagtcgtgggtggttagctttaattgccagctctctctatttgctggttctgtgtggggttttcagatggtgacgaccaggagaagtgctaataccggtgatggcaaccaacctgaaggcagcaaccatcaccaccagggcagcccacctccacctcctcctccgcctccaccaccaccaccagacaccaacgccattctcacccaaatcctcgcccagcaggccaacatgatgactgctttcctccaccacctccaaaattcgccacaacataatactccaccaccacccccacaacactctaaactcgccgagttcctacgcatccgcccacctaccttctctagctccaacaaccccgtggatgcgttggattggttgcatgccgtggggaaaaagctagacactgtgcagtgcagcgatgaggagaaagtcatcttcgccgcccaccagctgcaggggcccgcatctctatggtgggaccatttccaggctacgcagccagaggggcaacctattacttgggcccgtttcaccgccgctttccggagaacccatgtgcccgccggagtcgtggcccttaagaaaagggaattccgagagttaaagcaaggcaaccgctccgtgatggagtatttgcatgagttcaacaacctggcccgttatgccccggaggatgtgcgggaagatgaggagaagcaagagaagttcttggcaggaatggaccctgagctgtccgtccgtctagtctccggggactatccggatttccaacgtctggtggacaaaagcatccgcttggaagccaagcacaaggaactggagtcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcatggtgcgcgtcccacagccgcagcagtagcagaatcaacaagggactcgtgcgccccgtcctcctacgccaactgtgcagcctggtcaaggccgcagggacgctcaaggtccgcagcgtctgtgcttcaactgcttcgagcccgggcactttgcggataagtgcccaaagccgaggcgtcagcaaggccaagcgcctccccgctccaacaacggtggtaaggatgtcattcggggtcgtgtgaaccatgtgacggccgaggacgtgctgacaactccagacgtcatcattggtatgttcctcattcattccatccctgctaccattctgttcgactctggagcttcccactcgtttatatctgtgccattcgtggggagaaatcagttgggggtagaaaggcttaggaaccctctgctcatcaccacccctggaggggttatgacagcaaagtattatagccctgccgtccccatagaaattcaggggattccttttccctcggatctgattctgctagacaccaagaacttggatgtgatccttgggatgaattggttggctcaattccaaggagtggtggattgtgcgagacgcactgtcactctgtaccgagagccggaacaaccggttgttttctttgcacccccaacctctgtcagtagttcagaactccatcagataggactgtcagaaatccccatcgtcagagagttcggagacgtgtttccggaagaactacccggtatgccgcccaagcgagagattgagttccggatagatcttgctccaggaaccactcctctgtacaagcgaccctaccgtatggcagcaaatgaattggccgaagtcaagaaatagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaagaacaagtaccctcttccccggatcgatgatctgttcgatcagcttaaaggtgccactgtattctccaagattgatcttcgttccggatatcaccagttgcgcattagggaagaagatattccgaagaccgcattcaccacgcgatacggactgtatgaattcacggtgatgtcattcggtttaaccaatgcacctgcctttttcatgaacttaatgaacaaagtgttcatggaatacttggataagtttgttgtggttttcattgatgacattctgatatactcacaatccgaggaagaccatcagcaccatctccgtctggtattgggaaagttgcgggaacatcaattgtatgccaaacttagcaagtgtgagttctggttgtccgaagtcaaattcttagggcacgtgatatctgctaaaggagttgctgtggaccccgaaacagtgaccgccgttaccgattggaagcaacccaagagagtcactcaagtccgcagtttcttaggtttggcaggatactaccggaggttcatcgagaacttctccaaaatcgctcgacccatgacacagttgttgaagaaagaagagaaatttgtgtggagcccgcaatgcgagaaggcgttcaaaactctcaaagaaaagctggtttcctcgctagtgttaatcttgccggatactcgcaaggatttcatggtgtattgtgacgcttcgcgccaaggattggggtgcgtgctcatgcaggatggtcatgtggtggcctatgcctcacgccagctacggcctcatgaaggcaactaccccacccatgatttggagttagctgcggtggttcatgctctaaaaatctggcggcactatctcattgggaatcgctgtgaaatatataccgatcataagagtttgaaatacatcttcactcagtcggacctgaatcttcggcaaaggagatggttagaactcatcaaggattatgatgtgggaatttactatcatcctggtaaggccaacgtggttgccgacgctctaagtcgaaaaagccattgcaacactcttaatgtccgtggcattccactcgaacttagtcaacagatggaagccctgaacctaagcatagttggtcgcggattcttggctgcgttggaagccaagcccaccttgctcgatcaaatccgcgaggctcagaagaacgacccggacatgcatggactcctcaagaatatgaaacagggtaaagccgctggtttcacagaggatgaacacggaaccctatggaacggaaatcgggtatgcgttccagataacagagaacttaaacagctgatacttcaggaagctcacgaaagtccttaatccatccaccctggcagtacgaagatgtacttagacttgaaggagaaatactggtgggttagtatgaagcgggaaattgcagagttcgtggccctttgtgatgtgtgccagcgtgtcaagtcagagcaccaacgaccggccggactcctccaatctctccaagtacctgaatggaaatgggatgaaattgggatggatttcatcaccggacttccaaagacccaaggtggatatgattccatatgggtagtggtggatcgattaaccaaggtagctcgatttattcctatgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaacttcagcaccgcataccacccgcagacagatgggtagaccgagcatctaaatcagatcctagaagatatgcttcgcgcatgtgtcctggatttcgggaagacctgggataagagtctcccctatgccgagttctcctacaataacagataccaagctagcatacaaatggcaccctatgaagcgttgtatggacgcaaatgccggacaccgctcttgtgggatcaagttggggaaagccaagtgttcgggactgatatcctgagagaagctgaagctaaagtcagaaccattcgggataatctaaaggtggcacagtcccggcagaaaagttatgcagataaccgtcgccgtgacctggaattcgcagtggacgattttgtataccttcgggtcacgccattgcggggtgtacacaggtttcggacaaaagggaagctcgcacctcggtatgtgggtccttttcgtatcgttgcccgacgcggagaagtcgcttaccagttggagctgcccgcctccttgggcaacgtgcatgatgtgttccatgtgtcgcaactcaagaaatgccttcgagtgccatccgagcaggccgacttagagcaaattgaagttcgcgaagacttgacctacgtggagaggccagtgaaaatcctggacaccatggagggcaggaccaggaaccgggtaatccgtttttgcaaggtccagtggagcaaccacgccgaagaggaagctacctgggagcgtgaagacgagctgaaggcagcccatcctgatctcttcgccagttcttccgaatctcggggtcgagattccgtttaaggggggtaggtttgtcgcgtccaaaaacgactctaaaatacatcctcaaaattgtgcatagaataagtaaaatccatgtgaaagcctccaacaattaaaatgtgcaaagttaaaagtcgaataaggcttggaggatttttgtatatttcctaaaagcctaaaatgcgtaaataaattttagtggaattttca

SEQ ID NO: 65628 - DNA, 6762 bp, Oryza sativa
cattaatagaaatgaggtggtacaaagttttagaaagaggaaaagccaaatatgggaaagaaaaagaataagaggagcatagaaagaagaaagagccccggggggaggatttaaataatgttaaatatgtgatccgaattttgggcccacaatatattcggattatatagtttcctagtaggacttcatgtctatcctattaggtgtccttctattatctcctatatatactcttgtaaaccatatggaaaggggtgacgttcccattgtgattcccctacgtttgtaatcaactcctctatagtgattattgccggttgacgcccgtggttttttttcgcaagagttttccacgtaaaaattcgtgtctccgttgtgcatctattttcataacacacaattatatttacagatttaaggttctaactgcagcagctgacagataattacacacatgtttcaacttgagtagcgacagtttatttttcagcagcttgtaccagtctttccattttttccacaatgggaaattcattccaataagtaggaacatcaattgatcaattccattgatcaacaatgggagagataacgttgctgcaaaatgttgttgatcaatcacaagtatcctctgcagtcatgtcatgtaggaaaaacatcattgaaatggaagtgctagctgtgattctcttatgatggagcatgaacgagatcaaagacatcgcagttcacacgaaaataaaaaggattttaaaaaagtgaagcagtttaagctccagcatgttattctttagcttacaacctgggactagctttctgcttaaagtcaaggccttggatcatcggcttcatccttcttgtagcagctcacaccaaccggacgatcgactttactggagtttatcttgagaaagggtaggtaggtaatacattctaccatgagacacaaatcacacaattaataacccatcagttgcagatttggtaacgatcctgcaaggaagtcacaccacagagagagtcagcataaggatagtggttagcatttcattcgaaatcaatcatgtataatgatgttacaaaccatgatgactcatctggtcctgaatctgttactttaagcacagcagcctagcgactgcagattgatgggcctttggttctagcaaacaaaagataatagtaataaaaaatgttatgtattggttggataatatgtagaccacagcattccatagtcaagtttggcataagatgattagaaggaactacgtatactcaaactacatgcaatggagctatgagtttccagagaaatgttaatacaattcaagtaccgcgacagttagttctacaaatttaagctgctgtccatatcagacgcattaatatatatttttttatttattttagataatattataatttattatttattcgtagtaaagcacgtgcattcagcttgcataatagtaatggctacagtagatataactaaattcttttgtacccccaaatgcaattcaaaaatttgaagtgtttaggtcacaccactgcacaagtgagttatcgatgtgcattgtactctgtacatataatcgtattaatggttgactagagattctatacaccacactgcaaacttttagcaataaatcgcggtacatgcttaagccgagagttgccttttagggcacccaccaaattaaattgagctcctggctatctattatattatcaaaacagctatgaaaggaggcaccacgtttgctgtggatgctcgaaattcccatattaatcggagaaaaagaaaagaagagtcaatctaaaaataactgaaattcggaattaaaaatatgcaatattgatagatgagtccatataggaacccaatacgtgattaattaaaatttggaataataataaaataaattccaaaattagaaaaacaaaaaaagaagagttcgagtacgtaggtgacggagcgtggggctcctcaccgggagaccgcgcaggcccccctttgccggttcggccggggactcagggtgaaattctaagctctctgtatgtggaaggttcgcgaccgtcgaaagagcataagacacgggcgatgtatacaggttcgggccgctgagaagcgtaataccctactcctgtgttttgggggatctgtgtatgaaggagctacaaagtatgagccagcccctcccttgttctgggttccgaatctggaaaagtccagtcctcctctaagtgggcaaggtcctccttttatatcttaaggggataccacatgcaccatctccctctcttctgtggggacttactctaccttttcataaatggacggagatttgtatagttgccgtccgaatgaccttctgataggacggcccatacctacctccacttccgccggaagcaggtgcgacgtgggattatggctgtctgctgacgacatgaccagtgtcagactggtcacaaatcgctcattcttgtccaccacgtgtcagtttagcaatctacatgttggcccttcttcacacaacatcttgcctgtaatggttaggatgaagcctggcatatatctaaccaggactaacgtgccatctctgggaggtaacacgctagctccagctggggacaagcgcctagaagccctcgtcctgacgggatggggcgaggcgtgcgtcagatcgcctgtcgccacctaacccgcgatctgaccggtctgtgactggtcacaaaccggataaacgagtgcactgcactgcgttacatgcggcgtgacacgctcagccaaaccacaataaatgtggttaggtgagccccgctgtgctcacctaacccatacacgcggagcaaaaatccacgaggggtcggggcgcctcggccctcggggccgaggcgggtgcggcccgaccccctcggggggactaagaggagggcgaacacatcaccctcgggcccgacgtcccccgagggtgccaggccacgtgggcgattgtgtctgcctcaaacctctagtcatgatactcctgatcccatgtcaccgacagtaggaatacaatttataaataactaaaattcagaattaaaaataaaaattattgaaagaagagtgcatacaagaatccaatacgagataaattaaaaattggaataaaaaaataaaaaaatcgaaattagaaaaaaataagagttcaagtaggaatacaatttaaaattaacttaaattcggaattaaatataaaaaatattgaaataagagtacatgtaagaacccaatagtagattaattaaaattcagaataaaaaataaaataaaatccgaaattaggcaaattaaaaagatttgaaacaactgaaattgaaaataaaaaataaaaatatcaaaagaacataataataaataaaataaattctgaaattagaaagagaaaaaaagatttcaactaggaatacaatttataaataactaaaattggtgataaaaaaataagactattgaaagaaaagaccatctaaaacacatgacgagattaattaagtaacaggcctatggaggagcagagttgtggcggttgatgagacatctaaaaactattaataaaacagtaaatagaatcctaatgacgattaaaagaaaggatgatgggcagatcgtgaagcaatcggtcaaggcggttgtcggggacttctagaaagtaaaaacataaaccccaatgataatcatatttgatttttaaaatctcaattataataaaaatgagaggcagcgggtgggtcgtataggagtacaatggcagagtcgtcgatggttgttgcgtcttttagaaagtaaaaaatgaattccaacgatagttatgttcaatttttagaatcccaatgacaataaagattatgcggcggacgggtcgtagaggagtattttgacagcgtttgacatgatttctaaaaattataaaaaacatgaaacccaacaagacaataaactctaaaaactataaggtacaatttttaaaggttcgggcttctaaaaagtaaagaaaataaaccccaataataatcatgttagattttaaaatctcaatgataataaagaagggcggcagtgggcgagccgtagaggagtatagtgacaaagtcgctgacgttttggcggaacttctagaaagtaaaaaaaaacctaaataataattatattcgacttttaaaatagcaatgacaataaagagaagatgcaatggatggttgtagaggagtataatggcagctctgacgagacttctagaaattataaaaaaagcccaacaggacaaataaactctaaaaactataattttttaatccaatttttaaaggtttcaatgagaatgaatagaaacaatggtagatcgaaaaagctaataaaaaataatatgataaaagtaaggggtagcaactgatgtgacttttaaaaactacaaaattagaaacccgaggatgataatgtttggtctttcaaaatcttaagacggtgagataacttttaataaattttaagtaaaatcatattaaaaaaatatatgattttatacgggtgctagtcgcgcaattgcgcggaccacccagctagttcttattattaaaagaaatgaagaaagtggagattaccttcgtagcaggcatctagctctttctcctcgatgtcatccagacgttgctgcaggctcggtggaagcacctttataccagaacaataactaactgtaagagatgtaagagatgagtatgcttgaggccccttcggcaaggataccaggctctcgcaatcaaaaagggtgagttgttgcagcgacgggagctctcctaagcaagattccagtgatttcaagctctggcacgattctatatttaattcttgaacggcatccagctttcctgagagggactgaagttcttcgcagcaagaaatatccaatttcttgatggacggaggaagatggagaacctccaaacgatcacagttccatattactagagattctaggcgtggaagggtgcgattgttggtctcgctggtggagcctgatattaatgatgacttatccggctgtgcaaagctttctgcattcaccaacatcgtcctatcctgctgctgattgaatatgatggactccaggccacggcaccccctaatgtctaatagcttgagagacgcaggtaggttggggacttctacaaaagaaccacaacagcttatctgtagggactctaaacgtggcaggagttcacttggtgctggtgtagattgcccacgagcttgtgtgtgtcctgtcagattcttgcattgataaatactgtacctaacttcctcaaggaaaccaagccctggaacaccttttctggccagtagagaagcgcatcgactttccgaatattcagatctatgagctgaacaaaacatgtccagagagccagcgcacttgggtgagagaataaaaggttgcacccatttaagttcataagttcaaggggagatttatgattccatttctcatcctcaatcaccaattcactcgaatcttgttgcttggccaccgatgttgtttctgtgccatcagttgacaaatgcagatggagactggacaatgaagtagtatatctgctagctgcctgtagggatatttgttgattgccttcatgtatgtttaagacacttagttttggtgcttcaggtagagtagtcagctctgggcactcgttgattgttaatttgtcaagctgaggaaatgctacctcctcctttagagttccatcgactgcctcccatttctgaaagatatccaaatcatctaattccatttccttcaatgctggaaatgcagaacgacacacggtgctaactccgctagacgattctgaaatcacatttgacgcttttggtaaggcagttagcctagggcaactttcgataaacagcttttcaacctcaggaaatatcagctcttctccttttacctcatttgtgtcccaccatggctccttgaaatgttaaacacagcggtgatcactctgatccccaagaaagactcccctacactgctgaaagactataggcctataagcctcatacatagcttcgccaagttagcagcaaaggtcatggcacagaggctagccccaagaatgaatgaacttgtgccctacacacagaatgcattcataagaggtcgatctattcatgaaaacttcatctttgttaaagggctcgttcagcaataccacaggcaacacaaggaaatgattctactcaaactcgacatctccaaagcctttgacacagtgtcttggtgttttctattggatatgctgaagtggagaggtttcggtgccaagtggagattatggttggtatctctgttcctcacggctgaaaccagcatccttatcaacgggaatgaatcaaacccttttaagccggctaggggattgcggcagggagaccctttatcgccactgttattcgttctggcaatggatgcactgcaagcagttgtagctcaagcgaaagcaagtggactgatatctgaaccagcaccaagacgcccagttccaagtatatcaatatatgctgatgatgcagtattatttttcaaaccaagtcaacaagaagccaaggtagtcaaggcaattctacagatttttggtgcagccagtggattaatgaccaactacaataaaagtgcaatcactccaattcaatgcagtcaggaa

SEQ ID NO: 65629 - DNA, 5380 bp, Oryza sativa
tgcaaactaatgttagttcaggcaattactctgaattttctgatagacgaacctgattttttcatgtcaggtgccgtgcttgttcagattcagcaatttacatttccaaagaagaaaaaggaaattcatacattttttttacttttttgaaagtggcctggattttcatgatttggttaaaatttagcctttgtcgtaaggatttggatcctctatccagacacatgccttccaagataaacgaatccctcattatacaaaaaaaagcacaaaatgctcaacaagaagcttcaaattcgtgtaaatacatgtcatgtctcgctaccaaacaatatctcaacaatgacaacagattggaggtattcatctcacaatgatacatttcaacacaaatttatgtaggcctcgctgacaggacttggctggatggctgtcagttcagttcttgaaccaactgaagcatgagcagccctgcaaggaagcgataaactgaattaaaatagggatttgttacacaatacctgtaaagtggattacattaaaatattaccaaatcatactgtaagcaatcatgcagaacaagattccttgcaaacaacactaaccaaacttctagtaaaaccattatttttgctgtagtaccaactttttgcaaccactatatactccagtaaaaaccagaagtattgttgcaatgactttgccgataaattatagaatgcagctactcgaagcagtagattttagacaatttttactgcataataactacgcatggtgccatgatccctaaaaataaatagaggtataccaagctcaagtattgacaaactcaagtggcaattggcatatgaacaattttctcgttcaaatatatctgaagcaatgtgtaaaacaaaatagttttgctccacacatctgaccatattttttttgagtaagtagacttactgtggattcatatttgcgttgttgatagcgtttgatataatctgcctcgctggtcatgacgggagcgttgccggtaccagactgtttctcctccctcaccttctcaaatatgtcagtgaaaccttcacctgtagaaggatctttctcatcccattctccaaactttggcacggctgatcctctatcaggctgcaaacgcaattaattacttcatctaaaggtatttttatagtcaatgaatcaaagggcagtttacttaataccatgcatcataagttagagctttaccgtctcatcaccacggccagttgatctgaacttggaccttccaggtgtagtgggagcagatccacggtttccttccaatgaacccctacggtcacgtgaaggagacgaaactccacccttgtttgcagctcttgcctggtgacggggatgaacgggtgacttctctatgccggtttttctcacagcattgtcatagttggtatgatccccatatctatgattaggtgactcagcatatggttttcgaacagtggtttcgtgctgacgaagatcaccttctcggtttgagcgtctgtcatccttgggctttctcatggctggatcagatccagcgtgcaggggagaggccttagagagtgcttcagtatctccatgatgattgtttggattaacagacctccctggagatttacccttgcgggcattttcgaaatactgtgtgtagaggtgttcaccacggtcttcatcctcccagcttccaaatttaggaactcctttatgctggtaaagtttaacaaagaactatcatattattgaaatgcgctaagaaaaataaagaagcacatatactccgaaaaaagagctgatgaaaaaaaaaagtctagagcagacagcatgctgattgctgaatctactacatgagcttgttgccttgtcagttgtcatcatgttttctttcatatgtaacaggaattataattctagcctaaataggcatgattatctaaactctcagatattatctattgtaatcatgtatgcatgacatcagctttgtccgatcaaccagaatttactcagatcctgctatctatactgcttgaaagaacttgaatgtaactacttgtgcatcttttctgcaggaacactactaaggatgcattaaaaggacaggtctcaaacgagcaagtaaacaagctgtatcaattatcacattcacgaagctgagatcttttctctgcacgagattcctgcattaatatattactcagcaaatcagccctgcaagcatgccatgtcgacattcttgtaacattgaatccgcagcataaattgcatccttgaatgcagaaaggctggatcttggcagattggataactacataattgagcagaaaaggacatggcaacaatttcggtttcagattggcacattttcttgggaaattaaaaagatcccaaggaaaatagccccagaaggaggcaacaagaaaatgattccacaagatgcaacctgtctcctcaccagtaaacaaaaatactgcaatttaaggaacccctaacattgggcaccgagaagaaagaaatgacaaagcaagcatttctgcaaatcagaggcaaccccgagaaatcccacatggcaggagaagcgcccaagacgattcgagcaaacccaaccgatccaagcacgatgcaacccaggaaacacaaacaggccagtcaatcgagcaagaacttacggccatttcggcagggaagctccaagaacagcagcaaaggtgggtccttcacgcctcaggacgctgctccttgctctaatcctctccctcctggattccgaccaagaaaattgttgcgttcaattcaacaaggtcagtaaaagaagaagaacaagtgacccccaatacgagagcagcagcagtagcagcaggaagagactaggaagagcaggaggaattgaaaggaagaagaaaaggtaggaggaggaagaagatgaggaggagtcacgtttgaccattatggcgtcggattcttgctgcttcctcgcttgcttccccttcctttccggctgctgatgatgctgaatgcggtgggtgatgtggtggtggtggtcactgccccggccccttcctgcacgggcctgtacctatcgccttaactccagtttcaccatcatcgtggtggttaaccacacgccaattatccattaccaccacacacacacgctttgccctgcaatgctaaactgtaaacagtaactcagctttaagaattaagcagcttagcttaactgctcctgttgctgacgctgtcaatgctagtgtggcttgaaggctgaagtgctgaactgcactgcacagcggcaggtcatcgaacattctttccttggttgactcaggagtaaaatctccttcgtaataagggcatatgcatatctccttcaaagattttttttataaatatttgcagctacgtatagtagtataaaagcaagtttaatagtatagacaactactggctcctaatcatctatagttaatttaatagctaatttatacaatagttatccataaatatatactacacaattcatatttggtcccacatgtcatacacacatacatatttagtctgtgttacagctggctacaaatctgtaaaccgctgatcttctctatcttcttttatcttctcgaaatgtgtttatagctggtttacagtttgctattatctaagctctaatggtaggatgattatcatactgttgcagcaacgacttcttcctttggtgttgctgttgcgtggaattctcatggtatcatcgtctttcgccctagcacggagctttggtttgccctgaccggtctaacttggagtctactgtggtccaaactccagaccgtgatgattatgaaaagctcttatcataatttctcttttggaaaaggacttttctttttctttatgaggcatgcattattcctgtatatttttatttcagtagtatctaaaaaataagacaggcatcatttggatttcttcgggttccgaataaattcatgtaaattctctacatttcaaccggagaatgattcggtttagatgggatttaatgctagaaaggaccatatttgtgagcctaaaaggtagaaaaacaacatttactcgagctaacatgggggcaactttatctgatatctatcctagtcattgagagctaaaagtatgaaaaatataattatctctgaacaacctctttttttctctcttttcctagtcattgtctacagcctttttccaaactaatgttgtataagaaaaatactatacgtacgactaaacttgtgtgactttggaacgaccttaacgccgtgagctcgtgacgttaatctccgtataaccaagccatgttgtcaccatactcagtcacgtattgagttgttttaccgtttgatcgtacgctggtcggacatacaagtcatacgtatagcattgttcgttgtataatttgattacagactacagtcatatgagatgatagaacactgggtgtactgtaccttatttcaggattgcactgtatccctttgtcatcctccctcttctctttaggctcttctgtactttcaatttttcgtcacatcaaatctttcatacacataatttttcaatcacatggttttaatttcaaacaaactttcagaattaagtgtgaactaaacacacagtcttgtttgtttcgagtacaattactgtacatcgacagacctgcatcttcatccgatctacgtgtcgcagaacacaaactgacgacaacgatgggattttttttttttaaaaaaaaagttcaaattgtgaaaccatgtgtggttatagttcttttgtgatgggaaattgacaagtaccggatgtgcaagaagtgtgtgtgtggactaacgttggtcaggttgcgacatctgtgccaagacaacggttgtttggttcatgtgtgtgcaggtgatcggggtcgatcttggtcaacggcggatcgggactagactcaaggaggagttgaggtccaaagcgatcaaggatgccgggtgacaagattggacacaaggttgcacacggtggacgaacaccgtgtgaggaggtctttgcaacaggcttcacaaggtcaagtgtgcaagcatcggattcgcgaagaaatcagaagggactgtgcaagtgcattgctgctacagtacttgctgtaggtagcatacatgcatgtacacgtactgtacttgtgcaaggaggagcttgcactgtactggttgctactagcatggctcggtggaaaagtcaagctagctagctgtgcatgtgcgctgtgattggttggcagggaggccaagccaatccagccgttccacgtggcccaagatggtgaatggctcgg

SEQ ID NO: 65630 - DNA, 1564 bp, Oryza sativa
tgctatatgccatgatgcttttatttgatttaaagaaactttgttttgatatgtgatggatattttttcttacttgcatttgtttccatgatgcagggacagtatagcgatattggaaccaaggactatacatctaaattatcagtgtactgaggttcatgatagtgctctgctgaagaatgtggagattattgcaaaaagactcactaatgcatccgtgatttaaggtacttctggtagcattggagtctataaaatttccctacacatctttgatttaaaatattttgctttatgcatgtgtatagaattggagcctttctcaacaataatataagcttatgaacatgaaattctgaaagatcatcaagatatatctttcttaatctaaagagttatgatgatcaggtcaatttttttttcagaattaagtttagttgcatggctaaattggaacctattgtacttgctatgccccgttgtaatgctttggaatttttaagagctccatactgatgtctgctgatctggattggtataagtgttggctatgacattgttttcaggcaattggcaatgtcgtgctgcattgtgaaccttcttcttatcaccctttgatgggttggaggtatagaatcgagatgattgccaaaaatattccggtaattactgccaataaataagaataaaagcagagcggacataaggtaaaaagaaagcagaaagacattcatctagtcgtgttgtatttacttggtttttagagcatgataaacattaaggttcttagagcatgataaaaaattgcaataattaaacgatggttcatctgtctgcacagttaatgtttttctgcataaaattgctcttgctgcaattaccaatactttttctttcttctagtaatatataaagccacttaaaaaagagattttcatgtttgggtttgcaactcctagattttgtggtggtatgttatgaaaatagccgctgagcaactgaaatgaaaatatgcctgttgctaacttgctatatgtttctgcatggacagaaaaaagaccttgggtagttttattcaatattaatcttataaatctaatgaaattgaaattgcattcagggttgagttcattgataacctggaatcgacattaattggaggtggcttgacatcctagaggaagaagagccttgtgatctatatcttcttgtgcgcttctattatttgtattgcctgtaatcatatttgtgtattttgtcctgcgagaaaaatctataaaatcacgttagtgggagtgctagctaaatatagcggaaacaaaagcgggatagaatctgactcgggatagaatcgggatagaatctaactcctgacttgggctgcgcaaacaggagcaggaaaaggtgtgggcgaaccaacctgactcgtatgcgatattgttttcttgcgtgaacctggtaaacctggactctgtttttttgtatgtatattttgtgtgtgaactggactcctgtgttttttgtgcgtgaacctggactactgtgtttctgtgcgtgaacatgg

SEQ ID NO: 65631 - DNA, 3382 bp, Oryza sativa
aatcctgccctccatcctatataaggtgggcaggaggccctctagggggcatgagcacatatgatcgtcagatctatactacacctggcggattcaaatccctaaacaggagtagggtattacttctcatcgagagggcctgaacctgtctaaatcctttgtctccgcatccatccacttttaggtctcgtgtgctaccccttttattattgctgaattcatgtttcaacaatcgatatcatatttttcttttaatcgccgaatatccgaaacattaccagtcttaaccaatgtcgcagtcatgagtgatacatattattttattcggtacatgattctagtgaccactctgtcgattatgagatgaggggtgattgtgcggaaaactaagttaattgactatctcagtgatctagattaacagctggacaatcacaagctaaatatataaaaaaaaggtatgctgtaggattggatcgatcaatatcgagttatatactccctcctttcctaaatgtttaacgccattgactttttaaacatgtttgactgttcgtcttattcaaaaacttttgtgaaatgtgtaaaactatatgtatacgtaaaagtatacttaacaataaatcaaatgataggaaaagaattaataattacctaaattttttgaataagatgaacggtcaaatattttttaaaaagtcaacggcgtcaaatattttgagatggagggagtattaagatatgtaaactccacagcactagttgattctcctgaaactcattaatttgaaagggaagattaagctcaatgcaggagtgcagtgattgtgcagaaaaaataatttaacaaccccaagccagctatgtttggactacaatgatagctcgacgatcgcaagctgcatatgaaaatacgaattaatgctgaaatatttgggtacggtatcgcattctaaactagtttgctctacaatattatatgttagtatttattaattacatactctaatctatagtctatcgtgaaaataagatactatatatattgaacatggcagggatatttttcctgttatctaaaaataataacgcgcgatgcaatggaattaatcatgatagcagccaggtacgtagcagctccttctaatataataaagctcgtgtaaagattttgctcatttgatactttgcacgatgttagaggacatgaagtggaaaaagggtccttgatccagaccacagtagctgtggattgaatggcagacccaactttaattgtaaatttagagtttggaagatatgtcttttatagttctcttaatgtatgattttgttcatggccatgtgatcagggtgttactacatatattatggtattgagttatatatatatattatatgtggtctatagaagaaaaatatttctatttcatttcattaaacccacggaacatgtgacgattttttgagaatttctctaagccatttactaatgcagatagagttcgtggctacctagtgctaggtagctgatatgcttagtataaaaacacagagacagcagcaagaggctccatccatagacgcatcacataatcttctatctctctcaggctaactaatttcataagcacacatcttccatttccatcaccatgcctggagcagctaccaccgccgccgttgttgacagccgccgtagcgcacagcgcgcggaaggccccgccaccatcatcgccatcggcactgcaaacccagctaatattgttcctcaggataactttgccgactactacttcggcctaaccaagagcgagcatcttactgaacttaaggacaagatgaagaggatatgtaagaagatcgttcaatctacttatcatatgactattattaattattttccatttacttcaatcagaaacaagttatgcaagctcttacatttctagcaatatcatgccatggttcctaaaccacacatatatttattctatgttgaaaagaatgtaggctctacgtgtcctatatagaggttagatatatatgccgcactatctagtaatcagaaatgaagagtatgataatactcgactttagacacgcttcataagtgtttttgccattttgcaatctaagtgataaatgcaggtaaaaaccaaattaatggtctttgtcacgttaaaaatcaggcacgcacaccacaagcacttacctatgagtgaggagttcccacttttaattagatctcaacagagggagtcacaacaataatctctgggtcttactaaatttttattgaaatctcactaaattgtttattattgctggccgggactaggatttaaatactacatcatgagaccattggtacttcaacaaaaccatgtgccaagtcaatctttccaaattttaaacatgtacagcttcctaaatatttggagaatacatacgaaaacaaattgcgtgattttgttctggaaagagcattataacatatattttagttttgtaattatttgcaacagagatataaatctgcaatgatatgttctatatattttttctatcctcaagactactaggtacaacctaattaatagaggcattggttcttccttttaattataggtaaaaaatcaggcatagagaagcgatacatccaccttgatgaggagatcatccgtgcccatccagagatcattgacaaacaccagccctcccttgaagctcgtgttgaaatcgccgccgccgaggtcccaaagctcgccgagtctgctgcaaggaaggccattgccaagtggggccgtccagccaccgacattacccacctcatcttcagcacctactctggatgtcgtgcccctagcgctgacctccagctggcatcgctccttggcctccgtccttctgtctcccgcacaatcctcagcctccacggctgctctggcggtggcagggcgctccaactcgccaaggagcttgctgagaacaaccgtggtgcacgcgtccttgtagcactctcagagctaaccctggtatgtttctccaccccagacgaaagcaaaattgtcggacatggactgtttggggatggtgccggtgcaataatcgttggcgcaggcccgttttctgatggcgagtgcccgttgttcgagatggttgctgcctcacagaccatgataccaggaaccgagcacgcacttggcatgcaggccactagcaccggcatagatttccacctctctgtccaggtgccaatgctgatcaaggataacatccagcagagcttgctcgaatccttccaatcggtcggatacacagatcctgactggaacaatctcttctgggcggtgcaccccggcggccgtgctatccttga

SEQ ID NO: 65632 - DNA, 1689 bp, Oryza sativa
atatatacttaaactaagtaattgggatagatcggtcgccatgccgagacaatataaatcacttaaatcgaaatatatattaaaacatgaattatatagaagtttatagcatagccgatcaaatagacctagcatgtatcggctaatactccgataccactctatatcaagatatcgagacaagcaagatatatcaaataataaacctaatataactttaacgcaacgagatcttaatataaagggcatatttaacatatcagtcaagtgcatgaggataaaatagctaaatcaggtaagatcggctggaactccgatacatctctattgatgatcataaaccaggctagatatcacaattatagatagaacttaatagatcgaactcaaccgatgtagcattaagcataaagataactgtaagatctaaacaagatgatgaaaacctcttagagatggtagatatacgatataatctagattaataacgagatctaactctatcggctactttctaacagtaaaaaccagccgatggcaagttatatagcgaaactaacagagattataaagtatatatgataactcgatgaattacataaacaagattagagtatcataaagatggaagcactaatcccgagaacacaaaccgccatgacaagtttacctctagttgaagatcgaatcgatgcagcttaaccagaaagcaagaactcgccgaaatagaatgaaagtaaaagggtggcgatgcgcggaaagttttgttgaacgtgtgttgtttgattacatgggttcgagtcatatttatacctgagattacaaaatatgtccttgccggatacgactcttatttttaacaaactctaagataacataagtctttgcggcagacttttgcccgaacatatctctaaggaatttacataagatatcctaattaatagatacaattgcctatctgagagctttatctccatcgtggcaatccttgtgaagcacatcgatcgattctagaaacagactcagccatcggaatcggctgtaccagctgtatcattcatcctctgaccgatctaactcagtcgatgcatactcggttcttcgaatctatctctttgccaaatccgattcgattccaacgtcgaacctggttcatatcttaccaaatttgagctttatctcaatcgtggcaatccttgtgaagcacgtcgatcgattctagaaacagactcggagctatctccatcggaatcggctgtaccggctgtatcatccatcctctatcggctgtaccggctgtatcatccatcctctgaccgatccaactcagccgatgcatactctgttctttgaatctatctctttgccaaatccgcttcgattccaatgtcgaacctgattcatatcttaccaaatttggtcgttaacagttacagatgacacacatctcaatcgggccaacataaaagcccgtcacggatgactctcatgtaacgtctcacccctccactttgtcctaactcatgtggaaccaggatgaattttccggttagtgactcatcccaaaattgctccaggccaagcacgcttaacctcaatgttcttgggagttcgacttccggataataagttgtaacttattggtatgagtattctattaattctattaagccctgggccaggatg

SEQ ID NO: 65633 - DNA, 984 bp, Oryza sativa
tggatccctttttgaacgagagccataatttactcttcttttgctttatctttattatcttatctgaggtatttatttgcttgggtttttatgatgccatcttgggcgattcgaccgcaggacgaggtactcctccttccttcctcacaaagtcacaattgtttccgatccaaagtttgagtttcggttgattgaaagacgatgagcctcccgcggcggtttctgaatctgatcgtggagaacggggcggatcctggcatcagatcacttagctgcatcgacttgacacgctacccactctttcacccaccgttaccaacggcaacaacaatggaagcgtgcagcagcagcagcattatttcgcagcaacaacagactgctgatgccttcaatacgaagaacaaacatgcggatggggcagcgtttatggtgcaggagaagttccagcttcccgacccaatcttcagcttcaaagctcaagcggctgatcctgattacgggtggaatatcgactgcttcccgcttgcagatcgcaaggttgtctgcgtggaccagtctggccgcgcattcctcttcgacgccgacacagaccaggtggtgacaatgccaagcctcaacaaacccaagtggaggcccttctccctcttcgtccccggcacggacaacgacggcggcgatggtgaaggcaacagtctctacatcatggagaaaagccccaaatcagaggcggggtgtagcgcgcggtgcatcgatcagttcgaggcctttgtctaccgcaagcccacggtgacagcgtcgttcatgtcgtggtactgccagctgctcccgccaccgccatacgtccgcgattacgcctacagccagagacgccatcgaatcacatcctatgccgtggttgccggcgatgacgacggttcgtggcgcatcctcgtatcggctgaggacgcaggaacctactgtctggacgtggccagcaacatgtgg

SEQ ID NO: 65634 - DNA, 684 bp, Oryza sativa
acgtctcgcaggaattccgcagtaacataacagttatcgtgcaataacatgacaaactttctcgtagtaacaacatcgaaaaatagtcatgatggatctagttttgttaagcacttttttacgaacatcatggtgcagacggattagaaacatactatataatgtgagagatattgctctctaaagattgagatttacttttttttaagttctcttctctttagaaaaccgtagtaacgcgacgatcaatgtgtagtaacacgactactttccacagtaacaacataataaaagcatttttgtcttaatcatcgtgtagtaacaggactattgtctcgctgtaatatcgttttaaagcattatggtgaagacggttctaaaaaataatatgcgatatgagagatattattgtttaaatattataattctaaaagtttacttgtactaatctttctactatgtatctttgtatggacaaagagaagtacttttagcacttgtgttaagttgtgactatgcacatgcactttcttagcactttatattttgcactagattgagattttaaattttagctatgcacatgcagtggtactgtagtagtaccgttactaccatatgttctctgttattgcaatttcataatgatgttactgcaaaaagtgcagtaacgacctataaaat

SEQ ID NO: 65635 - DNA, 22088 bp, Oryza sativa
tattgcgcaataaattatttaaggatttttgttatagtaataaacacagtgaatcttctaaaattcataactaattcatccgagctccgtttaatcccattcaagtctcattaaatcaagaaaaatgtgtagaatccattaaaaatggttttgttccctgtttcagtagtcttatagcctgtttgcaatgtttgccttgtatgtcgctagattccggcaattccgacgctccggtgtacttcgagatagtcgccgaggttccttcagcagcagagcaaggcaagtcatgcttgtcacttgatcatattgatcctatattgcaaatgtcctaatgttttctttcaaataccgcatttgttttgcaatattactatgggatggttacctattgttacagccatgctattttgataccatgctcctttgttagcttgggttataacatgattagagttaggactagggtttgcttagccatgcttagttcaactagcacacaatggggagatctcatttaaaacctagactataggtttatgtgataatgttggattagtgacaccgcttgggtgttggttaattaaaatgaatcacatggtgggctgtgggtgcatggttctgctggtcgcacccatggcagttaaggaccggttcgcgggatgccctggaagaattcatcgtacttaccacaagccagcgtgggcaacggctgggcttgtagtgtggctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaatggtcctgtcacggcctctttccgggatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtttcaccctagttagcttttggaactgattagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtacagtgggtagtactcagtcttgctctcttttcccccacaccagagttgaagtcctttccagttgaagatgtctcgaagaggttggtttcgtcgctgctgtcaaggatgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaccaagcaacctggtaacgacatcgatgtgtacctaagaccactggtcgaagatcttaaactattgtggaagaaggaaggtgtccccgtgtgggacgaggacaaacaggaggagtttaacctacgggtgctgctgttcgtaaccatcaatgattggcctgcacttagcaacctatctggacagtccaacaaggggtacaaggcttgcactcactgtatggatgaaatagaaagtatgtgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgagaaaacagtgtttgctatggttaaagatcttaaagtagtgttcggaaaggggcctggaagccagcctatagagagcgaagatggtcacgcggcgatgtggaaaaagaactctatattttgggagttaccatattatgaattcttggacgtacgccacgcaatcgacgtgatgcacctcactaagaacctttgcgtaaaccttcttggcttcctaggtgtatacggaaagtcgaaagatacactggaagcacgtaataatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacacaatttcgctgaaggtcatcgatccggatagattagaagcccttcagaatgaagtggtgcaatgtctcgtcagttttgagtcgatatttccaccttcatttttcaatataatgacgcatctgctttatcaccttgtgaaagagatcagtattctcgggccagtgtacctacacaacatgtttccttcgagaggtacatgggtgtacctacacaacatgtttcctttcgagatttagccattccgctagttgctgcttatatatgttgattactaataaataatctctcacaacatgaaggtggcgtcgggcatggccatcccaacggacccttcaggtacttaccactgcaggcggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggtgtctcgtgcaccatctcctctggctccaccatctcctcctcgggatcctgcaccgtctcctcctcatgctccgccagcaccgtctccacctcaggctccagcaccgactcctcctcaggatcctgcaccgactcctcctcgggctcctacacctactccttcgcaagctcctcttccggcaccttcaaagtcaagggcccccctagctccaccgcctgcccacacaagggcaacgaagaaggcgaaagttgacgccgccaagaacaaggacccgaggtacgattgcacgcaagaggagcttgacgcttacgtggcatcagaagtcaagagacaattcaagcctcgaagtccagaaaagaagattcctatagacccgagtgtcaggaacttctttaggggtatgtctgcacctgtcaaggaggccatcaagctatcggactatgagcgaacgctgaagaaagcattttctggaaagtccaaaccagtccctcagcttggagagcaaccaaaccaggagatcgagccgttggtgaccggggaagacatgacgatagaagaatttattactgacaccggtctaactacggatcaattgctaggagtcgaaccaatagaaaaggcggaagtgaaatacatgtacgaactcggtaaaccgcttgtcaagcccgagctggtgcagtccctacccacacaaatgtacaagttccatcaactgtatatggagatgagcgccaccggtagagagatgatcggagcgaggatcagggacccggacttcttgcaaggagatgacattctctggatcaatttcaagggaatctacgaactataccagctggacgcccttgacgtctctattatgagttgctggattttgtaagtatatcgtttagttatatttcttaattactacgtctcctttaattaattaggtccttgtatataagtagactatataaaataaaatactcccttttatcgttgtagaatggagattcaaagggcccgacggcggagggttttcgatactggattcatcgaccctcggaaagtaaatgtcgcaatgctcaaccaatatccgcaagacacagaggacaatctcgtctatctcctgaaggcgcagcattacaagacgttcatactgttgccgtacaacacagagttagtttaattttactgtcttcctacataccaaatttcattcccgtacgaacttgctaagtgtttcatatgtaatgcatcccacgcacattgcagattccactgggtgcttttactcttcgacctgtcggcctgcaccgtcaacgtatatgactcaatggataaaaaagagtctacgtttgacaaggttttcgaacttatagacaggtactgtcataagttcctctgttaattaagaaattcttgttatgttaattatttctactacgaatcatatctttaaactccatgtagggcttggtattggttccgtcgtttggtccgcggcaactggagagaaagacttaggcggaagttcaaatttcctgtgagtacacatgctctacatttatatttcttcgattcaaattaatacatacaagtgtatattaattagatctcacgccgttaatttgtcatttatttgtagtgcgcaaagcaaaagcagggaactaacttgtgcggctactacgtgtgcgagtattgccactgccttgcagaccaaatcatcaccacaagagagctcgatgtacgtacaaataaattcaaaatttcattacgtaacgatttcttgtttaattactaatcaatttcatacattcatatagtttatttgcatgagggataacctgaccacacacaaggaatttatcgcggcggttcaagaacaactcatgtgattcatcaacgaagaaatccttgatcccaagggtgaattctactatggcggaaacacaattcacaggtccttagcttctgagctagcgactactactacgtcgaaatcgtagctagctaggacatataatggattgtaattaatacatgactacatatgtttctatatgcatgtgtacacattttctataatgtaaatatattttggtcatatatatatatatatagacacacacacacatatgcatttgcataacatatatatgtataaatacatatatattatgcatgtacatatgtactgaaccatatatacataatatatatatatatatatatatatatatatatatatatatatatatatatatatatatatatatatatatatatatatgtatggtttatatatatatagataaaccatgcagcaacagggccatgcaaaaaaaaaaggtcagcttgatctttagtcccggttatttcacccgggactaaagatagcgatctttagtcccggattggtagtcccagtttggaaaccgggactaaaggggggttacaaaccgggactacaaagggtttctccacccgtgtgtaaaacaaaataaagcaaacaaatactcaaaaggacatactccctccgtttcacaatgcaagacttgctagtattgcccacattcattttgatattaatgaatctagacatatgtagattcattaacatcaaaatgaatgtgggcaatactagaaagtcttacattgtgaaacggagaaagtataaactttttttagataatggtaacaaagaaaaacatagtattcagtcaaaaaaaataaatcatagtaatactatgttttttttctgaaaagaatcatatgtgctattgacttttggatacacgtttaaccattcgtcttatttaaaaaactttacataattatcgtttattttgttgtgagttgttattactaaaagtattttaagcataatttatatcttatgaatgtaagatgaatggtcaaacatgtgtctaattgttaacggcgttatctattaaaaatgagtacatacatggacatgactataactatgaagaaaaatgttaagtaacatgtaataagatatttcgtcatgcgatcggtaagtatgaaattagtgtaagtttagttccaaatgatttaatctagcttttctgcttgtattttaatcaagtaactaataataagccttatatgtcttcttatcggaaattagccttccaaaagtttgctaattcatctcatttaaacaagttcaacaaacttaaaatttcagtacagtagtgcaagttcaatacccacctttgtctgttttttgtgttagaattttaatcgtgcatgcatttgttttatgattggcctaacgacatgttcgctaactaatctctctttactcgagtaattaacctatgtcaaggttagggcagtcctatattgcaagacctatgattcaattaatcttttcctgtaatttaatgtatttatgagcgtgttggaaggagcgtctacgaagaaaaggtcaatgctacgacgcccccattaattccacaatcttctgtcttcacgtttggaaaatgaggaaaatatctcgacgaaacgataaaaacaaggaaatgtaaataaacaactaaaaatgagtgaaaaagataagtcaacgagaaacaggagaatatgatgacactcctccatcgctcgatgatcacttcatgttaaaaatctctatgacatatattgagatctcgctatctcgggcaagatattatttgaacgtgggaatttggttggattttgtccaaattgcttgaaattcaactaaaattgtcaaaatttaaaaattttcccataagtttacctagagatattcctatcttgtgtgccctacatatttcaatgaggtcgaaaaaaaagccctacatatcaatgtttcgcttagcttaatgcagtaacacaggcattgggatctcgatcttgttactgggtgcttcacactcacacatcgtaactctatagttcgtggggtgacaaaaattggagtgccttcccaggtttcttttcgattcgagttctaggaccagcaccgtagagagtagtcacaatgttaaatactatcagtagtttctatattttccggggaaccattgtttatatataagacagagctataaaactattcacataaaatttgtcctggcagacaaatttgcgtcgttatgcacacactcgctcagcaaaaatgactcaggtggccaaagtcctttcgctggatttgaggaggcactttgccccccgactatcatcggttgcatctgatcaattcacatgcctttgtgccctcctggctgagcacccagtgacaaatggccaaatggatgtgcgtaggtcaattcataacaatgatattctgaagacaagccatgcatacctagctgaatgttgcggacttcccccctgccccaacgggaagtttatatggaataataaggctccgctcaaagtctagttctttgcctagctcctggctaaagatcgactcccgacgaagagaatccttcataagaaaaacattgtgtcctcccctaactgtgatctttgcaattctcctgaagaaacggcttcgcatttgtgtttgcattgcccttttgctgtggcattttggaacaaccttcatatccatatcaacattacatcaatgagcgagctggcctcccttctcctgcctcatcaaattcctggcaaacattttagggtgttttatctcttgtgcttctggtgcctttggaatcatcgccatggagtggtcttcagacatgaagaagcttccctgctccggattttcactatgtgtgtcactgaagccacaatgtgggctgagcgactaaagtttgatgatcgtcatgtagtctcggcttggaaatctcttttttcttcttctattcgctctcttgatgtataactgaacttcctgttcctattgcgtcctaatgatcaatgaattcaagtggggaatctccccccccccccccggtgaattttctaaaaaaaaaagataaggaaaaaaaaaccattcttcaagatcaggcaagaaactagtaccatatgtaactctactaatacatatactactactttaacatgttaatttaataccactaaactcttatcatattaagcatattatgtagtagaaaagtcatatttttcatgattaaatctcttgctacatcaccatcaatcttaattgttagctcaactttagttctatgaaaccatccaaggtggagcattgagaatgcccttacctatgcttggacatctgcagtttgtgaaggttctttgaattgtttttgggtacttttcattgttttctgaattttacatgttccaaaatgactttaatttgattttaaaattttacttgtgttgttccaaattctctgagcatggtagtttttttttaatttttttaattattttaacagtatttttaatgcaatatatacgtttttattaatttggtggtttcgacctaatatttgtttcaatccaagcccatcgccgtggcactgctttctttgaaaagcacgtctcattcaaaatcgcagaattaatttcaatctattttttccctcgacgcatttattatccagccttatttttatgtttgctaataagaaatcctagcttaaattattattgaaaataacatttcaaaatcttatctttttagggaaaaaaaagctaaagtggggctaatatgatgaaaaattggataatgtgccattgtcaaaactgggtttcgccgaaatgctaccccgcaaaagagattcgttaaaatgccatttttcaccccgtggctacaagctataatgctatccgagaccaaattgcccttgccttcctctatcccccatcttctcttccaactccggctatccctgttttcctcatcctctggcgcggcggtgcagatggggaaaaggcagcaccgagcacgtgcgttggctggcggcggtggtgcaaatgggggaaagaatgctgcgacgcagatagggggagaaggcagcgacgtgcgtgtgcttcaggcggcggcggcgcagatggggaagaagggagcggcgcacgtgtgcatcactggtggcagtagcacagatgtgaagaagacggtggcggcgcagatggggaagaaggaagcaactacacatgcctaggtaagaagaaggagaacgagggtaatttggtcccgtatagcattgtagcttgtagtcatgagttgatattggcattttaacaaatcccttttgcggagtggcatttcggtgaaacctagttttggcaatggcagaatgtccaatttctataatatgacatgctgagatagctaaaacgcatgtcattgaggccttatcttttcgctcatgcttatcagcggaaactaaaatttgattgattttaggtttttttatcatcgtttattttcccgtttttttgcttttaaatcattaagaatacgtatataaaagttttattttaaattattttttatttataaatatgtcgcttgacttagttcctgaaataagacaaacgatcgggctgtgaagttgtatgtaatgaaagcaaatcaagtagggctatcactacagtagtaccaaaagtaaaggagaaaccgtacataatttgaaagaaagagaaagtcagaaaaccacataattatgcatggctctcgctgcaacttggtccgtgacccacacgagtcctattaaaaaaaaatcaaaacagcagtagttgagcttatttaaaaggggagattttcttttccttttcatttcgagtccacatacgtttggaggcacagaaaaaggaaaaaaaagaaaagaaaaacaaaaagtcagaacatctgcacttgatttcttattcacgcaactccattaaagtctaaccattgacttttttcccctgcccgctcttacacggcacgtctcattcaaatatgaactctcgcacagtgaggaatcccaaattgagaaggaaaaaaaatgaaaacaaatttctttttcctctgacttgtagctctacaactacgcgtcgttttctttattatttattcgtgtataaaaacttttcctttcttaattcttgccaaaaaaaaaaaactggtcacgaataatcgtctcctaaaaaaaaaaagtctctagtctcagcgcgataattctcccgcgaactgcgcactgaccccgcgtgaccaattgacatgtcggccacccaacaagtgggcccacctgtcagtgactgtgggatcagggagcgtctggttcgctcggtacgcgtagcgcgatgcggtcgcttgtctcgtagttggaaccaactagcccccgtgaccccacaacgcgtcggattctgattgggcgagacccacctcgtggccactgttgcatggtcaactttcccacccatccgagccgtccatcccatccaacggcgcgtacggatccaccgcctgacgccggtggcgccggtcgacgatccatcccgaccgtccgatcgggctcgcgcgttgactataaccggtccacgccgtgaccgccaccggctgctcccggtgaccgcgtcgcgtcgttttataaccccgactacgttagcctcctcccacttcttcttcttcttcttccccccatttctcacttactccggcgatcaccgtggttgagcgtcggcggcggaggaggaggcgatgattaccatggatctgatgggtgggtacgggcgggtggacgagcaggtggccatccaggaggcggcggcggcggggctaagggggatggagcatcttattctgcagctgtcccagactgggacgagcgagaggtcgccggcgccggcgcaggagcagcagcaacaggtggactgcagggagatcacggacatgacggtgtccaagttcaagaaggtgatctccatgctgaaccgcaccggccacgcgcggttccggcggggcccggtggtggcgcagtcgtcgggcccggcggcgtccgagccggcgccggtgaggtcgtccccgtcggcggtgtcgaggcccatgacgctcgacttcaccaaggcggcgtccgggtacggcaaggacgccgggttcagcgtctccggcatctccgccgcgagctcgtccttcctctcgtcggtcaccggcgacggcagcgtgtccaacgggcgcggcggcgggtcatcctccctgatgcttcccccgccgccggcgaccagctgcggcaagccaccgctgtcctccgccgccgccgccatgtcagccggcgcaggccacaagcgcaagtgccacgaccacgcgcactccgagaacgtcgccggcggcaagtacggatccaccggcggccgctgccactgctccaagcgccggtaaaaatcttcacgactccctccatttcccccacctcgaattgaactcatcggaattaattttccaggaagcatcgggtgaagaggacgatccgcgtgccggcgataagctcgaaggtggcggacatccccgccgacgacttctcgtggcggaagtacgggcagaagcccatcaagggctcccccttcccacggtgagcaccgcactgccccgccgtctctcctcactccgtcgacattaacactcaaaactaatcgtaatcccctcatttttgcagaggatactacaagtgtagcacgctgcgcggttgcccggcgaggaagcacgtggagcgcgacccgaccgacccgtccatgctcatcgtcacctacgagggcgagcaccgccactccccctccgccgccggccaggaccacccgccggcgccgcctccgccgctggcgctgccgctcgcctgagatacccccggtgaagaagagtgagaattagcttgtcggtcatcataattaccgttagaaattatttttttcgtttttctctctttttttttcttttttttactgcatcattgtagaactagcgtgtaaaacaattttaggagactttgagactgagcttttactgaagaaaaaataaagcagaacaaaaaaaaaagagaagaaggcgatcgagactatcagtagagtagagagtagaaaaaggcgtgccggaattgaagattttgaccgcgcatgcgaatttgtttatcaactcgggttcaatcccgcggattggggtccggtggaggtcaaaaggaggtggggcccggggtgttgaacgttgccccccgcccacggtcctcgtgcggggcccacgcgacagtgacggggagggtccctcgtgtgtgtaagtgtggacgacgcggtcaaagaacgcggcgtggggtggggcccaccacggccttggcctccggcgtccgcctcgcccgcgctgccaacgttgactcgtgtcagccaggctggaatcggattcgctacgcctctctgtctcactctctctctctgtgtttcgtatcatttcgaatgggacattcgagttcgatatcttgatgcgctgtttggagaaagttttataatagaggaaattatcaactttaattaagtatgataatacaaactgatattataatatggagtataaacgcatacgttcacaatgtctcacatctatgattactcacgcacaccctacccttacatatccagaagactttggtgatatattttatattgatgaaatcatcgtagacgtctgatcgtcaaccggtgcattgctaacataaaaactaattaccataaatatgaatacctataataagtgtagaaattgaaattaggtggactggttccatcacaagaaaatctaaccagttgacccatgctataagaaaatatgtatataaagttcttttaaaaaatacatttggatggtttaggaagtgttctcaccataaacaaccgagttaggaagatttaaacgtaattacactacaattattttatatttatatttgataaattttatgaagaaaaattgtcatcaaatgtattgaaaatttgatggggattatgtattggggtgttgctgtttgtttatacctgtaggaccatgatgtgttacatgaaggattgtcaatatcccgatcctgactatcttggttacatccctactacgtttaatgaatggagtagatcggatcggaaaaaaaaacctcaatcattgtctagggaagtagggattatattattagtatactactcccttcattccaaattgatctatatatagtttttttaaggttatttttaaatgatctacgacatatttatgttcatttattaagtctattcgttatttgtgcattggagtaaatggacattaatgcatgcatccatgcatataagtatttataacccacatgcaatatcttgatttgctattggttaggaaatagtatggatggtgtatgcattgagtttgttgctaaagtaaatatagtataagggcacctacaatggttatctatagactctctacaagagatccatgtcagcatattttcctactggaaagagattaaatgaagagagagagcaaaactatctactaatctggaaatagtctatagagaaaaacgaggcaatggattagagcaagttcaatagtatagccaactaccagctccaattcatctatagccaatctaatagctcattcatacaatagttacatgctacactattaatatctggtcccacctgtcatgcacacactgtgtcttggagtccgtgatacagctggctacaaatctgtagcccgctgcccttctctctcttcatttatcttcttaaaatatgtttgcagctggcttatagcctgctattgtacctgctcttagagagctatagatacccatgtagacatgtcattgaagtggtttactattaatctagtctattgctgagatgtacatgttttatagatagcaccttactttaccattgcaggtgttctaagagagttattagctcttttttttatcttggtgtacctatgaaatatgtagatcaatttgaaatgggggagtattatcatggtgattttgctagatcttgacagagattttattgattagtggagatgttgctaagccatgagattatacgtggtgtttactcatcaacctcgttcctaattcccgcattacgcgtgagatctcctccggatggagactgtcaccggcttcgagctataatgacgtgatctctccgtttcatattataaaccgtttgatatttttctagttaattttttttaatttgatgaagtttatagaaaacatagtagtaacataaaacaaatatattataaaaatatatttaatgaagctaatttgatattttatatattactaaattttttctataaacatgatcaaacttaacatattagaaaaaatgttaaatggcttatatataagatggagggagtagtatgaatgaggagtggacaagtgaatgataggagagagatccaacagtgttgagaacggctgtttgacttggctgggaggcagcctgcatgggtacgtgtccgtatgcccactttgatacatctccgttctaaagcacgtgacgctggtcccacctgtcagcgagcacctccccttttggtttggcaattctggtggggccggaggatgctagggagataggttgggtttggattgatttttgctttggaatttggtttgtggatggaagcggtggcaacgttggaaaggaaaggggatgaaaggaggagatattggtgttggtggtgggtttgagagagcaaaagtcaaaacggcatctttcatctttttgtgtccagaggggaggggggcaggtgggtttgtcccattgggtgtgaaactgtgaatgtgtgctcttgtgtccctaccaccactatgctttggaggctggatctgatgtggccttccgccttcgatgccgtctaacctaccactatgagcaagtttaatagtatagctaactactagctctaaattatttatagacaacttaatagttaattcatacaatagttatctataaatatatactacacaattaatatatagtcttatctgttatacacatattgcgtcttagaatctgtgttgcagctagctataaatctgtagcccgttgcgcatctctctcttctttaatcttctcgatatatgtttatagctagtttataatatgctattgtacatgttctaactgcttgttcgactagtcatttttgtggttgtacctgtggttagggtttactccctccgtaaaaaaaaagacaaaccctgggtttttgtgtccaacgttggaccgcccgtcttatttgaaaaattataaaaaatttaaaaagacaagtcacgcataaagtattaatcatgttttatcatctaacaacaatgaaaatactaattataaaaaaatttcatataagacggacaatcaaacgttggacacggaaacccatagtttatctttttttgacggagggagtatcttttaatataaaaataaaaaccgcttctcatggtttatcgaaaaccgataaaaaactgttaaatgtggatagaaatgattgaacgagagagattgagcgagagagagaattgaacacaagtagagcgaatcgatggatttctcattgatcaacagttcatttatacaatgtgaagcggtgtcaaccgcaagggacgcgatgtttgtcgagagggacgccaaagggagagagaggagcgatctcctcttctctgccagttagtttaggaaccgttgttcctattttcttgggtggatgagatcacccgtagtttcttaacactcccccttgatcgaatcaacctgtgatcattgcttatttattgttccaggtatctgtaaagataatcttagaaacgataaataattagtaattaaatatatcacgtaaaactcctcgaaaacccagtgggaaaaataaggagagaaccatgatgtattattgactatttttagatctctatgattaaagctcatagtatgatccaaaatagtataatgtctacagttattatttagtaaaaaccccagtggggaaaagccaaatgataggacatataagcttatgttgatattatctcgttaaaaactttggatgagaaaacctaaagggtaaaactcatacaaaggaaaaagagtataatatcacgaaaataggttattttccagaggaagatactccccttgaatcctgcaaatttttaagtcgtctcataccaattccttcgacatatttaaagaatgtggagtatggtagagattttgtgaataaatcagcaagattatcacatgacttagtttgcaagatatttatctctccatgttgctgaagctcatgaggataaaataatttaggagcaatatgcttagtgatgttgctcttaatataaccagttttcatctgaacaacacaagcggcattatcttcatagataatggtaggtgattccaatgaaccaataccacaagatgttaatatgtggttaaccattctgcgaagccatacacattcacgtgacgcctcatataatgcaattatttcagaatgatttgtggaagtggctaccagagtctgtttagaagacttccatgaaatagcagttccaccctgtaaaaatacgaatcctgtttgtgatctggcgttgtggggatcagatagatagctagcatcagtatacccaattaaagtcgaatcctggttctttttaaagaaaagtccaagatctcttgtgccattaagatatcgaaagacattcttaactccagtccaatggtgtttggtaggagcagcgctatatcttgctaatagattaaccgagaaagcaatatctggccttgtactatttgcaaggtacataagtgcgccaatagcactaagatatggaaaatcaggaccaagtacatcctctccatcttcctttggtctaaatggatctttctccacgtctagagatcgaaccaccatagggattttggaaggatatgacttgtccatattaaatttctccaaaattttctgggtatatgcactttggtgcacaaggattccagaaggtaaatgctcaagttgtagacctaagcaaaatttggtttgacccaaatccttcatttcaaattccgtctttaaatgatgacgtgcttcattaatatcttgtgtattgccaatgatgctgagatcatcgacatataccgaaataatacaaaatcctgtgggggactttttgataaagacgcacgggcaatcatcatttttagtgtatccctttagcgaaaggaattcacttaatcggttgtatcacatcctgcccgattgttttaagccataaagtgacttctgcaacttaacacaatacatgttacgatttaccttctgattcgggatgtcgattccaccaggaaccttcatgtaaatatcagaatcaagtgacccataaagatatgctgtcactacgtccatctactgtataaatagacgattttgtactgccaatgatattaaatatcggaaagttataccactcataactggagagtaagtttcattgaaatcaacgccaggtttttgcgtaaaaccttgtgctacaagccttgctttatatctcaccacctcgttgttttcgttccgtttccggacaaaaacccatttgtatcccatagggaagataccacgaggagtaggcattacagccgagaatacatctcttttgtaaagcgaggctaattctatgtcaattgcgtccttccatttgttccagtcaaagcgcttttggcactcttttatagacctaggttctggatcaacttggaggcattcagcaatttgttcagaaaaattagtgtcgacaattgtagctcttctatcaaaagattctctagtttcagagtaattgatggcaatttcatcaacccttatagactcattgtgatctcccgaaacaatgtgtctatggtcttccgaattcctagtctcagcattgtgcaccaccgagctaggttgcagactatcatgatctgcttgacatatagtatcaatttggtgtgtaccaactaaaggttggtttgcatttaccgtctttctttgcttattagcaattgtttctcgctgagtggccatacttcttcctctctttttagtgagtggaagttgagtggttttatttggtacctccactctttctggcgcattctgagcgggaatgaaagatttagtcacacctttaaaattggtaaatgcatctggcaggttatttgcaagtctttgcaaatgtataattttctgaacttgaagttcagcttcagtagtacgtgggtctgagactggaataccctgggcatcccaatcaatttcctggcattctttctggtacttgaattctccccctaatgccggaaaatgttcctcatcaaagatagagtcagcgaaccgggcaataaatagataacctgtttagggttctaaatactttatgatcgacggagatttgaatcccacatagacccccactttcctgtgtgggcccatagcggtacgctatggtggtgagatcggtatgtatatagcacatccgaacttacgcaaatgggaaatacttggaggatttccacgtactaactgcattggggaagtttcatgatatgcagttggtcgtagttagacaaggtcagcagcgtgcagaactgcatgaccccaacacgacgaaggtaatttgcaattcatcaataatggtcgagcaataagcttaattcttttgatcaatgattcagccaaaccattttttgtgtggacatatggaacagagtgctgaacctgaattcccaatgccatacaataatcatcgaaagcatgagatgtaaattcggcagcgttgtccatacggattgattgaatcctatgttcagggtaatttgccttcagccttataatttgtgacatcaatttggcaaaggcatggtttcgtgtcgatacaagacacacatgagaccatctagtagatgcgtcaatcaaaaccataaagtacctgaacggtcaagatcttggcacaatagggccacagatatctccttgaatgcattcaaggaatttaagtggttcggctctgattttgagataagatggtctcaaaatcagtttcccagtagcacatgcagtgcatacgaaatcagaggatttgggaaatttgtcagtgatcaaatgatgaccaatagagttgccaataatttttctcatcatcccgataccggggtgcccaagtcgatcatgccaagtgtggaatgcatcaacattttgaaaaattactttgtacgcaacatgtgcaatgggcttaatgtatgtatagtacaatcccgatgtgagagatggaattttctcgcaaatgcgtttgccatatccgttttgtttcgttaagagaagaaattcttctcgattatccatatgagtttcaatgtgaaacccattttgacggatatctctataacttagtagggtacgggttgaatcaggatacaataaagcatcctcgattgtaatttgtgtacccattgggagtgtaataattgctcgtcctgagccaactatcacagtatcgctcccagcgatagtcaaaactttgccttctctctttttgagagtttgaaagtatttgatctccctaagtatagagtttgtggtaccactgtccacaagacataattcctctccaatcggagcgatatccttagacatctataatgaaagaagaattgcatgattaagaattctttatccaatatatatacatacatacaataattaaaacatcaaatacatagtatgacgtttacatatgttaatagtacatactctaatgactagcaagccatacaaccttacaatacaagggagttcgtacttatctacttattacaaccaatattatttggcaaacttataggatatcaatatactgtttcaatcacactgagataagggcagcttcatctccaagtgggacgcaccgagatcattgcaaatctccaagtgggtccgttgagcagtattcgatgaacatatcgtccatcgtagagagtggagcgacatcttctgggagaacattgaggttgctctctggttcagcaggagcctggtgagaacttgcaacctcagggtgctcttcatgtgtgagattgaagtgtgcttcaaatcttgggttctcagaagattttttgtccttgagggatttttggtacaagaggacaagatgtttcgggatgcggcagtctttagcgacatgagtgtcagatccacacctgttgcaatgcttgttggtattgctacgaggttgtggtgccttacccttcccttttcctttctttcgacccttgaatttgcgcctgttgttggtgcgtttgcgctttccagtcagattcttaggattattcgaagaatttcccttgaatcctttcttattctcagcattattctatacattgaagtgcacctcaggcagtggagcagagcccggtgggcgctgttgggcattctttaaagaaagctcagggtgcctttctgcctgagtcaatgtatgtataagcagagaatgtttctgaaaattgttagcgcgatactgttgagtcagtatcctgtcctccggaagtatagttgatagagttttctctatcttctctgcctccgttggctcttgttcgcaaaacttcaacctggaacaaatgttatgaacagcatgattgtattctgccacagtttgaaagtcctgtaggcataaatgaacccactcataattagccttaggccaaatgagttccttttgctgatcataacgctcttttagagctttccaaaggttgagagggctcgtctctaacatgtattcatgtttgagatccttgtgaatgtagagtctcaaaagaaaaagggctgtattgagcttcctgggctcaattgccggatccccatcattaggctcctcaattgtatttagaatctcccgagaggcaaaattgattttgatatcagaagcccagatgggatagttagtcccatcgagggcgagttcgtcgaactcttttgttgccatgtccctacaatcatggttaacattatcaatttacagaggtaaattaataaaaacatgatattaagggtgtaatctcaatgcgaaatgtaaaacttcatattctgtaatgtttcgaaagatgtaggttatggacctgacaattttgagttagaattcgaaattaggtggcacaatgtggataatctctaagtaattaaacagtggagtagatctcttaatagtgggcaagttatacttgctgcctaaaacacggtctccaggcaaatatattctggtgaatataccgcagccaatgtttaggactccactaccttgtgttcaaccaaatttcaaataatctcatttctcaaaacatattcttggaaaagaacacatgtgggtaataatcgtgagatgtagacctctgtgagatgggcgaggtgctcgccgcctaagttatgaccagtgcggccaatttctaggactccatcgggtaatcatctcaaaatgtagaccactttatgatgggcgagatactcgctgcctaagttatggtcgatatgaccaaagtataggactccatcgacatgtgattaatttctaagtcaaagtgtgaagtggaacatgcattaaatcctccattaattatgttggacataattaaaagaatttgctaaatcaaaatacaaaatttatagaattttgtaaattaataaagcgagaaagtagagcgtgtcttaaaataatatgcaaaagacatgttattaagacaacaataaatttagtgaaacagagtatttaaataaacacctatgttaataaacacataacatcagtggtctataggaccattacataattgtttgtacaactgatgaactgtttcgactaaattacataaaacatagggactaaagtgaaattgttgctgcaaataaaataaaaaaataaaaactaaatttaaggggtaaatgggtggcccccccccc

SEQ ID NO: 65636 - DNA, 40523 bp, Oryza sativa
  unsure (1)..(40523): unsure at all n locations
tagggcgaattcgagctcggtacccttactcctgcttcagtattcctaagctgttaagcacaggccgggctgtgaggaaaaatgattttggtaacctcatttaatgagggatggttgggagtgtgagggtggctgaggataaagtaggaagatattgaaatgagagataattattagaacaaacaatataactttaggaatccttatttgtagacataggattagagtctgattgccggtatgttgtcataagactttcaccgctagcttatttacaagtaatccgtgagatttttttttatatatctatgttcttattagtgatttaaacaccaacgttagaaaataaattaaagtactacgaaaactcctcaaaatcaactattttcaaattcaaattttatatgtgattcatacactaataagcaaatgataagaatagtataataatagaaatggattgcctggtttaagagggaagaaaaagggaagaacagtgatcgatggggagtgtcctccggcaggaactattttaaataaattcttcaattatctctaaattttaatcataccttttatatatgttgtgaactcacctcttcctccctctttcttcttttaccatgaatatatcaaaagaccgtttaaccattatggctatcttctttattacttatattttcttttaccactgtggccacatctagattatgttaccaccggtagttttgcttttcagcttattagatgcagccaaaatttagatttagatttagattttaaaacttaatttcataattgattttttatattttttattgtagtttatttttaacattagcttgctaagagcacacataaaaattttatatgcaattttttatcactaattcttataatcagttctacactaaacgatgggttttctcactgctccacttggctggcaccaccttctacatgctcctccgccaccaacccacctaacatattccctgcctcctaatttatgacttctctagccaccattaaccttttatctctattgtcacaccttaaagtgtactttaaaaaaacagtataaacacaggcgactaagcaatcaaaaaataataaatatacataattagttgtttaaacaccaatgctgaaaatcaactagatggaaaaaatcctctcaaaatcaactctaaaattaaaattaaattatacaattttaatttgagagttaaagttaaattatataaacgagtagagagcgtcactacctagaacctagtatagcattacatgatctactctatcatcaagtacggatcctcctcaaatgttggacgattggtaataacaaatattatatacctcttatatactccctccttccaaaaatctgaaacctatttcattctttggtttttccaaaaatctaaatcctatttgtagtcactatatgctaaattaaattgttgatcggaaactaagaagtcattctaatacttattggttgcatgttcattggttttgccacatagtgagtgagctaattgcttcttggtattgatgaaaaagaaataggtctcagatttttggaaggagggagtacctcttagttcttgcttcaagctaccatgtaggatgatataatgagctagcagagataagacagagagagcagtaaccaccctcatgtaagtagcgacctctacatatataaactcataaagagatgagagaaagatacgaatagattgagtgaaaaaataaaaaatattatagtatattggggtaggtgtattaaaggtaatttgttgtatatactatctcttcattaatgagtaaataatatgaataaaattaaaggtgaccatcggttctactatatagaacttgctctaaggcagcagatgctggagagtacacaagcttatgtgtgaacgacgtagctacagatgaaaggaaaaatataacaaatgagatgagatatgcatgcgttttttttgaaaaagaaaaataagtgaaagacaaataaatgagtgtcatcatagccccacgtactccagttttagactggcattttcaggagctaaaatcaatagtgtgatcgaagacttcattatcaagttgaacagattaactaggagtacgtactgtcaattaattgaacaagatgtgcatgcgtacgattgtcctcgtcctgcaaagctttttctccaggattattgcagcttttgggtcgctgcaatctcatacaccaatcacccttctttttcccattctcctcgtgtaccatcaatgatcgataaaccaagtggctgtaccatcaatgatcaataaaccatgtggagacagtaaaaattggttcactttagatgttgtttttcatcgacagataaaaaggaaaaacatcgtgctaattaattaagcatctatttcaaggattattatttaggcatctactcaaactttagcttagtttgtccgattcttgtcacatatagtactctgaaaacagtgcttctatagtaaaatggtactatctatattatttgtttttattatgctagacttagttgcggtgtctgtagtacgacataatgcagacaattaggttctcatgttcaacatataatgttttagttttttctatcttagctaaatttttgcaagattaattatgatgtagtttaaaataaaaagttgtaggagactagcttgtcccgttggtttcatagaacaggatatataaaagaaataaaaaagatatatattacatagtcctatacagataagctggtagtaactagcaccatgaacacaaactaagtaggaccgatatattgacactaagatatactaaggaggtaagaatatattctctgtagactctagtattaattaggcttgaccaatgttcaacactaattcaaaatctttggaacctacaatctgaattaaacatagtacataatgaaacatctaaatttatgataacacatttatcagtcaatgataagagttagtaccgaccgtcagtgctaaagaagacacttcacattagatggtcggtaaagctggtgctaactgcctatctaaggcacctaggcactctatatgaccatcttggctagagtagatgtttcagagatcaagtggaattgaagctagagtagagaacatggaattgacatagtagagttaaaaaaaataaatgtaaatgtcttacttgaaaattgctagaattagtcatgatgtgtgatatgaataaaaaaggcaacgatgcattgcagtctttactatccatagtttcttggagctctattctccatctcacgagccagaaactttccattatcgctatatcactgtagaacatgtgcgacctgatctataaagatcatgtggactttactttaactcccacctttcatctagtgtctccatgaagaatgcaacacacactttttctttttgctttgtagcgagtggggtgtccaccattatcatcgtgtaccatattttctaattcttagatctcatgtcgcacttactataatatcaacttccacgacacctctcgcgacaaaactaattatatgacttcatactttttccccctaacagccaggtggtaaatgattatgtggaggcagtgaggcagcttgcttgccatgtccttgacctgctaggagagggcctaggcctcagggaccccacatccctgacaaggctcatcacagccactgacaacgactccctcatcaggatcaatcactaccctccatcctgcgccgccgccgccggcgaccacaagtccggcggcggcccggcgccgacggcggccatcgggttcggcgagcacaccgaccctcagatcctcagcgtcctgcgtgccaacgacgccgacggcctgcagctgcttctgccggacgccgccgccgccggcgacagcgtctgggtccccgtgccgcccgacccgtccgcgttcttcgtcaacgtcggtgatctccttcaggtcagttacaaattcaagtaattgatcgattgatgttactatttcgttaaggccctatttagatcccacgtaaaaattttacactatgttacatcgaacgtttgaatacctgcatgaagtattaaatataggctaaaaaataattaattgtgcagattgtgactaatttacgagatgaatcttttgagcctaattgctccataatttgataatatggtgctacagtaaacatttgctaataacaggttaattatgcttaataaattcgtctcgcggtttactgatggattctgtaattagtttttttattagtgcccgaacacccaatacgacaccatatataatatccgatgtgacacgccaaaattttataccctgatctaaacacgccccctaagttgtgttctttgttattgaaactttcgagggctcattcggaacgcaagattgaaaaaatatagaaataggaaaaatataggaataggataggaatacaagtataaaacagaggatttgaaaacataggaattttatgtgaataggtgtttggatagagtaaaggaaaaacataggtatctttaagaaaataggtgcactattacaaaattatcacatgctactattgaattaaacaacattaatcaacctaataacatgttttagttgcttgatggcatgatttgcctcgttcccacgcgaagggagagaaaaaagaggtcagtgtggattttttttttcctttgatctttcagtgatatgactagcgcaggaaatttcactacgtatttccaacgaacgttttcatgtgatccgaatgacgccacagtaaagtaatccatagtatctaaagtccttcatttttcctatgtttctcctccattccgaataagccctcaatttgtttgtacatatttttgcaggctttgacaaacgggaggctggtgagtatccggcacagggtggtggtcggcaccggcaagccgaggctgtcgaccatctacttcgcggcgccgccgctgcacgccaggatctcggctctcccggagacggtggccgccggcgcgccgcgccggtacagggccttcacctgggcggagtacaagaggaccatgtacacgctccgcctcagccacaaccgcctcgacctcttccacgccggcgacggcgacggcgatgccggcgttggggacgatgacgaccatgaatagctggacatgagagatcttggaactgtgcaatgcacacgaaattttggatcgctggaagtttgttgcaatttcgttggattgtaatatatttatggtgcagtaattactaattaagtttgtgactttgtagtaacagtgatcagtgtccttgtgcattagtgcatattgtataggctacagcataattatatgttctgtttcaaatttttgtcctaaagtcaaatattcataactttgattcattgatttctaaaaatttatttagtttaacatgataagattcatgtttttagattatctatgagaaatgctttcataatatatttttcacatgttattaaactatataaatttcacatagtttacatgttgtccaactaattctagaaatttattttgtttctacctttacttttgtgtgtatgtttgtgtgaagaaaatagaacttcccttctctcttaggtctgaatctcttccctgtttcaatttttgtttcttgctaatgttgcagatattgtcctttgcttaagccttgaagcaaaaaccttagtcttacctgcacgctgcactgaggaacgtagcagtcatagatgttgagatccaaaagattttcgttgtctttttcccttaattctcgtggaggtactacgttttggtgtgaaggcttactctcgttcgttgtttgctttttctttttcttttttggtttttttttcccttgcaagattccttttgttgaaaggggactcctgatctttcttgtagatcttttttcccccaagggattgttgcgtacatcttccggtcgactgaacgtaacactgaacctttctcccttcgcggccacggtatgtggttcatgtcccaaaattctgaaccttcctcaaggctttcagagatcataaccatgtaactaaatctttcagagatgtgtagctcaaaagattatatatttgcagttcttcaaccttatataggagtataaactttcttagctttattacgattatagatgttactaattcaacacaaaccaaacaccaaaagttgagtttgagatgatctgctcaagcaatctgacaagttttgaaggtcaagatagaaccagcaacaatgcaacaaggtagccaaggtgagtcttgcgcacatgcaagactacaacacaagatggggggcacaataaaaacgtgtgacagttccagcgtctcaactctcaacatccaacagaacataaatcgataatcataacattcatagcattgttatatttcatcaagataacaggaaaatggtgtcttggttcagtttgccaagtgatacaagatacagcttaaataatgacaatggatacaatggttagggcttcgcagcactcccgaattaggagctgctggtggaccgaacacaacaacaaacttcaatttcctgtgtacacgagagccacagacctgaatcggtgttgctctcgtcgaccaccggtatcacccagggtagctccaatcccatcgatggcagctcagcaaaaacgaatgagcgcgcatcgaggaaaatgaatggatggatatctagtgtaaacctatactaatgtacatggctatagtgtgttcgtctcaagttaattgtcgacaagtactcgtagtatacttgtgcgtgcagagtagcatgtataaaagggactctgctgttttactcgacgacatgggacttggctgcacggcgtgagcacctagttctcttcttagaaaggcagcatgcacagccttcaagcagctcgaggtcctcatcgcaggtcagaatagaagccagctcggggttttccaatagcatcttagaggtcagaaaaccagcaatagtccatgtctgatatgaccgagattgcttcccgatgaatcttccagagcgggtgtcatagtactctggccatttgtcagctgccagcttctcctcggccacagcaatggctcttcgggccaactctggtcttcccattttgatacaggccaatgtaaactgtagacaaataaaatacactggtaagggatgattcataagcataaaaggagcagaaagtttggaaacagtctgtcaatatctccatacctgccacagcagcgttggccaggatccaccattatgatatgaccatgggctgcatattaacaaaatgtttagatgtcaacaactgtggaaatgaaatagaaacacgtcgtatgaaaagctacacgaacaaactaagttgcccataaaaaatctgagtgcagcagggcatatggtgatatttaaaagataaatcagaagaggttttgagcccttgtttcggttattatgtgtttgctctgctaaacatttcttacaagataatatcagctggttacaatgtttatttagtggatactacatgtgttcactggatcagccaatgatttatgtgaaattatcattaactaagaggtcaggttgaacgtagatcatgaaaatactagcaataaagaccagttcaagaatccttacgtgttcttaggatcactgccggtaataatgcgccattcatcatcttccattgcggggtaacatatcttgaggggcatgtttgctatgagatcatcccatttctcatcaataaggctaagtattccctcagcttgttttggagtagttagagatgaagttattgcccaaaggttgccgagagagaagaacctgaaatccatgtgagctggctgcaggttcccgatgagatagccacctttttcaggaatccagtcaacaagccaagaagggatttgctcaggataaatgttgaatttgtttgttgcatcatgagagtattcttctgttttgtatctgtatatctcatttatcttcttcatgtcaacccagtagtattccctaatatgaaaggacagcgcactcagcctgttattaatggcacgaaggaggttttttgacccatcgttcataacaagcatttctcgtgagcatcgtagggcagagtagaacaaagcctgaaaagcaggtacaattggtcagttcggataatcttttgtatctagcttcaaagtagcagtatagaagtactgtctctaacagcacgttgatcccttcatgtcaggtttctttatcttaatagtgatataaaatagtaaatttatttactaagaacagaatttcctacagtaggctaaaccaattataaacaacattatcagttgctcagaaatatcattctgtaataatttctactaaaatccaacttacttgaatttcaagggggtgcccatgtattcccatcctcctgtctatcatgcatgatccgtctgtgaccagtaaagttggaaacatatcgaacccatcggacaaacacaagcttaagataagtttaatgccggtttgcacatctactctttcctgcagtgcattgtcccctgtaatcttgcagtatgccctcagcaaaataatccaccaaagtcctgtaaaattatttggggtaaactactttgataaatctgtcatagttgataaacgaatcaagtgagagagagagagagatttacctgaatccaccggagctacacgtccaatagctgactctccaaagtcagggtccaaaacttcctcaaatgcttcgttattgtcatcaagaggcacagccctaatcttaaagctagctggcatcaagccttgcccagggctgtaacaatcaacagtcttctcccagctctggccatcagacatagaaaaaaaatcagcaaataaaatcctaaaatgaattaactgccatgttgagacaataagaaaactaggctcaaaacaacatgaataagacagatttctgtaaccttactgttaagtgctagtgccatttgtataataggaaaattttgagaattttttatatgtatgtcagttaacatgtaagttttttccgttgaattattttcataatattccgaaaattagctgggcccaattcatcactagcagtatttattgcactagcaattcatcattttgtgacaaattagctgctttgattcatataataatatataggctgtctactggttcatcagactacgtgagaaagagacatagtattattctgcaaaagggaaaccttatctccatctaccccacagtagctaaagccatatagaatacgaattcatcataggtcataggactagacaatcacatctagcaagcaaattcaatctgaaacatgatattcaaagacccaaagtggcagtaaacttctcatatatatctaaccatgcataattctgtattttcctccccccaactagcaggaaaacctaacgtgcacgcaattagcagttctcagtacccacggtatgatgattactttggaatccgaaatcgtttggccccaaatttgaatcaggatcaggatctgaatcggctcacctgcagctgcagggtgtggaggaggaagttgcggacgatctcggtctcgccgcgcatgaggaaggcgagcgccgagggcacgaagtccctgatgaacacctggtcgtagttgagcgtctccgtgcactcggggtcctccgccgccaccgtccccaccggctcgccgcagtagctcaccaccgccctcctcagcagcctccacgcctcccgctccgcctccgtctcctccctcgccttgagcgccgacgccacctcctcatcggccgcagccgccgcggacgccgccgccgacgagggcggtggggtctcgaccgggaacgtgtccgggaagaggacgcggtcgaagaaggggaggttgccggagacggcggcgcggggatcggagggtataggtggggtcgccggcgaggcggcggtctgcccggactgctgctgctgctgcgacgccgcggatgcgaggaagggcaggcggcggccgtggaggtggtggtgcgggtgggggcatctggggaacagcggggtcgcggtggcgaccgtcgccgccaccgccgccgccgtggccgacgacagcagcctccggcggcacggcctcactgcgactgcggcggcggcggcgagccccatcggggtttgaccattcatagagggcaccacccacagctccggcgaagggcaccgatgcgataatcacaaacttaccagggggctctccgcaaaaaatccaataaagaggaaaggtaggtaactttaatgtaaatacggggtcggtgaggggtgtttctgcgaaagtgcgagcggggttcggtgcggtttaggtggtggaggaaagcgtaatggaggatggataggggggcagaggaggcggcctttttatagagtgcggtgtgtaggcgccacgctgggcccacctggttttaaaagtgcattgttttaaaaaaaattcaacgtttttttttcctctgtcctaattaggggaatcttggattggattttcgggacggtgaaattaccgtcgtgggactcgtgttttctattttccccttttctgcatctctggacagagagtttaattttgggctcgcagagtgtacgcattaattttggacgtgacaaatctgtagtcctttgacttgtaaatacattagggctgtgtttagcttttaaaattagggagacgtttagagaaagttggtagtttggaaaaaaaaattgagagtttatttgagtagaaaagttttagatgtgatggaaaattgagagtttaaaggaatagttctgtcaggcataacttgaacagtgcaatttactttaagtccctttcatgtgatcatttacttcctaatgtttatatattataggttaaaaatatgatcttttgattcgtaggaaaatacttaaaatttagagaatttgaatcctagagggaaaattcccaataaggccttcataagaaaggattaaattatatcaatttttttttgaaattcctataaaatgaaaaatcctacatagattttgaagaaaagttagtaagagctaaaacctttttaaaaaaatttctatcaattttatctctattatctgatttctatggttttcctgtagtctactaaaatgattatttgtgtgcaaaattaagtgtttttctatttctttgttttttttaatccaacctactaagaaaaccctaagtttgaaagttttggtttatatagatccggtgattctttttttccttcttacaaagttgacgaatagcatcattttgttcttggaataaaatggcttgctcaaatgaataacgtgtcatggcctaaatgagaaaagtcaaaactgggcaagggaaaatgggcagcgtgtgtaaaggattagtgggtatttctgtcattacgcaccaaagacagatcaaagaccagctcaaggagaaggaagacagctcgtgcgggccgctgtgtgagtcgtcagagaaaaaaaatacaaaagcgtgtcggggaaaacaattttctatacttaattaaaaaaaagtcgcccgcatccgtcaccaatcgctccgtacgtaccggcccattataccccttaaccggttacgcacactgacacgtcggtcccaccgagtggtgacggtccgcatggcccacaagtcagtagctactccgtagaatttttctccgtacgttacgaattagaacgcgcacccggtgccgtcacatgggatgcgcaccgcccaccggccgcgcgccgcgacgccgtgagcacgttttataataataaacctcggccgatattttttttaactggagacggatccaccgtccgatgggggatcgaacgggtgggatggatgccgcgcgtcccgatcgcgccgtgtggggacaggaaagggagccgttggttggtactactagtaccatgtgaaagtaaatacgaagtactagaggctgtctcgtggggcccagtggtcggtgactttagaaggtgaaattgaggataagatcggtagggggaaaatcctcacgtagtgcgagtggacacgtcacgttctgctgcaaagttttactactactacgggccagtcttttcttgttttcctgttggcgaatagtcgttactagtagtacttttatcgaaaataatgctccggaaaggaatttgtatccacaaacctatttacagtgttacctcatttatttgtatcaagccacggatcgacccgtttacatctttatttgtatttgagatttaagacagttaagtctgtgttcgggagtgatcctatccttcactctccagcacgcaaaacaaaatagcatttatctcataattaattaagtattagttaaaataaatttaaaaaatagattaatataattttttaaaataactttcatatagaaaatttttaaaaaaacgtaccgtttagccgttcgaaaaatatacgcgcggaaaacgagagaggtgagttgggaagataaagataaagaactcagcctaatacaagcttagagcgtgatgagggaatatgtaagtctgtacaacgtacgtggagaaaaaatatgtaattttctttttcttcgagagagtatgtcaaaatttgatggtcaaattatttgtgttaaagaaaatgagcaaacttctactaaaatattaaaactttaaactcaaaagtgaaaacaaaattaaccaaagcccatatttgaaaacttttcaatctaaattttaaagctttcaagttaagatttgaagactttatttttaaccttgatttgaaacttacaacttagatttaaggacttttgaatcaaaatttgagaactttttaattcggatttgaaaactatcaaatcaagatttaaaaatttcaacttaaatttaaaaaaaattcaaattaaatttcaaaactttcaacacaaattttaaaatctttcagctatttcttaaaaaacttttacctaaaatacaattagtgctaattaacgtcattagcgcttagcagaggaggggagcgcgcgcagctgcgctagctatgaaaccagcacgcacccattagtagtcttcggtataccctaccatattcctcaaatacgtactccctctgtaaaaaaataacttttataaagaaatttagatataaacatatccaaatttgtgtacaagagcagaaaagctgatttcttttgagaccatgaagcaggggatatggcatggatatggtggggattgatctagcaatagtaatagtatccaagataatcgatgtttacgtatcttagtggtggttatcgtagtattggagtaaatgtacatcattgatggtggaatagcagtattccatgcttcctcctaatggatgtaattatgtgaaattgattttattttccatctcaaaatataaagcatatgttgagattatgggcatataaggatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccgactgcttggtcgaaacttttcgcaggtgtctacgaaggcacgaaacacgcgagcgaagaggaaggcgagccgtcgcgaacgaacagggagcagtcgcacgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaaggatgaggagccaatttttcggaccattcgacgcgtacgtcgtgcacgcgcgccgcctgccctgccctgccctgccaggccaggcgaggccaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttccttcaagaatgctctgcaggacaacatctttgctaattaaagccaacagaactcattaaggcatagccaacctgccttgcagctcacgagagtatatgcatcttcacttggatagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtaccgttagttctgcttccatggttgacctcgtcaaaattgtctgtttgcaagacctccatgaaacagcaccaccacccagtgtgaaaacatatccactagtggctttgatctcattcacatcagagatccagttagaatcactataaccctccagtaccgcaggatacccagtatagtgaagtcccaattccacagtacctttcagatagcgcattactcgctcaagcgcacgccagtgatcatctcccggattagaagtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagagtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaaaaaatcttcgccttctttctgagtatagcccttagcaacaagccgagccttgtacttttcaatagtaccgtcaggcctaagcttcttcttaaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattggaaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaagagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaatccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggaagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctattcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcatataaggatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccgactgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagnatgaggagccaatttttcggaccattcgacgcgtacgtcgtgcacgcgcgccgcctgccctgccaggcgaggccaggcgagcgagcgcgcgcgtgtgtttcccctcttctctccaccacacatgcttcaagtggctaggagggcatcctcccttttaagaaggtccccctctcctagaataagcaaggtggtactaaactccacatgcatgccatcccatgaggtgggcttttgtgattttccaaagaattaatcttcgagtgggctaaggcccattcattaattccaacagcatattagttatttatatggccttctgtattctttaactattattattttcataatatatcattgattgttgtatggaattaacattataaaaaagtacttgatatgaatataataatatgtaatagaatgtgtggcacaaaatatacattcttttctaaaaatatagatacattatatctccggacagaggaagtgtttttaaatagaagtcgttctagttctttttaccaggaacatacaatctttgcaaattactcgtagtaaaagctagttccaatgttctttaactcattttctcgtaaattattgaggtagtattttggcaataacacgtgcaatagcgtacaatcaaacctgttaagtggactgcttgcatgcggtgctagccgactagccgagcacacgttttgtctagttacgtacattcgagttatatgtaacctaattattctatagttatattttttaaattttcttaagaaaaattgttgaatgttcgctttttcttcgacgtgcgttccctcactcaatcaaaattgtaataaaatacaagaagtaggaggggtttaatcatgaatccattgtggaaatccaggtagcggtccgaaaagggcaaaagagcaaagtgagtagtgaaagcaagcgcatgttgattgggtgcgtgcataccacctttttactaagggatgtacaacatagatgcgtgatgtggatgttgttcttttttcctggctatagcctctcagtgttggggtcttgtattttttttcctctatcaatacaaaacgtcgcactatcttgtgcgtgttgttttaaaaaaggcaaattttgctaaaggacatcgcaattgttgtatgtatttagctcagggacaccgcgaaagtgaacttttgggggaagacatcccataatcgtgaatatttgctgatggacaccgcgccgtctcctctccacttgacgtgctgacgtggcagacgggaggctattttttgacgcggtcggacgtaaatacccctgtgccttatctcctctcatgcactcggtagaaagagcagcggcagagccgatggcgcccggcgacgttgttgccgatgccggcggcgatcggtggcggttctgacgatgcggctaaaagagaaagtgtagagggcatccttgtgaatctataggtggtggttttgtgcaatatggtggccggaatagttgtcggcggcgacgcgagcggcagtgactctcggcatgacagtgcatgacgagctccggctcgtttccatgtgagtgagtacatgcgtgcgtggctataaggctcctggagactcactgaaggtcgtctgaggttcggcgatggatggacggcaatggcgaccttcgaaatgctccagcggcggcagagaacggcaggtcgacggcgtcggctccttctggccttcgggctgtcaaagggaggagggaaacgattcaaagaccatctgaggatgctacatgtgcgaggaattgtgccgaagctcactcgggagcgaggaatcgaaggaatgagccggcggccggacttgaggaagaaaggttcgatctcctcaacggcagtgcctcggatcgattcctccagtagacctccttctgggatgccggcgatgcttttggcgcagtggctcggtcaacgatggcttgagtcgacgggaacggcgaagcgacgcacggcggcgccctggacaccgagaacgccgacgagcgcatcttcatgtgcttgatctgcagttaattaggatgcaaggacatggctagatcaggtagaggaagtagttcacgttcccatggataaaatgcgacgaagctcaccagaggtctctaagattggatcaaacaccttcgggcagagaaatgaggagggtgttcttggagataaggcgcaggggtatttacgtccgaccgtgtcaaaaaacagcctctcgtctgccacgtcagcacgtcaagtggagaggagacggcgcggtgttcatcaacaaatatccacgtttatgggatgtcttcccccaaaagttcactttcgcggtgtccctgagctaaatacacacaattgcgatgtcctgtagcaaaatttgcctttaaaaaataatcatcttaggttcttaacccaacgcatgagcgcttgaaaactatgtaatgaagaggattaaatacgaagatataattaaagattttatttcaataaagactaaaagatgatgatttccagtagatcataaggttaatgaatgtgtgttttggggattaggatcctctgcattagagtacaaaatgcagagatgttacagtaaattgcattagaagacatctgcaccatccattcatagtcctatgcttgttatcaacctccacagcatgaatgcgatagttctagcttaagagcccctttgaatcacatggttgaaaaaatggaggaataggaaaacacatgattttgataggaattgaagtgtaaaacaaaggattgcaaaacacaggaaaaacacatgaatgatcgtttgattggatcacttttaacaaccaaatttggtaatatcggcatcgggaaagaagattagattggtaaagtcggaggcggagattgagttcgaaaacagagcaggaatcggctggagtccagataggctacgattaggatcggctgggtctgagtcggactgggtaagccgatgcagccagttccgacaatgcaacttgatgtatgatatcgggttgaattgaggcgcttcaaggtgattgccgcacatggatagagtcctgagaaggcaattgtatctattaattaggatgttttatgtaatttccttagagatatgcttgggtaaaagtctgccgcaaagacttgtggtatcttagagtttgttagagatagtagtcgtgtccgttatggacatatcttgtaattctcgggtataaatagacccgagccttatgtaacttttaacacatacgttcaatacaatctcggcgcatcgccacctttttgctttagttttatttcgacgagttcttactttcgggttgagctgcatcggtttcgatcttcaacaagaggtaaaacttgctatgatggattatgttctcgggattagtgcttccatctttatgatactctaatcttgtctatataattcgtcaagttatcatatatcttacataatcttcgacaatatcgtcatttaacttacaatcggctaacacctgtcaacagaaggcagccgattaggttaaatagcgatgttgacctagattatataagatatctaccactctatgaaacttccagcggcttgattgtctagatattgttcttcttttcatacttaaatgctgcatcagttgagtttgatctattaagtcgtgcttagaatatcaatctctagcctgccttctggtcgccgattagggtagcgtcggagtttcagccgatcttacctgatttaattgtatttgctctatatgcttcagcgatatgttaaatctgtcctttgtgtcaagatcttatttgcatttaagtatattaggtttttgtttgatatattatacttgtttcaatattctgatatagagtagtatcggagtattagccgatatacgctagatctatctgatcggctatgctataaacatatataaggctgttattaatatatatttcaatctaagtgatttatactgtctcgacatggcgaccgatctatcccaatcacttgatttaagtatatattgatataggaactatatgttgttaatatgtacagccgatcgaatagatttagttctttattgtctatttacaactgccgattgattaacatatgacatcggctcaaagataaatgatatgtcatcggcacctagccgatcggctatcatttatagatttatccgcggtttctttgtctctatttcttgttgattgtagaatcaaatcaactggcacgctaacacacccgaaggcgagttttggacctgcactagagttaagcagatctcccaggtctgtcaacaatcacagaaaaaacgcaggaatcgaatgagagagatagactcaaaggaaatctttcaagaggttagagctcttgctaagtctcctccaaaatccacctgcaatgtgtcatttcataggaactttataggatttggaaaacttcaatctttgaatcaaatggccaaatagaaaattttcctatatgatttgaatcctacgaaattcctacctaaatcatttgattcaaagagccttaaaaagtagaatattgttgctacagtaccccggatgatttgaaccattcgtttttaatctgagtgctcaagtgctactgcaaaacattgtagcaccttgctttggcagtacaaaccgcagaggatccagatccgtgttttggttatacgacttttgaatttcaggagcctcttttgaatttttgcactagggcctcaaattcgtagagacgtccccgcatttaagaaccatgttattcaatagatgcgtatatttataagttagctaattaggcaagtatagttaggtagtactacgccggagtacatgttagagtacgtgcgattacccctgaaaagtgttttccagtagttagttaggtagtacccatcgctacgtttggcactcatattgaacggtaacgtggtaaggatgaaaactggtcctcgaagcatctattctagcatccgattgcacacggcctaagccatgacatgcctcggcactaaggcatccggactgagcttttacttttcaaccatccttttatctgcagagatcgatcttgaccccggtttacttgctgtaatagttgaccccatctcttaatgttaatgcaactcctagcttgtttgtccccttcaccacattcaggatttagacaggaaactgatcatccatgtgtgctcacatggcattgcacgcacattgtatcttttaatttgtttcaacgcactaacttcttaagatgtggtacatgatgtatgggaaaaaagaagaactagcagttgcttaattgtgcgtcattttcccgaaacaataaattgcccgtcaatgtcaagattgcagtgctggagtttgtttcacacacccatcacaccaaggagcatttccagccaagtggtaagtcataagtagaagtacttgcgattcatagcagcatgacgtacgggatcccaaaatccagtcaccttttcatttgaattttagttagcatgaaaattctagaataataatctaaatttattttgaaggttagaataatctaaatttattttgaaaggctagttagaatctaaatttgaaaattcatgagtttttagagctccatgaaatggacttcactgaccagctggtccacaccaaaccagaccacaagctaagatgacaaaaaaggagtgaaatttcaagtggataagagttcttggatgacgtggccgacatttgggacaccttttccttaggtggcactgatggctcctatcctcctgtgacccactagtctgtttgatcctacttggccttttttgtttatgtccagtagttttctcccagccatccacctaccaccacgtgtacgcccctcccacgaagcaaaattcgtaccaaataaaaactcctggaaaaaaacatttggcaaattttatctctacatttgacgaaattgtatttgttgctatctacacaaaatttcagtctgaaaacgaaaattactttgagagaaaaaaaaatggtaaaccatgtggccgggagacaagaaaagcgactcgatcggcacaaaagggctcacaaaagggacaccgagcgaaaacgagaccacgttccagactcaacccctactggttactccgtcgtcgccgcgtgcggaaaatgatttcgcgtgccaaattatgtggcatgaaaaataccctaaaaaaacaattacatatatttattcatatatcccgacaacgacccgtcaaccgttggggaagaggagaagctgaggatgggttcctctccgtggctcacacggataacgtccgacgcggctcgacgcgggcgggcgggaggcgataacgccggcggacttggatgacaaccgcgggccagtcgccgtcggggaatagcacaaatgaaatgttgccgagagagttttttttttttcatgcgatctcccgagaaaaaaaaagaaaaaaaaaacgtctttgctttcgtcgtccgttcgtgtccgttccggcgtgcgaaaaaaaatctggggatggcaccgcggaaacgtcgccccgggctgggcgtttttgtcgtggaaaacgtacgctctcgctcgcggcgacgcgacggctcggctgcaaatatccacagtagcatgcagttcattctgcaaatgggagtagcgtgtgtgtgtgtgtgtgttttttgtgacgctgcgtcgttctggctgggatgaacaaatatccgagattcttttgcaatggtggcagtgactgactgactgactgactctgttagttgaagacgttgctgctagggagagagcattggaaaccagggaaaaggggcgtctgtttgttgtgttttcgcggaattggtggtttgcacattgttttaaaggtgtcatggagttggaacatacttgtatgagttattgatgtgtagggggtgtttggcataactcgagatctaagagtttttaaactatgaatacaaatcaatagatctggatctacaattatattgataacttttgaatgaatcatttagatgaaatataaaattttaaaccactataatttaatatacaaacttcaaatccaatgcgaatttaagatggagagttatgccaaataagaccctagtatgtgtctttacgatgatattttccaaatttctctttttttttaaaaaaaatctgctgttcacgaaagaaaaggtaacaccatattgctttcaaccagtgatatctaggggggtaaaggataaagatgtgagataagatggactgcaaaactacgaaggtaaaaaaaagaagatgacgaacgtgctttaggaagttctttttttttttcttgcagctgctttactagcatattctttgcaagtttatattaaggccaagcgtatcaagtattataatggagtgaagcagcaaggcaggacttcaaaattttgctttataatgttgacatgattgtgactaactacaactagaactttatcagcaattgtatgtccaggctgaaggaagaggtaggcgaatttgtcttgccggtggtggagatgtcaaataatgaaaatcacaatgcattttctcctgcaagatgctccttcacaacatcaacatccattgcttttgcctcatggttaaaagttcgacaagacaaactccatgcagtactatgataatgtttcaagatgttagctgtacactacaatctatcccaagtagaacgttttccagttcagctgctatacagtgtcaccagtgacaaggctaaaaaatacaaagaacatcaagaacttgtaggttgagtagtgtgcctatcttgaccctcaatcttttgtcacagtgaatcaaacaataccaaggatatcaggggacacaaagatgtatagggtcaataagcaactaggcaaagtaaacaaaagcagaatgcatcatctgattcataaattgcacaccactgtatgtgacattagggcgcctctatttagacaccgaatgctgactgaattgttgacctgacaccagatgataggagcgtagttctagtccaatctgcaacgtttttcttggcatctgaaaaataaccacaataaactcagagccatagttaaaagttcaagcagagtgcaatgtcttatatgccaggcacagatgtcaacatgcttgggtagcctagaagctgacttagacaatgggaaagctagaagtgatatctgaagctgacagaatgaatgtatttcctggcatacaatgtacttccccatggaattatccagttaaagacatccagagctatgaaaacacaagtacgtaaacagagaagaaccatctaaaactgatcagaataggtacacaaaacaatgatggcttcaggataaaggcaactggtctagattctagaacacattccaggctgaacatggtctgtttactaaatgaactgtactttcaaacaagatattgatgttgaaggttctattttctcagctaagacaatgttaaaaggacatgaacgcacagcattctgttgctaagtttaccattttgtaagcaaagatatagaaattcgtgcaattcacttccaatgcatacctgttctgtttctaactggctattttaagacaccaaaaaaaaaaaatcctctaacagaattgcatcttacatgccatgtagacttttctaacgagaaacacggaattctcttcaagagaagtctctcacctttgttgcacttggtgaagccaacaatgtttgctatgctgagactcaagcaaactccaacaacaagaaggtaatcagcatgaagtctgatgagtgagaatatcccaagaacaatccatgcagcagcctgaaacatggaaaaagcatgtttatttcaaatagccttcaaagaattacaattaccttcacagttagtaacctgttctcctagagaattttcttctgttccaaattattttctaatttgaacattattacagtaacaagaaaatgaaaacatgagcaactctacaataaaaggagcatcttttttttttacaaaacatggatataattgcttgacaatacgtcgtcaaacatgaacctgtgttaaaaaaaacacggatataatttttgtaaacatgttcctttttcaataaaaaaaacatgagcctatattgggcttgtttggcacaactctagctccagctccaccttagctccacctctggtggagctggaacttggccaaactgtttcagccccacctaaaatgggagtggggctgagtggagctctcttacaaaatgaactagagaggtggagctgggtttaggcagctccacaactccactctagacccaactcctggagctaagtttaggagttagagctctaccaaacagacccattgtttgacaatacctcatcaacatttatgtagtgttcacatgatgtattctgtatttgctttctcacagtttgccattatgggagctttaattgacgtgaactttcagttttgtgagtgtaaaactgtagatacctttatatgtaacactattgtagactacaattttttacaaaagcaaatcagtgaatcacagtccagattagtgtgttgggtcaactagcaggatatttatcaattgaagagatttctagccatccactatccctatcatgtaactccagcagaacaaatccttaatttcctagtgtttcatccagcttcaatgctgggtagctgaggaacacgtcagatccctcccagatgtaatcctctgcagaagcttcctgccctgcaacaaggatgccacatgcgctgcagggccacatggagctgaccaaagactttacgcttgccttgctccggtcgatgcttctaccggcctacgcagtctgtcctctgctctcgtcaatgcgtttactttctattttgcttttctcaagtgtcacttggtttatcagtgaatccatgaatgatttagtcttcctatcctgcaggaagccagctgcaatacctggtgcagcagccatgggaagaagggaattggggaatgtgagtttgctcgagatggatatggctaagggcagggagccagggattgatgactacatgctgtgattgcatgcgtttacttaaggatctaatctggctgcaaggggatatgtgtccttactcatgtctatttgaatgtttcacatgggaaaaaagcaaaatcatgatggcaacggacaaagtgatgaagaacttaagggtggaccaccatattcagtgacatgaaaccaaattttcctagattttaatcataaatgcaacagaactagcaaagtatatactatagagtatttccaagaaaaaaatcaataatactatagagtactgtttttataaccaatattttttgcatttacatctaaacggtcagacataagagtatcaataggttgactttacagatcatactacgacttgcattttgggttgaagggagaatatgacaagttctaattctaagtttacaaaggagaaaaaatagctatcctcagatcaacaaaattgtgcataaattacatcaaaatatcaaatcaataattaactatatgtgtagatgcacaccatgacaaaaaaggccgtacaaacaacacacatgtgcaaaaatgatgcacccaggggcggcgcaaggctaggtggaagctttacaaactgacaccatgcctaccagaggcacttcagatactttcagcatataggctcaacaattctacggtgaagtcaatctcgactctgtataaagatttgatacagacttctatggtttatcatactttaataggtatgctactgattgtcatctaattgcagttgtgcatttgacaagactgcaggcattcccttctgttgtatttatgttttattttcattttccatttcccaatgtgttcatatataaactgaatgaaattgtatatattcatatacggatactagaaactaaaaacgctgaatcatagtggagaatatcacttacagtcaagtacagagtccaccagaacagccatgagtccttcttgttcatcctagcaagagactgcagcaaaacggatacactaatttagggataagcaattgcaccaaaatgtcacaagtatactgagagacgaacgcaaacctctccatcaaggcactcaaacttccacacgctattgccctcatcatcgatctcattccaccagcgcagcccaaccaatatcctcccactgacgttcttgaccacccagaagtcaagtgctgccaggagcacggtgatgacaaagataataacaaagttggtcacgaacagcgcagacagtatgtagaacgccaatgcccctgccttcacatacaaacagtccaatcaacttagtaattgctagctacagtgtttatgtaaacaattacaaagaacattgaagaaaaacaggcgagtgagtaccttgaagaggacatggaagaaacatgtctttggatttgcataattctcgccgaccacctgcagcaacagaaacatatatcatcactatcatgccactcctaaatctcaatttaagcagcagaggaattgagaagaaatagttattagtgcagtcaagaaaccctaaccaaattgcatccacttgtcctagaaaccaaactgtaacggccgacccagatctcacaagaacaatttattgactcttttcttacacaactaaaactagccaagctcttgcacaacatatactaatctgggctggtccaatcagaaaaaccgaaagatctggagcaagtagcacaactccaatccaatccccaagcaaaccaactccttgaggttaaaaatagagaaatcaagaaccttccggccaggcggggcaagggaagggaagggagcggagggagctatcacctggtgttgatccatcgggctttgcttcttcgcccactccgcttgagttcttccgctgctatgctactgcttcgcgggatcccttcctcggttactcccttggagatcgaagaggacggggggtcaaatgcaaatatgtcgtctagaagaggggcggatcgcaaattctgcgtagagaatgggtagatatcgcgaggctggctggcccaacaaagttggcccaaactggtctcgtctaggcccatataagtataggaaaaagtacaccgaaggtcccttaacttgtcatcgagttacaaaataatccttgaaccgcaaaacgggatacaacgcatcccccaacttacaaaaccagtacaaattaggaccctcggtggttttcactccggttttatccgacgtggcaactgactcagcatgggacccacgtgggccccacactcagggtgaccacgtcatcatttcatcctcttcttctctccttccttctctctctcagttttctccttggtggggtgaggtgggacagggcagcaacggcgcctcggtggggcgaggtgggacaaggtggccagcgacggcaggcgacggaggaggagtagtgcgcaggaggcgggggagcacctgggcgcccggcgacaggcagcggggtggaggcaggcgcttaggcggcgagcgatggagaaagagtagtgcgcatgcggcgagggagcacctgggcggccgtcaacgggcggcggggtggaggcacgcgctgtggcgccggacgacggaggaagagcggtgtgcaggcggtggggaagcacctgtgtcacgtcctgataaattcatcccgaaataaaaatcattctctaaaaggaataatagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagttgaaatgagtttataaaaagaaaaaccctaaaaaaatctttttccccccttcccttcttgggccggctcggcccacctccctccctctctctcctctcccccgccggccaatcggcctcctccccgcccgcgtgccgctgacgggcgggcccgcccgccaccctcgctgacgggtggggcccacctgtcatccctgtcctcccgccgctcccgccgcctcgcccgtgccctagcgccgccgccgccgcgaatcccgctgcctcccgccgtccccgcgcgcaataaagagggggaaatcactccccgtgattccctccctctttcccccccacttttccctctctctctccctcgattcgtttggaaatcctcccgcaaccttcgccggcgtcattgatggagccgagatcgccgcgccggtttccttcccctccggccgccctctctcactcccaacactatataaacgctccccgtgcctccctcctccgtttccgccgctcgccgctctctctccccgtcggaatcgagctcgcgccgtcgtcctctctctccgccatcgccgccgagcttcggtccgccgccgtcgtcgccccggacctcctcccgcttcggcatcgcctccttcggcttcgccgcgtcctcgccgacctcgtccaccccttcgtttcgcccgccgaccgccggaacgccgccgtcctcgtcgacccgagccgcgccgccgcctctctccgcttcggtcgccgttcccgtcgtcgccgtcgacccggggtgagccgaggaccgccatttcgcttcccccttccctcccctctctcgggcgccgctccgtcgcgccggtggtcgccggcggcgaccatcggggcgcgggcgcaccgcctcccgtcggccgtgccggcgaggccgccttcgggcgcgccccgcggctgccatgtggggcccggccgtcagccgcccacgccctcgggtgcggctgacgcgtgggacccacggcgtcggccggcgcaagccgcgtgcacccggtccaccgtggaccgtgaggctgacgcgtgggccccactcccgtggacccggtccgcgcgcccctcccctcggctgacgcaataaatccgatttttaatttaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgcctgttatttggagtttattagagtaaaagccttttcttttccgttggtcgtgtagacgctgcagcttcggaagatccgctcttcgtggaagtcgaagccggcgtttgggaaagcgagcaaggcaagtcacatcatccttgagcatattgaatcccagtttataaaattattttgatttaaattattgcattaccgctttatttaaattcccgcgttatcactgttttatttagccatgcctatttacctttgttatgacattatcattgctattgtattattattaccttgttcaccctagaataaacaaaaccccaactagtggacactctattcctggttccactagtttgaatttaggtagatgcttcgctgattaaataggacaacattaggtggttttataactttagactttgggaattctcatatcatttggacactttggaatggttggcttatgttggaattggacacacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctaatgggtaaggcttagtttgtggctcagtctagtcttaaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctgcctgtcccgggtatcccggccgtaggtgggattgggtcggtactcttgtctaaggctaggatgggttggaaactatgtcacgtcttccgtccgtataccgtggtggtatgtggcgcgtggttacacgtgaggaagatgtgtcttgtgggtaaagatgtacacctctgatcagagtaaatctattcgaatagccgagccctcggatatgggcaagccgagcaatgtacccaagtcagtgttataattcttaaaatttgctcaacaactaaaatgtggaatggttggcctgggttggcttgggacgagctgggacccagggtcgggttgccagttcggtctggatcatcgtaggccttgggttaaggcaggttcgtgagggttcacggccttgattaataatactgtatagctctaggatcgtctttataaaatggctttgggcaactaagtgacttttaaatgctgtttactgcaaaacttaacccctatattattatccccttgtacccccttgcattaatcatgcatccgccggtgtggcttgctgagtactgtggttgtactcattcttgctcaatctttctcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattgtcgatataataaagatgtgtcttttatatcatgtttgtgtggtgtaccccggcttttcctgggacggggattaatacactagcgttcgggaaaaggcaattttcccggtcgcgacatagggccgcagcttgattcacagaagaggaatttctccagccacattagcagaaaggctacatgctctcgaggggttacagaaccttagcccatatatgctgctacataactagaccaaccgcctattgtcacgccctgaagttcttctccctagccaaaattcaattaataaattgttgcaagaaattatttgttaaaggcaagagagaaaccctaaatcaaaaaaatgcaaataataattggaatcgacatgtggaatttttcttgggttctacatgtcaaaatatactaataggatttttagtggaattttcagagccttggaaataaattttaaccaattaaaaatgagcatgtgcaatatttaaatccctggaaaatcccctttttccttttctcttctttttcttcctttttcctccctttgtcctcttattgggccatcggcccacttcctcccgcgcccttcctccttgctgggccggcccattccctccctcctctctccgggtcaccgacaggtggggcccacctgtcggccccttcaccacctctagccgacggtggcaaccaccgccgaaaccgccgcgccgccgccgctttccccgctcgtcccgcgcccccactccacgccaacacgccccccacgttgccgaccccacgccccgacttctcccgcccacgcgcgcgcgcccgcaagggcgggattcaatttgaatccccccactctctctccatcccccacgtcggcgagaaatccggccgcctcccggcctcgtccgccccttcctcacccataaaaagcctcccccgagactcctctctcttttcccccactcgccgccctctcccgtgctctccactgtgcccgcgccgctcaccccgccgtccgccgctcaccggggagctccggccgcacgccgtcgctgctagggccgccgccacgctgtgcattcgccgctgctagcatcgccgtcgtgtgagctatcccggccgctgctcggttgcccccctccgcgcgcatcgctctccccacgccaagccacacgccggtgcttaccaccgcctccaaccgccggtagccgtcgctagtgccgtcgccgcgccgctccgttgccgcagttgcccttgcgagatcgagggccggctcgtccaccccgcgctccccgccgttcgtcgctcaccgtcgccgttcgtcgtcgcctcctcccacgccggccgaaccccggtgaggcaccccctctcctgtttttcccctttctctccctcctagcgcaaagccgcaccgccggccgcccgtgtcgccggccgcccgggtcttctccccggtcgccgccgtcggtgaccgcttgccaccgccgcatcgcctaaccggccggccggtttgaagccgagccgagccgaccgggtgtttccccctccccttgagccactgcccggtggggcccacccactagcaggtgccacctcctcccccttgagccgctgccgagtggggcccgcatgtcggcgccgcccccctgctgatgtcatccggggttatttattgcgcaataaatctattaaggccttttcttttattagtaaaaacacagataatcttctaaaattcatatctaattcatccgagctccatttaagtccattcaagtctcagtaaattcataaaaatgtatagaatccattaaaaatggttttgtttcctgtttcagtagacttatagcatgttttgcttgtgtgctttgtttgtcgtgtagatttcggccgtttcgtcgatccgcggttcctcgaagacgttgctgagacctcattagtacgagggcaaggcaagtcatgcattacaattgatcatattgtacccaatttacaaatgtcccgcatttctattaaatgttgcattattttataatatcatgtgggatgggtcctactactcagccatatattgtttaccttatgccattgataacttgggtatcaaaatgattagatgttggattaggaattgcttagccatgcttagttcaactagtacacaaagggagatcacattaatgcatagactttgattattggcatagctttggattagtgccaccgcaatggtgttagttaattaaaatacactacatggtgggctgtgggtgcatggttttgctagtcgtgcccatggtgattaaggaccggttcgcgggatgccctaaaagaacttatcgtacttaccacaagccaacgtgggcaacggctgggcttgtagtgtagctttcctctagccgacgtactcatgcgagggtgggcgtgatggagttgggttggccggggtgtctgtttgatcggcttccagattcaccgcggcacgagagggggaatgcccgttgcctgctggggacggggcgaaccctgaggtgtggtgcgatcggttaaaggggttatgcaaagggtcctgtcacggcctctttccggtatgtcgtggtggcatgtcggcgcacggaaacgtgtcgtggggctgtgtcttgtgggtatagttgtacacctctgataagagtaaaactattcgaatagctgttcccgcggttatgggcggtcgaccaaattcaccgtgattagtcacaccctagttagctaatgaactggtgtagtttaggtggttggttgggcctgttgcaacatggtgtagcgttggacagtgattggttaatattgattaattactgcaactgttttactgctttcaactactgcttttaaatgctagctttatgcaaaaggacctttagccttccttggacttatcctgcatcataccttctcttccagtatgacttgttgagtacagtgggtagtactcagtcttgctctcttttcccccacaccagagttgaagttcttctcagttggagatgtctcgaagaagttggtttcgtcgccgccgtcaaggatgcatgtggaatggaatcgcccgcaggcttagctcgctttaatgcacattcagcttagaaattctggttcgtgaatttctgggcgtgacacctatgctcttggtcctgaagtcatattgattcttcgtgttcggactcatgggattagccgatgaggtgacatccaaaccggtgatcatggtgatgtctattagagtcggggtcatcggcacttggttaaacaggaaggcattgatggtgttggaccagaaataggaggcggaggccattaaaggttcgtctttggctgagttagctatggtaaggtcgagtgcttggccgattccgatctcgtcccagtgaactctcttgctagccgaaatgcgcttgaaccatgtaatccagcttttctcgggtggagtttttccagtgacctagatctgggttggccaatctgaaaggaatcctattggtttcgccgatgatgaactcggtaggatcagggttaccaactgggccgaggaagtagtaattttcatgcgataggcttggaattgcaactaagttggagagatgctacaaatccagaagaactaggaaggggaaaaacaagatgaggagtaggaaatccaatctgatgtgagaaaaggagatctagctgatgagaacttacctcagcgtactcggctgatggtgcggcagatggactggcagatgacgacatcgccgtaggcggagatctggccggagaagggatcgcttggggatcgcttcgtgcaccgaggggatcgccgaagagagacaagacggagcttgcttcagcggtaaaaacggaggaaaacggtgtgagatttttcggggacaacggttggtatttaaagtgctagaataacggtcaggaaacggcaagagttgatttctctcggagtcgacgtatggcaaatccgaaacattatccaatatgccggacttggggggcatgtgttaacgaccaaatttggtaatccaaggatcggagatgaagaagaaaccgagatggaattcgagatggaaatcgtctagggaacagatttaactgatttaggatagtatcggggtttcaaccgatcttacctgatttaactattttttcctcatatgcctgattgacatgttaaatctgccctttatattaagatcttgtcgcatttaggtatattaggctctttgtttggtatattctacttgttttaatattttaacatagagtggtatcggagtattagccgatacatgctagatctatctgatcggctatgctatgaacatatacagtctcgttattaatatatatttcgatctaagtgatttatactgtctcggcatgacgaccgatctatccctatcacttgatttaagtatatgtcaatatagggattatatatcattaatatctacagccgatcgagtagatttagtttcttcttacttattaatgactgccgattgatgcatatatgacatcggctcaaagataaatgatacgtcatcggcacctagccaatcggctatcgtttatggatttaaccgcaatttctctgtctttgtttcttattgattgcaggatcaaatcaactggcacgctagcatatctgaaggcgagttttggacatgcactggagttaagcaaatctcccaggcctcgtgttttcacatcaacaccgcggcgaagggcgacgcgtcggtggaggtgctggagacagccggggagggccaagtcttccacctgtggcaaggccaaggagttgctcaacaggatggtcgccttcgttaacgtcaccggcgcgtgatctccgagttcgtggccacgcgccattgtttgcttttgggtgtgcgaaaaattttcctactttgatttgatgaactctgctatgttgtgattgaataaatgagacaatgagtgatttttatggttgttgactctgtatgtgttaatggaatgcacga

SEQ ID NO: 65637 - DNA, 13022 bp, Oryza sativa
tcccagagggcggtaggcgactatttccgtcaattttcaaaatggaaaattatttttgtaaaacttttaataaaaaaaattataaataaaaaaaattcgttgataccgtgtagtacttgaattatatacacgtcattgttcatgctagtacttcatacccaaaacatgttgctactaacatacccaacacactggagtacttgaaatactagtatagtggtagcagaaaacgaatggtacagtacctggtcaacaaatgatttttgcacgcaaacaaatcaccaagaacgccatactattatgtgctcgctgtccggccaagtggaatggacagtaggcaatggcttcttttgggacttctttatggagcccaaacaaccatgttttcaatgccactgaaagctctgctctgctctgctcatctcatcccgtactcttgttgactatgacaacttgacaagccaattcccttccttaattacccctgtaaacgaaaatcaacatgattaattagccagcttatcatcagtcacgtttattactcacactgtcacagcaaaggcatgtgagtgacttttattagtgcagtagcagcagtaaagggaatgcacatgaattgcagttggtttgcacgccaacgaaggtgagagagagcagtcacacggcctaacacaagtacgaggacaacagtgcttggtcatgcgttacacttcgattcgatgccgagtacttataccaagcaaggccatacatgtgagtggtgctgcgtgttgactgcggtcatcaataagtttggtgtgtccctcccctctgcacggagtttttggccaattctagttcctggttatcttggataaaacatgcatcatttgattatggacagatattttatggtctagtactgccttacgtagaaccagcggttataccggtggcgtttgaaagatgccacttatgtcttctctgaatggatgattttttagatatttcgggagaaactgaactaaatcatgtgaaaaaaaaattctgcaaatttgctgcattatataaaggagcatgagtccaacctatttagtaattaggattgcgatttcgaacttttagggtatggtacatcaaaatatctagaaaatagtagtgtttggttccttttcataatttaatcttaaccatctatatgtcatatgcatttataatacactataaatttacttactgtagttattgatttattgctataaatcttaatgtgcattttaaccgtataacgcggaaagcaataaccattggatcctcacattcccaatacataaccattcctatgtgatgtgcaattgcaattccacatcaactatttttttagataatgtattttttattaatctggcctctatatctataaaggatatacacgtccaaaattccacatcaactattaaggagctcaaaataatgccttttaggcattacgagtatacggattacaaattattctcttcgaattttatttgaagtatttgtaaattccccactgcaacgtgaggggtatccactagtttgatctaataccttctccatacgtttgatgtccgtggcttgctatacttatatttactgtatattttgtgtttcctccgttacgtgtacttgcaatgcccacattactcggcgatttacgattttatacgtaatttttgttgaacattttataaataatagacatatcaccactttgtattatgtttttacatagattattctatgtttctttctaaaaacacctccttaccgtgtatgcattgatcaaatgtgtgaagtaaatttcaaccaaaatggtattaaacatatcgattctcagtgttatagtcctttttttttataaagcaactaaatagacccacaagcaacaatagttcaaatataagaaaggaaaaaaaaacatattgctttatctcggaggacatttcgatcataattccaacaatattcagacgtgtgtatccaacacacgtgtatgcgcgttatggtactaactgtggacaacaacactctacacgagacaatatgtaacattaggcgacaacaaaaacgacggtggaactgtggctgccaattccactagtccaattagggagcactgttgcgaaaaaaaaacttggtagccagtcagaaatgccaaaaaaaaaagaggaaatcgtttagggtaggagtcttatttattgatgataagtgtggtgtacgtgcatatatacatccaacaaatactaaaaagaacctattactcaaatggaggaggaagcaagctaaagtaaaaatgatccctacaagcatgagcctaataataataccataacggaagaacaataatccacgcgaccacgcaggcaaagaaacgaaaagaaaagaaaaccccaacaaaaaaacaattaaaaaaaaggagtaatagccggaaataagacgaccatgtgttgttgggcgcggtgaggggcccaacccagaaataagcgaggcggacctgggctatatatacccctacccagtctcctctttccggtttcctcttcccttcccccttcctcctcctcctccccctcctccggtgcggtgcggtggagtccccttcctcctcgcgctcctcctcctcctcaaccctactccttctcctcctcctccgaatccaaacctgacacacagaggcggcagcgagaaggtggaggagaaatttgaacggaaaaggttgggggatcgcatcgcaacgaacccagcactgcagcccccccgattccgattgggtggggggtcggatcctcggatccccccgcgccgccgataattcggccccgcccccgcccagatccccgcgattccggcgccggcgccggggatgagagccccgaggacatggtcgccgtggcacgagtgaggcggccccggttgctgcgccaccaggaggaggggaggaggaccgcccgcgcccgcgcccgcggcggcggcggaggaggtgtctgcggtggtggtggtggtggtgacctgaggcggaggagggaggaggtggtgggtgatccggggcccgaggcggccgtgccatgtctcgctgcttcccgtttccgcccccaggatatgagaagaccgcccgccccgacggccagctagcctcgcacctgctcgaaaaggtggaaaccccaaacaatctcacactccccccatgccacccccgtctccgtcctcctcgctccattgatcgctactagtacacatgcatccggggatatcttaacctgacttatgctgttgcagttgcctgtagaatttcagaaccaagccgtaggtcacgttctggtggggagaggggaggggggataagctagccctagatgattagggctgatgtcttaggaattttcagctgctgggctactagggttagatcacagccttgtcggctcgcgggaggcgttatcgctgctcacggggatctcacgagacatccatggaatttagatttgctagaccaatgctttcctaaaagtgtccttgatggcttgagctggataaattaggtctttgactaagcggttaaaggtaggcgtcttcttttggatggatcgacggaagataatgtagtaacgtatagtgtttattcattggtcgcaacttacgtcatgcttatctcaactatattagataggctagtggattgtagcatatttatcttgccactttgctagctgaaacctactcgagtcttcatgaaaaccacgacgtgttgttttgcaccattctgatggctgcgaagatggtgtggtagaaaaaacttcgttggttattttgtttgttagaggttacattcaattttcaattatgtcatggacatgttgatagaagattggacagtcaattactacactccttttatggtcttgacatgcatctttgtggaagttacaaagctagcatgatgcatgttatgctaactttgtctatgttaaaataaagttgtacgttactgaccttagtaattgtctgaccagaatcactatggtggaatgtgtcttttattaattgtcagtctcaatagtggttgttctaaatcaattttagctttcccttctaggctgtagaccatatatgtattccagcatttgtttctatataatgctgatttcaatcctctctcttcttcttttctatataatgctgatttcaatcctctctcttcttctttccatgcctgattatgtattacaacatttcctcactaagtcattattactttaggtaggcggaacttgtgcttctgttatgttgccttcatggttgtgcatatacatgattctaacagatttaactgccttttccctttggtatacctgtcctcagtctgtctttgtctatgtgctgttcctgtggttgcatagatcctcaaatctgtcaatctgcttcgtgcatatttcattctgcttcaatttttttttattacagctaacatgttgttcacttctgttcatgcttctgtttattgtccatattttgagtaagtagaaaatgcatttaacatgaaagttcaaaggggctaagctgaagtggcaacacaaatgcactaaaaatgaaaagatttggactttaagcttatgtctcacaaaagcaaatgccatgtttgtgtgttttttcttttattcttctggctgttggctgtgaaatatgcctgtagtgtctatgcattccatccgtatgataattgctaacattatggatgattttgtatctatgcaagcttacaaagttctgttacattctggcatcagggaactatgtcacacttgagttttactcttaaacaacttttagtggtgtcaaacaagtgaaaacaatggctatgatacagtttatataacatgaatacatgatatgcaacacttagtaaaaatatgctcttatttagtgattcccccactttgttttgtcacccggactcacgcttttgttaatataaaggtgttttctccgctaactatttgtaggctagtagtttaatttcaaaacaaaggtaactcatggttgttgcatatcttttgatctgtaacttgataataattggtacaattctccaaagcaaaatacagtgtgtagcttcatatacagaatcaggcgcacaattagtcttggatattgcagaaacaattagtttgcatttcaataggataaatttgttaccaaaaaatcctgcatttttttgtctcgtttgtttaaaaggcagtagctagccaatcttgcttataattattcaatatttatgtagtactatttcactggttcaaaaataccatttccgatacaacttgataaggatagtacagcggaagccatttatgatgctacttattggcttgtagtgttaatgatttacatctcagtgactgcagcatcggtaacttgttgttcagtagtatgtctttaggcagttccccaggacagtctctcttgtacgtaaaagtcttattatgttaccttggtcatcctgtgaggttaatgattatcagctcagagaaattttcttttgaaaatcatttcaatatgttcattcatgaatggtattgttgacatacatcttcgcgttttttagttatttgttttattctcaaactctacttaactgaaaaaccctccttgtttcaggagaaacacaaggagaagaagcataagaaggacaagaaggacaaagaaagaaaagaaggcaaagacaagaaggataaagaaaggagcaaagacaagcacagagataaaaaggatcggaaagaaaaacacaaagacaagaaaaaggacaagagcaaagataaaagcagggaattagaagaaggaactgaaagacacagcgaggctctccatgggcaaaaagttggagagagcagcaggaagtctgaagaaattaaggatcctaaatccagggaggacttggtcacgaggacacaaaatgagaaagggacgacgaatcaatctgttcagaacttttctgtttcaaatcaacgaggtcgtgaaggctttagtgctgcacctgcactggagaatgaaagaactgcagctaataaaatgcatagtcactctattaatgcttcaaggaaaactgaggtcttgggacagaagagcatcagcatcaaccaacaaaaaaatgggacagcaattcgacgtggagacaacatcaccagttcatctcaaagaacttctgatgtcttcattgcagcacctacagcagaaaaagaaagagttaaagttgcaaggcctctctctaactctactgattctgcaccaaagaaagatgggatgggacagcgaatcaataacattagcatactggttcagaagagaactgatagtccaaacaaagagactgcgaagaaagaagctggcaccaattctccactgcttccaagccctgctaataccatgcataagggaaatggtaaggttggtcggccaatggagattccaacacagaggtttgacagtccatcgacttctagtgcaacagcagggacagatagaggaatgcctaggtcatctatcccaagcccaagtattacaatacgaaggccaaatgggcttgtacgaccacctgagagcatttccatttcttctaagaaacctgatgcaggaggtgcttcccctgctatggggaaggaaaaggaacagggtggaaggatattgcagaataatattatcgatccaaaacagattaattcaaaacctccaactatggagaaaattacagatggaagaactgaaaggatggagaaggtcagagatggggcacctgatgttgcaaaggaggataagaagagtgatcgacacgagaaaaagaaaaggaaagagaaagataaacacaaagagaagaaaagggataaagaggcaaagaaggagaaagacgaacaaaataataacaaagagcatgataagctaagagaaaacagtataaattatcaggtagataatagtcttcacatgaagtcctcaacccctcctttagccccaccagctgatgatgcaaaagctgcccaagctgatgaaaacctgaagaagcgaaagaaccacgagatgaatggctacttgcaaagtgagttcattctttttctgttttttctgcacttatcagtattgtatagtgttgtagaacaccattatatttttctatggtacattatattataagacttctgatgatgtacagaccatcatgatacaatgcggcctacaaagttgccaagaccagcccactccaacactcctgtggagaatggtacagcatctcatgtagccgcgccactctcttctgtgaagccggaggccataaatattgaaaaggctataaggcaacacaagaaggaagagaagatcaatggcaaccaggaaggtcaacgatcttcagttgagccacggcttcatgatcctctagttgcatccgagaatggtgcacctactaagaagttgccacacccagacagcaagtatctcagtcagatatacagcattcctgaagcacctcaaatgatggaatggcatgggcacgatgaccaggactggctgtttgaccatgatggcacacaaccaaagaaaaccgagtcagagactgaggccgatggagcttcccaagtgtgggctcagcctctgaagattgaccaggcagatgtcattgcgttaccatacgtcattccctattaatacaatgcagcccaaactgctgggtgctgagtgaggatcctgtggagtaactgagcatttgaacgccaaactgcaacttgtttctaggtgctgcatttgctacaactagtgtagctcggcacaaatgggtgattcatccatttgcgggtagcacttcctatatcctcatgcaccctgctagattggtgcatgagattcatcactttgtgagagttggcgtagcagctgaagaatatcctgagtgaatgctgcgtgggaagacattgtccaattcattgtcagaacacgccgattatgtaaggggttgatatatcctgctgttaccgctgcacaattttgatctgtaaggtgtaaaagcatttttataaccaaaatgtacattagaaagaggaggatggggagagggaggaggaagactggaggattcatttatacttgagatggttccacatgctgttggctgagagtctgcttctgctttgatttatcccaaagtttggctctctacctttgacgtgccttttgtacatagctgttagttttacaatagatgatgtggtgtccgaggttgtaacttgcttcttgcgcggatttcatgttgagagtcatgccatctcctgtcacatacattttgaggtacctaccatctgaagaggatggatgactgttaatttcagttgactttaccagtttaacttctatcccaaattgctttgtatggtttataagagtagcttgctggcaactgtttgcatggacatgtcgtttttctaatggatttttttcgctctgctgtgctgctgttgcctttattccagtattgtttaccaagcttatgtctccattaaactttacatccaacatctgttccttgccaaattttaaattatcagtacccttccactttgcatttcgtgttctgctaaaggatcatggctattaagtgcatataatgcccatagacattaaatatactgcaaaggaatacctagcttatgctaatttttttaagaagaaatggtgaagtgtccatcaagacaagtatggtaccgggcacgctctctgcatacagatacggctcactaaactcgcctaatggtgcacctaatgtttatcatcagtttgtcattagtcaagtcaatcatcgagcgaacaatctaacaggcagtcaggcaatggcaaaattagacggcacggctaataagaggagagagccccacaaagcggtaagtgcagtgcatgacagcatgagcatgacaagactgtatatgtccagtattgcatacgcagcactggagaagtggtctggaaaatggaggctatccgtgagtaagaacataagaaccaatttggttatttcgtaagtagcaacagcttgtttcgaaatcttcagctcctccaaacaaaatgcatattctcacctacccaaattagttatagaaacaaaaagaaaattaattaaagtcaaaagctgagaaacctaacttaacttttctagctgtttctcgaaatctcaagctcctcatataataccaaaaaaaaataaatttaggattattttagttggttaccgaataaaaattcaaatcttgtattttgatttagatttctgcccaacaaaaactgcctgttaccggatttcccaggacggtaattattgacaaaccggtatttgaaactgtatcagcagcagggcagaggcagaggcaggtgcacttggaaaggcgatagtgaggcgtgtacttggaaaggctgactctgcctatgcaattgcacaaacacacatcacacagtgcaatggcaatgcaactgcaaggcagccaaaaagggaggaggaaacagaggagaagtgatggtggtggccgactggccgtgcgagcgtgcattgtctaacgtgcatctatctatccccaccacaaccaccgctttggtggtgagaatgagaggcattctgctcctgggatgggagtgacattctctgcttccagtcgttgctgctgacgactgcaatgccatagcagcaatgatgcttctcttctcttctcctgtctctcatctcatgtactactactaagatcaatcatattcagacgattcctacgcataagctgctacttccaaatcattatcgccatcagccttgtgttcatctgtactagtgtgccaacacttgtgctaatgtaaatcaatgctttcttggggccactagtaatggatcaattgctactagtagtcattaattcattatgcaccatgacaaattgacaaattgatcatcactagcactgtgattcttccaagtggaacctgacagctcaacacgactacacaataggtaaacaggaaaaaagagagaaaataacaagagatgatcccttaaccaaaatcatttttttaattatgctatgaaatacaaagaagaaaaatctcattctcctaactgattagattttggaaggcatgtagaccgagcaaacaagaagaaggaaaggaccaagaaagaggcatatgctcgtgattccacagccagcgacctgattccttccctttccttccttccagcatgcagtagtacggacgcatgcaggcaggcaaccaccaatctgtatctgtaatcagcatgctccatgcttgcttgtttcggttgcagaaaacaggaggattgtcttgttcgtttgcaagcatggcaaaggccagcaacaaccaatccccccggccatatatgcatgacggactgtagatttgttcatatctacatgcatgatctgattatcctatcattatctgcctctgattttaattatgcagagttgttttcacagggatggcactccatttcttgcttataccgagttctgaattcttttttttgttacacggaaaacacatacgcacgtacaacattacacacgtataacgtatagcgcgctcacacctattattacagtcccccaacatgcgctcaaagagacaaagaccaacgtcaattccttggcctcattaaaatcctattgaaaaggcacccatgtatagcacctgaatttttctattgaccacatgcatgatgcatttgtacaactgttcatcagcagaaaggtgctacggttagtatggacctccagttgactactactactacaactgtacagtgaaggactgaactgatctgatcaccagctatactggtatcaatgtaggtacaggtagtatgcatatgtatgtaggagtgagcaacttagcattccgtatcagtgtagggttggatcgacgtgttcactgcaacaaccataccagcaacaaccttcctccatcttgcactgcactatcacactacctcttttagtcatctcctcttttcaattcgcttgccttttcttttcttagtgctccagaatcgcttgcaccccactccagagatcgatgtcgatctcctcctcttctcctgctgctgctaattctctccaagaactgaactgcacctggttggttgttggctatagctccaattctgcagctgcagatcaactgatgcaacaattcagcatcagcatgtctgaactctcaactctgaagaggccttgcattctggacccatttctgcatggcaagcttggtcttgaaggcaagacaaggattcatgtggccgtttgtttattgtgacaaatgttctgcttctgccaatgcgtgcgtacaagtatttctcctttataatgtctgtctgcttcggcagcatgtgaacaatccctttcttgttttccaaatgggattaaagaagaaccaggtggttgggttggagcagattcagagacttgctaaccttatgcaaatcaatttaaattatactacttgaagttgattcatattgaagattacgaagttgactctggaggagatccagtccagggtagatggataaatcaatccatcacttttaccctttatacctgctagattttgctatggactgtactgtcggctggctgtggtaaggttcattcttgtcaaccttgctacctgcttcaccctgaacattttcctgacctatcaagtaaaaaaaaaacagagaggaaaaaaagacgcaattattagggaatgatctaatatcaaataattagaaggggtgaggcttcgaacccagtcgtctagcccaccaccttgtggagctagctggaaaacccccggatatttctccagagagaatatgtttatctagataaaaagatgctaatactatcttaacatggatgtcacaagtgtcaggtgcacttaaggtttgaatttttttttcaagtgctagcatgagacatccaagagagaatttatgtaactttcaagtgttaggaatgttgtacaccatgaaagagaggaagatacactgttgatcatcatcatgcaccagcactagcaaagcagcaatgacaaaattaacaaatccaaaggcaatcaaagagtacatgatacatgtacaatcccctctagtaggtcctaaacaaagataatctggatcacaaatctcaaactgaggataccataccatactctaccacgtacagatctctgtctgtctctactttctctctgtccttctctctcaccaaacctcaactttccccttctttcaggcctccccctctatataagctgccaatcatgcatccttggcaacaaagccaaaaacccaagaaaggagacactgatcattcttgccatatattctaccatatatacatacatatacacacaatttctgtatatatttcttgctaaccattgttgctgctagttgcttcttcttcttctcctctaccttgtcatcgtccgtagtagaagtaatcaagaattcaagattctcattggctgctgctgccatgaaggaacgccgcggcagcgccggcgtcttccccttctccatcggctgcatgtcgcagtccgccgtcgacgtcgccgacccgcacgacaagaagtcgacgacgacgacgcagaacgacccttcctcctcctccgcctccgccgccgccatggccgccgccgcacagagtgagttcttgatcaccgagtagtactgaagatgataacatcaatcttttcaacgacatcattagagtacgtagtgctaacctgcaattgatcaaaaggcgcgagaagaaggcggcggcgagaaggtgaaaggcgccacggcggcggcggcggcggcggtggcgtcctctggcatcgtggccaccggcgtgcagcggctgatcaaggggatcaagagcctgtcccagattttcgccatgtacgacgacgaggaggaagacgaagaggagagg

SEQ ID NO: 65638 - DNA, 21369 bp, Oryza sativa
gatatatatatatatatatatatatatatatatatatatatatatatatatatatatatatatatatatatatatatagagagagagagagagagagagagacacacacacggtcacgctacgtgacgcgagtcacaggcgatgcacgccagctaagccgtagcgccactcagagcgagagcccgcattcccagcgtacagacccgccacctcatccccatcctgcaggtgcaaacagagtaaaaaaattaccgtggggcaaatcagttacagtggttggtttatgagagaaacacgtgattatcgaccaccctgctcccctcccccgcaacagacaactgagtaaaaaaattactcattacaaaatttgtcttggagcgggcgtaattgaagttaaaaaattactcataggggttgactactgtggtacgtttcaatgaaatatacacgtgacaggcgatccttccagcgaaaaaatcttcttgccgtcggtgaaatttttactaatgggtatttttgttcggtatatgatagtaaatttttaactaatcaatatttcttctataaacgtaatatccagagcaatttattaactcagggattcttgtgctgctcagtttgcgagtaaaattttaactcatattgacatagatgaatattgggcgtccatttttcgatccaacggtagtttctacgtttgcattacatataaggtttgcactacatattttttccctataatacttattagggttagtaatgtttttacttctatatattttaaacatcactctcagtatgttcatagtaatatacttactcaatctgtccgtaaaaaagtgagtgaaaatttttaagccatcaacatactagtatcattatccttttatggggcatattttgacacatacagtcaatattagattatggagtattacgtttaatcatatgcatatcaatcgtacaaaaaatcacccgtgcgtaacaaactacagaaccaacaaagagaaaaaaaggaaacggaacccccgtccacgggaggatagaaacagcagagatacggatgacccgagaagcacgccgtacgtggtggtgctgcatgcgctaggctccctccagatccagcgcagcaaccagcgtctacatcggcctcttgccctatacgcatcgacgctggcctggaagctaatcgccgggcctgaagaccgtcgccgccgcacaaggtggaaagcaaccttcccctccattccagcttgaacgttgtttcagggccaccactgccactggccgcctactcgtgtgctccctgaaccgtgctccctgaaccgaccatgaggcacgccatggacgacgtagccggccgccgccaccctcacgggctccgaagaatgaccaccggcgccggccttcagatcgggcaccttcaagagggaggcagcccgacgccaccaatcgccctctcctacctggatgcatgacgacaccacccctcaccgatggatctcctcgccaccactcggggctcggcctccacgccatcgccccaacgagcagaccggtcacccgtcgccgctctatccccaatttctcagatccgaaaaaaatgaaagaggacgggagtatgaatgggggtttggatacggtgagatggttatggatgatataaatagaattattggcgtgagtaaaaaaattactattgtttgggctggagcgttgacagggtgggttgggggtggctcttggtggtgcgcgagtttattggagtgggggtaggggtacaggggtgggattgagattgatcgtcgatgagttaaattttaactatatatagaactactaagaagttggataacatcaagttaaaaatttactcgaactacgagagtgaggggagggggcgcaggggtgggataagactgatcgtcggtaagttaaattttaactgtgtactacggacctggtgggagcgtggatgggtggggctggaggctgtttcaggtgctgtttaatatgtagcaccttagggtgttgtatagtagttatatatatatatatatataaaagttgttcaatgaaaaaaagcattaattaaagttactttctttttttataacttacttctataatatatgtaaattacttttaggctttactgaatttacttttatatgtctaagaagtaacttagtgaaatctaaaagtaatttgtgatttttcatcaaaatataatcatgtgagatcttgttgtaaagatttaattattacgaatacaacggtgaaatcggatgaataatttaagagaaaattttatttaaagcatagatgatagtaatatttcccttacttgctcaatggattaatagcaaccaaaactcctaaagtactagcgcatgggtgtctctagttaaagactagatttacggttttgtaaacgtatgcttgggatgttttttgaattattataaaaaacgtatgtttggaatgtttttttgaattatagagaaaaacaaagaaaaaacaagaaaaattgtctaagcccaggttcgaactgggacctctaattaggaaacctataaaggctggcgggctggggcgacgctggggtgtgccacgttggattttaccgtgacgaagttaccgtgcacgcggtgaaattttgtaaaaaagccctccagtttgtgcgtaattcaatcgaggtcccccacgaaaagttcatttgaagagtcagttcacggataggcccttaaaaaagtcggatattgcatgcgaaagagagaaaattcacgaattaggaccgcgctctaaaacgtggaagcccaggggttttttcgaaaaacgacgccctaacccactcacccctaaccctagcctataggtgtccaaacgggcggcacggcccggctcggcacgggcacgggtccggcacggcccgtttcggcacggcccgttaggcacggctgatgaaacgggccgtgccgtgccggcccacatgccgagccgccggcccaagcacggcccgtggatggccgggccgtgcccgtgccggcacggcacgcctgcggcccacgggccgttcggggcacggcggcccgtgaaggcaggccggcaggcggcagctgagctgcactggccgccaggccgccagccgccaggccgccagtgcacagtgtttttttttaaaaaaagcaaaggaaatgtataaggaaaaaaaattaaaaatggaaataaaatgtttaaaaaaaagtaatgatttactaatgttaaaaaatgaaaaaatggtatttaaaaaatggaaataaaagtttttaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacttttattgatgtttatatcattacaggatacaatgatacatgctgcctcgttaaaaactttgtcatgtaaaaactcataggggaaaatgagaaaaccatgacaaagaaaagagtacaactcaaaggtcagaactacttctaacaaaattctactggggttggtctggatctaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaaaagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtgaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattactccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagttttgccacacaccggaggttctcaatctcttcgagccggtgtgtgtcgaaacacttccgctcgcggttccggaaaatccttccgaagctgtcgccgcctgaaccggtacctcctcaacgacagccgtatgaaccggtacctcctccacagatggtggagttggagccgatccggaggtatcgtcaaacctcgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaataaaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccctgctttcggcctggcgcgtgcgccgctggcccgctttcggcctgacgggccgccggcgaaacgggccgtgccgtgccgcgggccgtgccgtgccgtgccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccgtttggccacctctaccctagccgctgctcacgctctttcctctctctcgtcttttcctctccctctccagctcccgctgccgccggctcgtgccgcctccgcctccccctcgtgccgccctcgacgacgcccgtggccctcctcgacgaccatagtaaaaaaacccgtaccggtggtcgacccggtgatctcgttggttcactggttcaccggtcggaccactgggtcagccggttcaatgctgaaccgaaggcatatgactattatatgttttctattagacaggatgagttagctagctaaatggtaagcatgataaggtctcgacgcacaggttatgggttcaaatcccttcccacgcatgttttctctcctattttgcataaaatgtaaatgggccgtggggtaggatgatgggccttacaagtccagccccaagtgttagcccaacttgcaatgaaccacctgttcttatgagcccggttcaccggttttcaacaaaaaccggccagttcacccggttcttaccgggtcaaatgcacgagcggtctttttattgaaccgaccggtgagagacctggttccggtttttgccggttcaaccgccgggcccgtccgcttttttacactatgggttccacctggttcacacgcgcgggggcggcggacggagggagggacggcgccgctcgggagagggagcgggagcgcgtgcgtcgccggtggccgagccgagccgagctgcgtcgcggtggtgctctccgcgggcggcgagattcagccctgacccgaggaaggtgaggggaattcttcctcgggggtgggtttggtgcattccgtggtgtgagatgcgggggatgaacaaggctttcggggtttgggatgtcgcggggatttgggggcggtgggtggttttcggctgggaatttgcggatttcgtggctgctagtggtgttcccgtggctttacgaacagatgtatatgcttgatctcgtgcggctttcccttctatccctctctccatggtttgctcgcgttggggggtttcgaaaaattttccctactgttagtcctcgattctggtcgtcggcatggtggcggtcgcctccgcctccccgctcaccgccgcggcggcgccctccatgtgctgctcgccgcccgccttcctccctctccgtgcgcaccgcaggaggattttccgcgcggaggcgatgaagacgcagcaggagaagaagcagaccgaggtggccgtcgaggagtccttccccttcagggagacggctcctcctgatgagccgctggtcaccgccgaggagagctgggtggttaagctcgaacagtctgtgaacattttcctcacggtgatttccacgagtcaaatcggattaacatcaaatttgaggcagattttgttcaaattcagattttcattgctgtaaccacacacatattcctgttctattcgcaggagtcagtcatcacgatacttgatggattgtaccgtgaccgcaactacgctagatttttcgtcttggagacgattgctagggtgccgtattttggtgaggatctcgtcgtacatgctcgctatagcctgcaggtctctgaatttcacaatatacaagtatggttcctacacagtaatgtttcggttactgtttcactgactgcctgactattgaacagcgtttatctctatgcttcacatgtatgaaacatttggctggtggaggagagctgattatataaaggtgcactttgctgagagctggaatgagttccatcacctcttaatcatggaagtacgtctctagctctttctgtctgcacatcagtgcatttatatatgctgtttcttcctgttttgatgtccttttagattatgttagctgttagcatatcccgttttctttaactgaatataatctttaaaggaattcaacctactgcttattgacacattatctgtttttttttaatattttggttatggtctttgatgttctgactttattcctcatcttggttcatattaggaattgggtggcaactctttatgagttgatcgttttcttgcatggtttgctgcatttttttactacttcatgactgttgcgatgtcacgagccccggcgtaagaacgtatgggatatgaatgtgtgattggcggtggacgagggggtttggtggaacgacgacccgtgatgaacagcaagggatgagcaaatagagaataggagatgagagaactagagattgaatctgcttaattaaacgccaccgaaactgtgcctctaaataggcgtacacgaattaaccaatgtgctaaaaacaagctaacaaactgataaacagactaacaatctgaactcatccaatcgccgcactgtagtcatccggcacgcagcttccgcgcgctactccgccgttccgcccggcgacgcttgcggaaccacacgccctctgcgacgatacgtaatcccgaccatgacatgcgatgtacatggtgagcccaagaatggcatgtaagtgtgcacctatgccaattatgaagtaaaacacttcatttttatttccatgccttttatgtaatgataacgcttggaattgtttatcttatatacataccgcttttctgaatgtgttgagaggcatgcgtactcaacctatgacaagtttattaagctccatgaaggtaataaaacgttgatggatttgacatctctcctgtcgtgcaaaattttatcatgacaactagacatctcaaaatttttgttgctttatctaggttggacagactttgtaaaccaaagtggaaatgaggggaccgggaaaactaagtatttactttttttatagggataagtttatgcctaccttttgtcacagattgcccttgtgtgaataatttgatacatgcgccagtgaacttatgttatatcagctatttacttcaattattggcaatcaggattcaggcatggtgtttattttagttttataggtatcgtgtgcataaattcaaaaacatgtattattcttccatttttgattaagatgtcggctctggtatccttttatgatgtactatatttagattttttttccgtcctacatagtggttacttgaattgtgggagagttgaaacatacctgaaaaaattagcaaagctagatcccctaaggtctgaacaccaaactggtagactctttgcattactatccattcagaagttgatgcattgtacattttaaagggtgcattttaataaaccaaaatgttgaacactgcaaccaataacaccatgtctacccgacctgtccaccaactagaaatttacaggaacatcacactctgtcaattatatttacgtatttcttggcaaaataacatcctgatctgacctttgactgcagaaatgtagctgatgccatgcctgcatgccacccatgagtggcatacctaatatcaatatcaaggaatgacttcctgtagtgctcttcttccttgagagcacacgcaataagctatcaaagagtatacagcttttccaagaaaacgaaaggtagagattttttttatcaaatatatcaacacatgacctatttgttgacttgaaaaggaggattggttatacttcaggtttcttggtccttgaagtgggaattggatatgcaaactgacagctccttttctgtttgtggtgcagggaacgacagagaattgccactctctaacccaagaaatatcacaggtatctgaagcaaatcactctctaacgttactgtttttttattctgttctaattttatctggctaggaagtgggaactatcgggcgctggaatattgctgcttctttgaagctccttttttttctgtcacaaaaactatttcgtcgaagtaaatggatggttaattcgaaatgtgcccatcttgacgaaaggagcctagcactaccaccacatggccatggtaggctgagtccagaatagagattagattccccaatccatgacatgcaattcgcaaaggtgatactcagattgtgtactgtcaagagaatggtttcctgactttaccatccacaacagagtcacactaatgtaatatttttatgtaccattatactacaacatttttattttccatcaagtttttattcctcatgttcttcacatcctctgtgcttctctggtgatttacatggtattacttcatgaatttacagacatttattttctccatgttttttccccatgtatctatattcacactgctgaactttgcattctattttgcagttgcaagatcttggcagcacacttattgagttgtggaacctaatggacacaccaactgctgaacagaaatgctttgaccatgttacgtctttgatttcagtctcaccaaatacaaaaatgccccaaggatgccttgcacgtgaacttattgagaagtttacaattgatcgaccattttatgttcttttgctttatttggattgtcattgaagctaacttaatttttctgtaaaatccggttgaggttaagaggttgaattcttctgatcattgtcaatacaactatagcgattcattgagggtaagagctcacataacttttatgtgctttactaatctttttcgttataccttccatatttgattactatgcagtagtaattatttttctgatcattgtcaacacgactacaaatatattttatagtagaacctctcatgaattacactgaaaaacaaaggccgaatcatcgcctgcacaattgatctttaataaattgaacctgcccacactacctgtatgtgccacagttctatatagaaatttcgtgattagctacgttatgtaatacctacaccaaccatcctataatactatcactataatttcattgtaccaatatctactattaacaccactattcgcttttatcaccggcaccttccacacataaaaatacttatagacaaattttcatacaggtggacattcaacgaattatgtttctgcgcaaaaaatgtacaagccacacctgatctaaaaaattacatcaatgttattaagcgtttcctacagcattcgagcaaattctatgctgagactgttaacaggacattccttatgcagaatagagttgtaagttcgtacacctcctgttcattccttcaaatttataatacatactgctcgttttttctgcgcaccacagaaaactaacataacatcccagttgcagtactttgctaaagaattttcagaggtacatcgaaccactgatgcacaacagaaaaacaatcaacatttaggtccaagtagcaggaggcatttcaaccgagatgattctgaacatgtcaccagacgggcgctgcaacttggtgaaaggatgggcagatttcgcaacaaataagaacatatctcggatcagtctgcatcttccacttctataaaacaacttacttggaagctactatcgatgttctctaaccaacataagaatgctcttagtcatgctggaggcatccttttgttaccagtaaacacggacatcaccatggacatgcaccgctctccgcccctgccactattactatactaattagttctgcgccttatgtgcttatcacatagtttatgctcttctgcagatgtcaggctccatctatatatatctacttattactattagaggccagtacaatgcctgtatcaacactcctgtgctaactggtagatacttttgatgcacctgtttacaagtgtttatatactactctatgaaatgaacttatgcaccgcaagtggttaaattctgaccatgtttcgtcagatctgtttacattgtttctttaccttcacttgctccagctgcttacgtacagaaatcaccactgtttcctgcttcgtttctttgttggccgttcaggcggcgcgcaaaggcgcgccccaggctctagtacctctaatacgtgagactagtgtggtaaccgactacaccacccaaacttgccgatttagacttggcaaagaatttacatatacattttttctactcgtttcttaagtttagtaagggtatctactcatctgccatggcatgttgtttctgcttcttaagctcctgacctaacttaattcgcagagagcaattcagggaaaacatctatgaaacaattcatggcacgtttaatttagattattaccatgaactgtctactagattataaggctacattaaatattttaagaaaaaaaattaacaacaaaaataaaacaaatgatttaagcaaatacaacagaaactttttttaaaatttttttaaagcatgtaacaaataatatgtttcaataaatccaacaataagttgaaagacgggacctaaactatcattccacctatggagtagaggaattatattgaaatttatcagggttatggataccacatacctaatagtagttgactgaatctcggcaggactcatcacataccatgtcttatacagaaacaaccttcagatataggaggagtttcgcacaaggaaggatgaataaagttctacatggaaacgacaaggactactcggattgtatccatattggtttccctagttctacttggacaaggggacacctataggtataaatataaggccccctaggaggagatgggatacggaacaatagatcaagacacaagatcaacataccagccaacacgccgccaaatatcaacatcagagattagcttagacaaaccctatccggtacctgcgggggccggcaagaggggtcaagcactatctctgatctcaacgagttcgtgctcgaggaagaagactaccctgtcgtcgactacgagttgggttatctagccgtcaagtcgacgacagccagatatgttatcccacatattgtatttgtgtgatccaaatgaataaagagcaacaccggcttcagccaacaggatgtagggttattacttgacaatttaggggctcgaacctgtgtaaaaatcctcgtctccgtctcttttacctaagtctcgcgtatatcctagtactaacgatccccatactatgcaaatactagaatcgcgacatcaaacgtcgacagaatttgttcagaagaaaaaaacttaaaaatataagggataaaactactactaagtgcatatttagaaatacaatacttcctccgtttcacaatataagtcattctagtatttcctacattcatattgatattaatgaatctagatatagatcaatataaaagcgaaaaatgctaaaatgacttacattgtgaaacagagaaagtactacttattttcatgaacatgaggagcaagcaacagttgcttatttgttgggccattaagtacgtgataaatgggaaagagatggttgcctgtaaaaggagataatgttctgatttactcctagaacattgtgagtatgtgacataaaaacctagtctacacgaccatccaagcctccaaggtatgtgaattcttaagcattttgaatagttccgtaggatttcataaggtcaatttttttttcaatagttgtattgcaaaactgttctttttctgattatggagtttgaagcttatctgcacacttcacaagctcctaaatgatagtttaaacaaaactccaaaatgataattttttgttaaaaattctatattctaaatcaagctttcaactttatattagttaattcattattttatacttttaaatagctattacacaaccatattatctatcaatccatcagtttcagctatcttaaatagatgcttcaacttatgcaaatgtgtattacatctgactaaaaaccgttcaactgcgctcctatttactgctccctatgttcatattccttttgacttttactctattcaaacttctttagattttactaagtttataaaaaaataataatatctatagcaatatattagttttattaaatattatattgaatatattttgataatatgtttgtcttgtaaaaaaatattactatatttttttataaactgaatcaaaataaaaaacgtttggctagaaaaaaaagttaaaacaatttataatatggaagaagtattattccatacaatagtactattataaaaataaaaccccatgcttattcgatttatttttctatggtcgtgctaataaatatttatagattcatacaaagaaacatttttagatggttaaccagcagtgttgataataaacacaaaacagcagcgtgcaggaagccaggaagaggaaaaccgacggcgacgggacgcaccgggccaaaattttcaaacttgttactagtactgttctcttcccttctctccacttcgcaatggaaaaaaaaaaaccgggaaaaaataaaaatgtttgggcgtaccacggtggttgtacctagcagcaacgcgggagcacgacgccgttaacgcgctcgcccgcgcgaaatgacgctactaccctcgttgctcttatccactcgcgcctcgtaccaccacaaccctcccggtttccctcgtaaatccggaaaccgagcggaggtaggatggtcaattcaccgcgccgtccgacttccccaccgtggcgttggatataatcttctcgtatcgtctcgtccctcttccgttttttcccccaatttctcgtctccccccttcctccaatatatcggcggcgatcccggctcgaggagaggaggctccgccgcgattttttcggtgtcgcatcgaaattatggtgagttggtttcctccctccccctaattcccgatccgcaattcgattgcgatctccattgcttgggttctgccttttttgggggaatattttgggcgatatcggcgaatatatgctgggctctcgcgcgattcctttttgattatggtggttggtgttcggtgcgttttggttgaggaattttggctctaattcggtgccattaggtgggtttgtgtttaatttggggatgtttctgaattgtttccgtgcgtttcagattggggaatgctgtgtttcgccgagattttctcatcttccatatgtgatatcagattataattgtatgtgtttttgtttcgctgcaaattaattatattgatgcgaagtttctctgcatttgattgcagattttcgatgcattttaggctaaaagtgctcgggtctgaaacctacgtgcttttcttgtcgccgaagatggtgtcagcaaatatacatcgacgcacatgaacagcgatgatgcgttgctgaatccgtctgaagctgcaataagcatgacggttttgcaaattatgatactaaaccattcatgctgctacgccctcgtctggaactttcttcttctgatgcaaccgtgcacaagcaaacctagcctcgaagcgattgtgatgagttttagaggtggtgcgggttcgatcacgtggagttctattggtgttcagtgactcttggcaaaagttctcttgtaaaatcgacgacgatggaaaggtcagcagtaattatctcgcgaatcatattatttgttgcgtgcgcactaatttctgacatggcatctaatttcttctcaggtacaaagtgataagggagataggcgatggcacctgtgggaatgtttttagggcttataacactgaaacaaatgaaattgtaagtgcagctcttggcatagtacatatggttacttggatcttttcatgttaattcagttgccttctgctccttatatctactaacctataaaggaacgaacagtattatttgttgcacctaatcacctatgaatttcccacttgagggaaatgctagcaataatcatcttctacatcaccccagatggctacctattcgagcttgcaccttgtttgttggcttattatgttaacatttccccgaatactgtgcaggttgcagttaaaaaaatgaagaggaagtttttccaatgggaagagtgcattagtctgcgagaggtgaaggtaatatatctcatgtgttatcaaatgaatacaaatttgttttcaaatctgtgtgcttaaaaggagaaccatccttctgcaggcacttcaaaaactgaatcatcccaacattgtgaagttaaaggaggtgactatggaaaatcacgagttgttcttcatttttgaaaacatggttggtctcaagtcattcttggcatacttttttactactttctttatgagcaggaaaaaaaagaggaaaggctaaactattactagcccatatcgctatgatcttctagagttttgtggccagttccattaaaaatactggcatgaatattctatcgtctacaaattacgtgtatatcttgcggttctaatgattatagttctatagtttgtatgcctgttgcatttgttgtgacattacattacgtgtatatctgctgaatcttttggttcacacttctctcacctggagctgttaaatatttagcttttcacttactctggtatcattgtttcttttcacaggaatgcaatttgtatgatgtcataagagaaaggcaagctgctttctcagaagaggagatacggaactttatggtgcagatactgcaaggtcttgcatatatgcataacaacggttatttccatcgtgacctgaaacctggtatacctttcgactatattctgttgaagttataggctgtctatataccctagaagttaattagccttctctctttcctctttagaaaatctgttggtgacagatggcactgttaaaattgctgactttgggttggcaagagaagtatcttccagtcctccttatactgactatgtttccaccagatggtgagtttgtgtttcaaatttatctctgtataaccagtgaatatgtatacaccactttatccaaattattgtgaaatggtgaaggtatcgagctccagaggtgctgctacaatcgtcagcttacacacctgctattggtgatgcctattatcccagcccctgcattttactacttccatttttattaatgccagctcaacatgaaatttgagtttgtgcatataaaactcgcattgcatgaaactactgaattatataactgatagatgtgcacttcctcagatatgtgggctgttggtgcaattttggctgagcttttcacactgtctccacttttccctggtggaaggtatgtatgatactgttgtttgggtaccatgattatgttgcctctgtagttggtaatatccataatttactgtattcatgtattgatgcatatatgctgtctgcttacgcatgttttgatttgagcagtcaacagatcacccttttgatttctgttgaagtgaactcttgtttcttcttttggtgattagttgtgttctttttattttgtggatagttggcctgggaattttggggatttcatgccactatctctgagttgcatttattaattccaaggctgtaaaattattgttgttctgaatactgtaacaacaatattttttccctcatgttagtatttttagctcttatgatgcctatgttgttttcttatacgattaagcctatacttctccatactttttcttaagcccagttcatcttgcacagagtagacctagaccatttgtacttatatttccttgtttatggtgattctgctttgcttttaattattttatttgcttacagcgagactgatcagctatacaaaatatgtgctgtgcttgggacaccggatcatactgtctggccagagggaatgaacctgcctcgttcaagcagctttaattttttccaggtgaaattacttctgtctacaaccattaggataagttgcctttgacactgatttccttttcttttgcttgttcaaaagatcccaccaagaaatctatgggagcttattcctaatgctactttggaagctatcgacttgattcaggttagttatgacacatgagtcttgtttcttacatgtttgatttatatattgttatatgaaccccatgtttttttgtccagttgcttatgtaagtactaacatcaagttaattaatataacatcttacttatatattatattgttttaagtaatttaccatgacaattcacaataaattgcactaattactagtttgtaaatagtgtaaggtatgggtttgtaacatgttgatgatatagcttttgttgcttgatgttatttgtctgagaataatgctctatattaacatggtagtatttgtcattctgacagcaactttgttcctgggatccacgaagaaggccaactgctgagcaatcactacagcatccgttctttaatgtactaatttacacattgagttattcatgggaactatacttcgcttttctttatgtacctaagacttttgagttgtctaggtgggcaactgggtaccaaggccactccatgcctctcacacaaagacaattgaaactagtgagtttctcccctttttctttcaggaaatgataatttatgtattctgttttggtgatttgttgttgtttctcctattgaactccttttatttttgtaggaccgaatccaaggttggaactgaacctgtgggattttggtacagaacctgaggacaactaccttgatttaactctgagtctaaagccaagttttcctggaacaggtgcctaacataatttttcctttgaaattccttccggttattatcttttgttttattggcttatatttccttttctgcttgtagatttttctaacaatgttccagagcatacaaaagaggtgagattttatttgcatgacgtgggaacatatatttgcatgagagtggaatgggtgttatcctgaagttcgctatcatatcatgcaggaaattctgctgtacccaggatttgaaaatcctcctgtgcagtcaggtccgttctttgtctctctgccctcctccatttttgacttatagttcaggactgtatttgcttgcttttttgcgccaacagccagatggttatagatttaattgagatgcgtggtgctcaaacatggcttcctttttacattatttagcagggttttggcctctcgttgcatcagaccggccaatgggcgatgttccagccatgtcatcctggccacaggcatatgtggttgacgggtaagcatcagcatgtcctttacgaatgagttaatctcccaaagccagacttttatatccgctaagtgctatcattattctgtacttcagccaagccacacttccagctgttggattctctggttctccattcggtttgtcccccttacaaccaaatctgtttgagaaccgttcgttcgcaacacccatccggcaggtcaatttcttctgaggggatacaattaacagattgagcactgaaactatttttcagtccatacattcaacttgttcctttatacattgaactcaaataaacgggggcggcagatgaaatgtatataatcgtagcttgtttcctttttcttttctccccatctaaattcccctcacggagtaccctataatgtcagattctatatttatctagattgtgaatatgtgactttccaaaacagttttgtacgtcgatttgtcaaatgataacagcaagtatggatgagcgataactgacgatttgtgaagctgtttttgtatgagatgattcctgtgcacagagctggtgtgtgtgtcttgtgctatgaaacttgaaggcgtgtgatatgacctactgttttgattttgctgtcgtggtctagtacctgccatatcctgaactgaattcatgtttgtgaaggctcgcattgatgcggccaacgacaagttatgggcttcctgggcgctggatgaatctgacatggatgtaagggtgtagttcacgccaaaattgaaatgttgattgaaattggaacgatgtgatggaaaagttcaaagtttgtgtgtgtgggaaagtttgatgtgatgaaaaagttggaagtttgaagaaaaaattgggaactaaaccaggcctaacttgttggagcgatggcttgtgtaccgctttgttttgtgggtgtcagctcaatctttgtgcctaggcctagctgccactgtgcaaggaggcatcaaaccaccactctaatctgagagttaactgcacactaaacaggttttagccacgcagaaagcgagaggcagcaagaacatcgcagtcacatggccaagcaggaggcatttgcttgctggcagctggatagatgctgtgcaagtgtagaacgcgcaaacaaaatgagctgcactggtctgcaatggaaagctgtttttgagctggccttgccttgcctgaatgaatgatgcctgagcctgatcatcaaagttgacattggaagttgcctgtcatatcgtaaagttaagttattaatactacagtactacccttcttcatgtcactcgatagtcgatagtgccagtaggagagtatctcgagagtgaagagcactgaccacacgagtaaagaatacaccttccattttccaaagataaaggtatagttgataccggaattttttttatttataattttttttattaaaagttttacaaaaataattttccattttgaaaattaacggaaatagtcgcctaccgccctctgggagggcgatttttaaaaatcgccctcccagagggcggcgaaaatgacgtggcagacggccgttcgctctccggcgacggccgtcaacgaaatttgcaggcggcccccttgccgccctccgcgagggcgattttgtactgtgcggggggccgcctgcaaatggg

SEQ ID NO: 65639 - DNA, 27990 bp, Oryza sativa
tggggcggaggggtacggtgcgtcgagcgttttagttataacgcaccctgggtgcagtttagcgcgtcccagtcttatataacaaaattatacacttccaagagtatagctagtctacaatttccagatttccttcatgtctaagggcaaaaaggtccttttcattgaaattaaacattcaactaatggaatgagtatgaaagggatcaaaatcaaaattcaggggcatacaagggagtggacaaaactcgagggcatagatgggattggctaagctttcaggggtatagaagaaattttctccaacactcccttttatagcttgaaagggaaccaattagaaacttgcttgttgtggtggagggtatggtcaaatcggttgtggccatggtggcaccaattgttctgtggcccaacatgagttgaatctggccatggcgcatgccacaacacccatcctcgaaccacaccacctaagtaaggaggtggccatggatttctcttggttactccatcaacaacttcttgtcgtctttggtgcatttcatcgagcacttgtcagacatctcattttccacactgatgacggtgtcaagcttcagcccatgaactccatcaaatctgtgattaccccccagaggcctagccatgagaaggaatgaacctactacaagcgacggtgttgacttcaaggcccattattaaacacggcataagtgtgttctggtttatgttagcaattgatatcggtgccaagttactcacggattggatgaacacaacaatgtctttggacacacatgccttgttttagaacaaaaccacgacttcacacacatgccttgttttataacaaaaccacgacttcatcggtaccacccttgacgtcgaggcccaacatcaaacacttggcatccgtctccttggaacaatcaggggtttcaaggtcagggttagtgtcgaggctggtgcatttcatcgaacacttccaaggtatgactttgggaaggtgcttggtgacaatgtaggtaacgtgatccttgtccttaccatcctcaagctccaaggtgacaattagaacggtatcctcgttgatgggcttgaactcgccgtctcctatgtgacgttgttattggggcaagccgagcacatggtgggttctataggaggcgatgccatgggtggttgagatgatgccaccttgaagatggccgtggtcgggtggtaatatcctccatgattgttgttcttcaccgcatggactttctccaacaatttggttatcttctccccacggctaatcatggtgaacatggggtggttttggcagagaatttgtttagcaaagaagaggttgtgataccaatttgttatgaacccactttgccaacaaaaatattaataggtatcagtacaatgaacaagtgcttgagggttgaaagaagcagttagtggggttggagtaggtcagtcaaaaaagcttgagactcatgagctgctcgagctcggctcatctcagacttgactcaagctcggctcggctcagctcaagcttctcacaagcctagatgtatgtttattttttcttttatataacaaggtagtaggttaagaataaattagtgtatatttatgtaaaagtaagttttttttggtattatatattaatcttatgttcttctaacatttttctttagtattgttaacttaaaattattgcttttctaaaatattaacatcaaaatatgcattgacatatatactcagccaaactcatgagcctaaccgagctcaagttgaacctacttaaaagctcgtaggaggattaggctcggctcgagctccagcctagacaggcaggatgactcgagctcagctcgttgacagccctaggttggaggtagaagatatatgggcacaagactagaaggttctggaaacttttagaccatgtagaggaaggagggtagggaagtagatcagcacactagtagaggaacgatttttccgtgcggtcaaaaatgatttttgtgtgcggatcttcaaaccgtctggaatgaagtgtccctaaaaatcgctatttttgcatgcgggtgacgcacccgcacgcgaaaaatctgtttttcatgtgcggggtggttatgtcgcccgcacacaaaaataaaaaaccgtgaaaaaaataaaatccaaaaaaacaaaaccctaaccctaaagctgacaccgccgccctcctcgcggtcgctatcatcgtcgtcgtcaccgtcgcggtcaccgtcgtcgccattgccatcgccgtccgagcccgcctgctgccaccaccaccgtaggatccgggcgggggacggctgccgtcgccagatccgggtggggggcagccgccaccaccggatccgggcggggggcggtcatccaccgctgcgcgcatgcagccgagcccgccactcccggtcaccagctgccgcgcgcacgccgctgagccacgcggtgctgctggccacgcccgacgttgtgcgtgcggaccatgcctaggagtgagagtgagagagaggtgagagagtgagagaggatagagaggtgagagagtgagagaggatagaaaggataaggatgaggatgggtggacgagatgaaatttttaagtgttgaggagtgaaaagaggaggaaggatagatttgtaggcaggtctttattaagaggccagtacgtgaaaattgattttcgcgtgcgggcatcttaagggtccgcacgcgaaaatgggaggccaatttttgcgtgcggacatgaaaacgatccgtctgtaaactaaatagctcctcgtccaggaaaatcgtttctctactagtggcaatgagccaagcctagcctctaggtcgccaccactgcaattgccggattttgctatttgtttgatacctccaagagcatgtattgttgcctttgttctcttccttgagcttagttgggatagcttcactaagctgccgtatcggcccgttgaaagcccactcgatcctatcataatcttgtgatttgcattccaaaatatcagttattgcacttcaaagatttctagttagtgttttgggatgtatgtgcaaattggatctagaacaaagtgagatatgcaggtaggcacattgaactgttgggttttgagaaagtaaaaccatcattccaccactttcttatattcaccaccacaagaaacttcatcctgtaccttgcctggacagtagacactaaagctacaaatgttactagccatccgtcttcaccaatttccgtcactacttcaaaatataaattaacaatttgaaacataatggtcacaggataacattcaggagtttctttatttaaaaaaccatgacattcctgtcagacaataccgccacatagtttttaaagttcctcatagctccatctacgacattgtgcaaaaactcgctcgacgcaatgaagagcctctctacacatgtgccacacacactttaccaggcaatcaaaaagtatgtggtcactagtttctgggaatccacaaatgagagagctgacactttcatgaccttgctgacctctttttttttaaaaaaaaaaaagttaagttgagcacattatgtcttcattggtatagaaaattcactacaaggcactaatgaggcacttttgaaaataccactatagtattgtaaagacatttgaaaaatgcttctgtagtattagaaaaatatttctacaagatatttttgttgtagtaatattctacagacaccacgtggtgacatcttctgcttgaaatgttttctaagtggaattgagaatcccaaagagtaaagtctatcaccggtccctaaacttataccgttgtgtcatcctggtccctaaactcgcaaatcgaccgttcaggtcctcaaacttgttcaattgtgtcatcccagtccctaaactttcatatcactcatctaggtcctccaacttgtttagttgtgtcaccctggtccctaaacaggacggtctaaaaattttgtattaaaaaataattcataacttttttatgtgaactctaatgaagacaaactttatattaaaattgtagcccgcgacacgacctataaatttctagttgaaaagtttttgaattaaaactgtttagggtcccaaaatattgttgcatgtttatagattttgaaatttaaattttaaaattacattttgggacaaaaaatgacttaaaataaaaaaaaatcaactttataagttgtagatcgtgtcgagggctacaagtttgatataaagtttgtcttcattagtgtgaggacgacccaaagcctaggtggtgcaacgctccaaggcatgtcagcgcgaaatatctggatggatggggtctcaaataaagcccaaataaatacggtaaccatccaacctcatcgcagaccctaacatgtcttgaagagtgcactacataggctctaagccatcggatatgaaatagaagacacaaccgttggaatagccacaccagtcgtctacgtcatacgcccgtcaaccactcgatggtggcgaccaaaagcataccccaaagactcgatctcaacaaaggcatattccccggttatctcaaccatttcaaacccatcctcatgtgggactagtcgcctaggaatgcaacatagtctcacataaatcatctcaagcatgatatccaaataataagtggttctaagcaataagcataattagtcttaataaggttctaagtagtacttggcgacaagccataaatattggttcatgcggtaagcgtgctacccaaaagcacataggcaaaccgactaggttaaatccctagttagaaccatcctggaaatctgcaacatcacaagctgcatcaaactcctcatccaaacagtcattacctgcataggggtctgagcaaaaacaagtaaaagaaagcaagaaatcagtacattaatcaaattaatgtactagcaagtcggaaacaatcctagcatactacatgttggccatattcaaggataagctgtgtataggttaatttgcataaataccaattttagttcacaacattttccgcaacggaattttataacaatagtatagagtaagtaaaacttaaatgtaaatggataaataacacacatctacccctcaaggtagatcatcaccactcgccatcatctcatcaccattcaccgaactttacccaagttcacaaacaaaacattccaaccattttccaagttcacaagagtttatcaaaatcaccaactatactcatgacacttcaccatgccgctcatgaccgtgagcacggctaatcgattagttttagactctgcatagtttgtacaacttttaagcccacatgatatgaatcgctctagtttgtccgatacccgtcggtatcaccacactctacacattgagtgtgatctagaggtcataacgaaaccgttacattgtttattgtctagcattgcaccagcacgatgtgtgttttacccacgctactagcaaggtagcgccactaagtagcgggcccacgctttaacctagcgccgtaaggaacccagcccggaatccctcacgaggcacgacaccgttgtattggacagactacccgctcaaatcatcacataccacttgtcattaatcaatttcatcatatcaccaaccataggaagttccgataagttaccaaaacccggtaacccatacccttcggcctaccaagatgcaaggctaaactctaaacaacttaataggttgaggccagcccatacttagcacatgtgatttgtactgttttcattagttggtgacatagagtggggtccttaatcgacccgggcgaatgctccccctatcggtgtacaactaccaccatatgtacaccactcgccgcccaagtctaaaaacaagttatctccattttcagttcacaatactcacacatttaaatttctgtccagcaacatcaaaataaccattttcatatataacatttatcaaaacgagtaatttacaaggcggtaaccgaatataagcatataacggcaatataagcatagtataatcccaaagaacacaataattttattcaaaagcactctatggttacaaccagcaaggattcaatatttcaaggtggattatgcagcaattaggtcatatctaccattcccacatttatattttttttttaccaaaagtaatactagctaacatatgcatgtttgcaatagaatcatttagcccaataaaacataggatcaatgtggtcaaaggaggggcaaacttgccttcgtttgcaaactcctgaacctggtcgtcaacaaactcaccctcttctccttcgacgtattcttcctctatacaaaatatgcgtatacgataaatacaaaaatgcataaaaaccaaaatgcatgaaacttatgcagtgagtgtgtgctggtctcaggtggtctctggtgaaggaatttttattttgtcactttttatttacagagatatgcattttacaattaaaaaggtttaaaaagggctatgttttattaagcaacttttttgtacagaagtgaacaaaattcctttttacaaagttacagagcatgactttagaaagttaacagaagtggtttcacaatttttagagctatattcaatttgttatggatttaacaagttctaggcaacatttatggcaaaacaaaaataaaggaaaagtttgtatagaaagtacccagttttattttttaaaaaaaatatttcacagctttatggatctaataaaactggtttcacaatttttgaagttaaaatgaattttctacaaattttagaagttctgctcattctctgcttgaaaccaaaatagaaatcaattttcgaaattgaattccagcagggtccacaggtcagtgaaaggagatttgcagagaggccctcggaagttgggggaatcaacccgcactccttctaccacctggacagcaaactttcttaagagtccctattcttttgtttatttccatcaaggttctactaatatgattcatggcagttttcagattggaccctagtgtcgatcagattcaagaaatgaagtccccagctagctcacatcgggaacagcaatggctgagctcggtctacggctcacctgcggcgatcggtggatcgaatcggttcgagaacaaaagagaaaatgtagagaacgttcttgcgcatccgtgagtggtggtggtgagggaaatggtggtctgtagcccatggaacatgagctacagcggcggtgtgtcttggtatgcccatgtatgtgcatgcagaggcttggatagtgcaaaagggttagtgcatgtgctctcatatggtaccagggtgctcaccaagcagagaaacggaggcagcgaggtccagggagcggtggagacggtggttgttggccaacggcagcaaaactccggcgtcgacgtcgccggatcgactcaaggcgcgaactgcaacttcgagagtacaggggtgttacggatgagccacagagggtgcatgcgcgaggaatccggcggaaactcaccggagcttggtgttgcttcggtggtgaggaacggcggccggagcggcgtcagcggttcgggtggccggcggcgaggacggtgacgcccaccacgtgctcgacagattggcctagggcaaaacgggtacgggtgagctcggcgtgatgcgtaggtcatgttccataggagggaagagagagggactcactggggatgcacagcgacgatgactaagtcgccggagccggggaagatgaccgagctctgggcattctgggcgtggggtgtgttttcttggacttggaacgcgatgtggggagtgtgctgttgcttctggtgctttgtcttgggaaataagagcaggtacaatagcaggctataagccagctgcaaatatattttaagcagataaatgaggagagagaagggcagcgggccacagatttgtagtcagctgtagcacggactccaaaacgcagtgtgtgtatgacaggtgggaccatatattaatagtgtagtatgtaactattgtatgaataagctattagattggctatagataaattagagctagcagtgggctatactattgaacttgctctaaggaagagtggagtgggggagtgagagagagagaggtggctggtgctctcattgtgttccttgggcatccattgggcatgggggatggtggatgctgtgaggggagagtgggaggctgtcatgtgggtcccagggggtgtggggcccaccgtcagtgaaagaaattcgaaaatagccttggaggcaaagtcaaagagggttgcctgccaaggatctttggaggggattcaaggtggattttgtgcagcaagaagcctgggctagagatcctcttggtcgagggtgatgtggagagtaaatgtgctgaagtggattgggttagaagtctctggtttaggtttgatggagggatgaacatgggttgacagtgttggttagcagcagttgatagtgcagttgatagctgattggatttttggagggagggaagaaagggttagagagtgatccagggtgttccactccttagggtgttagaagaatgttagtagaagacctgaaaccaaacttcaaaaagagattttgaaataaattttacagagagagcaagtttgaatctgctaagcagtttttcaggattttggagagattaaagtagatcaacgagttagcaaaccttactgaaaaactctgaaaatttgtgggttgatttctgacatatcaaggtatttttgagaatttttgtagaatttttggatgcatataattaccagattaattatttttgtgactctaggcctatcattgcatatgatgatgagatgattaagatccaaaaacaattaaaatcactccacaaccacatgatgcatttaaattaaatttagttcttaggtttacaggcttgggtatgttacaattagagttcacatgaaaaagttatgaattatttttaaatataaagtcattagaccgtcatatttaacccagataatattcaaatccaagtttagagaccggggtgacacaactgaacaagttggaggacctaaacgagtgatctacaagttttgggaccgggatgacacagtcaaacaagtttaaggatctgaacagtcgatttgtgagtttagggaccgggaagacacagcggtacaagtttagggaccggtgatggactttactcaatggcaaaataacatgtgccatttactgagcacctatcacactaatattcatgctacttattatttttgtggatgctgagaaatgagttagtggggatgaactatatagtctatatagattcgaatttatgttggcatcatttattattttccatgatacatttccattgaaaaactagacaactgagacttattataataactcggggttatctatttgtaaccattaaccctgttagttcaacacatttaacagtaatttagctgcagtgtgatttattttttgtttcgctttatattttcatgtaactaaattgtcccatgaagataaggtggcttaacaaaatgcataggaatatgaacaccatttatgcttgtgttttagaattttgtactttcttgaacataaaattccattattacctgcaaaaaaataaaattccattattacagtatccaggtccatcaaataatattttggtttgcttacatgtattctacagacaccatgtgtccacaacttctgcttgaaatgtttccaatggtggactcagaatggtaaaagagcttgtgtcaattgctgagcacctactacactaaaagtggcacaagaactaagaattgactcagcactagtccaagctatccgtatggccaagggtgtaaacagtgcaagttcagctggtgaaaaatcagtttatcgttataaacaaaacaaagataagtctgataaaactttctctactgaatgggataagagggctggaatggcaatgcttctagtggacaaatatttgtgactattgcacctgatcattttggtccaattctcgaagaccatgacccaaaaaggaacctctgtgtttgagtggggaaccattggaagaatgtagatagtggggtgaccattttcctcataacactaggaccgccatccaatctacacatgcatggtgctcaattagtaaccttataatacaatgcagaaagtgaggtgcccattttcctcatgttgccaggtgccaggactaaggacagatctacacatgattctcaatcagttgccctatcaagagattatttggatgattaatatcatgtagagtggttcctatatactggaaggtttagtgcatgcctgacgttttgtccctgtggtcagtaaccttaatgatataaacattttaagcaaatagatatgaagaggatatatctgtagaaggaaaaagttgtgtgaaaaaatgatcatgtgtgtaccacacaaatatatattgatatttctatctttttaaataaaaaaagatattttgcttggtgaagtcccacaaaacacttctttaaaataaaaacgtaatgaacaaaaaaacatcttaattaatttcgcatagcccatcagaaacaaaataaataaaggcatgtttatgcaagattcttttgaaagtataaaagcacactagtgaccccatcttccacatcatacacaccctgatatctcccacctcaaatagacgtatatatatagagagatcattaagaaacaagtaagaagagaagtaacaaatacttcctccatcaaataaaaaaccaatccagattcattcctaaaagttgattctttttagtacaaagggtgtagctccctgaaaccgttcacgccatttatttcagaacttatgtcgcactttggtgcacgctgctacctctctagtctaccaccatcacttactgatgtgtggccgatatgatgatctggccatgcattgctctagggacattgcaaattcatctgattttgctagcgctgagagcagctttgtcactgccatccatgtgattagggttaatcagacattgtccatgttggagatcaaagccgtcaattgctgaggcttcttggtgatgccagtggttcagaatatagctaaagctcatgggacgatgggagcaccagagaggacagggacaacaacaatcctgcttgcttgctaacaagaacatcaatgggttcctctacatgctgcaatcggaacaacccatcactgccctttatatccggccgttatatatcctccactttagcaaaaactcgctcgacgcgatgaacaacctctctacacatatgtccatcacactataccaggcaatcaaaaaagtttatggtcactagtttcagggaatccacatatgagagctgacattttcatcaccttgctgacctctttttttttaaaaaaaaaagttgagttgagcacatgtatacactacaacaaaaaccttatatattgacacttttcaagatacaatttacaatttgcctttaacatttagagctatatagtctagagacactttaaaatttgcatcttccagcggcattgtatatttgtataggcaattaagaatttgctgttgggaatagtcccacattgcttatctagggggagttgaaccaacttaaaagtgaggggagcccctcatctcttgagctagcttttggggtgtagcaaggctttctcccagttgggccaacgtctcccggttttgggccaacaagtggtatcagagccaaacccacaatctctagtgcttgtgcactatcagggtggtgtaaacccaaagcccagtggaccgcgggtgtgaggcctgtatgtgcccgtgtgtggggtcggtcagtggaccgcgggtgtgaggcccgtatgtgcccgtgtgtgaggccggtcagggctaaggggcaccaatgtaacccgtatgtgcctgtgtgtgaggccggtcagggctaaggggcaccaacgtgtgacgggagagattgttgggaatagtcccacattacttatctagggggagttgaaccaacttaaaagtggggggagcccctcacctcttgagctagcttttggggtgtagcaagggtgtagcaaggctttctcccggttgggtcaatgtctcccggttttgggccaacatttgcctcaaatgtaaagtcattttcttgtgagattctaacatatgtagaggcactttttaggacattaatatgtgaaaaacatctagatataagcaacacacattaatatgtgcaaaacatctagatataagcaacacaaggcatatattaaacatgtagccacatgaggttgagatggttagtgcattgaagataagaatgaacttctcaagaggtttcgagttctaggatttaaagtagcaaggaatcataaagttttcacttattttttcacagtggtttgctatgtttgtcacacaatctaatgcccctagaaaatatctatactctctttgagaaaaaaagtttctataaaaaatgctgcaatacataaatgccagtttctataaaaaatgctgcaatacataaatgtcttcatttgtataacaaactcactagatggcactaatgaggcatttttgaaaataccaccatagtattgtaaagacatttgaaaaatgcttctgtagtatttgaaaaatgtttctacaagatatttttgcacaatctaatgcccctagaaaatgtctctactctcttagagaaaacaaagtttctataaaaaatgctgcaataaataaatgtcttcatttttatatcaaattgactagaagggactaatgaggcatttttgaaaataccactacatttgaaaaatgtttctgaagtattagaaaaatgtttctacaagatatttttgttgtagtaatattctgcagacaccatgtggtgacatcttctgcttgaaatgttttcaaagtggaattgagaatggcaaaataacatgcgccatttgctgatcacctatcacactaatattcatgctacttattatttttgtggatgctgagaaatgagttagtggggatatactatatagtctatatagattcaaatttatgttggcatcatttattgttttccatgatacatttccatggaaaaattagtcaactgatcatactcattataataacacggggttatctatttgtaactgtcgatgggggatacccgtagaccggataaatagagtggtggggtacgttggtacgaggatctacacgatacgacatcaaagcaaacaaaagacaaggattatacttcttcaggcccctcttgaggtaatagccctaatccagtttatatgagattgatatgaaaaatcacagagtacaaagggaatagatgaatccgatgataccggcaagatccttgtcgagattgatcgacgagatctcccgacggcttcggcttgaatccttcggcttcgtaaactgtggtggatgtattggctctaggattcgatgatcctaaacccctccgagggtgtgccctttataccgcgagttgccttagtctccaagtagaactcggagacaacgaaacatgcacgacacagaatagtcccaagcctttccgagtaggactctgatagtctctagcccgtaaggatatttttcataatatcttgtatatttccttctcgcttacggaaacatacctagaatatgagatacaccaatctagtatacttggttaatcgtaggataggaggtatggttatccataaccctgacagtaaccgttaacccagttagttcaacacatttaacactaatttagctgcagtgatttatttttgtttcgctttatattttcatgtacctacattgtcctatgaagataaggtggcttaatagaatgcatgggaatgtgaacaccatttatgcttgtgtttcagaattttgtactttcttgaacatgaaactccattattatagtatccatgtccatcaaataatattttggtttgcttagatgtatttgacaaataccataaggccacacactacaccagatcctcacacctttgacgacatatctgtgacggactttagcactcgtcagtgatgagggtcatctttgacggttcttataggatgtcgtcatcagtgaggcatccttctgcaacccgtcacaggtaactagtcacctgtgacggtcccgtaatgaaaaccgtcacctctgacggcttccacttctggcccgtcacaggtgactagttacctatgacgggttgcatgattataaaccgtcaaaggtgaggttaactcacctcaaacggtccggtcactaggcccgtcacaggtgtgggtggggacttgactaggtcagactaatatgtatatcttctctctccctcacactctctctctcccttatccacacattttctccaccgcgaaaaaaaatgccttgggcgacgccgctcttgcgacggcggcggaggacccgacgccctcgggcgaggcggcgctggacggcggctcagcaatacgtggcggcggcggtggtgcggaggcgaagcggcgaggtggtgcggcggcgcgtggcggcgacggctcagcggtgcgtggcagcggcggcggcggtgcggaggtgaagcggcgaggtggtgcggcggcgcgtggctgcgagcggcggcggcagtacccccatcctcctcccccttctttctcccctcctctcccttctcttatttctcaatccggtttttcttgaagtggcagcggcgtggagttctcaacggcgcgcggcggtgctgcggtgcggcggctcgacgcagcggtgaggaggcgaggaggaggtgaacggcggcgccgcggcctccatccccgaccgccgggggccacctccatcccccaactgacgggtgccacctccgaccgcctggcgctagatccatcctccacaaggtcaggggacgcggatccggccaccggggcgtcgtctcctccgtccgccggctgcgtccccaactgacgagtgcagaactgcagattcccccgtcggctgcttccgggtgcagaaggcgaagagggcggcgtcgaggagcagtaatagggacgaggtcatccgcaaggaggaggagcaaggtcgcctccaggccgagctcaagaaggtctagcgcgccaaggagttcaagcccaccgtggtatgaagaagccctgcccggcaaaacccacaaccatttattcccttcgtttttgttgctcgtcaggtgattgacgaattgcttgcttgccatggctgttttatgtgtgatgaaatgttcgtgaagacttttctgtgtgatgaaatgttgtgtgtgatgaatgcgatggcaactacccagaagcactttttttttgtttttttttatcaaaatctacatcagtgacgggtgttgagctgtggttgtggctcttttttcctttttttttgggtgatttttctcatctgtgacgggtcacatgatacaacccgtcaaaggtgtctgtcacctctgacggagctacacccgtcaaaggtgagttaagtcatcagtgaccattgatctgtgacgagggggtctatccgtcacagaagagggtttgagcccgtcactgctagcttgttctgctgtagtgacaacttctgcttgaaatgtttccataggttgattcaaaatggtaaaagaactttccatcaattgctgagcacctactgcactaaaagtggcacaagaactaagaattggctgagcactagtccaagctatccgtatggccaaggctacaaacagtgctagctcagctggtgaaacatcagtttatcattagaaacaaaacaaagattagcctaataaaacattctctactgaaagggataagagggctggaatggcaatgcttccaatagacaaatatttgtgactattgcacctaatcattttcgtctaattctctcaaagtccatgacccaaaaggaacgtcggtgttcgagtagggaaccattgggtagaatgtagatagcagggtgactattttcctcataacactaggactgtcatccaatctacagatgcatggtgctcaaccttataatacaatgcagaaagtggggtgcccattttcctcatgttgccaggactgtggacagatctacgcatgattctcaatcagtttccctatcaagaggttatttggatgattaatatcatgtagagtggttcctatatactggaaggtttagtacatgcctgacattttgttcctgtggtcagtaaccttataagatataaacattttaagaagatagatacgaagaggatatacctgtagagggaaaaaaatgtgtgaaaaaatgatcatgtgtgtaccacacaaatagatattaacatttctatcttttcaaataaaaaagatattttgcttggtgatgtcccacaaaacacttctttaaaataaaaacgttgggaccgccgttcaatctacacatgcatggtgctcaattagtaaccctataatacaatgcagaaagtggggtgcccattttcctcatattgctaggactgtggacaaaactacagatgattctcaatcagttgccctgtcaagaggttatatggatgattaagaccatgtagagtggttcctatatatatatggaagttttggtacatacctaacattttgtttctgtggttagtaaccttataatatataaacatcataagcaaatagatatgaagaggatatatgtgtagaaggaaaaaattgtgtgaaaaaatgattatgtgtgtaccacacaaatagatattaacatttctatatttttaaatagaaaagatattttgcttggtgatgtcccacaacaaaacatttctttaaaataaaaacgtaatgaacaaaaaaatcatcttaactaattttgcatagctcatcagaaacaaaataaataagggttaattgcatacatgacattataaattttatggtttgctaatatgccattattattcatatatttggtaccatgtcatttcaatttcacaaatattagagatatgccactacataccacttcacagtattatctactttctccgtttcatattataagactttctagcattgcccacattcatatttgtgttaataaatctagacatatatgtgctagattcattaacatctatataaatgtgggtaatgctagagcagtggtggaggactcgccatacctcgccgcccgctcgtaccaacaccctctacctccaactccggcaagccgctgacggcagtcaggtgcagaggcgaggtgcggcgtcaggcgatgggcgaagacagggcactcgctgctgggccactctccactcaatcgtaggcccattgggctcgtttcgtgttaatgtgggcatatgtggatgattcactagacttaaccctagctcagaaattccccatctccgccgccgcggcggacgatgaggcgacgacggcgcggccgtttggaactgcgggaggcatccgcatccagctccccgcatgagatcaacaagcggcgactgggcgccagagctggtgtgcggtggcgcggctacgcggctaggacagcagacagcaggagcgatgtggtaggcgtaaggcaagcagcagcaggtaagctgaagcaagtggccttcctcccgattcaatcgtccctaatcaatccttgctctccttttttcagattctatgcatatctatcctctcccttgttccagtgattattgccatgctgaatattgatacaatgttgtgccgtacagtatagtgcgattaggtatgtgtccatgagttatacctcttttttttccgtcctccgctactgtgctattagaaaatgttatagtctgaaacggagggagtattttttaggaccaaattacccttttcttcttcctttctacttcccctctcttctctctttttagaatttgatgtggctagtggcatgcagccgtgagatcagttgcttgcttgcacccattttagctaggattcaggaatatacagcatgcattggcctatgtatgtgtataactgtgtagatgtagagacgtacagtgactgaaccacgccatgtatgagcgtaagtgtacaggctagttccgtatagttcgtacatgctgggcagcacctcggctccaacaatgtggcgggcgctcctgccgtccacgccaccgaccagcctgtgaacggaccaaccaccaccgacggcatcttcgaactttgccgagaccacgtcggatgcgccagtggagggcactgatgcagcgttgctcgcggaggtgttttgggagatcggcggtgccaagctgtagtcctcaccgtgcagtccaccactacaggatgcagccggctacataaacctcgtcggatggtcagagtttgttggttggatgacatgagagaggagaaagaaagggatgaagcagaagaagggtaatttggtcctaaaaagttagatataactgtgaaaggatatgtagtggtatatctccaatgctcgtcaaattgtaatgacatggtatcaaatagataaatattaatggcatatttccaaactataaaatttataatggcatgaatctaatgaacccaataaataaagacatgtttaagcaagattcttttgaaagtataaagggacaattatatctgtgcccccactttgaaagccaattgttgttttgcccctactttttagggtttgtatttttatcctcactttttgaatctcaagcagccgtctacaatcacttgtgacagccgtttggtggcggcagtgggcccgcagtgcgcgacagagcgaggcggccgagggcgtgcgccggcgcccactcccaggatggcagttgccgcgtcgagggcggtcgggcggccgcgtcgagggccggccggcgcccgctcctaggaggtccacaaccggcggccgcgactcttctacgcaaagccccgtgagatctccggccgccgccatggacgccgtcgactcagtcgtcgaccctctacgcgagttcgccaaggacagcgtctgccttgtcaagcgctaccacaagcctgaccgcaatttcaccgcaatttcagttgaacactttgtagtttgaagtttaactcaattttattccacaaccgtgttaagtcaattttatttgactgctatcgtttactcagtctttggtagtttttcttaactgcagaagtttgtcactttgtcaggtgctccatcaaatccaatattaactgatttttattttactgttgagaaaatttcaattgaatatacctctattcaatctagttccagaatcttcatggtttgtttgcttttggacatctatctatatgttgtgcacttttgtgcatatatagacttagtaatatgatctggactgtaatatgtggtaatttaccctctatgttgtggatatgtgatgtgtgcaattatgtttgtggacactcaatgtttgtggttgatgacttatatgtaccatggctaatttgtatgggacactttgtaatgcttgctttatatgtgacttgtgctagttgtgtcaaaattctatcgaaatgctgtccaaattttatttaaatttcggtcaaattttgtaattgtctagttttttgtgagtttttttgttaaaaatacaaaaacatcatagcagattctcacatttgaattattcacataagctgaagtcacaaagtaggggcaaaatcacacaaagctgaaaaaaatggggcaaaattgcaataacaaccaagggtataaatatccttttctctacaactaacactgttaaaaccggctgctagaagtgggggtacatggcttcttcagatttaaaaagtaagggtaaaactgcaaaccctaaaaatttggggtaaaacagcaattggcttcgaaaatgggggcactgatgcaattgccccaagtataaaaacacactagtaatcccatcttccacatcctaggtacccttgatcctcccacctcagatagacgtatatgtagatagagcattaagaaacaagtgataaaagaagtaacagctacttctataggatcgaataccaataactaagctaaccagaggagggtgaatggttggtatacccaaaaaccaaaacttttagtggaaataaaagttaccctcgaattcgtcggatcgcggtctaaccgaagtagatgcgccggtctgaccgcctgaatgttgttggtctgaccgagattgcatctccggtctgaccggcgagattagctatcgtcgcctgaagtcgccaccagtctgaccgccacgatgccgctggtctgactgatggtatttcgccggttagaccgccgaaaccgagcaaacacaaatcaaagaactcttgatgtatatgacaactttattacttctttttgtgtttacaaagtgcaacaacaacactcctcgaaaatttcgactaaactcgaaaccctaactcaactctcaattcaatgctctcaaaagcgatatcgggaggccacaccctccctctatttatacatgaggtatgcagtctaaagccacaaactaaactcatagaagaagtcctaatccacctaggaaacctttccgtacaagaaaccaactttacaaactccaatcataccaaatttggactccttccaaattcgactccgcatcacatactccttccatcgtatgccatatggaatcttcaccaaccacgtgcattgatctttagcctaagtatcccgcatgatatctgaccgtccggacgtcaccttatctccaagttgaattccgatccatcactggcaatactctccggaggcattaagacacctacacatgaatcaaacaaagaaaccatattctaagaccaagctatctccaatttgactcattgttagcaaataacagtattacatacgtatagtatctatctagaagccataaacatgaaacatccacggatatccaaacaaacaacccgaaaccgaaaccgacacagagtcggccggtcagaccacgggctggccggtctgaccgctcgcatagcatcggtctgaccggcctcaccagcccggtctgaccagacccgacaaaatagcaaaccctgttcatcacatgaaaatcaatcatatccaaaactacttcgccaataatctccaaatatcaaaaccaataaactcaaatgccaattgttcatcacagaataataatcaaacacgctttgattttacaacttcctccatcccatataaacgaacatctagggatgaatcttgacaagttcataactagaagttgattcttttcaagacagagggtgtagctccttgaaacctttcacgccattttagaatatatgtcgcactttggcagacgctcttacctcttcagtctaccaccatcacttgctgatgtgtggccaatatgatgatctgcccacattgctatgtggacattgcaattttatactctatatttgattttgttggcgctgagagcagccttgtcactgccatccatgtgattagggttaatcatgcattgtccatgctggagatcaaagccgtcaattaattcctgtagcttctttgtgatgtcagtgattcagactgtagctaaatctaaagaatcaaattaagacatatcgattaaaacatttcggtgaatcacgattaaaacatttgggtctcacacaaaacataccgattcaactgatgaaaactaacacattcagaaacaatcaaagacaaaaatataaaacatacaccggaaaaaagtccagtgcaacattatattgatccaacaccagaaacataaacatgaaagatctatggcctaaaacatagaaaatccgccaaatgtacacgtcgggatctaacttcttcctcacttgcgtctctggatcagactttttctatttatcacatctaattaattctacagaaacctcacagttactcaaataaaacgtgaatcacttacaacagttcactcggttactaaaacaatcaatttgagacataaagtttcaacttaatttcaagatcagtttcgcatgcagaagatctttccagtatatatcgccacatcaccctagtgtactgtgtgagaaccacaagaaatcaaccatgtcgtcttctttgccctgcctcgccgtcgccgtcgccgtcgccgtcgccgtcctatcgctgctagctctagctaattccaaccacctgccagctgcctccgtctccgccgccgccggcctcggccgctctgcgatcccgcgcggccacatcgcggccatgaagttcctgtacgcggtgaacgacgtgcggcatcaggccggggcgccgccgctggagtggagcggcgcggcggcgcggcactccaaggagcgcgccacctggctccgcggccccggcgggtgcgacctgcaggcgcagaagggcggggacccggcgccggcccacggcggcgccgtgacctacttcctcagcgacggtggtagccgggcctcgccggaggacgcggtccggctgtgggcggacgagcggcggtggtacgacgccggcgccagggcgtgcgccgccggcaagcagtgcggggactacgagatcatggtgcagccggcgtcgaagcagctcgggtgcgccgtcgccgtgtgcgcgtcacgcaagacgatcatggtctgcgagtactacggtgggcaggcattgatctgagcctatctatgctagtactacaatcatgtactaattaagctccatttttacaaaatactactaataagatagcatatgctgggcatattaattttcttcttcgcggcttgtcttgaatataatgttccgttggaatttgagaccctgtaaactccattttgacatgattatttcactttcggagtacaacgttcaataaagattactacaccccactattctcaaggatgactcaaatttatgcgtgcagtatcttgaataattaatatattaaaaatattacgatttaatatgtcaaaataacaatatatttgtaaatggcacttttatattaattagaaaaatataatggtagaacctatgcattcaagattgtgtcgatatcgaagacaagtaaaaaaagaacaaaaaataatatgacttaagagagtacttcactacttcagtctggaactaaatgccaaccctgtatataattgcacgaatattatatcataatagaatttgtttcgtagataatcggtttcactttatcttcgaaattaagataaaatttattatttgcacctttgatcaactatcaaattgctataaataattttggatgatttggttttattaattagagaagagaaaactgagaacttcaaaagataaaaaaatagacaatttgcatcttaaaccaatggtccaatggttaaaaatagttaatataatgagagcatcaattacatttagtagggtgaagacactaatataggagataagttagattagctctaatatgtttacatgcaagatttgtctcttatcaatattgtaaaagtaagttcataaagttctgttgcactatttttcttatgggtacaaactcttacatccgcactatagtgaaaaagcacgtattccctccgtcccactaactaaggcgcacacatattgtaagatttaactctttaaatatttgatcgataaatagtttattaatgaaattatatttgattaaaatagtatcattggattatcatttaaatttactttcatatgtttatgattttgttactattatagtatatgagaaatttaaaaatagtatcattggattatcatttaaatttactttcatatgtttatgattttgttactattatagtatatgagaaatttaaagtcaacgattagtcttgaaaactgtaccaagtttgaccacgtcgtagtgagtgggacaaagagagtaacaaagaaattaaacattaaatgtgtctttggtaccactacatattatgggagtggtaaataattactaccaagcataaggattttatggataatcccaccttattttttattatggcagagatctaaaacggaaaatgtttcaatccggttgtccgatctcgagaaaaaaatcggacgcctctcgctatgactttgatgcatgcagcctactcctttgtaggctttttgccagatcctctctttgcacacatgctacatatgcttccttactgagcattagtatgcatgaaggagagaggacatgaggttatttgcatgtacataacacccttttagcaaacttgaaaatgatttttcttctagattacttatccaatctatgatccgattacaccaatgtattcgttacaattaaatctttacaacaagatttcacatgactatattataagaaaaaatatacatatgttttaaccaattaaatttaatgtttcacatatgagaatcagatgtttcagctgaaattatattatgttgtacatatttaattagtgtcgcactgtatatatcttttcttagtgtatcacatggtgctatttctatgtttcagtaaatagtttattatgtttcactggtttatttgtaaatgttgcatatgtgttggttgagtgtttaaataagtattcactagttaattaaaaatgttgtacacggtatcatccatacatttcagcaaatattaaaaatgttgcaaatattatataattggattatactatcatatttgttgtaattaaattttacaacaagatctcacatgactaaatcctgatgaattttaaatttagcttaattttatgttgcagttaatctttttctgaatgttgcacactgatttatttggatgttcctataaatatttttccgatgtttgtttagtttattttgcaaatgttgcatgtcatattatgagtatgttttagcaagggttgctttatgtttcaatagttacaactcgatgtttcatgtacatgtgctataaaaatatttcaataaaatcaagtatttgtaaatctatagtatgtaccgtactatttactattttcttttgtgtttcatttgttaagattcaatgtttcatgtagtaatttctagtgttgcgatgatattaaatattatatctctttgaaacataatttgaaacataattaaagacgagttgaaacatttgacctcaagtgctgaaacatttttttataaccgatgaaacatcttttttgcaattattttttatcaaaataaaatcatgttggatcttattgtaaagatctaattgtaacgaatataacagtgtaatcgaattatagattggacaaataattgagaagaaaaaatcatttaaagttttctaacaaagttagtttgtgctattatttaatgggagagatgagagagagtagttaattcaccatgtacagaaataataaagtaagaatgaaatagtgcatagctacatgcatgtagcagagccatgtgagtagcgtacaccagcccatagtagcatccgatttttgtattccatcagacgtccgatcgctagtactctcactctaaagtatagatgttggatttttttagatgatctcacttatttctccatcttcgcatgcacgtatacgtattatggtgtctctctaacatgctaatgtcacttgacacgggcagcccacttattgtcgagttggacaataaacattgaggaacctagctggtgattagaaagtattttaaacataaaccaaaacatcatatttggcattcacatgtatattttttatcattacattttctaatcatgtaattaatatgaaatacgaaaattgttggaaacataactacgtgaaaacattattaatttttcatgacaaatctactgatattatttttatataccaaatcttatcattttttatatagtagtgatctctaaaatgttacgttcaattgtccgtacgcatcctaaaattaacagcatccattgtgaacagagttgatagacttcagttgattttgaaacgtaaagtgtcacagagatataggtaaaacttaattatatgacatagtaccgatcaatccttttgcttgtaagttgtaaccgcatgcgaacgttttattatctactagtatctcagaactcacttgcagttactcgcgtagtagttaacacgaatcactggaagcaccgtcactcggttactaaaaaatactccttccgtttcaaaatatttgacaccgttaactttgtagtacgtgtttgaccattcatcttattcaaaaaatttaagtaattatttattcttttcatatcatttgattcattattaaatatacttttatgtacacatatatttttacatatttcataaattttttaataagacgaatggtcaaacttgtattaaaaagtcaacagtgtcaaacattttgaaacggaatgagtatacatttgtgtaacgaaagaacaataaatttttttaacagcagatgtaggagttctacctgatatattaaaataacaataaatttgagacataaatttcgagggtttcatacaaatctttagttactatataaacaaatcttcatcatacaaaagaaaaagcacaattaaccatgtcgtcttcctcctcctgcctcgccatcctgtcgctgctggcgctagcctcccacctgccggacgccgcctccgcgcctcgcggcatcgggccgctcagccccgccgcggccgcgaagctcgtgtccgccgtcaatgacgcgcggcggcaggccggggcgccgccggtggcgtggagcgcgacggtggcccagcgcgccaagctgagggccgaatggctgagcgacccgaccaaaggccggtgcgacgtggcgaacgccggcctcgatccggggctgacccgagtcctgctcaagccgatcgtggccctgacgtacttcgtcaccggcggcggccccgggcggcggcgcgcggctgacgcggtgggggcctgggcggaggggcggcggtggtacgacgccggcgccaaccagtgcgtggccggcggcggcgaggagtgcgcgagctacaaggacatggtgcagccggcgtggaagaccgtcggctgcgccgtcgccccgtgcgcgtccggccagacgctcacgatctgcgccttctcccctgcgtaaattaataagaaagcgtgcgggtttgatttcgcactaataatgttccggaaattgaaacatttgttatttttgagagtccaaaattttggaaaatcatatcacagtgttgagattttccagacctcttaagtccagacaacccctctcctgtgaagacccttgaaaactgaccaaatttatatgaagtaccactttgctattcgtatttccgccaaaaagttgcattccaatttaaagttttaaatcgttgacagacactggtggagaaaccatctttaatcgttcggccaaattctacaatagtcccggttctaataaaaaccggaagtaaaaaacatctttagtcccgatttaaaagttgaggggtactttttaatctttagtttcggttggtattaccaactgcgactaaagatcttttttagtcccggttcaataagtcgtggggttcaagacagaccccaattatttttactcccggttggtataaacaaccgggactaaaaatagatctttagtcccggttgtttatactaaccgggagtaaagagtaccccgaaccgcatgccagatattatccgcgtgccaccaaaataattgtttataccaattatttttactcccggttgatataaacaactgggactaaaaatagat

SEQ ID NO: 65640 - DNA, 702 bp, Oryza sativa
aggcgtgaccaccacggcgcgtcgcgcttgtccgcgtgcctgctctgcacggcctcggcgtaccatgactgcagctcgtagtccgcctgcacggccttgtcgctcgggtagtaggccgccacgtacgcctcgctccaccgcgagatcgccgaccagaggcagcccatcggcggcgtacgggtattcctcgatgagcagccggagcccgtgcggctggctcgggtcctccacggccatgcctctgcacgacacaaccaaatgcccatttcactcctcgccggcgcccaacgaccaccgctgttgttttccctaaatccggccaccgccgctgccccaaaccccagatccggagtttcacgccgccgcccaaggctgctcttccgaccgccactcgcttgcacgtgggggccacttctctgagccctgcgccggttgctgcccttcaccgccggagtcgcgactggtgaccaccgttgcctcgccgcgccgagcgttgctcggcgcgagtgagaagagagcaagagagagacagaagaaagaaggagagcatgatgatgtgttcactggtagggtccacgtggatcctacgctgactcagctaccacatcagataaaatcggggtcaaacccaccaaaagacctgtggtgaacggttttataagttaaggaatgtcatatatctgtttttgtggttggggaaca

SEQ ID NO: 65641 - DNA, 2511 bp, Oryza sativa
  unsure (1)..(2511): unsure at all n locations
gtagattacagagtgtatagtaccaaagtagggactagaaaacagaataacacagcaacacataggatgaactaaaagaagggtgagtggctgataccttccctggcaacagctcaaatgctcaatcagtacagtcttcttttaaacaccagcattaatgtatggtcatgtttgggtccccatacagatcactaatgtagggtcatgttggatcccctctacagatcactaatgtaggaccatttcatatgtttggctcctctacagatcaatgacgaacacttttgtctgatagtcacaacaccacatagttctttggtgctctaagtacgtgtaacaagggttttgacataaaacattatgatgaacaaaattcactggtcgatctgaatgatgcccaataacagaactcattgatatctgagctgaaaatattttactgccatgttttgttaagtatcaccacggattcagttaataattacaatgtatcacctatcaaaatcaatgtctgtgccaaaatatcattaagacctcaagagaattatatgatcattcatgtcgacagtgaaggtgcccagcaattctgttaatcattggcttaagtatgttaaattgttaatatgatatggactaaaggtgtgtaatgagacatcgacatctccacaaatttacaaaatcactgaattgattatgctgatataatatgcatgaagctaagggaaattttggaataaaacataggggtcattataaggaacaataaaaatatcttaatatgtttagctgttactaaaatatattgttagttggttgacgtgtacgtgttcaaaaagaaagtttaaagctacaaatcactagcttaatgctggtctaacatagacagcgaggaaagtttggtgaacaaaatcacatcataccaaacacggtgaacaaaggaagagttagacgccatgtcatcctaactactgcttcttttctgtatactttaccatagaaatgataaaatgagcaagaaaaaaaattaccatgttctaagaagctgctaaaaaacaaggtagctttgttgtcatatgtccaggaagagtttgaaactaggctgtcgaggtgaccaatatttttttgtatttcagatggaagctcatcaatgttcataggtggtacttgctttgatcaacttatcaacctttgtactcattgttccagatcaaactcaaacgaacaccagtaccacacagttaacccgaaatattggtgaatattaaacaaataaaactgatgagcaaagatgatcatctcacccatttctacatctatcaagtgtcaagtattggtgaatattacaccatcttcaattcagtagaagtaacaacaaacaaactgtggtagcaaatagccaaataccaactcgggttgaggcctccaaaacagcaggagaaaatttttttatcgatcaacaaaagatacatccacccacacaactctactactaaatcatctgatcagtaacaaaagataagcaacacaactagctatcgccgccgcaaaatgcatattattcctcaagttcgcctaccgcgcacgcatcaaatggagcattcgcaaacgcctcccaccctccattagctcatcaatatacactcgcaatctcaaatttcatcgaattagtagcagtagtagcagtcgtagaagagatatcaggatcattaccttccttccggtgggaaaaaaaaaatataaatctaacttgcaaatgttccaagggagcctttcattccgagaagtggaggaggagccatcattagccatggcgtgaggagagcggatcacagagggtttttaccatccgtggaagatctcggagcacttgcccttgaaccagcggaggccccttcgcagcgacgccttcatcttgccctccaccgagtacgccttgtagctcgccacccgccgccgccggttcatctccgggtcgctgaagcaccacatgccaccgttttcggcttcttcaccggcaccccccgctccgccacctcccaggtagccgtcccgcctcccgggcggcggcgggagcgctaggcgcggcggagggggcagcggcgggggcggcgccgtggtgtagatctcgatccgccggtcgccgttggccgcaaagccgccggtgcccttggaggagaagtagcccgttgccggtgggggaggaggaggaggaggagggnaggtagtatccgttggagtgcgggaagaagtcgtagtacgccgncggcggcggtgggcggaggtcnaggtcgctccggtaggggcggtggtagtcggccatggcggaaggagtgggagagatgggaaatgctcttgtgttttttttgctttgatttgagagggtggagggcgacaaaaggggaaaggaaggagagaaaggagagtgttgtgatgcaaccatgaagaaaagtatcactcatcgatgcattattgacagttggaaattttctttgtaaaaagcaattttgatac

SEQ ID NO: 65642 - DNA, 999 bp, Oryza sativa
acgacgtgattttcgttgcaatacataggggttattgctaccgaagtctaatttagttacgataggggggcatattgccactaattgcgtagtgttgcgattgtaattttttttgttgcaataagtaggaagtatcgcaacgaataaatctgcgttgtaattagggtgacaatattgccacgctttttgttatcgttgcaatagttatccatgtcgcaacaaatttagagcgttgttataagattcatgtatatagcaacgcgaaactactttgttgcaaatgagtctataggtattgcaacgcaaacctaaatcgttgcgaattagtctataggtattgcaacgcaaacatgaatcgttgcaatcattctttgatattgcaacaatgttgatatttcttacgatccagatagaatccgcaagcgcacggatataccgatgtagcacttcccctacggagtattccaagggtatcaaatccaaaggaacgtgtgtgattatctcttcctccggttcatccaaggaaacaaagctaatgtgggcagaggacagagagaatttcctaatgagaaatattgtctagggaaagcttaactttaatcctaatgcaatacttcaggcactggcaacccgctgctcctagatgtcgctctactatgtacccggactgggaggacttaagtgatctcgagggctgtcaccacctctacacctacctcaacgtactgtggaatatgcagcaattactggataataattacctaaataccacatctaagtaattaatatctactttagtgtttataactcaccaaagcaatcactatattttagttgattataatgaacaataatctcgtatgctatttaggaactaaccaagagataattctcacaagataaatctaaattactcaggaagaatattacattgaattcagagtaataaacagaataaaaaaataggagaagattactgacaactctaggattcttccg

SEQ ID NO: 65643 - DNA, 11215 bp, Oryza sativa
ccaatggaggcgcttgtcggcggatatactccgcaccttgccgaaggtcggcaagctgcccaaacccttctaggtacctcatagatgctctagaacccctccccgagccatgtctgactcacatcaccccgatcaccttcacggcttaactatgccatcgccgccctagccgctagctcaaccacataccaaattaacccctccgccgccgcttgccgtcgccggagaaccctagctccctcccctcctcggccgcaacccctttccccctctagcgccgccgtaatcccaaaccctagcgccgccagccacatttggggaacggctggaggttgaagaagagaagagagagagagagagattgataggtgggacccgcacaccgtgccatttcacatttaattgattttcaaactttagaagcacatatcttttaaaatatagatctaattccagtaaaacttggaccaatattcttctaaaatcattctctatcttttgagaccccttttgttatttttctattttattttattttccctatctttcttatttttgaattttatttgaattccttttgaatttgaattttatatgtctaaccctaggtcttgaggattcttctaacacactagataacagcaatcaatttcaggacatcgagcaaggcaagttaccatataccttttgatcatttaagcctatattttacaaattatttatttatagccttctattcaatattctattttatatgcacaattcaaccatagaaacccagataatttagccttgcttacttcgcttataatctggttaaaatatcttatacttagattgggacagtacgttagaattggatgatttccgggtggctagtaccgtctcgatcgatatagttattaccaggtacttatgtcgaacgaacgggtacgaccgctgtttctagaatggggacaaacctagatattatgttaattagcaatatggcacctccgtatagtggttcttatttttaagccctcgcgcaggaggcatttatagccgtgaagagcaacttttaaccattaccaggtacaggtaaatggtttgtgatactcgtgtataaactatatggtatatttctaaaccctgatcgagatgacgtggtgtcatacggtcagttccccttaaatacctcgagaacgccagaactcctcttgctgctgttaacaatacgttcagagcatatgaggatataagttcatggaacaggtgccacagttgttaataacttgatactgggccatgactaaagccgatgattatcagcaagtcgtggactacgggtaaagcgtacatctgctgcagtagaatatctttgaaactattcgaatagccgtactcatggagttgagtattgggactcatatggtacactggttagaaatttaaagtctatatatttataaattcttgctataactcttccagattgattattactttttttttgcaaagaaccctacaatatgccagtgcataacatatttccatgataacttgctgagtattgtgaatactcatccttgctctcataacccctttttcagatatgggtcaagaggaggacccctatgactattactatgatgaccccgataatttagaaaatccctaaaggttatacctccctagttagaatgtatagaaacttccgctatgtattaattctagttgatcaattaggtgagtacctaattgtaaaactcttagtattgtaaaactttaacatatgcaatgaagaaccagttatattgtatgtatcaatatttactgatccatggattgatacattaatcatagtcggatccaagtaattaattttgggacccgacacgatgtcactgcaaacaaagaaaatgtggaccctactataggaaaatctaaagtttccaaagttacaaagagtatgcttactgaaaatgttgggaaagggacagcagcgaaatacatttcctctaaacaactactatctggtgctctaacgtgagcaagcaacaggaaacaactggtaagaaagttaatttttgcattgccatttcacaatccagcccaacctattgctatcatgcagttcaaaccatgtttgtattcagcaggaaactcaaactcgggcggcacattaagactcaaagattggtagacatgggaacaaagaatagaggggttatggaacaatatagggtttatggacattttattgttgaatggatgaatggacaagttacaatgtatcgtcatatttatgtactcgttatttcaatgggctgtaagactaatgatagtttgctacctcaaaaatttcaatatatatgttgcagtaaccaaataaatcattgttatgacatatttcgcttcgttgctatatcctaccgtatgcgacgactcctaattcgttgcgatatggttctatccaatcgttgcgatatggttcaatcctatagcgacgggtttactttgttgcgatatagttgtagcctatagcgacgggatgcatgttgatgccataacctagaagcatatagccacaatccatacttagttgcgatatccttcgagcgtatagccaccggttacatgttgaacttagttgcgatatccttcgagcgtacagccacgggttacatgttgttacgatacacgtttggtgtatggcaacgactctaacttcgttgcgatatccttcaagcgaatagcgacgatttactttgttgtgatatcctttaattgtatagcgacgagtcctacgtcgatgtgatatcctttaagcatattgcaacaccgtacgtgttattgccacttgcaaatatcgttgcaatatacaggattgcaacgaaactgaaacgttgtgataattcttgtttgcaactatctaacgttgttgcgataacaactattgcaatgtcaactcgaacgctaaatatcgttgcttcttcaatctttccccatgcttcgtctcgttgcaacagcccgattttatggcaacgcgtgagcactcgttgcgataccctatcgcatcagaggtacttgcaacgcatgccaatgaaattttttcgttgtgatttctctgtattgcaacgaaaacacccatatcgcaacgatttggcgccgtggtgctaggccgatttccttgtagtgtgtgctcttgctctttctgcagtcatgaagagaagaatcacgggtttgttcaagaagggatcaagctcatgttcaagtcatcaccaagataagtcgagtacacactcttccaccgatgtctccatggaggaggtggacacctcgccaaggcttctcgatgactccaacctcgacctcataggagaccgggagatgcagggctatcacatgctcaaggatcggccatttgctgacaccccagcatacgacctagaacttcttcagaaaataggtacggatgttgattttcgtattgtttggaaggctataggatgggagaaatttgctgtggtagatgagccaggttctcgcttacttacctagaaattttttatgtaccttgctactttgctagaagtagatgatggcatttctttttggtttttctgtaaggagttctatctctcttttaaagaattgagtctgcttttaggttttgacaaaacttgcaaaattaatttttggaaggcagcttccaactctgagaaaaacaagttatgtagaaggcctagatggcatccataatcctactcttagactcatgtataaatggcttggcatgactttatttcctagagctaatcttagacccattcgtgaagataagttgattatcttatttgacatggttagaaagataaaagtttctcttatgtaatacatgattcgccaatggttagaaaatttcaagttttccggtcctattgagtgcacttctttggtttctcgcatagaaaatgcacttggggtaataaggggtgatcaagtcttacttagttgctaaggttattgtgtacattgatcatgctgctctaaaattcctgctcactaagaaagatgcaaaacttcgattaattagatgggttcttccactccaagaatttgattttgaaattaaagatataaaggagtagaaaattctgtagcagattatttgtcgcgtttaaatattttacatttcgcatacgttacttgccttccaccagggcatgtcacagccacctcatcaaaatgttgccaaacggccgaagttcgtgatctctttgagctggtgttcgtcgatggactcctgctcatagttcctgatccatctgaagccaccggtacctcgtccaaaactgacggtgttggaaccgatccggaggcatcatactcgttatttatgtatgacgctgataggtaattagggtcaaagtcacccaaattgaatgacagactgctcggatcgtccatgctgaatattataaccacatggacggaatttcaaaagaaatatacatataacataaaatacgaataataaaaaagggattctccaattctttcttaccttctttacaccttgtgcatgcagttttgctaaaaaaaagtggacttcacaaagtatttttgattttgaacaaattttgtttagataagaaaattgaactagcacacaaaagaacaaaagatagcacaaaatggaaggtttggatgattcaaaatctccatagtgagtgtcctatttgtaaaaaaaatagaacttttctgatatttttcgcattttttatattttttttgtgctccaacgatcttctcagctggattggtgcagacgggcgggcgcctactagcactattggcaggcatggctgtggcgactagcggcttggcgcaggcgggcggtgtgaggagagggcgggaggcaagatgcgcgcatgctgcaattggtgaaggcgggcggcccgcgtgagccgcgaagggaggcggggacgcacgggggtgcgtgcgagcgtgccgcgcgcacacattggcagctgggtgcggcactgtggacatgtacctgcggtgggctggtggcttgggcctttcgtgccgtgctgggccatgcctacccagtacacgccatgccataccaacccatgggctgtggcctcgacccggcacaacccagaagctcgttggccagtgccgtgccgggttggatactgtatgtcacgtccagaaattcactggtaatttcggaacttatttgtgtataaaatcctcatacagaaatcagccgagatacacaaactgacaatttaatatacaaattcatcaaaataactaaagcaataaatacctacataagaggtacttagtccccaccacgaaaaaaactgcagcggaaaaataaaatctagtgaagcttcagctccactcccataggcagctcaactggggtataagccaaacgtcttctccttcacaacttttcttcaaccgaggtttgattgattattgcaaggtgagtacatggaatactctacaagccacacaacaaaaatgcaagtgcacaaggataccaaagaatggcataatatagggctcatttgcaaaagcaacatttagcaaacatttgagaattgtaaaacagtagaataataaatcattaatattaatcaacactgaacagcacacccatgctgcatatgcctaaccaaaactgaacaaccatacccggctgtacagatctatctccaaaccagaaatgtaccattccaaaccaggagctaagcaaattattagcaattatatcatcatttattatggtgagaagtgtgagcctaatcacgaaagacattgttagacccgcccacaaccacgggtatggctatttgttgggtcccaaaactaatgattcggaaaccgacatgtttaactgtatcaagccctggatcagtagattgatacaggttcaacaatctggatcttcattgcatacatttgaataaggctccaaaggagatgttattacaaaatatatgggtatttacaaacttgtggctaactaatacagcagaagctatagaataaaccaactctagtgtattgctatagacttaaaccatctaactaatctagacttgagaactagattgaaatgaaaactaacttatatgattgaactctcggcttcggcaagaactccaaattaactctgaaagaagggggttaaagtaagggtgagtacaacgtactcagcaagctattatattcaagtatgaatgtatgaaataatagtatttgagtagagctagatctatttgcagaaagctgagaaagtagaaggagaaagtctataatgttttgaaatgcaacaatatttaataaaatctggagttatatttctaaccaagatgccatagtgagtcccgatgctcaatatccgtgagcacggctattcgaatagtttcagagatactcatactgcagtagatgtacgctttacccgcaatccatgacatgctaatattcatcagcttagtcatggcaaagcttttcggttactaacatcaacggtacctgttccatgaactataatccccacgcgctctgaacgtaacgttatcagcagcgagaggagttctggcgttcccgaggtctttagagagaactggttgagagacccccgtcatcccaaccaggttttcacaatacacacacagtgcgcaataatcaatatatttacctgcgtctcggtaaatattataatcgctctgctcggcgtaaatttgcctcctgcgcaaggacttaaagaagaaccactgtacagaggtaccacctttgctagataacctactttgctaagtctgtccccattctagaattgcggtcgtactagttcgttcttcacatgtacttggcaatcttatgtcggttggaacagtactagccacccgaaaatcaaccatttctaccatactgttccaatctaagttcattatattttatgcaatctaactaggcatggctaagcaaaatctagcatatatctggtttactatatgttcaagttatgcatttaaaatcatgaatggctaatgcatggaataatagagatatagaatataggataataatgctcaaaggggaggaataataacttgccttgctccaacgcaaacaaatccaagataggcaacctaattatccgatcctcaaaacatcacaagttgccatccaaaagataatagactctactaagaaagacgaagaactaaattcaataaaagccataaaataacaagaaaacgataaatggttaggagggctagggtttggttgtgtgttagtcgatgctagatcataacgactaggtttggtatcttctctagccggtgtcaacagacagcataacggttagagggataggaggtttgtgtgggtttagttgggcggaagtgttactccgacaaccgtgagtggcggcggagcgactaggatcacacagagctcgagagctaactgtgcggcgtgctgtggaggtcgagggaatagtgaagctccgaccgctatacgcatcaaggcgtggggtgccagaagcagcacttcgaccttgggtttaggctttgccgggctttataaccaacggttcgacgttgaggtccgtagaccgcgcaaacgtccccatggaaggcataaagttccaaccggcggctttttagtggctaaaggggtaatttgggacaaaagaaaatatttgaaaaggcaaatataaattcaaacgatatttgaataaattcaaataaaattataaaatacaaaatttggtgtcaaaagatagggtttgaatttatataaatttaggtccaagttttactggaatcggatctacggtttaggaaatatgggcttctaaagattgggttttgaattaaatctagaaaatgagaaaagtcactgtgcaggggacccacctgtcaggcttttctttttcttcttctttttccttctctccttcttcctcccgttcctttcttcttctctttcttgccggcaacagagaagagggagggaggtggggcgccggtgctccggtggctggatggcggcgacgccggcggcgggtggtgttccctagcaccacgcacctggggaggccgttggctggtagaaggagtgagagataaggccggaacggcgacggtaagggctcacctccggccggcatgggtggagacggtggtgacttgattcaaaggggaagagaagggggaaaggggcaaaatggagttgtcggaggtaggcaaagccggaggtgcgaggaaattgataggggagctatagagaaagagatcgaccgacgacggcgacggccggacatggcaggagagagagagagatggagcttggtttgtatgcagagaaggggagggattggcgggctatttataggagggagaggtcggtttggaggaggagggcaagagggtcacggcgccggtggagtggaggagaaggaggcggcgccggctttcgtttcttagcagcgacggaaaaaaattggcggcggcatggagaagacgaacacgtcgcccgttctgtcagttgattggccggggaaggcgcttcggctcggcggctgacatcagaggcgtgaggtggcgctgacgtcgggcggcggttgcttagcgtcgaagacaagacgacggcggcgcaaaacttcgagtggcggcggcaaaagccgtgacggcagcggtggcctgggcgccctgtgcgcccacgggaggagaggcgttggctcagctggccggctgggcttggctgggccgaccctggtcaattgggccaaaaggaagaaaagaggagactttggcccaatagatgattttctaaattttgaatagaatttggaggagattgactaggaaagtttgaaaggaaattatatttgaatataatttccaaaagagatatttctatagttggtttgagtgcaatactttagagatggagtttatttaatgcactcaaatagaaattcaaaatattcaataccataaataatatggctctagatttgaatatttttgagtatgtggagggaatatggagggagtagagtaaatagaattctagcccaaaatatgtggtatgaaatttagagaattagatatgggctaaacgaggttttgaatttggggcggagggataaagtctattctcttagcacaagagcaattattcacaatatttgtaataatattatttttgtgccgaggaggaaatcaagccacggaaattaaattggtggctagattgaaaaaaggaatttggatacttgaaatttggaaagggaactaaggataggtttggaatcaaaggataggttgacaattaattccaacaaatttggaattgcttcggtttaggttcaaggatagtgttggaggatttcttggaccatgattcataaaagattttcaaactaaatttgaataaaaggaattttgtcaaaggaaggtttttaaattaaaacccaaaatcaagaaacaccttaatttaactaaatatatttttaaaggaaagacacaaaagaaattaaataccagaaagagattttatgcaggttaaatttaggaggtctctttaattataatatcctaggtttaggaggttaataaaaacataagaaccggtatgatgcataattagaaaatagctaatttttagtatgttacactattcgaatagttttactctggacagagatataccactgtaaccacaagacatagccccacaacatgtcaccacgcgcctcaataccaccatggtacctcggaaaggagctgtgacagtacccctcgcataacacaatccatcacagcgcaccgttcctggatcataatcacctccttataattcaaggcatggactccccagcgacccccgtgggtttatctccgccacttctcagtatggtgccccgcaatgaactatgttatacaaaaggtaaagccgttgcctacgctggcttgtggttggcacggttaatgtttcaaaaccgaaactcgtgaacaaatttaagccacgatatcattagctttgttaaatttactccacattttttttgttaaatttaaaaaaatactccacatttttgttcaatagaggatggcggatggtggggttagcacctaaaaggaggagcgtcgtagtacggtagtacctttcagagtgtgtgtcataacaaattacagatatgcaccttcacctaaattaagattcaatgtcaaaactttgtccaatcacttttcaaaatgtttacttatggtatcacggcaattcctaaccaaaaaaatcatgttttttcgttcttctaatgtgacttatgctcaacaccagtaggtgaccacattgttggtatttcttaactacattactaaaaatataattcccagtaatggcgcagaaatattcatggtatattatggttatagatcatatccgcaagcgcacgggtataccattgtagtatttcactcgagagtatttcaaggttatcatattagtttaatctcgtggaagattataatagagagaaccatgctaatatcaaaatataagcaggggataatttacttcaagggtagagtgccacaaagcaaaagcactcaatattctcatacatacaaattctaggctaagtggaaaagaataagaaaataatcatttcctatacttctaatatacatacataccacttcagataatattatctactatataattatataatcaataccccctttacaatgccctcctggggtttcgagtgaccacccctaatttccgagttccttacgacaacccatcatggccatccaaccagggctaaatacggaggagtacccccccaagaaagtaacttaggattatatactgtcgtggaggaatactcatactgagctgtcaccatcagcggcccacctctactaactcgtagcctataaccccaaataatgatattcaatagcctaagcacctcacttatgctaccaaatactactgtacaatcatcgtcatgacttagagcaatcatataaatgaatattatacccacaccaatgcatctcccaggtaagctagctagacaattatatcccgaataatatatcggaaagtaatcagagtgaagtaaagtaccataaatatattgagaagagtattctataaatagtacaagtct

SEQ ID NO: 65644 - DNA, 6024 bp, Oryza sativa
  unsure (1)..(6024): unsure at all n locations
ccccgtccgtcgacaaatataaggaattttcaaatgataggtgtgatctttaccaaatgagtaaactctttgtgtacaaagtaattcaacctcaatcttaaactctgctaaacaaactaggaccaattatatatgtgaccagatggagtacatagtttatagtcggacatgcgaaccagccacattacaactcagaatatatatgttattgttataactaagcttcttacaaagtatgttcaacgaacacctattttaactcattactataaataacatttaacatgtttcatggagggagattatggttgtgcaaatgcacgacttaaaggccagtttaaactaatttttttaggaccgaaattgaaacagtgaaaaacaatcgactactgtcaaccacgataccgagccagtggagaatctaggatgtaaattgagggagggctcgtgtttaaatatgaaagtgtgattgaaacaaactaagatatatcaattgacgaaaaatcttaaccgagagagctcttggtttagtaccaaggagcgatggtccagttgctaaatgtggtaaaattatcatttcaagccagagtttatgcaactgaaggctaggttggtatggggtttgtgccaacctattattgtcaacgtgcatgtcttttattcttcttataaaattttctgctaacttatttatccgatctataatctgattataccactatgttcgttgcaactaaatttttataaccaaatattacataattgattttattatatatgtaagttacttttatcatgtattaaaattacttttagattttattaaaaaaaatttcagacattcggtgaacaatttacttgattggttagttctatattatgttgattaaatttaattattagtttgacttatgtttttacccccacaataaattaacttttgatgtcgtgacaagttactttcttttattttgagttactattataatatatatgtaagttaccttttttaggatttattaaatttacttttatatgtctaagaaataatttaatgaaatctaaaagtaatttagatatattatgaaaataatttgtaatttttttaaaaaatataatcatgtaagatcttataaagattaaattattatgaacaaaacggtgtaatcggatcgtaaatcggatgagtaatttaagagaatatcctataagaaggaaaagaaaagacatgcactgttggcagctgatgcatacatgcctgctaggatgaatgtgtaatctcgagccaacaagcttggtagaacggtgttgttttagcaaaagaaacgataagcggcagacggcacgccgtactatttttagcaaggaggaggacggcgcatggtactatttgtggcacagaagatgtcactgtattagtcaatcgtgctcaactaagtattttcggatgaaaccccaaatgcatatgatcaattaacatcccattgctttctccattttaattcgcagctatacaaatatatctacacaaatctatcgagaaattagtatggtatacttacatcatatttgacattggcaacttaattttggcattcagtgcttgagctagctttccttgccagtacatatttacgctaaatgctaattaattagagtcattagtcgctaattagaggaagggaatcatgcagatggggcttgcgcaccaacaagccccaacaatagatccaccactgtaccgagctgtgtttttacagtaaaaaaaaactgcaaattttatactattgagtaaatttcacaaaactacatatactttgcacgatctatcacaaaactatagatttaagaacttattttataaaactatagattcaatatcttcgttgtcacaaaactacatgtactttgcagaatatatcacaaaactatatatttaaaaaattgtttaacaaaactacagatttaatatcttcatttctcacagaactataggttttagcattgttaaaccaatagttttgtaataatgaggacactacacctgtagtttggttataaatgaagacactaaatatgtagttatgtgataaacgaatacactaaatctataattttgtgaaacaagttattaaatctgtagttttgtgataaacggagacactaaatatatagttttgtgaaacaagctcttaaatctgtagttctgtgataaattatgcaaaatacctgtagctttgtgaaatttactctatattatactataaaagaaaaaaatcagtcagttaagtggaagttttatttggtttgttgcgaagtaactatcagtgccaaaattattgtaagaataagaatgattagacattaccaaaacaaaataaaagaataggacatggatggcaaactaaacagacctctttgctggctagattcaacggtactacgaaattgatattatcgtaaacacacaccaaacaccgagatatttaagtatttgttactgttacatgtgatatttaactatcgatagttaaatgttacatccgattttaggttgttaaattatgtaacggatggagtggacgttaagattctcgagtgcacgtgttccacgtgaaacagatagatatcgacccctgcactgaacttcaagcaaatttaatgatgaacgaaattaagaaagattgacgacctagcaagaaatttcacaataattatcgagtgcacatgtcccacaataaattattgaattcacagtatctttcttgttcacctatttgagtagtattttctgtctttttaaagagagcattacagatgattggatttgtggatttaaaaaaaatcctaaaaatatcaccttttagcccaacctctcatccttgtctctctccccgccccggatttttttaatatctaattttatttatttaaatattttttacaattttttaaagttttacaaatttactccctaacgctctctcgtaaaataacttttggtttcaaagttttttaaaaacactttatgttgtcatgatacacacccgttggtgtgttgttacagtcacgcgaacattttaatggcggtccccttgcagactatctatataaaatagtgacatacaacattttataagcgggccacttgccgttctctagagccttcctgtaaatggctagcctatgatactttgtaggtggccccttgcaaaatgaccgaccatttccatatggccgttagaatacaccaatgaatatgtaccatgtcataaaaaatcatttggaaggatattaggggtgtagatctgtaaaactttgaaaaaaatattttttaaattttttaataaaataaaattgaaaacaaaaaactcccctttcaatatgctgcagcccatatcttgcccagattcgtagcggcccagcaacaggctagctgacctaacctaactggtccagaccggcagcaaggccgaagtggcccagccaccagtcacgcgcacgctgacttcgccgcagcgcaccgggcgaaaccggcccacgcgatagcgctggtgcgccgcatttgccgccctgaccgaatcgtggaggccgtctcccgtgcgcccgatcgaaaccgtcttgccgctcccgctcccgctcccgctcccgcaccacactcgaccgccgcgaaccagatcgaaccaatcgccgcgccgaccacaccaagttgccactgtggctcacgtcacccgcaccctattgccacgaatccggcgtgctccaataatgggcggcgcgcgactgggggctgtgttccgttggtagggctgggaacggggtgaataattagggtatgattaattaataagtgtagtattaaatatttttaagaaaataaattaatacaatttttttgaaaaaatttaaagcacaaattttatacgatttagtagtttaaaaagcgtgaatgagaaaaacgagatatggaagttagggatcttagtgaaagaactcagccttcagcggaccacaaacatactgccctaaccttcgcctctcgctccacccactcctgcggtcaagcaccttgcgtgcgtgtctcgtcgcaagctcgccatctgcccttcgcgcgagtccaccgccctttcgcccgccatcgcctacctcactattggaaatgtagccttgcaaatgttaatacagaaaaataagatattaaatatgacatgtgaataaaaggatgatctagtgatagttctaaatatgaacatattaataacaggaatagcatcatctactaacatattcaatactaaagtgaatagaacaacatgctcggagaacgctttggatccagataaggcattgttgttgttgcctccgttgttgtggccgttctctcctcctttgccaccgttttctcattcattgccgccattcctggtactggttgacattgccagcagaggaaacaggggaaggcaagaaagccctcccgtcccgtccccgtccccagcttagctcagcgcgcacgcgtgtgtggcagtcctaccaccaccctatcaataggtgctatccatttgtagcttatttaagtctaggtcccttctcattggttttaagatgatattaatcccttaacattaattttggtttcattaaaaatactacaattaaattgggcctatcccatcaaattctaatactcaccacggctcaccgtctgcctttacccggtacactatcacttctcgttcaccttgagctctaagctcttagctagtccgcccggagctggagccagttcatccagcaccttgtgtgcaacgtcattcgttccatcccttcctggttcgagcaagggctaaggatggggatccataatcggcgcgtgtgcgcccccctctaatccactctgttcctatatacgtatataagtatatacacatgtgtgtatatatattagatataatccattatataccactgagtttgtcataggtttacgatttgccactgacttttgcttaacttctacgacttactatcgtcgtccagttagccttcgttagtactgtacaattttgtccaagtgaccaaaatatccctaggataaaaacttccaaaatttggaaaaatttccgaagtatcatattttaaatttttgatcaaattttaggatgctttaacaatgcttaatgaaagcataaatggccaggtttagaaaggaacaaattaggccaacccggaagaacacgncaggtntaagccaggtgcaatgctgcacagagctcctgggccaaaaactgacttcagcaaatatgaatgtagcaaaagaaaacagccaactttctagaaccattttaggaagtaacagggacgcactgctggagaatcgtttttagtcccagtttttcaaccgggattatgaatccgggactaaaaacgtcgcttttaatattgaaataactagaacaaaagtttttttcctttttttttcttttctggcgccaaatatctccaaatcattaaaaaataagaaatcaaaaatcacagattgtgttcacacattacatattgttcacacatcttagcatcccaaatcatccacaacaacaacccaatatctcaacatcccaaatcatccacaacaacaaatcacaaatccattcacacatcattctcaaatcacagatcaaatcaacaaacaattattcacattattcacacaacgagaaggaaaaaagaaaaaaaatccatggagcctgccgccgcgcggccttccgcgccgggccgccgtcgctccgccaccacctagtcgccatcgttccggcatgggcctggccgccgccgccccacccggcacgcgcctagctacggcagctgccgcccctgcccagcacaggcctggccgccgccgcccctcccctgcacgggcccagctgccgccggctgcttctcccgcatatctgaggaacggaagagaggaaaactcagatgtggaagaggaaggggagagggagagatgagagtgaaagagga

SEQ ID NO: 65645 - DNA, 1186 bp, Oryza sativa
ggctgtgcgaccgaacagggcccctaaaatattatgtcctatatataataatattagaggctttaattttgttaatttgcagttcaaatagtagtaaaacaaggtccaaaacgctgcaaaagatgaaccaatccatcttccatcatactcctgtccaggcgtccacgtcgttgcgtattgccgaagtcctgacgccgcaactgcttcgtctcctctccccagtcccctccggcctccgcttctacctcatcgctgatgataggctgatcaccacgcccctttttaattttactataaaaaattactaggctactagggccccattttaatattttgcacacgaacccgatttggcctggacgcccctggctaactcaatcaaccgggcataggcccaggctccctggttcggtgcagggatgtgatacttggctagtatatgtggttcaattatttttatttctttggtgtttagtctctactattcttatctctttaccacattgagaaagtgctggaaaattccggaataccctcttttatccaatggctgagatttattttatctattttgtcacttcatgaatctaacggctaatattaatatgatgatgtggctcatcctaattgtattttaggattcactttacactagtagaaatttgaccaaatctgtaaaaaaaatcattccgaaaattaacagacatgtcagaaattttgataccccggaatataaaacgaaattacgtccatgatggttaattacacatgccaccaccggaaacatccaatcccaatcacaatttcactttcttcaatatggcgtgcaaaacgccgccttattttattgcaaataacatcacagtatcacatccaccaccttcattttatagctgctagaagtctgccagtttccagctcacaccgtacactcactaaaagccgtagcaatggcgacttggattcttggatggttgctatggcttcccgtgtttctcatctccctctacctcgtcgacatccttgcacactcctgccgccgcctcccgcctggaccccgcccacttccgttcatcggcagcctccacctgctcggcgaccagccacaccgctcgctcgccggcctcgccaagaagtacggccctctcatgtcgctccgcctgggtgcagtcaccacggtggtcgt

SEQ ID NO: 65646 - DNA, 787 bp, Oryza sativa
ctaggtttcaaatcataaatcaacatcatcaacttgcaagctaacatcaatcaacatcaatcaacatgtaaacttaaaaaaaacgccgttgtcgtccatccgccggcctccataggtggcgccgtcgtcgtcgtcgcgtcagcgccgtcatcgcagcagtcgtcgtcgtactcgcgtcgtcgccgtcgtcgtcgtcgtcgtcgtcgtcgcgtcgtcgccatcgtcgtcgtcgtcgtcggcgccgtcatcgtcgcgtctcctctcctcgtcgccgccttccctcccctccactcccctcccctccccgagaccggccagcggcgaggagagccggcggcggattcggcgcccgaggaggcgaggaggggggagccgccgccgtcgtcgttcgtcggagccgccgccactcaaggaggcgtcgtcgtcgttcgtcggcgtccggcgcccgaggaggcgaggaggggagccggcggcggatccggcgcccgaggaggcgaggaggggggagccgccggcgccgtcgtcgttcgtcggagccgctgccgctcaaggaggcgtcgtcgtcattcgtcggcgctcgaggaggcgaggagcggagccaccgccgctcgtcggagccgtcgccgctgctgtcctgccctgccgccgccgctcgtcggagctgtcgtcggccgttcacctctgctgcgcgcgagggagatagaggatagggagagaggagagggggaaatgagtggtggggggagggtggatgagaagataaggatggaaaccgtaagagtagata

SEQ ID NO: 65647 - DNA, 7233 bp, Oryza sativa
ctttttactgaaataattctgggtgtttccaaaatcttcatcaagatcattcctgaacattatagcacattccagagtttgaatttctttgctctttgctggtgatggtttggaggaggactccttagccgaatctattgatgtaggcggttcagtctcagattcagctatcgaaggttccttaattttacgcatcgatgccttagggagggattcattatattgctctatgaaggaagtattttccataattcgatctagaattatttgtccttccgaaggagttttatgcaggaatgatcctccgacaatggtgtcaaggtataatgcatactccttgtctaaacctgcatgaaaatgttgtaatagcacatattcaggtatgaacaaggttggaccagatcatactaaattattaaatctggactaggctgcaccgatggattctttattcatctgctggaagatgatgatttctcgcaacttttcccagtcaccatttgcgcacttgatggtagatgtgtactgttgtattgcgctctcttgaagagagaacggaaacaatttccaccgtacagtttcttctttaatgcctcgaatattaaagtatgaacacaactgctcaaattcctatagcatgtgtttggttgaagggatatcccgggatgggatgggatcatcccatttttacatgtgtttggttgagagactagatgggataggatggttccaaaaaagaatattccttcaatattcgggaccaactcatccgccaaaaactggcggacagattcatcccacctccacatgcgtgtgaggcgcggtaaccctcatggcccatcccgggtttcaccgcatccctttttttttcccttcgctcttttcagctcctcctcacgactacgttctagggttagcggcgggagcaggggcgaatcggcggccagcgcgcgaggcggcgacgggagcaggggcgagccggcggcgcgagcagggatgaaacggtggcgggagcgcatgagcaagggcgagctgacggtgcaaacaggggcaaggcggcggtgggagcgcatgagcagggagctggtgatgcctcttctcttgccggtcgctactctgctatccttctgtaaatttctctatccaataattggtattgatcagagagactgatatttgtcaattctcatctccgaagcgcttgatcgctatcatagtattatgagtaagtatggatgaagtcaattagttagtagcaattgaaccaacagcagtataattagttcaaaaatgtgttatttttttaggtgaatttcttgacagtagatgatggccatgtgttattttctatgaatggattgatacaagaattgatgtatactgactaaaaatgtagcgatattaacggtatttaattttcaaatagtgtaattttcatgtctaaatgttattttacaatgtgtacactccaggcatcccaccttcatccctccatccaaacaaggcataggatcattccaacccatcatatccttcaaaccaaacaaaaaataggattcgttccatcccttcaaccaaacagaaaatgggatcatcccattcccaaaaacagggatggatccaacccatcccaccttgtccctaaaccaaacacatgcataggtgatggtagggattttcttggtcgagacctaaaaaaggatttctccctaaccatacttattaattcggggcgaatttcgtagtcggttataaaaattggcttcaatgaaggaggtggttcatagaattttcctgtaggagctaacaatttgaagataggttgctccagggtcgagagttgtattttaggaaatttcaacggatagcaggggtagaggaagaagaaaaatcaaagatatgaggatgaacaaggtacggaggagaatagcaattgttccccggcaacggcactataaatgcttattggtatttcttacggtcacagataaaatctgcaagcgcacggatatgccgatataacacttcactcgggagtattccaaggtatcaatttccatgaggaacgtgtgtgctcagctattctctaggttcatccaagggcacgaagcaaagataggcaaatgatagagaggatttcctagcgataaacaatgtctatagaaagcttggtttaatcctatagcaaaacttcaggcgctaacttgctcactgctaccagaacgcgctctactccgtacccggactgggaggactgtggtgctcttgtgggctgtcactatctctataccaacctctaatgatatgtgggatacgcagcaatctctgaaaataactacctaaacaccatgtttaagaaattaatttctactctagtgtctataactcactaaagtaaacataaacactgcatattaaatatagcgaacaatgattagaatgctaaaaggaactaactaagagataattctcacaaagcaaaatcttaattactcggaagaatatttctatgaaatcagagtaattacaaaggtacaaaaagtaagaggagattatcgacaactccgaaattcctccgatttcttcttattctctccctattctagtataccatagggcctcttataattcggctcaagcttggagtgtgtgttggagtggagcgaggcctcctccttttataagctgagtattacggttatggcggttggaattgtccaaactaccctgtaaacgtcattgaggagtgattaggagcgtccacgtagaaagccaggatgaagcctcagccagggtttggccgaacctgggttggcacatctggcctccagtttttccctgggcctccacaattctctcccttatccacttctatacttgttgagctcaatttgtaatgtttcgatgaagttgtgagcccacttcttatatggatggattttccctccaattaagtctagatttcatcccaacttggtgatttattatctgcatccaaatatacaccaacactcgtggaatatgtcaaaattaaaccctaccactatgttggatgttttattatctttgtattatgcaggtattggcggcataaaattagcatttaacagccaccaacactcatgtggaattctagactaatgtccttgtatgtgaaagaagcaaaaggggattagttcagttgataattatctagctccatgttggatgctccgattagcatagccaaggacatgcaaaactaataaaaaaattcagttaaccaaccggccgtatgcaaaatcttgtaccagctacgtgctaatcctagccaaaatttgtcgtttcatgtatacatgccattactatatgtgtgcaaacatgtgttctgtttacttgcttctcatgatgatctagtttacacatgcttcattgtttgacatgtatatgggagctagatgaaatcccacatgttactacggaaagttctatataatagtagtataaaatatggttaattagttccatgcattaaaaatttattggttttgaaaaatatcaatactatttgcgtatttgtaacgatgccactgatatttatttgtaatcttctacctctctcttcccatcttctatctctctccctctctctgcaatctgttgccgccaccgctgctgctgctgccgcgccgccgctcgcagccgcgtcgctgttgctgttgccgccgctcgcagccgcgccgccactgctgccctacatacaaactctagtgcgcatatgctagctgcagaacagcaatcgcgattcttttttctgaacttggttaattttcattttccgcagaactggttccatttccaggtgaaggaactaagctagctggatgaacgagtttccatcaagttacaacacacagttgacaggatcgatcgagttatacatggttttgaacagcaggaggtaaaatctcgtgttgctttgcctacaaccttactgctgccgcccccgctcgcagccgcgtcgctgcggctgctgctgccgccgccgcgctgccgctcgcaaccgcgttgctgctgctgctgttgccaccactcgccgccgctgagaacgaaaagaggaggaaggagaaaggggaagaaggaagaagcggggaaaaatggcagtttggtccaattttctatggaaatgcatataagaggtaagtagtgatatttttgaatatgtgtgaaattataatggcatatttccaaatacataaatactagtggtatatttaaaaaccggtaaatttctaatggcatgtatccaattaaccctataaaataacatgaaaaatagctagatgacataactttatatactttatataattttcatatttaatcgaccatgaaaaaagttataaacaattaagatgacaaggtttataacaatttaaattatatgtagtttgattattcaaaagtaaaactaaggtaatgtatcttaatgacagaaggaaaagattgaagataaaataggttaatcatctaaagataactctaatctaatgtaagataattttattgggaaaaaaggaggaagatattttggagtatagattaatcatctaagggttagaaaaaatgatatgatacggtttattgagagaagagataaatatcattaactacaattattaggataaactttaatagatatttatgacaagtaaactagatgagagcctttggaccatacagcacgattgatcaaccctatctgtaaatttaggcaacgtaggaacttcaaaacctactagatcaagtgaatacgtacgtactcacggcaaagtccaaggggtgccgcagggcagtagggattgtttgcaggactgctgatgcagtagcggagcccacacatcagtgtctgctactgcatcagcagtattgcagaggatgtgcatctgccgcagggacagcaaggaccacagtacaacaaatgaacaaaatgtctttgtaaggccttttttttatttctatagaaaaaacgcttgtgcgttgcaacgggtgaagtttattttaatcttattattgttatatggtttagttaagatgaaattcaccgtgggagatcgtatgtatatatatatatttttagaaaatcatgagctgcagttaggagtccgatcgtctcaagttagcatacgagtttttttaaacaaatttcttatatgattccttttgtattaccaaaagtgaatggtcttaaaaaacagactcaaatacggatatttattcccaaaagcaaacaaacttaaaaaccgactcatacacggatgacgtaccaaaataccggaaaaatatcttctttttattatagtagagataaagacactttaaatagctttgtaatggtgctttataatggagtataggtatttgtgaaaatatcttataagtgacttatggtgaattgtcaatgtaaataaagggggaatttgtcagggttatggataacacatacctaatagtagttgactaaatctcggcaggacccaccacataccatgtcttatacggaaacaaccttcggatataggaggagttccgcataaggaaagataaatagagttctacatgaaaacgacaaggactactcagattgtatccatattggtttttctagttctattctgacaaggggacacctatgggtataaatataaggccccctaggaggagaggggacacggaacaatagatcaagacacaagatcaacattcaagctaacatacgccaagattagacgccgaatatcgacttcagagataagcatggctaatcccctacagtgtctacggatactgtcaggagagacatagcgctgtctttgatctcgccggatgtggattcgaggaggaaggctaccctgttgtcgactacgagtcagcacttcagaccgccaagtcgacaacagttaaataggctactcctggttctcggaccagtaggccgtagcgatctctcgtacctcgacgtcaatcggtcgagagatgaggcttactcctagttctcggaccaataggctgtagcgatctctcgcacctctacttcttgtggtcgagttaaggctacacctggttttcgaccagcggtttagcgatactcccactagctttacttctcgtggtcgagttaaggctacacctggtttcgaccaagcggtgtagcgatactcccgctagctttacttctcgtggtcgagttaattaaggctacacctggttctcgaccagaggtgtagcgatactcccactacctttatttatagtggtcgagttaaggctacacctgaatatggtcatgtaagatctggtcatgtaagagcaacgaccatgtaacgaccggcttacacgaccatcatgtaaaggaagggagtgcttgaacctttaagcacatgcattagtttgaatattgtttctcctgcttattatgctcttatgtgttatggttctgatgcttctactattgatacaatagggaaagtcatataccgtttaaaaatatttatcgtgcttaaaatattatattttataatgtccaaattttctattaatgtgttacatgtttcactttcacatgtaagattctattgaaattgttggttcgcctatgaactgtttcgctaagtggtttacgctacattttttttttcacaggtggtgatcatagcatgatattggtcaaattccgctatgtactttgcctacaccatatattctctggcatcatagaagacagaaaatccatgtatgtttctttactaaaagttttccaaccttgaattattgagaaactcaaagctaccgctgaacaattgtgctctgtttgtagcaatactttattctgggtgtaacatataatctaaactggttttggggtcaactttatgttattaattggtttgtacttggcagattctttgcattggcttactgcattcttttaagtgctaagcatgtaatctaccattaatgggattcatataattatacatcttatttcaatttcagttccacacagggataccacttttgcatagaagaatgaaggtatatgattaccaactatttcctttgtatttcaggaacaagtattgctgaagcaattctgtaaaaatattaacgcacgcttgcattttcgtcagcgagataaattcctggccctctagctgaactattctaattgttttggcatcagattacatgtaa

SEQ ID NO: 65648 - DNA, 11481 bp, Oryza sativa
attaatatatatttcgatttaagtgatttatactgtctcggcatggcgtccgatctatcccaatcacttgatttaagtatatatcgatacaaggagtatatattgtgaatacctacagccgatcgagtagatttagttccttcttgtttattcatgactgccgatcgatacatatatgacatcggctcaaagataaatgatatgtcatcggcacctagccgatcgactatcatttatagatttaaccgcggtttctttgcttctattttttgttgattacaggatcaaatcaactggcacgctcatacattcgaaggcgagctttggacctgcactagagttaagcagatctcccaggtcacgtgttttctgtcaacacaccagcccttgaggtttgctgccaacccgtagaagtcactcatcctctccaccccgccacctcgcgaggagcaacacatctagcatcctggctcagaggagctcgttagcaccatccccaccaacttccacaccgtgcacggccgaggaggatagctagagaaaggcaggtccctcgcaccgaccacggacaaggtgaggaagccccagatctaggaggagcgacggggaatggccaccaaacctgggtcgaaagctgctccgcaatatgccccccaacacactcgctaataagctcggtcagcgagttcgccgcacgcacctccctcgtactgccgccgtcgtccggcaacactctctccatgccggaggggcacaaaaaccgagccccaccatcgcaatcctagctagccgctcaatttccggcggctagctccggctgcgtacggttgggaatggggaggagggtggtggcggtagggcttgcatgtcgcccccaggttagttgctcgggtgtgatagggggcctctcctctctctccaactatttttttagtgaaagtgacatttcaagaacaagctcacttcttttgtgctagtgtaccttctactcactccgattcacaatgtaagtcattctatcattccccacatctattatctatctatctattatatactaaaagtccaagaaacttcctacaaacgctcctaagccaccatgtgtactcctacaaatactcctaaaccgctatatggcatcttaacaaaccggtaggtccaatatttttgtctattagaattttattaaaaaaataaccccacaaactcccctaccctctcctctccccatgggcccatccttcaactggacgtacaactcaagttcgtacgtccgtaggtacgtcttccctcccctcctatccaatctcttcttcttttttctttagttatacaaatttttaaacaataataaatcttaaataaccatattttttctatagttatttgcacgtagtctatcaacaattaaaaaatatatggtgttctttaacctatatgaaatatttaattttttatcacctcctaaactttgcataacacggaaaactgtcatataaaatagggaaaaattgataatgtagattacacaatcatatatcaattcacagaatatgcatgaacaaattaagttagatctattatataacaaacttttctaagccaccatgtggcatcctgcaagcgctacttactaagacaccacgtgtcactgtaataaattagagaaatttctaaaaattttaagaaaaaaccaaacatctagacattaattttcattaaattatgtggacccattatttaccaccattagatttgtctttaaaagaactccctaacccccaaaccggatccaaattgggactgtatgtagcgtacgttttcttaaggattcttaaggatagtacgtgcgtacgttagtaacgtacatccaccccttcatccctcaatttcttcatatttttgcacatatttcttcccctattatcatatactttattagttagaaaatatattttttgtgttaaacaattcaacaactataacatctaaatcatacaactaacttttaatccgcttatatcttaaaattatttatgactgcatctacaggcaaagaccaaaattccacaataattcaactttgaggaaaaaaatgacactttggattatatttccagacttttgcgtaccgttcaagcaattacaataaatatgaaataatattattatagactctatcattgtgcataacttcataagaattaaattatatctacaatcataaaatctaaaaaaatagctatgagtaatgttcccaaaatatataagttagaaagcaagagttatacgaaaaaaataagcagctataacatctcaatcatgagatcccctatatcatacgagtaatatttttgcttatgtattttgattattttacatttaaagacccatatttggggttatattatctgacttttatgtgccattcaaacaattataaaattgtgaatagtaatgatatatattttatcattgtatataagttcacaataattcaattagatatgtaatgacaaaaaggtaaaatgaacctaataacactaagtattgttccaaaaatttactcctcccattatgatattataataaagcaaaaataacagtagtagatttgtaatgttcacattttcaatattgtatactatgtaggaaaagacgagtaaaaaagatagatcttaatcaatcaataaagcttttattttatttttagttaataaagtaataataagtaaaacacaataaatgtaaaaaaataattatatgtacacatactttgtcccattcgactttctcttcttctcctatctcactcaactcctctatcttataatttttaactaattaacaaaataataaaaaatgatcaataattacaaagctaaataattatgattcttatgtcataactgttttttagtttatttgaactgttattttttttataattaaataaataattgaagatgcatattactcatatttcactccataaaaatgaaaatactccatttaagcacacacacctatatatcctttgcatggtaaccaaatagaaaaaaaatagagcattataaaaaaagtgacaataagtattgcatcacctcaaatcattgtacatcctctgtagcacatttacagtggtatgtaacttacgtgttacatcttaattaaaagtaagaccttagaaattataagaaaagacatctgaccatcagtttccacttaataggtggatctattattttaaccaatagatataatattagagaaaatcttaagctgccatgtgttacgccttaaaatttagacgcaaaggatattaaaaattttgacaaaaaaagtggatcatcggttttcacttaaatcattagatgtgcacaacacagtactacccatcccctccccccccccctcctgtctcagcttgagttctccactctctcctttacccctcctttttatagcgagaaataatcaataatattaaaacatgcaattttttagctgtacatctaatttctaatctaactattgctctattcataattaaatcatcaatttaaaggttcataacctctatagtttgaactggtataaaataaaatttaaaatataaaatatcaatatggactaagttgaactatttggagaaaatcaaataagttcgtacctttcactaaaattggaccaagcattacatgctctatttttataatttttttaaatgcttacatattaatgcccttgcatctattctataccatggtataatgagtttctcagcctattaagccacactatggtagcagtatacatatagttagttgaaaatttatatttattactattaaatttaaatttttgaactcatgttaactatattttcttttagaaaagatactataggtcaaacatattacaaggaagcgatggtctacgatatgtatttgttaatttatatgtaagtatgtaacaacttgtgtgaatctaaaccaactaaaaagaggactaacttgatggtacaaataaaacatgtttactaacaataatagtgctttaggatttgttaaaaaaagccactaaacattcaattaaacaagacaaaatattttacttttaatttacgtttaatttgttagatatgttttttccaaacaaactaaatagatactttgaaacatgacaaatgtttatacggatcatagataattgtttatacgaatgaattaaatattatatattttaaaagctaacaaatagtttggaaaaattatctaagcaatgccgatgaagtaaaattatggagaaatagtacttatgaaacatggcaatgtcattgagttgatattcgatctatgtaagtttttcgaacacaataaaatacatgcccgcgcaatgcatgggctaccttcctagttcatattaaagttaatgaagtctagattcattaacatcaatatgaatatggaaaatgctagaatgacttacattgtgaaacggagaagtagaacaaaatcatgcgaagcttctaggtgatcttcaagtgcgcttaatcttggttttaggacaaactacgctagctctttcttttattttataaatagaatgagatattttggttcgaacgcttaatttggagttggattagctgcattttaaatgctctttgttaggcaagatctgcttagccttaattaccaggatgtcactataacttggattgcacagaagtaaattaaaaagtaggagtataagcttcgcttgggctcaattcaatttacatattccgtaaatattgttacatgcccaatccagctattcttgaattaaaaaaaatccaactattcttcttctattttatttcaccatgactttatgttacgacttacaaaaaatacctaagtagaatgggcttatatatagtagcaaaattccttacacgcacctacaacctacggacctcacgttcactttaggaccagtactgtattaaaaaggagttgattcagcttgtccatatcccgattaatcgcttggtgccttctcacaaaaaaaaaatatttctctcaaaaaatcgcttggtgccttggtggtaccataagatttggacagccaccataagcttcccctttcccaacatgggctgagtgaatcagtacgtagtgcaataggctgttccagtgagggagtggagatgcttcctacttcctccgtttcacgatgtaagtcactgtagcttttctcacattcatatttatgttaataaatctagataaatatatatgtctagattcattaacatcaatatgaatgtggaaaatgctagaatgacttacattgtgaaacggatggagtattttgtaacatgggaataacttcactttaagtcttttatttttacatcaagtttagattatatccttcaaccacaatacatgaaatgttgaatccccaacattaaaaacctggttacataaaatcctaaggcagcatggatggttgttttgattgacgtggtattctagtacgcagaggcataagattctaacactagaacggataccctcatctcaatcgggcggtaagccccatctcaatcgggcacagcgtccgtcacaggctagaagtcactgatgtaaagagttatctcaatcgggcaaacggccgtcacgaatgaatatatctcaatcgggccctaagtaaagcccgtcaccgatagctttgacccagacgaccagtcaaactatagcccgtcacagatgacctatctctatcaggccacaactagcgcccgtcacagatgactactaacctttatcgggcctaaactagagcccgtcacagatgatactcatctcaatcgggcctaaactatagcccgtcatagatgactgatgacctcaatcgggcctaaactagagcccgtcacagatgactgctgacctcaatcgggccaaaactagagcccgtcacagatgactagtgacctcaatcgggcctaagctagagcccgtcacagatgacctcatctcaatcgggcatttagttatggcccgtcacagatgactataatccacaaaaaaaaattgttttttggctagcctctggcctttgctagccatgcccgctgtaaaaataacagaaacaaacacagatatccaatatccccagctccccagcatcacccattcatacatatgcattcacatacacagacatcaacatatttcacacaaccacacattcacagccatctcatatttcacatccattcacatatttcacatccattcaaatatttatcatattttacctgtaaaaccgagttaattggatcaaatatttatttagcaagtcttaacataaacatataaaatatatacataaatataagcatcacagtgacatcatcacagttgcataataagtgttcatcattgcctaaacatagaagttcaacattgttcatcattttagtttaagcctaaacattcctttggggttaattatttcgcggaggatgaagctggctatctcctcgcgaacctcctcaaagctggtagtcagagacttggttattgtgccctacattgtcataaatccagattagttgatcgatcatataaaagtactaaaatgtagttagtctatcacaattgagaccaccgacctcaaactcagccaaagtcttcaccttttctctatacagaagtcgcatgttgtggcacacatggaatccgcactggttacctatttgttgcttcaccgggaagtcttttttgtggatgagggtgtcatgtcctgtcttcctgaggcctcctctttgcacgtattgggcccacgcttcatctatcgctagttgaattggggtccaatcatatgcgttcttatcaattctggagttcaggtaatgacatgtactccatttaggtgttatgaccagaaggatccaatgggcactgcggcattaatatagtgaaagttaattaagtactcaaggaatgtgtcatgctgttgtgtatatttagttaacacacttactattgattataggcacacataatgtactccttgtctcggcgggaccacaaggtgtcgtagatgtagttgaccattcattgacggtcattatggagatttgtgacagtgaccacttgtggatcaaggaaggcaacttctggtgcatgcttctgacaccattgccaacttaacctacacacaggatcaacgatcttgtaagcaagttaaaccgattgttattaccagaatgagttgggcgacaatacttacaaggagtagcacttaaggaggcttgtgtccaccgctcggagcctgtagaggtcgaaaagatccttgaagtcgaccacgatataatttgttggaccaaggaatggctttccatcgtgctgtccaaggatatcggtagctttatttggcttcctggcgttagatttctccatgtagtataagtgaaggtccttgcaagcggtgcccattgcgggaagcacgtcatctccaaccaatggcatgcctagttggaactcctgtggagcgacgtatttcttcttgacctctttgcccttagtctcttcctggctcttgcccagatctagctttcttggagctagaagcgaggcctgcacctttcctccccttcctcacccctttgcttcgggtttatcgagagtaattctctaaggggaagagtgtgccttcctgctcttcttcatcggtgggggttcattaatcgccttgctgtcggcctccgttcggtcctccccaaaatccgtatcgtactgcaactacacattgtaagattgtgcatgacgatcttgagcaggaggggctgaaggagtagaagcgggtctctttggtggacgaccgcctggtgcagtggttggcctcgctgtaacctgatctcaatgaggtccttgggccattggatgaaggtaccacgggcatttcctagtgagaggacctcgtcgtttggtagatacttcagagggaacagctcgtattcgggcttcgccgagtcgacttgaacttttgcacagtcggccctgagttgcgctccatgcactcttgtctctggggtcggcttgtacgcaagtccctcggctgctggaacagtgaaggtcggcatcaccctaactgtgagggtgcagctcgttggttcctgtgatagattaatcaatttttttagaatattatatatcatatggatttgttacgtctttcatgtattgagtaagttcacggttaccgttatgtggtcgacggcgctgtcgaccgatgttggattttccgccaactcagttgatgcgcaactgctgcgtttttcggtgggacttcctaactctttgtgcgcagcagcaacgacggcctgggggatctattgctcttctcggatctcttgcctaatcttggccctcatcgactcgagcttttcgtcgaattcagatgtcagctcagctcgtatcgactcctggatcttggcttcaaggtgtgcatctttctccgccttgttggaagtccgcttcttgtactgccacgcgtagtctggaaatccatacttccaaggaacagaagacccaatgccccgtgtccgtccacggtgttccttgttgcccaacgctttcgtgaggaggtcgtcctcgcgtctttgagagcaggcctcttgcgaggcttgttgctcggcaaccaactccttctgcattacaatttagtggggtcaaataaactgcacgatgggaaacaatgcgaacatctagtttgactagacacttactatagcttcgtatactcgttgatcttctgcatttggcatgaagattgtgccatcatcatgtttctggtacctagccctggcccagttcctagcccgagggtgtgggatatcgccaaacacgagcggtgtgcacgattcctccgcttcttcatcctcacgctgccattcctcttccttaccggcatatccagtggtaccaagccggtgcggatgctggttcctggtctggagcaagcgatatgcctcgcttctagctctggactcgggggtcgacttcttcgcatggaattcctcccagacctgttctgtgatccaaggaaatttctctcttggatctggatttgccgggttgtagacgaactcgccgactagcttagttttgaagttcttccaagcagtgcccataaccttgaaagcagcccgcctgagacggtcctcatgctccgcaggataatcaaagctctccttgaacattagccaagcaatgtccttctctgcggccggcatgagcttgaagtcgtcttacagaatactgaatttctgcctccctatgaccccgcagatagacctaaatcggctcaatattttccttggagatgtcggcaaccctacggcgtccaccgctgttatgcggaaccgttccttaggaattttgttccctgtcctaggagtacgtgcccttgaggacccactagttgtcgtcgacattggttcgccttgctgagacattatctacttttttccaaaaaaacaaaaaaaaacataatttagtgctacaatttattacaatctattaaccacatttcacaataatttcattaatgcaccacatttcatcccaacataaataaaccacatttcatcccaacataaataaactacatttcatcccaacatgaataaaccacatttcatcccaacataaataaatctcatttcatcccaacataaataaatctcatttcatcccaacataaataaaccacatttcatcccaacttaaataaaccacatttcatcccaacatgaataaaccacatttcatcccaacatgaataaaccacatttcatcccaacatgaaccacattgcatataaataaagttaaatgaaccacatttcatcaattactacaatcatctatcacaaaattcataaatgcaccacatttcatcccaacatcgacatgtctcactcacagttcaatcacatatcatccacatccacatttcaatgacatgtcattcacagttagtagagggcgacgcgatggaggactcacctgaggatggccggtggggctcggcggcgcccgggctcggtggagggcggcgccggtcggtggagacgccgatcgggcaggtcggcaccgggcgggcggcgtcgtgctctatgggggtcggcgacgtgggtcggtgaggacgcgggcggcgacgacgaggaaggccaacactggtccgatcggtgtaaaggctcggtggcggcggcggcttcctgctcggggggagggtcgtcggtgaggaggctcggcggcggaggtctgaatggagggccgaggaggctcggtggtgacgacggcaggcttggcgagggaggacgactgcggtggcggcgggctcggtggcgacggcggcgggctcggtggcgacggcggcgggcttggcgagggaggatgacggcggcgctagggttctaaggaggcgggaaactgtagcgggacttagaaaaattttcgatccgatctgagaaaccctagttatattagagtgatgagtcatctcaatcgggctttgccgtagggcctgtcacagatgactcatcggtgacgggctccatactaatgcccgattgagatgacagtcaggcccgtcacggatgactcatctgtgacgggccctaagataatgcccgatagagatagattaatctctatcgggcttgaactaaggcccgtcactgatgactatttttccatttcccagataagtctttatatttgtgagtacaaaatatatagctgttgtataataattcattttattagtcataacatattttcggatagtaaattatttcaaatcgaaatatggtcaacaacaaaattgtagaggttatcaagatctacaacttttattttggtcatttgtctatataactttgtttccaacagcttgaaattgattttgataatatgacaaatctaaacagcatttgtaaatactaaatgatttgaaatggaaatatggtcaacaacaaagttgatcctctcatcaagaactacaacttttattttggtcatttatctatataactttgtttctaacagcttgaaattgattttcacaatatgacaaatataatcaacatttgtaaatactaaatgatttcaaatggaaatatggtcaacaacaaagttgatcctctcatcaagatctacaatttttattttggttacttcttcatccgacaaagtgatagttatattattcacaaaaatcacatttctctcatctggtttataaatattaacacagatatgtcaattttgtaaacattggtactatcactttgtcggatgaagaagtgactaaaataaaagttgtagatcttgattagctgtacaagttagctatttatggctttcccatttaaagtcatgtaatatttacaaatgctgtttagatttgtcat

SEQ ID NO: 65649 - DNA, 9342 bp, Oryza sativa
  unsure (1)..(9342): unsure at all n locations
agtttcctcaaggctgtagtgctccaaagtgagtacaaaaattactgtgtgatggataccatgatgattgatgagcttatgataaaaaaaatatcgaaattttacagtgcatggtttattggttttgggtgcagaaatttggctgctattttattcgaatttctattgagcttgattgttttgactgaattaattggggtaccaactcaagtgataaaatcatcaatcttttattgcaggctattcatgccacctagtatttgtgttggtgtttccataattttttcaaacattagatggcatttaatttatttttccaagttaaaataatgcatgcaaatgcaattaggaatgcgagaaaaaaaaacagccaaaaccaactaaaagaacatatattcaaaggcaagcatccacagctcatcatactgttttgaggactttgtttcggtttcttacattaagagtgaatttaaactggatttgaaatgtaacatggaattggatggttttggtgatattccagctcaatctatttaatattaggatagtggaccatgttatgatgtactccataaaatattcacatttcattccattggtggttttgctacggaataacgaaaaaaatcattggtttaaatcttaattgaaaattctaccgttgactgagctaaccctatcttgaataaaataatatttcttctgaaaactgttgattttcgtttcgtacgacaagtttagctttatctatgatcaaattttcctagtccgatatgttttatagtgtatcccgcacatgaaggtcagtaaaggatgtttgctttttaaatgttgttggtatattttgatagctctagaagagttagaaaatctatttgtaattaattttattacttgtaatcatgacaataaaccttgatataacaaatatgagttttatattccctcttattttggttgcatttaatgcggttacttggttgaattatttgtgactgacgtttgatttatctcttcttgtatgtactattttgaaactcttttatgcaccggaatcataaaggaaagcttatataatatatttcaacactataagagtaatttaacatcaagagctaaaacttgggtaagttataatgctcaccttcattgagtgaaaccattgccgctataaagatagccaattttgcttcacgacattcaaagtttatataatttactggtgaacattgaaaaaaatatccacggttagaggagacgtcaaaactaataatttgatggaaaacatgcaatcaatattttattattttttcaccaaaaggatagagaaacccattataatgataaatttgtccctcgggccaacatatgttactatgattggtttggtcgaactagaccaaaccaaaccaggccatgagtatattttgcaacctttcccccttttttaaaaaaaataggttttcattttttaccctaaatatattgctaccatatatcatattccttcttcattctagagatagcttagaagcttctagcccgaggggcaatatcgtccttttgaaatatatctcgccgattggactggaaataacaaaataatggatgtggtgtcgacctttggcaaattaccagtttttgaaggtgttctcccaccttttgctatgtttaccaacaaacaagctatgtttaagtgacctgtgtcaatattttaccaaatgataatgacaatacctataactttcacttatacatgtaacttgatctatcacctatgtctgacagttgagaagatggttaggagatatgttccatagaataatatactgatccttctcttcatgggccaatcggcctagagtatatatgtgccatcatctacttaacaccgtcatcaaactcaagatgagagcagaggatctgaaacattgaatttgagcaagtgaagttaatgttatttctcaagtctatgcattaggatgctcatcagaataagcggttctcaagatctttataaaaaagcatcaacatctacaataacaaataaatgcactatcaagacataatattgtggattgaatgaaactaaattgatgtatatattgatgcacttatttataaactcagttaatgttagaaaacaaaatgcagatcacctagcatgatgaggtctactgcatcctcatcaatgcccccttttgtgactaagaagacgagaccattcaacatcccctttttatcttatgtgtgtctagacagatgtggttctcccttttgcatcaagttgtcccttgggctcttgaaccacaacctgtggttgtgaactttgatgaatggtggaaccgaatcaatggtatggtttgtgcaagtaccaggaagggtataaacaggttgatcatgcaaggagcttggtctatatgaacgattgcgtcttcaatggagtacctccaagattatcagccacttgtggagtttggcagggactaaggggctttctgtaattatagaccttagctagggccttttatttttaagttccttttggtcgtgtaacaagttcgtgtacttcttagtgcttggtgtgtttggacgccttatttcttctcctattgacgcaatgatacgcttcttgcgtcttcaagaaaataaacttagaacaaaactatatgacttatattataaaactgagggagtactagttaaatagattctattccaccatgaatacaaattgccatgcatagcatgacgaggtctactgcatcctcatcaatgcccccttttgtgactaagaagacgagaccattcaacatcccctttttatcttatgtgtgtttagacagatgtggttctcccttttgcatcaagttgtcccttgggctctttaaccacaacctatggttgtgaactttgatgaatggtggaaccaaatcaatggtatggtttgtgcaagtaccaggaagggtataaataggttgattatgcaaggagcttggtctatatgaacgattgcgtcttcaatggagtacctccaagattatcaaccatttgtggagtttggcagggactaaggggctctttgtaattatagacctcagctagggccttttatttttaagttccttttggtcgtgtaacgagttcgtgtacttcttagtgcttggtgtgtttggacgccttatttcttctcctattgacgcaatgatacgcttcttgcgtcttcaagaaaataaacttagaacaaaactatatgacttatattataaaactgagggagtactagttaaatagattctattccaccatgaatacaaattgccatgcatagtttccttgtttttgttgagaatataggcatataatgatttaatatattccataaataaatcatgacattacagatgtatactagcattaacgcatcattagatctacacatgtaaactaagcaataaaacatgaacagatcaaatatgcgcaacatatcgaacacgtaccgagatggcggaaagaccggttgctcggcaggaactactcgcggtagcgagcgtcgacgaaggcgcgcaggacgcgagcggagaggaaggcgagccgttgcggacgaaaagggagcagtcgcgcgaagcgcttcccaaaaaccttattgctgccttctcccggtgcaggacgtcgaaggcagaggttccggagacctgctctcccgatcgccggtgcacgctggcaagcgggatggagtagtccacaagcgacggcgcaacacagagtaggaggcaaaccctagattgatttcgtgtattttgcgtgaatgcggcggctcggtttatatagagataggtcgcttgatcagggcgcccggacgatctccattccgcgtaaccgaaccggataagtcgcgcgtaacttatccggatttttcggaatgtttccaaaacaaaacaaatccgaattttcgccaagggtgatgagccaattttgtggatcattcgacgcgtaacatcgtgcacgcgcgccgcaaggtaggcacgcgcgccgcctgccctaccttgccaggcgagcgagcgcgcgtgtgttccccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgaatgggtcttagcccatctattaattccaacagttttcaccatagttgacagtaacatttttccatggacatgctcccctaccaccatcactgttgaggcagcattgccaatcaaatctgatttcgcattgaaatcaacattagccattgatattaatttatttacactaatcagtgtggttttatggtgtattgttaattgcacatcagttcacaagctagaagtcattaaggaaacactctacactatttaaaatttatgtgaaaaattcttcatagtgtgtgaatattctctacttcacagtggtgtacattgcaaccaaggagtttctatattgggccgacatcagtttattaatcatcatacatagttttcacaagtatcttcatattttagtactttctagctagcgttgggttggaatccattaggaacccacctctcgaactcaaataatagcaggtatcagtacacaaagtaattgagggttggaagaaccaaagtactttatgtacagtagtggagttggtgttagaagatggaaggagtacaaggccaaaagtttgttcaattcctttgaaaaagcagttgttgttgcctttgttctcttccttgtgcttgcttgggccagccatagtgagttaatacaacaactcaacttgtattgacctgttgctagccaccggtcctagcaatcccctttgctttaaattcaggttgttcccaagccaataagttgaaacctcctagatctaatgactgaacatgaagtgtcatggcataaaaagttaccttcacatttaacaaatcactttcatcattccggccgggtgatttgcttccaggcatggtttcattcatgatattatcataaaaatggttcttatagtccatgtctccactctgcttcgtgctaggaagtaggaacatgatagaagtgttgggatattgatttgtctttgcagttacaacccattttttatagcgcaatatccgtgagcatattttcagcaaagcatcacaattgcatttaggatatgggcatagtgttgacttcatttctcctgtgatgtccctttgcttgtattactcccttccttccatttggacagcacctgaacaacggccccaaaaattcagtggatggtaactgcgaagcaaaatcaagatccaaacacttttgcatttcctgctcaaagctagcatcaattgcaatactcctattttcgtccactcatttcaaatctatatccttgaaattttagccgattccttctatgcccctgaattttcttcactcctttatatacctctgaattttgatttggatccctttcgtacccttgccatcaattgaccattagttgaccgtttaataggtatagaaaagttagttttacccttcaatatgtgagaaataagtagaaatttgtaaactgtattgttggaagtataaaatttgttgtgtgattatcatatgcataagtttgttgtacataaaaaataatatatattaaaaagtatgtgtagcactttttaaaatgataaatatagttttggaaaacattcctatataatatatacaactggagaaaatatgttgaactatcataaaaaaaagctacatatactgttttaataagtaaataaatattagttttatgtcattatataaaattaaactttttcataaaaaatacctggtataataaagtcataaatataatagtcttatattatatagatactatactacatatgaggtgtaggcgttaaaacacaccccccgcagcaacccccccccccccctcctcgtatagtaatcgtcaactgtggccccaccccagaaaccgcccctgcttcttccccgcgctctccattattttcggatctagccctcccgtacaccgcagttagccaagccgctccgcctcgtttccatcgccgccaccaccgcctccccgtccgcctgccgccgccgccgtgtgggaggggataccagacttgggaggtgacggcgacgaagcagagaaggcgcccaccctctcccctgcggctgtggcttgtgctcggggatggatgcggcgacgggcgacggcgacgcactgcggcaatggcgagcgacgggctcggcggggctgtcccccgctcgaatccggtgacgacggtcgtcctccgcccggatccagtggcggcgggcgtccctcgcctgacctcgcacggatccaccggcggcggtgggaggagagcagcgtgcggcaggccaccttgcagtcctctcctcctcttcctcctcccgcttcttcctgcccgctgccgtcatcgtggttgtcctccaccagcttgccgcgtggccgccgccgtctgccgatggacgtcgactctgacccggccgccaagggcaagcccacccagatggacctcgaggaccaggtacgccgcagccgctcgactcgtccccacgggaattcttccttcagttttttattgtgactgcctaagcttggagagcatctcaatttctgttgaaacacttcagggaagcatttagctctcagagcattcatgagacttccatctataatcctactaaacttctggctggttcgttagttctatgtgatctggatttggtttgtgtaacactagcatccattgatattctgaatttttcaggcttctatacatctacaggtttctgtaattgataggttaagggcccctttgaatcacagggtagaaaaaacattggaataggaaaaacacaggattctgacaggaattaaagtgtaaaacagaggattgcaaaacacaggaaaaacacaggaatggtcgtttgattggagcgcaggaaaaacgcaggaatcggatgagagagatagactcaaaggaaattttccaagaggttggagctcttgctaaatttcctccaaaatccacatgtaatgtgccattccataagaatttcataggatttgaaaagcttcaatcctttgaatcaaagggccaaataggaaaatttcctataggatttaaatcctatgaaattcctatataaattctttgattcaaaggggccctaacaagcttttctaatttatttattttttggtgattgctgcttttgctggatcaagcatcatgagtgaatagtcctgatagccgagttttttttttttttgcaacgcatgaagaaccatatgctctcattttaattttcatttgttcagtcatgaattgttattgcaatatattcagaaaagtgctcccatctgaatttcatttgttcagtgatatatttgtgtgtgcaatatttggaaaactgccaatagcatcatcatcaggttctctgatattttttataaataaaaactctagaagcttgattcaatagcagttcactgaaattttgtggttcaacagagcatatcaattgattttctctgaactgctctctacatatgatcctttcgatcatagtttttcgctgaatattttggttgaacaaagcagttgtagtcccctatgagcttctttctgctgtagatgtagttcatgttctgatttttttttttttgttgatgaacagatttctcaattttggtctacttgatttttcatctatagactacaggaatgctctgaatttgtggagttttctgcacctcagctgacgatcatgggggaggctgcaactccagagaggcaggaggatgttgtccaggtggcgggtcacgcctcgtcgacagcatagatcacacatgggcagaggaagctgtggatagcatgatgggtctgctagctgcaaggttcgttgggttgcagctgagctatgcatttttttagctccttttatttttctcaagcaattatctttgtggttcaacaaagcagatcgatacatgttttcctcaactgctcaatgcatatggtcccgttgattaggctcttgattttcttgtaaaaatgcgtacaacctgtcaatccattgaattttctgcaattttatggttcaacagagcatatggattcatttttctgaagcactcactgcatatagtcatgttgatcagggtcttgatttgttctacaattgtgtagaatctgtcgatccatcgaattcttttttatactgctcttgattttgtacagttcattgggtggagctttctcttggggggtgcttttgcctgccatggcaaggccagcaagatgggatgaggcttcagctggctagtgaggatggagatgaaatcagaaatttactacctgtgagctgaactcaggatttactgccttttgtagttaataatcagcgtcgtcggccctgatctacgttgctatattagtgctggcatcgatcggtattggcatatgtattagcgggtggtgttgatttgattttgtttattagttttgtgtttttctgccgatgtatcattgcgtgcattatcagattgttgatgtaacaccgacactggatcaaacaattcatgtttgtaaagaaattattaaattgtggttaggttaataatatgaatcataattttttaccttcatttgttttgtcactaaatactccagcggccttgtgcaatctgcaatatatttactcctgtatcaggactaacttattttactaagagaagtccaatgacgtgcaaatattaatttatttactaagagaagatttgcaaaccaattgggagtactaatgaagagctgagaacgatctgagagtaatttatttacttaaaggagtaaccaaattgggaagggctgaaaataacctaggagtaattcatttactaagagaagaaatcaatttggaagtgcggaagtgttagtaactcatttactcttagaccgaaagacacaataatattgttactaatgggccaatcaccaaaaaaggtgcgggaggaaggaaaaaaaaggtgcggggaatattttgatagtaacttgtttacttatcgaacaaaaacaactgatagtaattgatttactgaacgacagaatttgtcggagagagagggatgagggagtttgtgcaggatggatgtgggtggggtgatgcgggggtgggggggtggggggtggnggaggg

SEQ ID NO: 65650 - DNA, 3542 bp, Oryza sativa
aaatcggaatcctatttttcaataaagtttatgaattttcaatacaattcgtgttttgctgcaatttgtgttttatctaacttatacgatctaaaaaattagaacataatatttttttttcaacagaagttttatcaacaatagctagcatagtctattttatgttttactagaaaaaaatgcctgtgcattgcaacgggtgaagtcaattttaatcttattattattgttatatggtttagttaagatgaaattcaccgtgggagttcgcttggatatatgtatttttagaaaatcatgagctgcagttaggagtccgatcgtctcaagttagcatgcgagtttttttaaacatgtttcttatatgattccttctgtattaccaaaagtgaacgatcttaaaaaccgactcaaatacggatatgtatttccaaaagcaaacgaacttaaaaactgactcatacacggatgacataccaaaataccagcaaaaacatcttcaatttttataatagtagagatagagaagagatatagattaaaaccaaaacataaaattaaaaccgactcaaatacagatgacgaaccgcgaaaacatcttcaatttttataaccgactcaaacaccgattacggaccacggaaacatcttcaatttttataatagtagagattaggagtatgaattgactatgggtgggaccgtgggagtgagggctcaaatccgatgattttatctattattttatatgtcttttagtttatattttcacttttaattagggtctatttggtaagactttaacttttaaatttaattataagaattgggtctggagtgtagttgtggagctgtctaaatcagctccacctctctagtttgttttgtagaaaactttagccagctccactgcaattttttatttttaatgaagttgaaactatttggttggactctctgacttcaagagaggtggggatgaagctaaagttgtaccaaacagatcctaaatttgtagtttgtcttgctagttgtttattcatgatttttgtttttagttgttcacgtatacgctaccgtacacatatacgtgagccagaacgttagcttttcattaaagaaagttaagataaaaccaggagataagtgggcttgctgttgctgtgcgcggttatgttggggaggccgtttgggccaatggcccaagcggaagcgtacgtcggtacgtgcacggtgctggatagatggaggaaagggagcgctggggaggcggatgcgtacatgcgacgtttgttgtttctctctttttttttcttacacatgccacctaatcattctgctacttggtccaatcaaacggcgacattaccgccaacttgagatatgtagattcgaccaaacataatagtgaaacatttaaacctataaaaacttccttttagcggaatataacgtaatttgatcaaacataatggtgtttaagactaaaaaaactaaaaatttatgagacaaatataatttaatacacctttgaaggcttgaccaaatttatctagattccaaatactctgttgtagcaagaggcaaacaccatcctcatattcgatcgaaacactcttacccacttggaaaagaggtttttactcgtggcaaaacttttcgacctaatgtgacaagtaaatactaaaagactgacaaacatggtaagaacgctagtctggaaaggagtattctagcctaccacaagaggaaaataccattagaccatggcggatgaagcctgaaaattatatcattgagtgaggaatattactcaagaagatactgcagggaccattttaaccactcctataagctggcgccatactattagggtttctaactttacaggggtattgttgtaacttcctatgtatagttaggggtaggattgtaacctcacatgtacctccggaggctatataagccggtcatgatcttgtaatcagacacgaggtcagatatatcataataccatacaacagatgagactttacttttcgagtcatctcacttttgggaacatattactttcctacctatccctgatttgtccgtgacctaaggtcactacatactcttgcgcacaacttagaattttgttatatattttccagtcaatttactcatttgctaaaaatttcctctatttaccaaaattttttttgctacatttgtctaagattaaggctgtgttcttccccctattttcccaacccacctcactcgtttttcgcgcgcacgattttcaaactgctaaacggtgtgatttatgcaaaaaaattctatatgaaagttgttttaaaaaatcatattaatctatttttcaaaaaataataattaatacttaattaaccatgcaataacacagcctaagtgttcaaaattattgtcacatcttaggtcattagtaagcctaagatacatttctgattttgtgtcacatgatttatatagatagaccctttattaaaagcacgtttttgctagttaactatcgacagttttcagcgctgaaaactttcctttttttgtccgttcgatccagctccaagattcgtgctggcggtgctggaagatagaaaaaaatttgcaagcccaattcgtgtctgcaccaatttgtaagcctagttcgtgcctgacggtgcaggaagatggaaaaattttgcaagcgcgccatggggatcgaacccaaaacctacagcatacacacttgctccattacactttagtgggagttacacctgagttaaatactaaatatactgtagttccataacagttacatagtagttacaatgtaattacactatagttacataatagttacatttaaaagtttttcatctaaaaaactgtcgagtgttatatagctactccctatacaactacctaagctaatcaaacttgcctaatatttagacgtatgactagctataaaataaccccattaacctcaggagttaggagtacaaaatagtataccttttcttatcccttttgaatttcaaaaggaggcacctccaccactgaccgtccgatctccccagcaagggcgaccaccggataggatccccctcggccgtccgatcggtcgcggccgctgggatgaagccacgcgtccctcccgcgtctctccctcccaaaagcccacctccaaaaccccggagcccgcccgcgtcgtaaaccctagccgcctccgccgcctcctcccccctcaaatccccccacctcctcgcttccccccttcctccgcccgccggagcagagttccttctccttccatccattccgttcgggaatcaggcgagcgcgtcagcatccccctcctcctcctctcgcggccgccttcgtcgcaggcatcgccgtgctctgaccggagggcacttgttctttccttcgtcagagcggaggggagcggaggagcggagccggagatccagatctgcacgggaaggtatctcccgctggtacggtctacttctctctttgggctgcaggaa

SEQ ID NO: 65651 - DNA, 13012 bp, Oryza sativa
tgttcaacctgttgagcaacatcttgctcagcttgttgtggttgtgtggaccttgaaacattttccggtgtttcctgaatttcttcaagtcccaccatgctcccactatcctttcttgaaataaactcttttcccaagaaaacaccgtgtcgggcgataaacactttgccctcttcccgattataaaaataatatccttttttttccttaggataccccacaaagaagcatttatctgatttaggtgtgagtttgtccgattgcaaacgttttacatagacctcatagccccaaatctttaggaaagacaaactgggacgcttccctgtccatatctcatatggtgtcttatgcactgattttgatggaaccctgtttagtatgaacgcagctgtctctaaagcgtaacccaaaagcttagcggcagatcagtttggctcatcattaatcgcaccatgtccaacaatgtacgattcctccgttcagataccccattccactaaggcgttcctggcggagtgagttgcggaacaattccacactcctttagatgattaccaaattcatggctcaagtactctccaccacgatcagatcgtagatacttgattgtcttgcccaaatgattttgtacctcattctgaaattccttgaacttttcaaaggactcagacttatgcctcattaagtagacctaaccatatctattaaagtcatcggtaaaggtaataaaatacccaaaaccacctctggcagttgagctcattggtccacatacatcagtatgtactagtgccaatagttcacttgccctttcactttgacccgtaaaaggtgcctttgtcattccgccaagtaaacaagattcacatgtctcaaatgattcaaaatcaaatgagtgtagaagtccatctctatgaagtttctccgtgcgtttctcatttatatgacccaagcgacaatgccaaataaaagtgggattcaaatcattaggagcctttttgcattaatgttatagactgaacatccatcaagattcacaatgtataagccattcatgatgggtgcatgtaaatagaaaatgtcattataatagactgaacaaccattgtccacaaactctaaaaccataaccctctgcatgcaaacaaaaagcagagataacgttcttacgcaaacctggaatgcaataacaattatttaactccaaaacaaatcctgacggtaaagataatggcatagtgccgaccgcaacagcatcaactcttgctccattgcccacgcgaatgtccacttcgcctcttgctaagctcctacttcttttcagcccctgcaacgatttgcatatgtgagcaactaacccggtatcaagtacccaagaattagtagaggaagtagcatgattaatttctataacattaatacctgaggtgaaactctttccatcctgctgcttctgcttgagctgctctaggtatttcttacagtttctcttccaatgacctatctcctttcaaaagaagcactctgcatccttagggggccatgtcttttgaaccttggtcttagagttgcttgtactcgtgatctcatcagagtttagctttctcttttgaccactcttcttgttgttgggcttgtgcttatgcataaccatcacatggttggagtttttcttaatgctttcctcggcagtctttagcatcccatgcaattctgccaaggtcctgtcaggttgttcatgttgaaattcattatgaacggctcaaagctgggagggagcgactggagaatcaaatcagtagccaactctcatctaaggggaaagcccagcttatccagactctcggtgtaaccaatcattttgatcacacgtgggctcactggattaccttctgcaagcctgcacgcaaattatcgtatgagcatgttacatagtcccgtgattatcgtatgagcatccaatgcctcatattgcctttgaagctcaggggacatagtagcaagtatgagacaacttatatcaagataatcattgcatcgcttttcatgctccctacgttgagcagcaggagcattgttgggcaagttagctggaaaaggctctgtaagcacaaactctttctgctcttgcctaagaacaattctcaggttgcgataccaatccatgaagtttgttccaatcaacttctctttctcaagaatagaccgcaagttaaaattggatggtgcaggagctgccatgatctacaatagaaatatatgtatacaaaatcagcaccatgtttgcatttaacctttcattaaacaatttaacaaaagatactcccactatgtattgtgaaacaaaattccctctagtaacatagtgagtcaagatcctcattttattagtgtctagtgagctttggcatcgcagctagacaactatcaaaataggtaagcaacaccttactaatcacatcattgtgactcttctgctgttggggtgacatcttcatatccaacccaacctatgccccaaggtccaaaactgttttgattaccttgtcaagtaaaccaataatctctgcatatagatgtccgacatctatcctattttatcatgataaaagtgacactttgctatggcaaactcatcacttatgatcacaaccgtaataggtgcaattattagaagagcataaattacacttaatttttctgagggaatctatcctaccatgtcatatcaaatatataacagtaataaagtaagatagatataaaaaccccaagcgaaatctaaggggcaacgcacacggcagtcccagtggtacatagatctcatctacgattcgccatgtgaaaaccttaacggcgtaatcaaattatgccgaaaccgagtcaatctcattggctcgtttttctcattggcgtgcggttccagtggacatcagactatccgatgaacacaatcgcgctcagccttggtgagtactaaacattccagtgaagtcaccaacacacataccgattgatctcatcaacccatgtggctatcggttcatctcatgttccgatcacctaagaactcatatacaacataatagatctcatctactacacccgcatatcaattatatgcaatgatctagatcataaactatacaaggcggctctgataccactgttgggatacgcgtaggctacgatagcatcaaaattttctatcgcgtaaactaggaaccatgcaagtattagatcatagatcgttaccactcgacgcgctgcgcaacggaagaagacgctgagaagtcgaaggaactctcacgaagtagcgcgcgtcgatgtagaggaagttgtcgatcataccggctcgaccttctcctcctcgtgcgttctcctcgccgtactcccacgccgatcaacatcgcaaaccagcggcgcctctaccggtatccacacgtacaaggacggaacaccacgcgcagatgtgctagcacccgcgcgcggctagggttttgctcggggagggaagtgacggctaaggtttctcacgtgatgcaatgcctccgccagtcacacccctcacgaatatataggatccatcactcgggcctccaaggcccataggactcctattcggatccctatccgaattaagctcatattggatctccatccaatccccttatttcggcccattaagcgtgcgaccctgtaggttcatatatactcggctgtaacccgaaaactccttttcggtccaggcatcaacagcggcccctagcagaacgtattgacccaccgaacatacataaagatcatatcggctgaacctctagtgtatacttgtatggacccatttgcctcacgatatggattaagctcaaggctagatatgtgccatcctctaatagctcaatcattcactcgaacctgttgatagattatatgacttgtgattgactcctcaatcacctttggcatggccatgcacttccataatctacaacatcgaggggcccagagatatctctccataggaggggcaaatcccatcttaattattcatatcccactacatgtttcatagcatacccgaaaactactttcataactacccaattacggagtagcgtttagcagtccctaagtaagctactacacatgttgggaaccatgataatctcaggtctaaggattcaacaccaacactaaatgagattactgatgatacaacacatatggctcttgcagtgtctcatgttgggtctatccaacaacatgttcactaacatgtgtccacattattaatttggtatctatataccatgatccatgagacatgatcatcaattaatacatgtgctgatcatctaatcatatttgttacacatatgatatttgatcagggatcctttagaaatagtaacacataatataaagagtctcatgaaagaatcacatattcattaaccaataatgagtttatctattttaagaaacaatgtcggataaatatgtaaacatagtgtgtgatacaatcatctttatgattgcctctagggcatatcactaacactacgctggctctacaacgtatattgattcatatgtaatgaaagcataaagacaatttcatttggttccaggagtctttttgaaacctagttccaggagtcttgatggctcataattatatgcatagtaccctttgatttacactagttgcaaacctgcaaccctcggctataaaatacgacagctaattgatcctgtgcttcacttccaggtgctatcagagtacctcaccttcatttcatttcctgcagcaacatctttgtagcggtagtgcatacaagacaggcagtacatggtttgtatagcattttaccgcgtaaatcaaatggtaattaaattgggcacgagagacctcagggaaggaaggaacacaggatatgatggagtgcttagttttcactcgaatgccacatttctactctaatatggcacagcagatttcattcatgccacaaaactactgcagttcttggcatgatcaaattcctgtgattattgcctgattgtactggcgtagcagagagagagagaaattgaacatgtctttttatttgaaaccttttggctaaagatgccatgttttctataagagtttataaaatcctgggtgataaagttctagcatgcaacctctgctaaagattcaccttaaactaactaggtggagtaatttgcatgttggctgcattcgcctgcgatttgttgtagctaatgagatcttccagttggatgtagcataggaagaaagagtcataactaatgctgaaaaggagcttagaacatatctaaagacaatagtggtggtgttgtatctactttaaacaagattaagattagacataaggcaaggctaacttggaccaaagaaggtgatgtcaattgactgttctttcacttaaaagcagatgccagaggagagaaagaattatacatagatgttacaaaccccatcaagggatgtaaccactcaagacaagaaagaacttcatcgttttttcacacaactcctaggggttccgacgatctcggtgcctgaactggtcggcgataaacctaccaaatgtatagctctactataagaccaggaggatacagcacaaggtgaattaaaggagactatcttctccatgccatctgaaaaattaagcccctgatccggatggttacattggggcctttttcaaacaagcttgggacatcattaaagtctgcaactatatatgcccgagcattatcgacctataactttgattcacagttttgttcgaattgtgacagagctacttgccagtcatttcgccccaatattgaacgaattgatctcgtataaccaaagtgcttttattcgtaaaagataaattcatgataattttctttatgtgcggaatttactgtatggcttttatgctcactactagagaaataactattaacgatagaaaatgtggtccataaaagtataaatatggtccaactttggttctataattaaagtatagtaaaaacgggtattgtttggctaaggctctatttgttttaccctaacattattgtaatctatattattgagtcagattactataaactggattataataagctatagtagatttgtttgtttctctagattatagtagattaagggtagtgaatctttaaccacccgataatctaaaaaagaaaacacgtttataggagattaacatattatactaatatggcttataaattataataatctatcgtaataatctacttgtttgttacagattattaccaataatccaaattataatattcctaagctaaaacaaacagggcctaagtcaactagtcgggataacttactagtctgttggtgtcctatcatcggaaaagaatgttttagaaggcaccaatctctacctatactaattggacactttctacgagctctcacgttaattaaaaaaatctgaccgtcaattcaaaggaggttaacatcgtgaccgtagatcaaattgatctatctccgcaaatcaggccgagaataacctcagatcagatcaacctatccgcatatctggccataaccagaaagagcgtggcaccactgacgcgttgacccggcgggcgggatgcaatgcaagcgtgttcacacggcgatccatcgatcgatctggggaagcacgcgctccagcggcggcggtcatgcatggcaatccatcgtgtatgcagcggcctcaacacgtcatcctccagccctctagccaatttcgtttcctggtgagatcatccgcttgtggttgtggatccgtacgctgctgcaatctagcctgtggatgggttttactgacggctgctaatgcatggcgtgcatgcctttttgcagttcatgccctgctcgcagaagtggaggagatcaacttttacagtggtcatcgagcaccagccaccaggtactttaatatatctaacgaactctttcacgtctatctgcttcacatttatcgtcctgcatgcatgcatacgactatatacacaaattgacaaatccttctcatacatgtatcattgaattcgtcaacaaaaagctggcgaaggtaaggcgcccccagtcaaataaccaagattggtttctaaattggttgttttgttgttcgtccaaaactcatctgcgtatgcttgcacctaataaaagtaagatctatatatcatcggcacatacagttattatagttattatgcttacacacattcttaatccatagtttttgttttaaaacaatgaatcataagtgttttgtttttccacctattaaatgagttgttttatagataatttcgacagccaaacccccataatttacttaaagaagattgaacattaatatatcataatttgttagcagataaacatatattgatccacattttttcttaaaacaaactagcatataatgattaactttccgtgccctgtctctgtaaacccgtatgcactgtatgtactctacaatatgcatattattgatttatgccattcaattttgatccctgaattatttttttcatcacaagtaatacctatatcgctaataaatatttcccattctttgtccaaatacatttctttgaatgattacatgattatgttcacggatatatataatttaccagcctattccatagttgtttttatttatcaaagttaaagtgtaacacaatggtaagtcttatggttattcacattgagaaggaatcaaggaaagtcaagagaagagcaattagactttaggagtcataatctaatcatgtaatcaacaatgtatgcatagataaaagtgattccaggtcctttttagagattaaagataaatgaaaaagactgtgatggccatcattaaataaggtatagttggatttaagattgggtgaaaattaaataagtgatccgatggggaaaataacaatataaaattccttatatttgtggataaattatgagccccaaaatccgttatgttggtggatagagagagtacttattagcctcgatgtcatacttatgaagaggctattagtataaatactttttcacgtacagatagtgttcatatttacatgtcttcccacttattttatttgttgcatgacaccatgatatatgccaataaagaaattctgggtccattaataagagatggttaagtgcacttaataagaagatgcttcattaacttcatgttgacctcaccctttttcttatccagatatcatattctcttagcatctctcatagctaggactgattgaagaaacacaacaaagtcgtggaatgagaaatatcaatgacattatgctccaaatcatgtaagtttaattaatatcatttaatccacataagtataaagtattggcagcagtttatctgaaatttcagcatgtgcatagttgaaacaatgcaaatcacactatatttggagtgacgagaaggggaaattggaaaataatttttaattcactagaaagtgtattgtttcatctaattactgacaggaataaacatatgtagagcatactatcatgatcgctaaatattaaattacaataaataaaatataattagtaatatttaatttttagttcatttggatgtttagcatcttctttgtcaaaagattcatcatcatgaaaatgtacaacacgttgttgtataattattatttttaatatttatactaaaatattttatttcaattatatttattaattaacacattactacagaaggttacaacttagatgcgattcttaccttttgattacaatatcaaaataatacaccattcaaaatacttaaattttaaaaattaagaatggtgcaatgaattctatgattaaaaaaattaattcacgcaggaaacaaattataaatgtaaaataattaaccaattaaaattttatatgattaaaattattatataaaattccccgtgcaacgcacgagttgacatctaaaataaatgtattttaataattatattgtatcaaatgtgtgaaagaataaaataagttataatactgcagaacagatgtcacaaaataggagagcactgcatgaaattactcaatttatatacgaatctaaaaacgaggtatttatgagtttctttctttctgctgtgcttgtaagtctgatatacgaatctgtgagagaggtcgaattgattaaggtactaatgtatgtactgatatactgacagagtcatataagtcttcttatgttgctacaaatatatgttccattccatttctttcataattatttaccttgagattgattggattggtacactaatgataataaattcaattaattaatgttcattgatcgcactacataaatatacaatgaattcactaattaaaaaaataattcatatataaattgccacactcggctcccaattttgcatttctttcactcaactcagaaaatcaaaccaaaaatcatgatgttgcaatttccatattgactcttcttttgattaaacccattaaacttttacatgattcacaattagtataatattaccccgtgcaacacacgggttggcggcttgttcaataaatacaggatcacaaaattgaatagatttggaccatgggctttgatggaaacttcatggcctcaagaaaatttcgagcttatttttccttaagtagccatgttgaagctccatgtctgtttcttataactagtccatctcaaaatataaaagtttctgacattttaaagatcaataaagaataaaaagaaattattgtgatgcctctcattaattgagaggtgattgcagtgtgggagggtggttagatataaaattgagtgaaaattaaatgagtagtgattgttgggagaagtagcattttagaagttattatgtttttgtcaaatttcaaatgctataatgtaacaccccaaactgtctgtcgcctatagtagtgggttggtgcaagtacctataagttgcagcagatgtgatttattactatcataaaagttaggtgagtgatagccaggttaacccttttatatgaaacaatgatcataaaaatgtaatatggaatactacgtctatataggctaattcaatgtgtggaaagaactgatgcaaattttaaaggaacggaatgagatgtgtatgtgaatggaattgtgaaatatgtgaataatagatgtgtgaaatatgtgaataatggatgtgtgaattatgcgaatggggatgctggggatgtcgatgtgctgggaatgctggggaatatatatgtttctgtcattttacagcgggtatgactagcagagacctgaggctagcaaaaaacatatttttttttgggggggatactcatcggtgataggctttaacttaaacccgatgggatgacctcatccgtgacgggcttttgttaaagtccgattgagttgagttatctccttgcctcctgcttgctgcgccaattggcaatgggtccaaaataacataatagtttataatcacttctttggacggatatttctcaaagtgcaacgacaaaaattgtagttccccgacttattagcgcgttggtgagacaactcacaaaaaagggtgtcaactgatgcaggcaaaatctgcaattcaatgttcagcgatcgacataaggtcatctagaccggtcaaaatgtcaaggtaatctgtgaggttgcacactcccagtcgagtgaaaccagtaatggtgaggaaaacgaataggaagaggtgagaatgtgcatcgactttactgatgtgaaacaagcatgtctgaaagaaggcacccatggtaaaaaccaatttgccatgtagagaacctctgtggatgaagaaccaagaattgcaatacattttttcccaacttctctcattcctattattttcacaaaactaggaagaagaagaaaacagaatagaacatgagttgtggagttctaccacaatcaagttagtagcacatgggagcagaaagtagtcggcctagttcatatatggggaatatatatataacaatccgttacagtagcaagaaccaagatcattactgctgaatattcagcataggtacaaatcaagggagattgtattgaatcaatagtaataattaacctgtaggggagtaaatcattcgcggacactgaaagattatgaaacttctatcagtgcgttcagatatttttgaacaaagcaaagatggtattatgctctggtagttcgtggatagtctgtagatatcgatgagtaacctgtgggatcacttattaatgtgttctctggagcatcatactttcatataatggctgacgaatcaattcaatagcaactttaaagctttgaatgataattgggctgcgtactattttataaaatgcttaggaacttgtccaatgtctcttggacggtgtagaaaacaaatggataataggttggtcgtatcaatcaatgactatatgggttctgattgtagtgaaatgtattttgctaaaaaatgtggaactagttttgatagaaaacaagtggtcatcacttaactagtttccacaatagtgatcacggaccgaatcttgagtgttatggaattcctcttttaagtgaggaccacttgttttctactccatccgtttcacaatgtaagtcattctagcatttctcacattcatatctattatataagtccatgaaactttctacaaacgctctcataccgccacatggcattctaataaaatagagaaaatcctagaaattctagaaaaaagcaaaacatccaaccgttaatttttatttaaattggtggacccattattttgcactattagatttatctcaataagaaaacaaccaaagccacctatttccagcgttagatacttagattagattgatctgtacacctcgcctatttccgtacacacacctctcctctcttttgctgcccctcccctcctattctctttcctatttctatgcaatcatttttttatcaagaaatcaacggttcgatgagttcaaaataattactatagtttttaatatatttcgtaagcaaacaatcagctcaagaaaatccttcatcgatatatggagcagttctaccgactgctgtatcaatataagcaatgcaagcaacttccatctctttgtttgatctctcaccttacagctggcttatcactttgattccacgtagtagtagtgcagcaaggctatctttgatttcatataaatttcacaaagcttttggaatataaattaattaattttaggcatttgagttatcaggtgcttcaaatggttgtcaaatatgcatgcgtgctccgttctaggcccatgagtacttcatggaaaactcttggcactactagaaaaatgattttttatggcgtttgaaaaatattttttatggcggctacgagaaaaacccgccagcgtaaaaaatcggggggtgggaggtcacgggctgccagcgaaaatcagttctcgctagcggccacattaagagatccgccataaaaaatattatatttttcgaggcggacctcttacgaaaatcggcgttttcgctggcggctgctaaaaagacccgccagcgaaaaacactgtctcgctaaaaaattttgatggcatttaaaacaatgcgcgctagattccttcacccaccacatttaaaaccgatttcatcccacttccactacccacccacccaccacatttcttcccactgccagaccacccacccacctcatctctttgtcctcctccccgacctctctcccttccttgcgcccccactggtgacggcgactggtgacaaggaccacggcgactggtgacgatgaccacggcgaccacaacgacgggccgggccacaggtggcgggagggggtgga

SEQ ID NO: 65652 - DNA, 1780 bp, Oryza sativa
ttgaactcaaacataagcttcctttggtacacatgagtttttttccttgatttgtatgaaaaatgagctccttgatgtaaaggctctctttgtttaggcttataagccaactttttttttaaaaagtttaagccaaaacaaacaagcagctttttcattcggcttttttgaagccataagccactctaacactattaagccaaaagctaggttggagaagctttttttggcttatatgagatagatgtatgactccaccactaaacttaggacattaaatccactggcttataaatcatataagtcaataaactgacttaaaagtctaggccaataagcctaagcctaaacaaagagggccaaaatccctggaaataaccatgaaattcctacccgtccaaggatgcccactacagatattgtactgctggatcgctcaataagaatttaagaagtgagcatagctcacctgatggaaggtgtgtgttcagcttcatcctccaagttcagcttcagtaagcagtacgcttcattcttttttaagatgaaaaaccctactacctaataaactaaactaggaatcgtgaattcgcgatgcagatgacctctcttcctatcgtacctcacctgcagtgcatatctctgctcggtcgccactgccacgccatgccactcctgatgtatatgttacatttaactttacaagttgctcccttttcttttcccatatataccaggactatacaattagaaggtccgaaaggcaaagtgtacattgatcgacagtctcgtgtacgataccctacaccaactattgtcctcgtttcaccaccaaccggtgatggcagcactgaagatttacaaattctgtatgtactctcgtagtctcgtccaacaaatagctccgacgaggatgaacaactcgaatcgagctccttttcagccaaaaatatacaaggaaccgtaaatatgtaccagctgcttcaccctcccagtcagagtcttctagcgtctccttcaccagagccctcaaaagcatttgaagctccagcttcacatgagcataagtaacttcagagccagataggctcacagcatgtgcatcatccatagtttgaacttgcgcacgtatagatatatgacgcacggtccaatcagatcagtttcggagagtcgcttgcagagtttcatgtaggactccaggctgccagattcctgtatgtttctccgcagggcggtcagcacagctgctctgtctaggtactctggatacaagcccatgtcaagcatcttcatgagtgtttccgaggcctccagataaaagccgcctttgacatagcctcgtagaagccatgacagagacttcttccttcttccagcactggttgactcgactccagcgagcaatcgacggacggcagcaacttctccctgagaagcgcagatggccaaaacaacatcatagagctgtgtgtcaggttccctaccaagaagcttcatttcccaaagttggtgctcagcttctaagccacaaccagcgcaagtgtacaatgaaaggagcctctcgtgcacaagtcctaggacatcactgctgccttcctcaattgcccattttgataaaagaacaccatcacttaataattcagattggtaattttcaatactatgcatagtctcagagtcaagtttggaaatcgagcccaccttcaccgatgaattcaatttccgcaatggctttgagaatttcctttgttctttaaccaagggcagtcaacccaat

SEQ ID NO: 65653 - DNA, 14912 bp, Oryza sativa
ggggggggggagtttaccctaatccgttttctcttcacttgcgcgcgctgtgagctacggcactcgaatcttctgctttcggtaaaatggaaacgctggttttgcagttcgcctgggattcactgccgtatattgtggggattatctcgctggttgaaggagggaagggtggggtttaaccttgtttttgcttatttatgctagtataagcattcctgtgggtaggttactatcatgttatatatttcgcggtaggcgtgttgcaagtgattttgccctagttggaagggaggggaaggggtgctcattttgacggttttagatgttaagatttaggtcaacatgtgctgcggaagtgtgtatggattcactttgacctaattttttctcttcattgttgcaagaaaggtaatacagatctttctgcaatattccatccactaagtttgtgtagatgagcgcccgctatttgattgggcctattttaccccctttgattttctgatgaccttgcactgaatatactgttccatctcttattgttggtcttcagggcacgagatgtcattgtatactgcccaggtctacctgcgcttgtgctagctgtttaggttattttgtgttttttgttatgtgagttgcttctgggtggtgctgttcagtgtaaacataatacctgtggatgtccaaggtctggttattgtggctattcacatgcttatgttgtgcctatgttgtgtggaccggtttttttttataccacagcatatatgtttgcttttcttatggttgattgataacaaactgatttggcctgttcaagatcctgatactaatagcatattcacctattcaacctgtttactttggtttagtaatttcttcattgtatgtcagggtgttgcccttttatttggttattcatattttatctaatgtgttccgctgacttagtgtacttgtgcagctgcctgttgaatatctaattgcccacagcatagttagtctaattgagctttgcattgttaattgtacttagcttggttcccttgtttagatgaaactcatggccaaatgaggtgcttatccaactgtttaactgagtaacttgattttcttatgggaaacaatcaatttttaagtaagggtaaattaaatttgaataatctttagcagagcttaactgtgttgctaatgtggataacataaatgttgcatggtgatagttctacatcttgtaaccataatttgcaagtatctgtggatggaaaggaattctgaaggaccctaagctaggtcaaactggcccaacggcctttagttgctaggattgttaattgatgtgccttttcattaagtttgtgtaattgtttttcgcttaacatgattaacagctaaaatctgtttctttgatgtctgctaggacagttggtacagccatgaatatcactcaaatcctgctatcagctcaatctgcagatggtaaccttcgggtagtagcagaagggaacctcaagcagttccaggagcagaatcttcccaacttccttctctccttgtcagtggaactttcggataatgaaaaaccaccagagtctagacgacttgctggtattatccttaagaactccttggatgcaaaggattctgcaaaaaaggaactactgattcagcaatgggtcagcctggatccatcaatcaaacagaagataaaggagtccttgctgataacgctaggatcttcggtgcatgatgctaggcatacctcatcacaagtcattgccaaggttgcatccattgagatcccccggcgtgaatggcaagaactcattgccaaattattgggcaacatgacacaacagggtgcacctgctccactaaagcaagcaactctagaggccttagggtatgtctgtgaggagatttctcctgaacacttggagcaggatcaggtgaatgctgttctaactgctgttgtccagggaatgaaccagacagagctaagccctgaagtccgtcttgcagcagttaaagccctatataatgctcttgattttgctgagagcaactttgcaaatgaaatggaaaggaattatatcatgaaggtaatttgtgatactgctgtatcgaaggaagtggagatcaggcaggcagcctttgaatgccttgttgcaattgcttccacatattatgtacacttggatccttatatgcaaaccattttcaacctgacagctaatgctgtcaaaggagatgaggaagcagttgcacttcaagctattgagttctgagcactatttgtgatgaagagattgagctccaagaagaatatgagggatctgatgatgctaattctactgtaaattatcgcttcattgagaaggccctcccttcacttgttccgatgctgctagaaactctgttaaagcaagaggaagatcaagatcaggatgataatgtatggaacatttccatgagtggtgggacatgccttgggctcattgctagaactgttggtgatgcgattgtgcctcttgtgatgccttttgttgagggtaacatcacaaaaccagattggcattgtcgtgaggcagctacttttgcatttggttctatccttgaaggtccatctgtggagaaacttgctcccctggtacaggctgggtttgacttcctgctgaacacaacaaaagacccgaatagtcaggtaagggacaccactgcatggactcttgggagggtatttgagctcctgcattctccagccagtgcaaatccaattataacaagcgcaaaccttactcgtatcatgactgtcttgctggaaagtagtaaggatgttccaaatgtggctgagaaagtctgtggagccatatattttcttgcccaaggttatgaagacgcagagtcgatttcatctgtgcttacaccttttcttcctaatctcattgctgctctcctttctgcggcggatcgtgctgataccacccacttcaggcttcgtgcatcagcttatgaagcattgaatgagattgtgagagtcagcaacatatctgaaacgtcaggcattataggtcagttactgcaggagatcatgaggagattgaatctgacgtttgatctccatatactttcatctggtgacaaggaaaagcaaagtgatcttcaggcattactgtgtggtgtactgcaggtcatcattcagaaattgagcagctcggatgctaagtcaataattgcccagactgctgatcagttgatgtttctgtttctgcatgtttttgcttgccacagctctactgtacacgaagaagcgatgcttgccatcggtgctcttgcttatgccactggtacagattttgtgaaatacatgcctgagtttttcaagtatctggaagctggcttgcagaattatgaagagtaccaagtctgttccatctctgttggagtggtgggtgatatttgccgtgccttggaagataaaattttgcccttctgtgatgggattatgactgttcttctcaaggacctgtcaaactcgatgcttaatcgttctgtgaagcctccgattttctcatgctttggagacattgctcttgctattggtgataattttgagaaataccttccttatgctatgccaatgcttcaaggagctgccgaacttcttgctgttttggaccatacagatgaggatatggttgattatggtaaccagctcagacggggaatctttgaagcttactctggcatactccagggtataaagggtgcaaaagctcagttgatgataccctatgcaagccatctattgcagttcactgaagctgtctacaaggaccgcagcaggttaatgtcatgcacattgcaatttatgttgtattatattggtaagtttttacctgcttagcgcttacatacattacatttgtgtttatactttcagggatgagagcgtgacaaaggctgcagttgctgtcctgggggatcttgcggacacactcggctcaagctcaaaggatctgttcaaaagcaacctcttccatgttgagttcctgagggagtgccacgatttggatgatgaagttagggacaccgcgtcatgggcccagggaatgataaaccaagcactggtttcttaagaggggattattttgttttgtcagttattggggaggtttcttttgtggctgtgccaagaccatttgccacagattgaacgaaaggataccaacatatatgtagcgtcagtcgtaggctgcttctgtgcttttgtcgtcagtctgtcaagtcagtttatgcgtcgcatttggcgtgggtggattctggcattgaatgtcttgaacagctaaacctgttaatgttaatgtattctacctgtggtgtttatccattcgattctgctgatgttactgcctgcctaagagcaagtttaatagtatagccaactattagctctaatttatctatagtcaatttattagctcattcatacaatagttacatattacactattaatatctggtcccacatgtcatacacacactccttcttggagtccgtgctacagctggctacaaatctgtagcctgctgctcttttttttcctcatttatctttttaaaatatgtttgtaactggcttatagcttgctaaattatgctattgtacctgctctaatactcttatcatgttcaggtgatattaaagttgccagcctgtcatgtgtatttgcaaatgcaatgttcttgtcaattgtcatccttgttggcaagtcatttcaaacttgtcaagatgttggtttcagttatatactagacgttgtgatgctaccacacaactttgcttttgttgatactcgttgaacttgtatatgctttggtttcagatattatgtgcaggatgaatgttatgcagaagctgtacagctcaggtagattggtttgtgaaactacacaaggttttacatttcaatctcgttaaacacctcacaagaatctgcacgcacactacatatgaaatcccctcattgttcatgtcatatttacagatggatgcaaagtaggttcatttcaagagcaaagttacaaatactggcacgctggtcaggctgcctcggtggagatgatctcgagctcggcccaccagagcggcgacaccttgggggtggcggcgtcgggcggcatggcggtgatctccctgagccgggccgcgacgtcggccatggaggggcgccgcctcgggtcgcggtcggcgcaggaccggacgacggcgtccaggcggtcgacggtctcggcgtggaaggcgccccgcagcgccgggtccatgacgtcccgcagccgccgctccccgcggaggagcgccgccgcccacccctgcaccagcccgccctccgacgccgcgagccgccccgccatcatctccagcagcagcatcccgtacccgtgcaccacgctctccctgtccgccatcgccggcgccgccgccgccgccgccatctcctcctcgcagaagcccacgtcggagatcttggcggcgaagtcgtcggtgaggtagacggtggaggcgtccagcgtccggacgatctccggcggggcgagctggtgcatgtgctccaggcagtaggcgacgccgaccgccacgcgcagccgcgtcggccagtccaggtgcccctcgtccctcgctgcatttcccaccgtcaatgtcagctgccatttttcgtgcttgctacaggtcggggtgtcgaagtaggtagaaatccaaagttccaaagaaaattaccgtggagatgctcgaatagtgtgccgtttggggcgtactcgaacaccatcatcctcgtgaacggctgctcctcctcgcagtagccaagaaggttcacaaagttcttgtggttcaccctcgacaggctcgttatctggaacaaccccccaacacaaatgacacaatgttaggcaccgttatctcgtaaactttttcacaggaatcagtgaatcagttcaatttcatagggacctagggaaaaaaataatcaagtattgcattattggtagtcaaaattaaaataatatcaagggaacgtatcttacacacactaaagattctagatatgatttgtgcatgtactctaattgacaattatttactctggtttttaatacataacgtcattgaccattgtccttatttagcttttctttgcaaatatttaaattacatttaatgataaaccaattcacaataaaataaacaataataatagtaatatttacaaagggaggcagtagtaataccttctttctgaagtgtgcctcgcacttcttggaccagtccttgggcgacgtcttggtggtggagacgacggcgatctcgacgccgctggagagcgtccccttgtacatggtgtactccggcagcgagccgatgacgttgctgaagtcctcgcacgccgcctccagctccgccctcctcaacgccggcacccccgtcacgaacgccctctgcagctgcccgctcagccccgtcgcccacggccgcacgctcctcaccaccttgctcgaccggtagcacgccgcgaacgccgccgccgacgccgcaagaagcaccgacgcccccgccgccgccacaagaacgtagttcgtcttgccgccgccgccgccgcgcctcgttgcgctcccgtccgtcacctccggccggctggtttcgccggcgtcgccggagctagacgccggcggcaacgcgatgctgcgggggcgcgcgtgttcctcgccgcgccgcggcggggccgcgtgctcggcgaccgcggccgacgacgctggcgaaggcgcaggggaaggcgaaggcgagggcgagctcgacgggccctggaccggcggcatgtcgagccatggcggccagtccttgagcggcggcggcggcggcagcagcatcgggagtccgaacgggttcgacggcgtcgacgacgtcgacggccatccggccttgctgccggcctgcctgctccgctgctgctgctgctgctgctgcgaagatgatgatgacttcttggcatggatcaacctgcgaatgattgagcagagatgaggctaaagttgacgagcaattggacaagaacatgcgtgcagcccggatggggtcgaatggttggttgttcagctgtccatctctgacagccacgacaacattcctagcacaaatttttttcctaccattctatatctactttgatttctatggaaaaatgtctttgtgatgaacattcacggataattcaggcaaatttggcctatgcttgttcaaatgcaggggaaacttgtgatggaagagaagaagaaattatgcccaagctgcaacctaattataacactgtgaattattatttccttaaaggaaactctattattgcggttttttgaaaataaactttattactactgcctataattaagagtctctgaattttgtcaaaatttagactgaaattcagggcatgtacgaacatgaaagtgagccaagaaaacatcaatcgttctcaccgagctgcagggcgcacgccttcattccaattcgccgttccatcaacaccacatcataacaatgatttcaaaacatacacaaatcagctaaacagaaaccagaacattcttggacaagctgatcatctgaacaaacaaaaacaaacatacaacacacacctcgccgagcaccatggccgccgccgccgccgccgctgatcccaagctgaagctgcaagcagagcagcagcagcacagccaccgccaccctgctcatcctctccatgaagagcaggacggtcttaagaagggaaagagagagaagcctgcagcaatggcgatgatgatggagctcttgcagaggaggcagggaaagcaatgcaagagagataagcttaagccaagctaagctaggcagcagcaagaagcagaggcgagaagatgatttgggcgtgaccactgcggcgagctagcgagagccacgccgcccacggcacgcggcgacaataaattcttgtgcttggctcgacttggattttttcgacctaactagtgctactattgcttaggagtatgcatgtactatgcccacttcatccagtggttggggttcttgcgataggtgagaggtcacaggaggatacatgatagtagtagaattgttacggatttcgcaaaagaagggttttaattagtgtcctaatcctagaggggggcttttaatttgtactagcaattaattgtctagaaagagaaaaaaaaagagaggtttgtaattaaaggaggcgcttttatcacgagatggtgagataggatcaggttgctatggtatagctagggccaaggtattagttattccttctgaattacttcctccgtttcacaatgtaagtcatactagcatttctcacattcacattgatgctaatgaatttagatagatatatatgtctagattcattaatattggtatgaacgtgggaaatactagaatgacttacattgtgaaacggagggggtaggagatttgattgtgtgaagtttgtacattgcctaacgctacaagattggtatgtgttcttcgatcacagggggagttcagctttggcaaaatctggtatgactgtaatattttggccatcattaatatatataaaccatgtaaataagcgaatttcgtacgattaattattgtttaaaaaactagattctggacaggttgcgtgattttactcttggaaatatgtgctaatatggctcaagactgaggctatttaaaaaaaataaaaatagtgaattacttccaatatttgttggaaaagcgctccttttttggtaagtgtttgctacctacaaaaatttcggatgcctgaaataagaaaaataaaattggatggcaaaaaatagttgtgaagacagatctacaataaaatcattatttatccaatctaaatgtttaagagatgttgaactttacagtttgggaaaatttgattagaggtttcaccaaatgaaaattttaaactacatttatgcaagtcaaatggtcaacactaatgacaaaggatgcggtctggttaattgcgatgaaatatattgagtgggccattgttcacctcacccaataaatgttcactttctactctctccatcccataatatactaccaccgttccaaaatacttgtcgttataggttgtttagcatatagtaatatttgaagaaaaatactataataccccttaactaataatggataattggatgtgggatggtggttaggggtagaatagggagaaatttgaattggaagtggttgatgtgacatgtagtacttcaaaatggcaactgttttgggacaatttttaaatgctagaaagacaagtattatgggacggaggaagtaagagattttattcctactattagtcccacaatgggactttgctatactacttgtcacattccattaattctaattcaaatttctacctattttaaccttcaactacccactcgtcacaaccaaaatcacattcaatagaggcattgcagtcttttcttttcattcttaatctttcccaaaaggaaataatcccttatattatggaatggattagggagtacatagtttgtgttgcgcaatgggattaattgacaaaaccagcttgcatctctaactactaactagtcaaatttcaaactcatttttgtttttctgtttgaggcccgaattcaattttgaattttgaaaacgtcgttcacactgcttcatgtgcctcaatagtccagttatttttttttacataaaattctggctatctactcctagctagttctgccgttgaggtagttgaagaggatgagctgccaaagacaaaggggatgctagctactaccatgcatcaagttggtcaggtcaggcaggattaagctttagaaagcgtggtagatggtacatcaacaaggaaactgatgtgaggtctcatgcagatttgacaccaaagcaaagcattctcagagattttcctaacacaccgcgtgttgattgcgtcgtttgtgatatcttagtaaccaagcagattaaattaaattatgacctgtcccataaacagaggaagacaaatagacaatcccgatgggattagacaatccagaggaagacaaagagttcgtcagaagttgtacgtcgaagtgtaccgcaagctggaaacttctacgtgaactgattgaatgtgaagaactgtgtagtgaaccgtaagatcattggctcccattcggtgcgcagcctcagccagctatgccgatcgctaatttcgttcttcatttttatcaattacataggagacatgcttgttttactctacttcaaccgaatttaaactagataatacgggagtttggcatggagaaaatgcccatttaatgaaaatagataaactgtaactaaaagaatttctcagccaggttattgacactccccctcttataatgtgtgtagctccaccctcacagacacacgcatataaagtcgtagattatttcaattacgtagaagacatgcaagcgcacacagactcgatcttgctctcgatcgattacctcttgtaatataagttagttccattgacacacccatatatatataaaatcgaagattatttcaattacgtggaagacatacacgcacacaagctctcgctctcggtcgatggaggccgggggagggtggcgcgttgctgtagctagttgcatgcgcgccgctcgattgctgccgcgcgcgcgcctcattgcgatttgcgatagatggggatcgctcgcccgccgcgcgcgtcgtcgtcgttcgctcgctcgtacgtgtatatgcaaatgcagtgcagctaagccaacgacggcaacgtacgtcgtcgtcttcttcctcgatcgatcgatagctagctccaccggccatgcatatatgtcctgcgctgcatgcatgcatggtacggtgtcagataattaataacaataatatagtgcaagttgtaggcatatatacgtggtatatatggtatcagttaggttttaagcttaagcaaacgcacaggtggagaaagcctttatagtcccggctggtaaccccctatagtcctgtttttttctaaccgggactatgaatccgggactaaagatcgctatctttagtcccggttaaaataaccgggactaaaaatacatctttaatgttaccaatcgggacaaaagatggcagcgcacaatcctggttggtcaccatttttttattgtttctttccaaatccagttgctcctcccaaatgtccctacatatcccaaatcctatccccaaatcaaagtatcatcacaaatcagattcacatcacaaattctaaaaaaatagatcacaaattttaaaagaaatacaccacaaattacatacatcacagatccaaacatcaatacatcacaaatcacatacatcacagatccaatgattcacaaattcgaaaaaaaagggttgccgctgccgcctcctgcctcccctccggcagaggggaggccactgcctaccgccccccgccgcggcccgctgcccacagcgccagccgccgtcgcccgggctcggccgtctgggctcgctcgggtatgggaggtggaggtaggtagggggaggagaggagaagggggaggaaggggagaggaaggctgagatctgagagaggccggatctgagaggaggttgttaatgagagggaggagagagagagaggaagggggagggattagataagatcgagactactggcgtgcgccgctcaggtggttttatctttagtcccaattggtataaacaatcgggactaaaacctatttttagtcccggttgtttataccaaccgggactaaagataattggggtctgaatttgacccaacaaccttttgatcgcgactaaaaatgatctttagttactaaccaggactaaagattaaattttttttaaccgggattaaaaatgatctttagtctctgttcctatttaaaccgggactattgtagtttttaggcgaccgactaaagatggtttctctagtagggacagcttcatctgtgatacatctggtaattaatgtacgtacgtgcgtgtactgatcgatctactcctgatctctggacaaatactccctctccgtcctttttgtttgacgttgatttgcactaaccaacgttaaacattgggagatgttgatatatatactggatatactattcatttatttttaaactttaactgctcgccggccgtcattttaagaaaatgcatagatcgatacttcaaaaatatttggtattcaccaagtgtgttttgtatccttaacatagatatacaatacttttgtacactataacggataccctcatctcaatcgggcggtaagccccatctcaatcgggtatggcgtccgtcacaggctagaagtcactgatgtgaagagctatctcaatcgggcaaacggctgtcacggatgattctatctcaatcgggccctaagtaaagcccgtcaccgatagctttgacccagacgaccagttaatgcccgtcacagatgagtatattccaaaaataaataaattttattttctggctagccctcactcgtgtgcacccacgtgggaagtttaaacttcccagacgaccagttaatgcccgtcacagatgagtatattccaaaaataaataaattttattttctggctagccctcactcgtgtgcacccatcccaaaattgctccagaccaagcacacttaacgtcaaagttctctagagattggcttccggaaaagtaattgtaacatgttggtatgagtattgtattaatcctattatgccctaggccaggatgtcaaattggggttattaaatgatttcaaatggaaaagtcaccaaaaccaaagttgtagaactcatcgaggtgcaaaatttttattttggtcatttctccatctgactctatttaaacaatttgaaatttgaaattcaaagtttgaaaagttcaaatagaattttagatcagtgaacgacttcaactgaaaaagtcatcaacaacaaagttgtataacttatcaatatttacaacttttagtttggtcatttttcaatataacatttttttgaacagtttgaatttgaatttgaaaatatgacaacttcaaacaacattttcaaatactaaatgatatcaactgaaaaagtcatcaacaacaaagttgaataactcatcaagatctaaaacttttattttggtcatttcttcatacgataaagtgatagtaacattgttcataaaattgacatatctcttatctggttttataaactatagcacatatatgtaaaatttatgaataatattactaacatttcgtcagatgaagaaataacaaaaattaaaagttttagatcttgatgagttattcaactttgttgttgatgacgttttcaattgaaatcatttagtatttgaaaatgttgtttgaagttgtcatatttttaaattcaaattcaaactgttcaaaaaaatgttatattgaaaaatgaccaaactaaaagttgtaaatattgataagttatacaattttgttgttgacattttttccatttgaaatcatttactacccataaattattttgctatagtcaacttagaaatataaacatttcatatgaaaaatgaaaaaatagtcatcggtgacggactttagttaatgaccgatagagattaagtatatagcccgtcactgatgaatcatctgtgacgggcctagttgttatctcaaacgggcctcaagttggtgcacgtcacagatgatggtcatctgtgacgggccacaactttaggcccgtttgagatatggaatgttatcttaatcgggcctaaagttgtggcccgtcaatgataggtgtcatccgtgacgggcttaagttttatacccatctaacatgtctgagcgaccatatctcaatcgggcactttttgggtccgattgagattacttccttgtgacggcccgctatttctaagcatattagagcccgtcacagatagaaggatctgtactagtggtaaaccatgagctatctttttataattttgttgatcgtcaaagttcaaattatacagatcaacaataatggcagctatttgaaaccgaagggaataatatataagtagtatttgttaaattgacaacgtagttatatatgtcacgttctatatggtagtagctagagctagtacagagttggtacaattcgttgcgttgcatgtttagtttagttaatagacagagatacccgcgcgcgagaaagaaagagaaaaaggaagaagtcaaagttgggtttaaggtgcttggaatgtgacatgtcaaggtcagatcgatgtgctttctgtttggcaaagggtattttttaggccaaagtaggtggaataataatgtgtctgagaagaataattaagacatcatttttccccctttccttaaaagaagaaaatcatagtactacaagatagatctaagtcctcctacaaaaattgatggtaatgttggactcgcaagtctataattgtctctccggtctctgcccataagtatatagatatgtcgtttgaaattttaataaatattttaaattttgactattgatgcattttaaaatagttagaagtagtttggaaacacaaatataatgcatatatttatccttaaaacttaagtatactttataatatcgtaaacttataatttgagtaaattatataaaactattttgatccaattaaattaaaactatatatttgatagggtgtatcataaaaatacaagtttagcatcaagtta

SEQ ID NO: 65654 - DNA, 15368 bp, Oryza sativa
ggtggggggtgctgcacgaatcttaaaatttgtgcgatgtgaagaggggaaataagcgatgtatagatagtatcataaatctaaaccagggacagttaactatttcccactgttcacttaattattacatctgcaaccatggaaccattgaaagaaatgtagccattatatatatcaaagctatatttggtagcttcttccttcgttacttttccctggatggcagaataggcaagcacacccagtgttaatacaggtcccatgcctgcgaaaaattctgtagcaatccacctcacacgtctgcggatcacacgccgtacccggagatatgaccaccgttgtgcagttctgcgcttggtccgctgccaacttgcttgccggcacttctgtggccaaaaaatgcaacaaatttatgtgaaaaagtactcttgaaggatatgcttgttcagcaaatcagtgttggagttgggtgcaaattaaagttacctgaactcatcgccaggatggcaagggccataagcatcagatgcccaatcctcatgaaactctgttggtcgcaccgttgagaatgggagatgttgcgcaaggtgacctgggtcccttggcttgtggatagttcatatatagtgaaatggcaaggctttggtttaatttgctctggaagttgatatttttttcttttcgggatcagttttggaatatatgatgatctttaatgtgcataattaatatggatatattcttgtatctagaaacaacagatacagttaataaataggtcatgggccactacaaattggagatatgcacatccagcttggcatttatagcatatattcatcagtgcagtcatggggccaggccactaattgtttgttggggcattttctacttcaaggttataatgaaacagcctcaaagatttaaggggctttttcgaccttttcattttcaaatcccaactaaaacagctttcattccccctggaagagctcgtaggaacaaattgtatccttatcacctaattgtaggaaaggttaatcatgaatgaattttaacatgtttcatcttacatatatcaattgctttgctccatatctttctctgtaaatattaacatcttgcattatatcaaaatatgaacatattgcacaattacttgaggaaaggtttgcaaacataagaacaagaagaggtagagatgaagacaaaaaggtctttattggtatatgggaattttgtgctattattgttgtttgctacacatcccttggaaaagctgaccatatttgtcaccttgtgatgacacatgaagcacttgctacgatgaaaaagctcttgcataccaaaaccaccttgcacagaaaaaaatggaatgtccaatatagaaatccttaccaacaatcgtttgaaaattggaaattgttatagggaaataacttgaatatatcttgagaaaatatatttaaagatcattgattcaatccaacaatgctaatatattaattgaaaatgttagcacacgaagacatatgtttcatgggaaccaaaagcgtaaatatgcttaagtggaatatatttttcataaatgactagtttaaaacattttgatgaccacggacccaaacatgagcaattcaacatttaaataatttttttggggggaatattagcaattccagccgggcttggtctggaggacacgacaacagtagtgatggaggcggctgtgctgcacacggagcaacgatggatgtggcggtggagggctagccctctagcttgggcttctgtggtgccgccaaccggccagacatatgccaccgtcactgtcatttgtcgctcaagcacagatatcggtgacgctagtaggcaccacacaccatcatggaggtgatatgtgaaatatcgatagtgacattcccaatgtcgtagcctgctacaaggcgtctcattagaggttccctattggtgcggcatccttatggcgatgtctgtgttggttgggtttgatggcaatggtggcatttggatgaatgactgatttatataactcaattactctccgagttatcttccgctttgaacgtcagtcacctatagttatgggaccgaaatttgatcggcaggagtcggccgctgatttctgggtttttgcttttctggttttaggaaaataaggactacatacatacatctgattaagttgtcgatagaaataatggttatgcatgaacaactatatatagaaatcttgatctctttaaggtggtaaactaagtagttttcttatactatgtaggtaataactgactacgagtgggctccaccggcctgtcggtgaaccaaagcaagacatgcatggtggcttgtccgtttgtgctagccattggcaaacaacagtgtggctagggtgtagtccacctgggaagggccatgagttcattgaactcatgtacacgtctacatagcagatctaggggtggtcctcattgtccccgtgctcccaggaccacctaaaaaaatcctagctcaatgcatatatatgtatatatatatgtgaaaataaaattttgaaaaaagaaaaaaaagcttctttattaatgtattatgatgcatatttgatcaatttatacttctaacttggaccatccatatatagatacgccggcctttgcatatctactagaggttgcggtgtgcaagaggaggcgagagagcgagaggggtgcagcaattggctcgatgtgggtctatggccccaggcatcattgacaagggtggatataagaagtgactgaaatattagatgtgaaatggatgaaaacatatggcaggttcttccactcatgcgctacctgtacatacattgctgttaattttactataagggcaggaggtcacagtgaacacacatggtgaacacatgataaaaattgcatagccgtgtatggttgtattctacatttaaccttactaacaaatttaaataggcaccaatgtatttgacaaaattatataatttgtgcagatggctatatggatgctacttcatactccctctatccaaaattcttaagcatattttattttttggttttttttccaattgagatggtcagatttgtagttttcatgtgcatagttaaattgttgactagaacccaagcaactatctgcaaatacttcattagtttgttacgtggaggatgagttaattcctccatgattttggtgacaaaagaaatatgacttttgggtggatggagtatttattagaatgtttatgaaattttgcattgtgctgaaatgataaatatttttttcaagtcttagctatttacatgcaaataaatttattaatgcaaaaaaaatagaaaccaggctaggataaattcataaaaggaagccattaatactcacatcgtccaaccatatcataattagacaataggctatattagattcttataaggaagcaattaatactcacatcggccaaccatatcataattagaaaataggctaggataaattcatataaggaagcaattaatactcacatcggccaaccatatcataattagaaaatagactaggataaattcatataaggaagcaattaatactcacatcgtccaactatatcataattagaaaataggctaggataaattcatataaggaaacaattaattctcacatcgtccaaccatttcacatttgtgaaccatgaatgaaaaatctttaaaaatagaggcaattaatgcatagcaaaaacagaggcaattaatgtagagccaactagtcccagtgaagaataaataaatgcaaaattttgtcacttacccccttcttttatattaaaattgaagataaaacctattggcttatatgtcagtgaccttatatgactcatatatcgatgatataggagggtatgtccaagaattataaattaagggagggtgtatgaccaaatctttcataataaattagatgtatccgaggcatgttgaacatgtttgcctttcttgaaagcataaaaccaccccccctcccctttcccacctcacatgtcccacctcttccccaccccatccccttctcctctcacttcagatcgacaaagagttctatatagtagagagagatagagagaaagctagggatattgagagtctgacatctgaaaattagctatttgaaatctagagagttgagaagttcaggagagtagagggggagagaaccgcgtaatcagatggcttcgtcatcaaatccatcaaatcttccctgctctagtgatggtgtatgcatgttatgcaaggtgcttacaacagaggtagagcagctgcgttgtagcacctgtgctacgccatggcatactccctgcctctccagcataccgccccttacagatgtggcccactgggtctgtccagattgctccggtgatgtcacagccagctacccgccatctgatgttgttcgtccggagagcagcctcatcgctgcgattcgtgtgattgaggctgatccggtgctgtccatccaagagaaggctcgtcgtcgccaggaacttcttggccatgccggtgatgcaggggctgcaataactgaagctgttggggaaaacgtagaggacagtgagagcaacaatcctttgtctatgctgaacaagaacatcaactgctcattttgtatgctgcttccagagcgacctgtcactgtaagtatgattgctcttttgccaaccctgtcaacctttgctttggaacagcctagaaaaatatagaaatgtttccatgaggcactacatgtcataatatgtaagctcataaagtgtaagtttgtaccattacttagatctcagatcacactgaagataggctcctattagcacacaaataaattatgattaagttgttctgattttatttgaattgatctacaattgctgtacttctactgcaaattacatcaagtatgatatatacatgaaaatacagggagctactggattgttggtttctccatctatttagcctgttttactgctctgagatatgcctctgtggatgcaattgatctcctttgacttttgccagtatctcctcttccttctcgacagttgtgtcctctcttcagcagcacccaccttcccgatgtttcttgccaactttataattttcaccttgttaagaacctttctctcttgattatcaggctataggatcttccagttaggaaagagctatgtatagttttcttctatagggacagtgatcattacatgcatggcatctcgttgcttatatgctagccctcctcctatgagcttaatttatgttgccatcgatctgtctcaacctggaaaatttacattacaaaaatgtcatgcacatattcgtagccaaagtcacatatgatcgcctcctattgccttgcatagctaatagttctgcattcagtataactttctaatacaatacctattgccatttgcacccactatgaaccatgcacaactaagtcgaatcaaccatgcacatatgtgttttggatatttgtattatctcgacaatttttaatctgctccttgttagcaagaacgcctcgtttcatagcatatgcatttgtctggtaccataatttatcacagtgaaatgactaatgatctcacaaaaagtggttttgttcatgttactttttatctccgtcctttatttaaatattgaaatttgtggaagcttcatttattgtttacaaaggatatatttccatggacagactagtcggctgagactcattattatctggctagttcattttcatgttatttttcatgtaactacattattatcctatgaagataatgctaattaaccgaatacataggaatttgaacaccatttatacctgtgtttcagaatattttactttgctgaacatcaaattccattattatagcatccatgtccatcaattgtcatcacataatattttcctttgcttacatgtattgtgcagacaccatgtggccacaacttctgcctgaaatgcttccgaaggtggattgaaaatggtaaaagagcttgtgtgatctgccgagcacctattacacaaaaagtagcacaagatctaagaattaacttggcactagtccaagctatccgcatggccaaggctgcaaacaatgctagcacaactggtgaaacaacggtttatcattataaagaaaatgaagataaacctgacagagctttcactactgaaagagcaaagagagctggaatggcaaatgcttcaagtggacaaatatttgtgactattgcaccagactattttggtccaattcttgaagatcatgacccaaggaggaaccgcggtgttcgagtcggggaccattggaaagatagaatggaaggtagacagtggggtgctcatttccctcatattgctgggattgccggccaatctacacatggggctcaatcagttgccctctcaggaggttatttagatgatgaagatcatggagagtggttcctctatactggaaggtttaatattactacctgaccttacattgcgatttgtttctgtggtttatcaaaaactagttaatccattattttctacatttggcagtggaggaagggatctaagtggaaacaagcgaacaagcaaggagcagtcttttgatcagaagtttgagaagctgaatgctgcattacgtgttagctgcttaaatggctatcccgtgagagttgtacggtaatgtttttttttctctatgtgcatccatgacaaatttagtgttagtttatgtaaaatcatcattatattatttcctatgggttgcttccgggaccatcacaaaaaatcaaagccatcacagaaggacgttcttctggtaatgcacggagaatatatgtagacctctatatgttgcaagatattatttgttccattattgttatgtaattatgatacgttgcgaataactgtactcacacaaggttattgtcttttaaggctttcagtgttacgtttagtatgtttccactacatctaatacgaacaatcttgtttcatttctttggaaaaagtaatcccaatttttgtttttgtatatgttgttctgtttgtttattaaaaggtcttttaaagagaagcgctcaccatatgctccagagtctggtgttaggtatgatggaatctataggattgagaaatgctggaggaaaactggagttcaggtatttatagttttcatgaaacattacagatattttttgtgtaggctgcaatgattttttttttagatttacaaaactgaatgtatccaaaattatagtttatcaacttatcaatataagtgatgattgttggagtttttgttttttggcctcagggtacattcaaagtgtgcaggtatctctttgtgcggtgcgacaacgagccagcaccatggactaggtttcttatacatcccttatctcatgtatacattgctattgttattctatttatttacttttccatttaattttctatatttacttgaagtgatgaacatggagaccatccaaggccattaccagatatcgaagagctgaaaaatgcaattgatattactgagaggaaaggaaacccagcatgggattttgatgtaagttgttgtattatgttctcagaaaaaatattagcttgcacatattgtgacatctcctttttcttgttataggcaacagatggatggaagtggatgattactccacccatcagcaggaaggctgtcgtaactggagatcctagaggcaagaaaatgcaaggagcagcaaggcatacaaataacttgtcaatgagagaaaggctgttgaaaggttttttttttttttgtctatgaattgcagttcatagtagtggctgcttggcattgcatttccactgatttcagtcatatattttctttattatagaattcagatgctccatatgtaggaacgtgatggaagagccagtgacaacaccgtgtgctcacaacttctgcaagaaatgcctgcttgggtcatatgataatctttcccttacagaggagagaagccgtggtggtcggaccctccgggcacgaaagattgttaaaaagtgcccttcttgtccaagtgatatcgctgatttcgtacagaatcctcaggtacagtaaaatagtagcaaaaattaattttgtatagattttagtcatttttttgcgagggatttcagtcatctttcccattcttagatgatgtattctttgttgtaaggtaaaccgtgacattatgaacgttattgaatcactccaaaaagaagctgagaaggaagatcatgctagggtgagtggagaaggcagcagtgcagcacttgtagattctgatgatgaaaatgacactgcttgggagaaccaagatgatggtaatctggatgagggaggttgcaacaatcctgaggacatgataactgaatctgttgatttgaattctgttactaatgttgataatactgaaaacaaggtggaagttcagcagcctcacaagcgtaccgccggtgccgggaaggggaaaggtggcaaatgggctaggacaagctctgcaccaggtgatgcagatgccaggaatgttgtgacttcaactgaaacattggatggaatagctgctgagaatgtggctgatttagtacaaattgaggattgcactttcactggtgtggaaagagccgaccccaatgcgttagaagttgatggcaagaatatgattccagacttttcagaagctgagaaggttaaccctaaacaggatcaagaagttcttccatgatgtgtttccttgcatacttgggatgtttaaaagtttttaagaagtagtattatcttattatctttggtgacattcagattgggatgatatcatttaatttgggaataattgaactcatagtgggggtgcaactttcacttcctcaggttcagacattaagctgctgcattattgaaacttgaaacatatgcaaattgcttgtgaagttttttttgtattcttcctcttttgttatccctttttctttgattatatttttttttgcttgccctgtttactttgcaaaaactagcttggactgaaatgattcatgggtcgtgaaatggaagaaatagtggtgatatatattgttgttgcattgattcccagtttctttcacggtataatgcagtggtggatttaccacccggcttgggcaggcagttgtccaggctatatgaacgcaaactatcaaactggactgatttctctacggtaaaatccatggatttaattacttcctgcacaaaccaagtagattagatttaactactctagttgggctgtacaagcagcaagccttataggcttacagccctgtagcatgcaattgagccctatcacaatgaataacatatggcatgctcaagcttatacgaatcatcttgtctttcaactattgaaaattttacatgcattttgaactaacaaaattgttttgcctttaattagtagtaaaatgagcgtataggcattacacatgtgggtagcggatttggttagactttcccatgctttgtgaaattcctggctccttcactggtataatgcattactagataagggaaggctcctatatgctaagttctaattgatgttattgggtgttcctctcaacacctgggaacttagtggtcgtatcaacagatattctcgataacatctggtgcataacgtgtgctacaaatgaagaagaggcagaggtttttaaccctctcatgagtagcacgcccaaccaggttgatatggtaggacagagaggtagagctgaagtgactttcttggaagttgaattgagttgcaggtttgcttgaagtttcctcaaggctgtagtgctccaaagtgagtacaaaaattactgtgtgatggataccatgatgattgatgagcttatgataaaaaaaatatcgaaattttacagtgcatggtttattggttttgggtgcagaaatttggctgctattttattcgaatttctattgagcttgattgttttgactgaattaattggggtaccaactcaagtgataaaatcatcaatcttttattgcaggctattcatgccacctagtatttgtgttggtgtttccataattttttcaaacattagatggcatttaatttatttttccaagttaaaataatgcatgcaaatgcaattaggaatgcgagaaaaaaaaacagccaaaaccaactaaaagaacatatattcaaaggcaagcatccacagctcatcatactgttttgaggactttgtttcggtttcttacattaagagtgaatttaaactggatttgaaatgtaacatggaattggatggttttggtgatattccagctcaatctatttaatattaggatagtggaccatgttatgatgtactccataaaatattcacatttcattccattggtggttttgctacggaataacgaaaaaaatcattggtttaaatcttaattgaaaattctaccgttgactgagctaaccctatcttgaataaaataatatttcttctgaaaactgttgattttcgtttcgtacgacaagtttagctttatctatgatcaaattttcctagtccgatatgttttatagtgtatcccgcacatgaaggtcagtaaaggatgtttgctttttaaatgttgttggtatattttgatagctctagaagagttagaaaatctatttgtaattaattttattacttgtaatcatgacaataaaccttgatataacaaatatgagttttatattccctcttattttggttgcatttaatgcggttacttggttgaattatttgtgactgacgtttgatttatctcttcttgtatgtactattttgaaactcttttatgcaccggaatcataaaggaaagcttatataatatatttcaacactataagagtaatttaacatcaagagctaaaacttgggtaagttataatgctcaccttcattgagtgaaaccattgccgctataaagatagccaattttgcttcacgacattcaaagtttatataatttactggtgaacattgaaaaaaatatccacggttagaggagacgtcaaaactaataatttgatggaaaacatgcaatcaatattttattattttttcaccaaaaggatagagaaacccattataatgataaatttgtccctcgggccaacatatgttactatgattggtttggtcgaactagaccaaaccaaaccaggccatgagtatattttgcaacctttcccccttttttaaaaaaaataggttttcattttttaccctaaatatattgctaccatatatcatattccttcttcattctagagatagcttagaagcttctagcccgaggggcaatatcgtccttttgaaatatatctcgccgattggactggaaataacaaaataatggatgtggtgtcgacctttggcaaattaccagtttttgaaggtgttctcccaccttttgctatgtttaccaacaaacaagctatgtttaagtgacctgtgtcaatattttaccaaatgataatgacaatacctataactttcacttatacatgtaacttgatctatcacctatgtctgacagttgagaagatggttaggagatatgttccatagaataatatactgatccttctcttcatgggccaatcggcctagagtatatatgtgccatcatctacttaacaccgtcatcaaactcaagatgagagcagaggatctgaaacattgaatttgagcaagtgaagttaatgttatttctcaagtctatgcattaggatgctcatcagaataagcggttctcaagatctttataaaaaagcatcaacatctacaataacaaataaatgcactatcaagacataatattgtggattgaatgaaactaaattgatgtatatattgatgcacttatttataaactcagttaatgttagaaaacaaaatgcagatcacctagcatgatgaggtctactgcatcctcatcaatgcccccttttgtgactaagaagacgagaccattcaacatcccctttttatcttatgtgtgtctagacagatgtggttctcccttttgcatcaagttgtcccttgggctcttgaaccacaacctgtggttgtgaactttgatgaatggtggaaccgaatcaatggtatggtttgtgcaagtaccaggaagggtataaacaggttgatcatgcaaggagcttggtctatatgaacgattgcgtcttcaatggagtacctccaagattatcagccatttgtggagtttggcagggactaaggggctctttgtaattatagacctcagctagggccttttatttttaagttccttttggtcgtgtaacgagttcgtgtacttcttagtgcttggtgtgtttggacgccttatttcttctcctattgacgcaatgatacgcttcttgcgtcttcaagaaaataaacttagaacaaaactatatgacttatattataaaactgagggagtactagttaaatagattctattccaccatgaatacaaattgccatgcatagtttccttgtttttgttgagaatataggcatataatgatttaatatattccataaataaatcatgacattacagatgtatactagcattaacgcatcattagatctacacatgtaaactaagcaataaaacatgaacagatcaaatatgcgcaacatatcgaacacgtaccgagatggcggaaagaccggttgctcggcaggaactactcgcggtagcgagcgtcgacgaaggcgcgcaggacgcgagcggagaggaaggcgagccgttgcggacgaaaagggagcagtcgcgcgaagcgcttcccaaaaaccttattgctgccttctcccggtgcaggacgtcgaaggcagaggttccggagacctgctctcccgatcgccggtgcacgctggcaagcgggatggagtagtccacaagcgacggcgcaacacagagtaggaggcaaaccctagattgatttcgtgtattttgcgtgaatgcggcggctcggtttatatagagataggtcgcttgatcagggcgcccggacgatctccattccgcgtaaccgaaccggataagtcgcgcgtaacttatccggatttttcggaatgtttccaaaacaaaacaaatccgaattttcgccaagggtgatgagccaattttgtggatcattcgacgcgtaacatcgtgcacgcgcgccgcaaggtaggcacgcgcgccgcctgccctaccttgccaggcgagcgagcgcgcgtgtgttccccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgaatgggtcttagcccatctattaattccaacagttttcaccatagttgacagtaacatttttccatggacatgctcccctaccaccatcactgttgaggcagcattgccaatcaaatctgatttcgcattgaaatcaacattagccattgatattaatttatttacactaatcagtgtggttttatggtgtattgttaattgcacatcagttcacaagctagaagtcattaaggaaacactctacactatttaaaatttatgtgaaaaattcttcatagtgtgtgaatattctctacttcacagtggtgtacattgcaaccaaggagtttctatattgggccgacatcagtttattaatcatcatacatagttttcacaagtatcttcatattttagtactttctagctagcgttgggttggaatccattaggaacccacctctcgaactcaaataatagcaggtatcagtacacaaagtaattgagggttggaagaaccaaagtactttatgtacagtagtggagttggtgttagaagatggaaggagtacaaggccaaaagtttgttcaattcctttgaaaaagcagttgttgttgcctttgttctcttccttgtgcttgcttgggccagccatagtgagttaatacaacaactcaacttgtattgacctgttgctagccaccggtcctagcaatcccctttgctttaaattcaggttgttcccaagccaataagttgaaacctcctagatctaatgactgaacatgaagtgtcatggcataaaaagttaccttcacatttaacaaatcactttcatcattccggccgggtgatttgcttccaggcatggtttcattcatgatattatcataaaaatggttcttatagtccatgtctccactctgcttcgtgctaggaagtaggaacatgatagaagtgttgggatattgatttgtctttgcagttacaacccattttttatagcgcaatatccgtgagcatattttcagcaaagcatcacaattgcatttaggatatgggcatagtgttgacttcatttctcctgtgatgtccctttgcttgtattactcccttccttccatttggacagcacctgaacaacggccccaaaaattcagtggatggtaactgcgaagcaaaatcaagatccaaacacttttgcatttcctgctcaaagctagcatcaattgcaatactcctattttcgtccactcatttcaaatctatatccttgaaattttagccgattccttctatgcccctgaattttcttcactcctttatatacctctgaattttgatttggatccctttcgtacccttgccatcaattgaccattagttgaccgtttaataggtatagaaaagttagttttacccttcaatatgtgagaaataagtagaaatttgtaaactgtattgttggaagtataaaatttgttgtgtgattatcatatgcataagtttgttgtacataaaaaataatatatattaaaaagtatgtgtagcactttttaaaatgataaatatagttttggaaaacattcctatataatatatacaactggagaaaatatgttgaactatcataaaaaaaagctacatatactgttttaataagtaaataaatattagttttatgtcattatataaaattaaactttttcataaaaaatacctggtataataaagtcataaatataatagtcttatattatatagatactatactacatatgaggtgtaggcgttaaaacacac

SEQ ID NO: 65655 - DNA, 13962 bp, Oryza sativa
aactgaatttacagatgtaagtcctcatgctccttagatattgcaaatatttcatttaagttgattttaacacaaatcatttgtcttttactttccatagctcccgagcatcccttataacgcaatccggttcgatcagaaaacgctgatcaacttatgcatggacttgtgccagttcattcgttgcgacatctgtaaccatctaggagagttccacgatcctcatagtgaacttgctacggaccccaaattcaagaacctaagggtgtgggagagggaacatgctatggtctaaaaggtttatttgtcgcgggggaaacttgtaatattacaaacactatacattctacgtaatttgatgtttataattgagctcggtcaatttttggctaatttataatatattatcccgtgcggtcaaattataccgaccgcacgggataatcgattatcccatgcggtcagccctcccgcacgcgaaaatatcgattttcccaaacgcggcgttgcaggcgggctgatccaccgcatggaaaaatgggtattgtaatagtgtagagaaaccatctttgacgggtcagctaaaatccacaataacctcggtttgtgtaggaatcaggactaaagaatatctttcgtcccggttcaaaaggtcaggggtactttttgatctttagtctaggttggtgttaccaagcgggactaaagatcatttttagttccagctcaaaacatggcaggcggtgttagaccccttcactatttttagttctggttggtaacaccaaccgggactaaagatctatttttaatcccgattgttaaacaaccgggactacaaatcggccccgagccacactctactcgtccgatcgcgtccttccttgatacttccaccttatctcctttctcctcctctcctcctataacgccccgatttacggtcgggattaaaaatcaattaataatgcatcttctagatattttagaaaagttaaagcaatttaatcaagtgaaataatgggaaaattaaaaatttcccttaaaaatcattgaccaagaatattttgtaatattctttgtgccctaatatactctccggatttttccgtgaattttcggagctcaggaattaattttaaaagcataaagttcatttaatcaatttaaatgaaaagaaaaacaaaataaaaactccccttcctccttgggctattttcggcccaagaatccttccccgcggccagcgcgcccctccctctctcgggctctctctctttccctcaacccagctccatgctcggccctctcctcccagaagtctagtttgcctccccagccggcctccctctcctctttggccgacagatgggacccatggaccccacctatcatccccaaccttaggtcggcaactgccgttgccaccatggccgctaaaaaccgcccacgtcgccgccattcctggcctcctcgagccctctctcgcgtgggaccggaagccacccctctcctccacctcctccctcgtttttccccaaaaaccggcgccgatttggcccccacgatcccacgatgcctcgccacttcactggccgttgccgccccactcggccacgattccccctccacgagtgtatataaacgatccccggagcatcctctctcgtttcccccatttcgcccgaacccactgcactcctcctcgctctccccacgctgctccgcgcgatgccgcccgccggcgagctccggctgcacgccgccgtcgccgtagccaccgccgcgccgcaccgttggttccttcggcttcgcctcgccgtgccgcaccccggcctccgctctgtttccccattccatcactgcagccatcctcccactgcgaacccgagccgccatcgccatccgccgcctccagccgcgcgctaccgccgctcccgccgctgccgtactgcgccgcatccaccgccggtttcgtcgccgcctcatccctcccattcaccatccggaaccatcctcccctaccgcggaagcccgagtctacactccactctccatagcagctccagtcgctcctcgccagtgagggggaccttgcccagccgtgctgctgccgctggcgcgttcgcagtgctcgcctgcacctcgtccgctgctcggtcgtcgtcttccgccgctcaaacccatccactaagttcgccggtgagctccacctcttgtcgtcgtcatcgtccttcatttccagtcaccccgcatcggctcctcccctccctaactccctcttctccttccgcaggtcaagggcaaccccgtccgccctccatcctcgcaagccgccatcgggcaatcgtcgtcgccatcatcatcctccgcgccggccgccgcttccagtgaggacctctcctccctccccctttttttcctgtccccctttcttgccggccgccgcctcttggggtgcgccgccatcctccgtgcgcaccgctgtcctctggccgcccgctgccgttccgcgtcgccgggtgctaccgccagtggccgcgtgccgccgccgcgccttggcttggccgggccggctttgtgccgcacccgtgcccctggccggcgctcccctcggccgcccgatcggcttgggccgatctgggtcgtccatgtggtggacgcgcacccgaggacacgtgtggacttggtccaccgtgcgccgcccctttgtgccgctgacgtgcggggctcgcgtgtcggcgtcggcctccccttgatgactcaacgcgtcccttgtcctttgagaaattaatcaatttaatgcgcaataaattcgttaataattctagaaattcatttaaacggttcagaacttctaaaatccatatcaaattcattcgaactccaaattgagccattcaacttgcaaaattcatctaaaattgggctctacatgtttgtttacttttattgtactgtttgcttggtctttattagagtttttcctcgttttgcgtgccagcgtgtagatttcactgtttcggaagttcgtggtcacgaggataagagtttggaagattgtttgaagaagcaaggcaagtcacacattccccttgagcatgttgatcccaatttataaatgttttattgtttgcaaataaatatgcaccgttttgctaattacatgggaatagggtttacctatctgcttgcttgtaccatattatttgatatctgtcctttgtcaactgtgggtgataattcgactagcttgtgtcacttatgttgatctagctagaactatatgcttaccatgcttaattatcactagctcagttgatgggataattgcagaattagaccttttagtatcattacgagctgcgtgctcgagacatatgaccatgtttcattggtcgtaactatccaactaaaatgcgactgaatggtgggctgtgggtgcatggttttgctggtcgcacccatggcaattaaggaccggttcgcgggatgcactggaagacatacagcgcttgccacaaccgggaatgggtaactacctgacttgaagtatagctttccgctggctgatgcatccaggcaagggtgagcgtgatggagttcggatgggccctgcgacggcctatgcggctttctgattcgcctaggcacgagaggggactgcctgttgcctgctgggggcaggggtgaaacctgaggtgtggtgtgcttggtcagagggggttatatgaagggtcttgtcacaattactcgacatggtgacgtgtctggcctggcacggtgacatgccgatggattgtgtcatgtgggtacagtagtgcacctctggccagagtaaaactattgaaatagccgtgcccgcggttatgggcgattgaccagattcaccgtgattagtctcacacttaataaatcgacccaatgcactgtagttcaggtgggatggttgggcctgttcaacgtggtgtagtgttgatcagtggagatttaatgttactctaattagtcaacagttttaccctttttctcaataaaatgttttacaaccgcctttatgcaaatagcaacaaactgtccttgtattcccttgcacgtctgcatcattggtgtggcttgctgagtacggtggttgtactcagttttgctattattttccccttttcagaagtgtagtgcttctgagctgaagacgaagttagaagaccaaggctcaaaccccagttgtgttttgcctgaggagtggagctgaagccccgctaggatcgcctttttccgctgctgctgctttcttttcggtgtgaggactaagagcctcttctgtaagtatttactctttatttacgtttggaactgtttattacttgtcttttgtgtaccctggctgattcctggacagggatttaatacacaaaatagtctggaaatttgggctaaatttctgggcgtgacacctcccgtcattcactcaccctcatctcctcctcccctctcctcctctcttctcctccggcctcctcccatcccctcccctcctccactccgctcccctcttcccctccggctcccttctggcgggcggcggcggcggtgtcgtggggacgacatgaggggcgcgagggcagcagtggcctcccctccgccggatccgggaggggaggcggccgtgcggtggcggcggtggcgccggggcggcccgaggggcgcgagggcggcggcggcctcccctccgcgggattcgggaggggaggcagccaggcggtggctgtggagttgattcgtagatttttttgtgaattgatttgtaatgaatgatttgtagttattttttattgatttgtgattgatttgtggattgtggatgggcatgtgttgtggatgattgtgtatgatttgttgatggttttgtggatgattatgtatgatttgtggggatttgggtgtgacggtgatagtcgaggtgcaaacagcataaaaacaatggaaataaaaagaaaaaaaatcttttactcccggttggtaggactaaagatactaaagattgatctttagtcccgaatatttgaaccgggactaaagatagcgatatttagtcccggattcgtatccccgatttgctatctgggactatagggggttgcaaactgggactaaaagggtttgtgcagcagtgtactggactcttcatctcgatctgtcacaaacgacgcaaaacacatactagatagctgaataaaaagggtgactgttaatagtgaaatttggtaagcccggagtagtcatcggcttagagtcagcatcggcttcgaagtcctgagattagccgatgagagttgtcaagtcgtcagttatcggattcttactatattcggttaaggaaattgatctacttaaggaggcttatgcagaagagactgagttcaaagagaatacggtatggcaagttatctattaattaggaatagtttgttagtttccttttaacttaggaaagtgtgtttagtgtcctataaggactttatcttttccttttatctttaggaaggtttctttcttgtccgacaaggacttgtatcaacccatgggtataaatatgtacacccggggtctatgtaatctatcgctacgattaatacaattcggcgcatcgccacccttttttacttctacttttgtttttacgttccgacggaacttggcacccgacgcggggctgcatcgtcttcgatctccagcgaagggataagtccaatgttccgccggtccaggcaattgtatcgtctacgtcggcgtcgttcaaggctgcatcaggacattcgacctcttggattactctggtttggataatatatttgcctggctatttatcatatgtctatgttaatctagtcctagcatctcaatttagctctatcagctgtctctcgctttagggtttatgtcggtatcggctaaatcgccttgctagattagattagcctaggcatctaccaccttgaaaatcagtcaacggcttgattgtctagatattatgtttcttttcacactcagcgctgcatcagttaagtttgatctactaagtcgtgcttagaaccataatctctagcctgcttcttgattgccaataagggtttcatcggggtttcagccggtgagttatctggatgttgcatcggctcataagaattgcatatacatataagttggatttatccgatgacaacaaaggtttcactgtttaatctaatcttgtggatttcatgacatcggaactccagccgatgtgtgctttaaccttcagatcgatgcttatttatcatatcattatttgccgattggtttatactggattatattgttattttattacatcatcatcaaccgattgtcttcatatcattatctacattagacatacaaccgattgtttaaaccctatcactatcggctggtatcggcatcggcatcggctattatcggctatcgactggaactattccatcggcttgtcagccgatcggctgttttgatctactatttgcatatcttgtcagttgtaggatcaaactgactggcacgccctcatctcactaagatttggacctgcacatgagcttagcaaatctcccaggccggtgtgttcattttttcgtcaacagtaacatatctgtaacttttttcatatcctatcttactgtaaagttatcccccactaactccttaagcttaacatgcaaagatgccacatcatcatccactaacaagatgccacatcatcatccactaacaatcatcacatttaaacatcatgcaaacatgctatatctttatagttttttataatttaagagcttttcaaatacaaacatgttaaattatcatccaacataattcacaattcacgtaatgtttcaatgtatatctttattatgttttatgatatcatatatatttatatagttcatcctcacttagttagtgcttaaatgattaatctatggtccaaattatctttctccttttttcctctaattaagtcatatcacatcaattgttttttgcctttagatgattaatctacggtccaaactatctccctactttttttttccataaagtcataccaccttactttttacgtatactatttaaatttaaattatcataaaccacattaatttacttaatttgatgttacctagctatcttacacgttattttttttattgttatcatactaaattcccgcagcaatacgcggggtttcaccttgtatattcaaatgacatgtcttgttttccctcatactagcaaatatatatatttcccccatatttatgctttgaaaatactcgcatattagatatcgctgtaaatgactcgagtagtcgggtctgacaaggggctttacattgtcaaattacaggatttgtgcagatcacccaactactaaataaacttggaatttttttgtctttaaccgacaaagattataatttgttaactagccaatctgaccgagagcaatcgctagataaaatcctataacgtctggataactcgaagagtttgtggtaatgaagatgacttattgctggtctggacaagagaaaatattagtttatgatgtcggacaaatacgcacgggtgcacaatttttattaggtgttttatatgcatttagtggcttacgtttaatgtctgtatgtggagctaaccgacgctgctcgacgactttaatgtttgctgataagtctattcgagtatttcagaaaaaaagaaagaataagcaaaacaacaacatcgagattctaatcacacaattagactgcttaagttctgaactttatacaaacactactaactactacaggattgattttcctggacactacctttttttccatgctgttcataactggaaccgcacagaaaaatagggggaccagcgtcgggttgtcgcccgcacggaaaaataagctgattttcctgtgcgaacctattaagagagccgcacgcgaaaatagtactctctcttttcccttctacccacttcaaaatttcccctttttccgcgcgcctcggtcccttctctctcttttatccggccccattgattctcctttcaaagtcttctctctttcctcactgcctcacgccaaagtcttctcagccgattctcctctcctcactcactgcctctcctcactacctctctgtggcggcggcggcccatggcgatggctgcgtggcgacagcgacgatggcgctttggtggcagcgcggcgacaacaatgatggtgtggcggtggaggcgcgggatccggcgagcagcggcggtggaggcggcgacagcgacgacggtgcggcggtggaggcgcgggatccgacgggcggcagcggtggcggcgcggcgacagcgacgaatgcacaggattcggagggcggcggccgtccccgcacggatccggcggccggccgccctcccccgccatggatctggcgcgggatctggctcccctcccctccccttccttccctccccagatccggcggaggggaggggcgtcggcggcggtgcgatcggaagggagcgtggatgggaggccggcgggaggtggcgccgacgacgatgaggtgggtgccgccgtcgatgacgaggaggaggcggtggacgggtgctgcggcgccgatctaaggttttcatttttttttgaaattttattttattgttcggatttttgtttttcagtgcgggcgacataagcacccgcatgtgaaaatcgctgttttcccagacaccttggggcgtgcgggccgtccatccgcatgcaaaaatcgtttgacccgcacgagaaaatgggtactgtagtagtgaaattttagacaccgaacacatgattttcccgtctgatgatacgatttagttgtcggccttaactttattatcggctaactatgtcgactatgccgactaagttttaagttttatattttgagaactctgactcatgtgatataaatatggtcaacataatccctccgtcccataaaaaaactaacatagtactgtatgtgacacattgtagtactagtagtactacgaatctgcatatacatcacatcagttctagattcactttttttttttacgcagggagtatgtttgaatagagtttaattaggagctattgtcagtgttccaaaaataggataccctatggatctgtgcttatcacagcggttgtaccatataaaatgtcctatatgaaaataaacattatagatatggataaaaatctgaaggggataaggaataaaccccaaatatgaaaaaaaaacacagatcagttctacttaagcccaactaggactacccgtttcgtactgtacatatctccctaattatacgtggacaagggggaatcgagagtataactgaaaatcccttgtgtgcccatgaaaacttacctaatctctttaataccccctcaattttacttgatctctttgtacccctgaattttcgctttgatcccctccgtacccctcccgttagatttccgtttcatctgtaacgtattctatgagcaacattgtcagtattttcaaaaaataccaaaatggcaggctatgagctacattgtcagtattttcaaaaaataccaaaatgccctgccagtgccaaccctaactaaacagatccaatccccttctcttctcccccatcctctccacgcgagcggctaccgtgcaccgccagtctccaatcgtgcaggtggtgcctttgccatcccaccgccctctcgtcgcgcacgccgctggccgccgccctccatcgcacggtggagcaccgccggctatagacccgctgcatctctaaccgcccccggctctgctcgtacgccaccaggttggcgagcatggcgtggttggcatagttctccacggtggggatctccatcacgccgtcgcgctggctgaacgtgacgtcgacgaggctgcacggcaaccccttggcgtggaacgtcaccccggcatcctgcagctccgtcgccgacggcatctgccatgccacccgctcgtggatcggcttcgccagccactcgtcccagtacgcctcgtcctcctcctcccccttgccgctcacgccgccgctgttgctcgtcctgtgctccggtggaaagaaccaatggtagtagaggtcgagaaggtggagatttaattgagatatgcataattttcgatttggaagcttcggttatcaccgtcctgtcgctcgtcctgtcctccggccgccggcaacattttccaattctttaccaatctacctactgttgctcctccatctacaagggcattatagacatttgtaaccacacataactacaaaataaagaaaacctaacgggaggggcataaaagggatcaaagcaaaaattcggggtacagaggggatcgagtaaaattggagggtatagaagagattgggcatgttttcatgggtacacaagggattaactcagagtataaattcaaggcttctcacgaggagggatgacattgatggcagactcgattaaggttatctcctgatactttgtactcccttcataaaaaaaactcaattatgggtttcaaaggcgtgtgtacaggttcaaacatagaattggattttttttgacggagggagtacatatgagattgatatatgaaaaagtgttttcatccctcgaggggatattcccttgtttcgtgcatgtcacataaatatttataaaaaaatgaaaaaaaaatcacaagatagattaatatgaaatgtatcactccacaaacatgcatgttaaaaatcaacttccacaaattataacaaaaataacaaatataactgcgaatgtacgataactactttcagtctaatttgttcttttttgttgtaacttatagaaatcaaattttgcgagtggtatatttcatattaatctatgttgttattttttttcaatttttttataactatttagatgacatgcaagcgatgaggggatatcctctcgaggaatgaaaatccacatcttgatatacacaatgacaacactggccttcgctcaaaatgaatagggctattacccatctcggtggccttaacctatataaataaaccatgtccctcttattcttcttactgcttcatttttatcctcacattagtcgatctctgtgtcctcaaatacattacatatgtacggaacctacggtcaggatgttaccggtataactagttgaagaaacagaatatgcacaaatataatttttgtacttatccgattcgatcagttaaataacatacccagaaatttacaaaactattcatttatttgcaccaataatcacattcctgatggaatgtttccatttgtaaaggcaatctattactttttacccacaagagcctgattgacttacgttggtgcggccatcgcacataaatgattggcttttgctaaagtcacaccaaacttctccgtcatatcaattctatttccttctacctcagctgggagtctccatttaaaatgaattaacagggatgcaagaagtacatgcaccatcctaacagctaatggcattccagggcagattcgtcgtcccgcaccaaatgggatgagctccaaatctccacctttgtagtcaattgtcctttctaggaatctctccggaataaactttcccgcttctggccatatatcttcgtctcgacccatggcccacacgtttattaacactctagtacctttaggtattgtataacccattatttggatcgtcctcgtagcttgccgtggtaataataacggagctggtgaatgcagtcgaaatgtttcttttatgacagcttgcaaatagggcaattgaccaatttcagattcttcaattcttcttcttgacccaacaactcgtcttagctcatcgcatagtttagccattgatattgggttctgtagcaattcggccattgcccattctactgtgctagaacttgtgtcactacctgcagtaaacaagtcctacaatacaaagatatacaatgaaatggtaacggaaattaatagtacaccaataactgtggaagagcatccacataccacatttttatgtttaaaagttatatatatatatatatatatatatatatatatatatatatatatatatatatatatatatatatatatatatatatatcttgtcgtaattagtaactatttgtaacgagagccatatggggcatcatggtgcctgggcaccgatggttgaaatacacaaattgactcaaattgatttttaacttatgactataaacccaggtgtaacaattatattcatacctacacggctacacctaacaacaaattgactcaaattgacattatttcacaattcattaagttatatgtttggatggtacagaatcaaaatctaacaaagaaaaatgttcaatttagtttaaacttgactataaacaagttaatttcatacctaaaagtttttgaaattttggacccccaaaattttcgtaattttattcttttgtgattttgttcaaaatatgttaaattcagtcaaattttgtttaagttataagtagttccgtatcaaatttttttgaaatttctgaaattttggcttttacgaaatagcggtttgtatgcgattgaaagcaacatatttttggtttttttatcgaggagatccaatcagggttcactttatcggttaggccgatcgtgtcggaggtcaccgaaatcccaaaatttcggtccgaaatttccaaaattttgaacaaatatgaccaaaattcatgaacaaattgaaaaattgaaaaattttggccaaagtaatatcatttcggaggggaccgaaattcggaaatttcggtccgaaatttccaaccttggatccaatcatgcatgtcacagtaaaaataaaatcaacccatagccccccggcactgcacaagttgtaaacggaaaatgaaaatgactggaactgaaaacgatggttgttttccttgtatttttttcctttttttatacttttttattttttagttttattaatagacctttacgaaaatatttccgaaaactgaattcttttaccatgctaggcacggtggcgctgcaagatgttgttatggcgcatgaggtgacaaagtgatttgactacatcagacgggttgacgtggccaaaagatttagatttagaaatacagttctattaataaaattttaaaataaaaaattctaaaaataaaaaaaattcgttatccttaccgtgaacagtgaccggagcgtgtcgccgtcgagcctcgccgtgtcgtcgtcccgcgcggcgagcctcaggagcacctccaggaagtcgccgtccttctccttcattccgtgcagcctgcgatggtccatctcggcgtcgaacagccggtgcagccgcgcaaacagcccagacagccgccggcgccagccctgcaggtcgacggcggcgagcgcggggaagaagtccgacaggttcgggctgccgactgcctccatgacgtccgtgatcagtcgctggaactccttcgacgcgccgtggtcgtcgaggctcgtcaggtcgtgcgagaagatggtgcgcgcgacgaggttcaggctcgtggtgaacgccacgcggccgatgtccaccgccgtgccgtcgcgcgccagacccgccacgtggtcgacgagctccgccaccttctcttgccggagctcgtggagcgcgtcgagccggcgcgtggagaacagctccgtcgccatgatcttgcggagctcgcgccaccgcggcccggggggcagccaggcgacggagttcctggcgtggtcaccggtggcgtcgggggttgaacgggtggcgaagacggcgtcgtgcttctgcaggaactcg

SEQ ID NO: 65656 - DNA, 2007 bp, Oryza sativa
agaaggaacgaaaaacagaaaaatctggatggttaatattttaccgggcctattgatgaagcacaaaagaaaaaagaaatacgaaaggtgggtggtaaaaaacgaaaaaaataaaccgagaaaagatgggatacggaggaaaggcatgggtggtaaaaaagggaaaaccggacggagagggcgttgtggagcgctcgaactaatattccgcgttgtagcgtgcggattagcactactgtaaaaacatattcattattaattattattaacataaacaatatataaatatatttaatagatggagaggccatagtcgtgtgacacgacttatgttgctagttggtctgaagctaggagccggtatcaggcataatagcaccagtcacaagggagagagagaatcattggacccatctgtcagacaacacaatatctgattctcctttgcaattcaatacagctaggcccaccatatggagcctatgctgggttctattatggcatgtacaatggagaccacatgtactagtggtctcatgataccacataggatagaaccacataaaagtcacactacctacagtggaaaccactccaaaatatattttgcattttagttcctatctatttgtgtatcttagtatcaaatctattaaaacttaataatttggtccgtataacaaccaaaagaagtatatatgcacccctcaacaccatgcggacccactatcagcctgtccctgtccactcccttttttattctctctctccctgtccctcccgagccttctcgtcttcttcctctccatagagaccgtcggcactctccttctcccagtccaccccgccgacgagacccctcccctaccccgtgagctcgccgatgagacccgttccctcctgtcgtccccggttttaaaacacgggagaccacttgtgttaacaatactaaatccctagatcaataggttggcatacacacaatatgttactggtacagtgtcgtctgcagcgtattggattacaatacttaatattacaagggatgtccgagtggatccccaaataggccatgaggccgatacattaccaacatagaagcatagagtagggtagcagaagcgaggccgcgatggtatggctttattcccacaggcaatgattgggaattagtccctacggcatcaccacgtgttcttcttcggggagggtcttagtcgggtcatccacaaaatcagagtctagaaagtgatgtaaagcaagagtgagcacagaagtactcaaagacatcactacaagattcctaacttttaccaagggtgtttaaaccgtcggccacctattaaaactgtcggccatacatattactgagtgtcaactgtcggcaacttcccctcagccacatgtggtcggtaattgatcatattgctgagggtaccctcggtaactatgtacccgagggtttacggtcggtccttttttcagagaccacgcatggttctttcttgccgaccacatttcccgagcgtataccatcggttattcattgagtgacagtataatataccgtcggccttattctcacagagaggtttattttcccgtcaaattgtgattaccctcggcaatttagtaacaaatggttctacaagccttcggaaatagtatttgccataggtttttatataccgtcatccattcattaccctcggaaatagtattgccgagagattatttaggttacttgaaaaagaaaatcaaaccctcggtgatttgatattttctaaaaaaatgcaaatttaaattgtacccatttttaattaatcttataaaagtaacttactgcacatagtcacatcaaaacaaatttcagcttaattaatccataaacagatccacgggaagttcaaccatagatatataaccaaattgttcaaaaatatttatcatccatcaccatagcaaaactaagtaattcctgacatgtcttgcatgaaagactttaat

SEQ ID NO: 65657 - DNA, 1477 bp, Oryza sativa
cctaaccacatttattgcggtttggctgagcgtgtcacgccgcatgtaacgcagtgcagtgcactcgtttatccggtctgtgaccagtcacagaccggtcagatcgcgggttaggtggcgataggcgatctgacacacgcctcgccccatcccgtcaggacgagggcttctaggcgctcgtccccagctggagctagcgtgttacctcccagagatggcacgttagtactggtcagatatatgccaggcttcatcctaaccattacaggcaagatattgtatgaagaagggcgaacatgcagatggataaactgacgcgtggtggacaagaatgaccgatttgtgaccggtctgacactggtcatgtcgtcagcagacagccatgttcccacgtcgcgcctgcttccggcggaagtggaggtaggtatgggccgtcccattagaaggtcattcggacggcaaccatacaagtctccatctgtttatgaaaaggtggggtaagtccccacaaaaaagagagaaatggtgcatgtggtatccccttaagatataaaaggaggaccttgcccactgagatggaggactggacttttccagattagaaacccaggacaagggagaggctggctgatactttgtagctccttcatacacagatctcccaaaacacaggagtagggtattacgcttctcagcggcctgaacctgtatacatcgcccgtgtcttgtgtgtttcctgtctcgcgagccttccacatacagagagcttagaatctctcccggagtccccggccgaaccggtaaaggggggcctgcgcggtctcccggtgaggagccccacgctccgtcatacttcataattgttggactgtcctaaccgttgccttgacaaccaacatcaccgctgccgcacaaaatcaccatgaggagaatgtggattggggactcaagtagaagatggtggaggggaacagggagaaatggagctgggagaaagaggaggacgccggagctgctgctccactcctccggcttggagtgatggagtctcttcaccagccgccactagggggagaggacagggaggataaagagtgggttagggtttttttgtgtgagatttgctcttttatactagggaagatacttgagggctgttttggaccatgggctgggctgaaaattcaaattgggccgaatttttttggccggtttagtgttgtctcgggctggaccgaaatgggcgaatttcaccgaatttcggcccactcggtccgtatcccagaaccctgtccgaggtagctcagttttgtcctgtggtggaagcccggattcggccacaggagcaaattaaaggaagaagatagatctaactattggagtagaggaaaagaatggacggtaggcttgttgcaattcattgtattatattggtgcactttgttgttttcgtgtgttccgtctttttctaattgga

SEQ ID NO: 65658 - DNA, 19331 bp, Oryza sativa
ggcatgcaagctttgatcttctcatatgcaggaaactgaatagcaacatgactgataccagccaaggcagggacaagtccactttataaaaaagaaaaagaaaaatatcagccagcgcacaaaacatattatcatcaaacggtgtaaaatcttgcatctgtggacttccatggaaagctacctgtacagtccacgaatgccttcttcatgtgctattctcttcaaagcagcaagtgtacctttgtacgggatcaccccagctcgtatcccttgggtctacaaaagggaaaaggatacagatgatgatatgactcaaaataaaatctttgaatcaatttgtctgagtatagcatgtagatgttgactgcttagtatggacaggtaaaagatctaaaagaaattcagcatatttataagtgattataattaatgatagctccattccaaatgggcattcagcctgtgtaaagaccatcagtcaacattaggaaagaaatgggaattgcttacaggttttaaacacttgcctaatataggccagacaaaatatttggtatgcagcattttgaaattgcaattatgctatcaggcgtcttggatcgactactggtccagacaagttgtggtccaaggatacctgaaatcttgtcttcacaacccaaagtggatttgttgcaatagtagttgcacctccagcacatgatgcagcaataacatttgcccctaaggacaggtgatgacttctatctgcaaaatgaatgtacgataccacataagaactgacaaatgatatgctgtcaagtaagtcatatgcagggtaaaacactaaccattggaagaaagcaagcttttaagctgctcatacacagtaaaatagacctggaaatccacaaggatactattagctccacaatagatcatagacacttgattcatctatagtgtagtgtactactctactcggtgccatacatgggtttgcatgcagatcaacttatagcattatcattagcatcgttgctttttacatagaatttaaaaacatctcatcaatggagtaagtggagctataatgtaagggtaaagactaaccgcccagttaggcaagagtgccagaatagttggagataaaccacgatacattccccgaaaaccttccctctgagcaatctgttgtaagcttccaattattacactacctagtaatgatagaacaaagaactgatgtaataaaccttagcttctgaagaatcttggtatagtagaaaacaatttagtccagacataagcatttcagaaaatatgctactcatcaaacttctattgacaaagatgcaaattcaacagtaaaaagtacgaagtaagtgcattatcaatgcaccaatgctgttggccacgtacataggatgacctgctggcattcttcagagcataacgggccacacatatgccagcatccatgaatgcagctaaaacattttttgaattcaaagcatgtacgtcagctgatgttccaggcaatttaggttcagcaaatgtgtaccaataacatcagaaatccaggcttggaagtattacccacactatactacacccatggacatcacaaagtctgttggcttttttcacatgttcatgtatgctaatgcttttatcatacatcaacgaattcatgcaacagcaaatagcacgctgcatgctttccttccattctcaatgtgcacgatctcataagttcccaacaattccgctcaacacatgtgaagctcccagccccactttgattggaggtactgatagattcaaggtgcgcaaaacaacaacgagagaccaatcaaaagcctcagataacagaaccgtccaaacaagcaatccgaaaccgttacgacatctaaaagcagagagcagatctttcgttgccgacaagtattttctcaactccctgaatcctggaagtgtccgagtaaagctacacaaagagaaaggcacaaaatctgcaccggtttaccatcattcccctgcatgcatgatgcatccactgtatattctgaccactatatgcactgactttaagtgctcaaactcctatgtgctcaccatgcttcatcaagcataggatagaaattgcagtctataatagatttatgtgcagctctagctctgcagcagcaaactgtagcaagcaaagattcgcaagaattcctctgaagagacacgcacctccaattgtgccggtggcgagcttgggccagccgtgcacctgaaacctcgtcttgatcacatcgagcgggcacacgaaggtcgccgcaaccacacctgcggacaagccccaaaaattcaacgcttgctccacatgggcatccccgaaacacacaaattgacccaaaaaaatggataagatagctcgagcggtcatgtgttaccagcggaggcgccggcggcggcgtggcagagcaggccgcgggcggaggtggcgtggtggctctgctgcgaagacgcggacggcggcgccggcgccggcgaggtcgccacgtcccccggcatcactcccccacacacacaccgatctgctcctcccctccctcagggcacggaaccgcgcgccgccgcgtctagggctacagccaccgctaccctcccctacccctaggagaaggtgaagcccgggggcgctacgcgagggcgcccgatcgcatccgcctccggggggtcgcccgcgacgtccgtggcgcgctcgtcgcggcagcaggaggcggcgaggcgggggcggaggcggaggctagggttaggggtggggatctgaggcggcgggaggcgcgcgcattggggtcgcggcggtggcggtggcggcttcctcgcctcggctgctccgtttttccgtcgtcacgacatcctcgcctcgcctcacctcacctgcccttctctcttctctctcatatgcttctcctcctcctcctcggggaggcgtggggcccacgtggggcgtccccctctcactgacggtgggaccgggaatgattccgagggtccacgtgtcagtggggttgggtgaagactttctcgcccgtcgtgcacgtgcggcgcggcggctcacgtgcggggccccgatgtcagccacaagcgtggacccgagcggattcgtggtcaccagccaaggccgtggggcccacgagtcattgacacgtagtcctcgtttacgtgtacgtgtagaactttaccagcttattagttaggccacatgtttttgactcaacgaaccccgtcacccgaccacgtcactgtcaggtgggaccaccgcgcggtgggtccccggtgtcatcgatggcgggacgtgggggcccacggcggtgtctggtcgccgcttaccacccggggggtgacgtggtggaacggcagccgtgcatcggggacgaggcggaatcgaccggacggcccagatgggctcgcggggaccattttttatttttcttttcctcgtttcgttttctttcgctatccacagcgagcgagagaggaaaagataagcttgcaagaattatgttgctttgtttcgccatggtgcggcttgtactgatctctcccccttctctcgatttgtggggacagattggaaaatcggacataatatataggtagattgtccaagtacttgaaaatagctcaaaattttgtcttgtttgtactacccaagtgcctaagtagttggtacacgtacgtgactcttatcaatgactttggttcgtaaacataggtatttggcaaaatttggtacatgagtacatgacatcatgacttcgatatcttcaccgtacgacattacacaagtgactttagaaaaaaacactataaaggtgatttatgattaaataggggagaggaacaatgtgaaagttgtgaactattgtttctctcccatcaaattagaaatcaatattttaataggtacggcatccatgagttaatttttacgtttgtagagtattttcttccaaaagctacttttgtacgatgttctacagctaaaaccgctaagtcacaacattctttattaaatttttccttattatttttatcattgctctgtgtttttatcctgaatgtttcttgccattttttttctttttgttgttatatggcataagtactcccttcggtcaactttattttattttatgtatcatttgttaaatatagataaaatggaagtcgatccaagtggatttattggaccgtagtaagccaaaaattgaatttacaacttaattttcaagttaattttttatattatagtttattttatagtatttgcttttgtatcgctaatgagtaaggacacttatataaatattttacccatatttttttctaatcctttataacccactaactcctaaagcttaacatgcaaaggtgccacatcatcatccactaacaattaatacatttaatatcatgtaaacatactatattatctaatttaaaatttattacattttagagcttttaaaatgaaagcatgttaaatcatcatcccacataattcacataatatttcaatatatattttcattattttttataatatcttatatacctatacaagttcatcctcacttggttaatattatttctctcttctctaaataagccatatcacataaattgattttagtgcttatgtaagtttatattgtttagctatattacatattatttttacttattattatcatattgaagtcccgcagtaacgcgcggggtttcacctagtaaacatactaattagtataaataaaagcgaaaagatgagattgtaagaagttgataagttattagcttgtatttgtattcgtaaattagagtggatctaatttatggttttgacgttacgttttaacaacttatacgttattaaaataaaatgaaaattacttaaaaaatcaaatgcggtactacatctaaccggcacgaaataagtgaacccaacatgaacacgtaccctaaacctcaaataacaggccaagaaacaaggtaaaccatcattagctacatttaagataacccctctaattacaagttattaccatccacacgaaaccgtatgaaatacatagaaataactatttggataaaccgtaggaaaaacacataaactggaaattcctacaatgttaaaactcttgataatttttctccaaaatctacattgagcaaatttataaggaattctatagaatttgggaagatccatttctttatttcaaatggtcaaataggaaatattcttacagaattagaaccctaaaaaaaattctgcacaaatccttttgttgacaccttcgaaacagacacgcaatagcctcttatctgtaaagaaagagttgactgtccagattagaattggctgtccaattcgatcccccaacaaacagaaaccaccctatccatccagccagagggaagatctggtcggccaagaaccgaatccagtgctatcaagtatcaacacaagattgctacagccaaccacgaattgattcccgaatgcaaagtaattatcaggaaagagtgacagcaacccaggagatcgaaagggagaatgatcgcctttaattcctaataattcttcagtttttctgtctcgccttttttagatctctgttgatggtgctggtaatgccacgtacgagcaaaagatgaaagcatagttaggaagtaataattctgtataattatatgtacctatcacgaataatgagagaacttgcccttttaaagcttagatcacttgaaaaaaagtaatgttgagaactctggattactttgtgccttactggacttgctggacttgtgggaatctactgtactgccacaactatatggaatacgagaaattttttttaaaaaaaaagttcctacattcccgtaaatgaaggaaatgaattcccttgagcaaaggtaggattcacgttcatctaaatacaaacattctagtgttagttcatgaaatttcaatcgtctccaactggcacattggcacatttctatcatgcttcctgataataaagtccattgccaccaaaaagatgcatgcctgaactgtcataggctcatagctcctaattagcgataacacaacatggaagaaatctgagcatataatatttacagatggcagcaacagctgctgagatcatgtaagatgtgagaaagatatgaacagattgattcttaacttcttcctggctaacactttagcaagatactacgtccacagtcaactttgatcagcccttaattttagaagcgtaatgtactccgtgaattcttcacccgagaaacctgcaacgatggttaaaatgtcacatgatgttcaggattagcatataaacatggcagtttgatactttgatgtttttagattgcacttacaatatgggacttccattccactttgcatccctcggtgacaccaaactgaggctgtcccttgacgtgatggaatatatgaacaaggaccacagcatcaagggcagcatactctttctgcaaaaggaggaagaatctctctgttttagggatggcgctttttgtcctcgatgaacagtaggctatcaaactaactcgtggctttagattgcaagatgaagcatgtttgacttagttttaactaatggtgtttaccaagataagcttagcacaagatctgatagaaaatttgcttgtacatgagaataaggagaggcatcttaaggtgatgttaaaaatgtggtaatcgacaggctcatttctaaagtaaatttctttttctacttttttcatacaaacacctgtcatggttagaaaagtattgtgaaaataaattcagaatgagactgaaaaaaaaaactcacaatacaaaattatgagaaattaattaatcactcataccaacaaatagggcctttcaaggaataaggactcgtgaggacagcttttaaggaatatgaaagatgacagacctgattctgggtgagagggcgctgttcccagttgctattccgtcgcgtcttgttcaaaccagctcctaatattttctgatacattccgtgataaataaagatggaggaccagatgattcacactaaactataagcttaaaaaaaatcaaaactggttcaacgtccagttaagtggagcctataccgctatagcaattaccttggacagcccagatagaccaccagtagtccctttgaagagcttctggatatcaagcagcatttcataggactggaaacatttcaattctccatatgattgtgatagttgatgcagatcacattgcagattatatcctttggtttacaatggggcaaaaataagtacttgtttaacaggatgcataagaaagaaatgttgttttcaggaaaacaagagtgtatgggaagatatgggttttttaatcaaaatagtacgctacctagctttagtatgtttgaagaacacataattcgcctgaagcagctatccaacacttttgggtcatcttcatacagcttgatcagatcaaaaataaaagctttcttatctgacgcaatttggataatagagacctaaccatagagcaaaattcaattaatgcaagaactgacatagatagataaaatgcagaatttctgaaagaggaacaagtaaaaaatatcatgggaacttaaggataagatagtcgttccaaaacaataaacactgtaaagaaaatatcactgagatgatcacaaggccatagcttactacacagggagtgatatggataactgaatactagaactactaaattgcttaaatgatacctaatacaatttatttatcctattttatccagtgatgccttttgaggaagaacagggggagattttcattcagcctgctgtatcgccacaataatgcaacatatgattaccatacattaggaaaaatgattataattgtaccagaaaactaagttaaacatggaaactgacagaaatttaaattaagacatcgcttaccttattaggtttgctacctttctcaaaattaggcttccattcacaatccacaccaataattttacaagcttcaatataacttattgaattaagaagtccatcaatctcatcaacccagataatgtcttccaaaatcagttctttaagatctaagtagtcagacccacaacaaatctcctctggaactgctcatacacaattaatataggggatcaacagtagaaatggagttgatgggataaagtcaattacaacgtatcaagagtacagataaaattcaatgaatgtatcataaagctgtgtttcatatatcataattttgcattaacccatcctgcattctccctccctccctccctctcacgcgtccatgatttttgcattggtaaaaatgttagtctttaaaataccttgttcctaattacagctcttcctatgtaagttaaatttggaacgtcggatgcatgtagtaaacctttccattataatgtttttctagtaattctatatcagcaacccagatttcaaagttccagctgaaagtaatcaacttaatcattctagtgggttgtaataaccaaaaggaatgtcagcagggtggctatttaaaagttaatgcaaacgtaaaggagatagtttctacagcaggttgaaaataaatagctagaaaattaaaagaatacacacctgcaggactacagatattaatgtatgataaataacgttggtgtttatgattacccaaagaattgacatagccttcaagagagtatctttggcaaagttcttcaactttctccatgtacccagcttccatagctaggtatacctgcacaaggtaacaaagtcatgagtaaagcaattatattttactagatggcaacccgcgcgttgcggcgggataatggtgtgtgcaatacgattataaaaagtctatatattaatatgagagagattgttagttgatatgaaccgtaaaagcaccatctgatgataagatgacaaatggcatgacctgccttctttaagcaataataactacactatgtgggataatcaatattaagttatctaggaactaatgagaagtaaatgtaactattttaatatatcttggatgattgtgatgaagcatgggaataatccaatggctcttattttgtcagttatgtggctcaatgcatgttaagcttttggtgccaactatataggatatatagattttatacacaaggatgccagcaaaaaataaataaatatgaacactatgaaatagatgacagcatggcttcacaataacgaccatcaatccacatgtaacaaaagcaatacatcctagccatttcatccgatgaacaaagatagaggcatataggaaactgtgtctcgagtgaatccatcttccattgcagcagatactttcatgatgacatgtacaaacaacaaacatgtctaaaagatgactctgacaatgtggatgcatattaccaggtattccatcaattttgtttccttcttggcccgaacctctgcaatatcccagcaccctttctcagccagcttcttcagtacactgcaaatacaatataattcagagatctataagattagtaaacattatagtagaaatattttgcaatttgcattgagcaaaacaaaagttacctctctttatacaaatagttaacatctgggaacttttctgtaaggtcatgttgttttaccaactcatttgccctctttagcatttttatatccagatacgtttggatgatcaaacatatcatttcattccccatgaaaactgcccacttctctgctgcctccaagtgattattttcaatcagttttgtaagaaaggactcatcataacattgaatagaaaatcgtgttatcaggttcacagcggtcacataagattctgattccattaagcattgtacatactgtttgagatgttcttttgctttcactagatcttcatcacccaactctgaaccatataatgcatcagccatatctctcaactcgatatcatatgcctcgagaagctttatcagtatgcgttcctcatggggcacaatagaagcaacaatatcaagaataagtcgcgcagcaagatgctttgcatctaagaaatctttctgtacagattccacagatttcaaatgccttagagaagagatcaacatatggctgaagccttcagcatgggttttccccagcagtggcacaatatacatgcattgaacaacatacgtgaatgggcctggctgaggatcattatttaatacccttttaacctgcagctgaaggatcttgaactttggggttgctttgtcagttcctgatttttcaaaaaagattgtaaaacatcagagtatggacaattaataagtgcataagatcaaggatgaaattgatatcgaaaacaaataaaataaaataataaagcaagcttgtagcaaattcatagcagagagttggttatgcaaaaagtttgaagacccaaggaattcaagagcctgcattttgcattaaccgaatttgaaaatcatatttgatgatatttacctcaaccaaggttccatacaaactactatggatttaacctgtaattattactatgtaggtaactttatttattttcctatcacgtgtttatttctgggaagattgtgtgacagcattttcatatcataatcaagcagaattagttgcaccgaagcttacagaaagaaatattttagcacaccaatcatgtagatattaaattataacagtgccacatagatgatactacctctttcttaataactgacaattttgactttcccaattaaactttgacaattaattgcccttaaattgttagaccaaagtgaacgaaagttttgatttagggcaaaccccactttagtaacatggtatcatttctaggtttgtaaatattcaacaaaaaatatgagtatcagttattatgaaacggaaggagtagttttcgaatagcatgaaaaagaactaggtataccatataggtagcagtccttcaaaagatacataaaagtagctgcagaaacatgtgacaagtcagaaaatgagtgtaagcacagggagcgctcttcattgcattgattgaattcagagtcttcctgagtctgtgtctttgaacaacccatacttcataaaatcatcccaacctgcgtatgagaacatatattccacattaaatcataaattgaacctctccaccaaaacaaataatctgagacagctccatatcgtcataaacgatgggaaactaactatttagttctgctcagtggaggttgctgagtttgcgaatacaaaactacgattctgctagagaatttatatacatctatcaagctgacatttcttctcactccaggaattcctaacaagctgaagtagtatttgttttcgcaagatataaaacattaacaccatcagattatccattctagcacctcagactatatatatggcatatgctaatggagacaacaatgctacagcaatacttccacaaaatctctgtaacactagtctgaacgaactaacaacaattgatattgtttcccccaccctctccgcctccagaacatcaaagatcaagaacaagatacaacactttggacaggcaaaagggagattgaaatgctcacacatttcctccattcatcccaaaaccgatcgccagaggggattttttttctctgttttttttggtttttcttttcgaaaaaaaaaatcccccaccctaaatcaagctctcactactgagattggggaggcgaggctcccgtcgccgcaactcgccaaccacagacagaagaagcaacgacgaaaatggagatgagacgaaacgaagcaagaagacgagcgcgatacctgccttccacacggggattccggccaactcctcctcctcctcctcgactcttggtctcttgcttctagggttcgcggtcttctaggaagttggggctcgatacttggaagcgcaagaatggaaaattttcgcggacgaaagacaggggtttcgtttcacggaccacgacggctgccgcaggtgaccagaaaacaccactcgtcggcggcggcggcggcggccgctgtactccttcagttttcggccttctcggccttttttttggggggcctgcttgacctttttgggcctttttcgggtacatgcaacaggaccagcttcttttcttccacccttcttcttcttaaaaaagaatatatttaaccgtgaaattttccccagtactccctccttcccataaaaaaaccaatactggatgtgacacattctaatatgtccatattcgtttttctttcgggacggagagagtaccttctatagatcgctttccttctgtacctctgaatttaaatttgatctttatggttagttgaccatgagttgactattaaaatttccatcaaaaagtctattttacccattggtatgaaaaagcatatagatttgtggagcgtattgttggatttaaaaaaactattgtatgagtttataggtttgttatgcggaatttatttatgacaggttttatgtttagatgacataaattattattatttatttaaaataattgtttgtgtagatttgtcttataagacaaatacgttgaaactactatcaacaaaaatatgctacatgtacattttttaataattaaaaaataaatattgatttttttgtcatgcatgaaataaattttgtcgtaaataatatctcgcatgacaaactcataaatataaaagtttcatacagtaaatttctatactccaataatataaataattacatgtttcttcgtactaaatggcaaaatagacttttttataagaatttaatgatcaactaacaatcaaccaacagaaaaggtatggaagggatcgaagcaaaaagtctagggtatgcaagagaatgaataaaactcagcagcataaaaggacttgggcaacttttaaggggtatgtaggtgtcaagggagtgattccttggacaacgaggagtggagacccctcccccccaagtgggaagattcaaccaaggggtttgtggtgcaatacttagaaaaagattcaagcaagatcggatctgtggggcccaagctccccgccatgcaaaagacacatgaattatacaggttcaggctatccggaggtgtaataccctactcatgtgttggtttcgttgtcttccctagatcagctgcttacaaaggaggctttttcaggctgcaaaatgaattataccgatctaaagagtccagccctccatctgtagcttgtccccttcattttatagtccaagtaggggctcacattattacaaatatactccttgtcttgtcttatcagctatcttgtcgttgtcggctggtttcctaacacatcttcaagaaaaccctattgagatttgaaatctgcattaccccgtgtacccgggcttctgtccgagacagctgggtcgcgccagctatcccaacacatggcgagtggtgggcttggtggaacccgggctgtctgaaacaatgccacagcctcgcttctgcccgtttggcttaatcaggtggtgcagggcatgttcgacacgcatccaaggtgccaccggcaccaatgactcaacactggtgtcttgtctacatcctttcaactccatgctggctggggctccccataaatctgtttcatttatggcggagaggaccgcttcacaatagcccgtggagcgtgtccatctccccagctggtcgtgaggtcgcacctgcgcgctttttgtgatgatagttcatctattcttaggcatgcttctcgaaaatgtctttgatgagtcgataatgtagttattttacatgtttcgacgctcttttttgcagaagaatgcggaaactatagggactagggcgtgcctggatcccaaggcgaggaatggaccgaggcagaccttgagctacatacttatcccgtaaacaattgaaggtgggcccgggacccaccaaagtgggacccctagccgcatcaaactgggtgtggctttttatttttaaggatggtttaagcatgtcatttattttatttataattgttctgtcagggaaatgggtaccctggttgccattttaccgacagtagggaatttacttttctttctttctttttccctcttcctgttattttttgaaggggggaaaacagagagcaaatctcattgtgtaagtgttcttgcaggaatggtggtgcttgttagcttgtagccatgcgcatccctcctatcatcatccaggaagattgttttaagatccacgaacaaaagagattttgtaatcaattaatatcatgctaagctctactcactttgtgccacgaaagacaaatctaggactggatgtgagatattctattacaacaaatttggaagtacaacgaatttatctttaaattcgttgtactagaatatgtcacatccagttctagatttgtttttctttgagacggaggaagtaattccgtaagaataggggatatcatataacctctagggaccaataagggtcacaaaatccacttcaaaatagcactcacatgtcccgtgatgaagggctttagatttggggagttttagattataataagcaaccggtgggaattcaaccaatgagaatctagagaagtttgaaaaaccgattttagtttacttattggattttgcactacagcctcttagaatatgtaagaaaaactggattgtttggggggacttgtctattctgtgagaagtcgtagttatcaaagctcccccaaatgattctgaaacataagccataattcatgtgtagttgtgtacaaagccaatggctgcagttgtaccaccagcacacgagggcatgttgaatgtgcttgggggaatattatcccaatcatctgaagcatacattttaatattaaccgttcgttcatcttatcccatttcatcccaaccatccattcgtcttctttttttattcccgcccttaataatccatataagttccaaaacatcctctgagataaaataaagagtgaattccactttggaccagtttttattaccttgtttgcatattggaccaggtataagcaaatttttttcacttagggctagattttgtgaccaaattttgcattttggactattggatccacaagtcagtggccaacatcatcttcttcctcagcagtcttctaggctgagctatatccagcgatgtctctagtgagcctattaattcttcacacagacaaagttcctctttcccaatctccattcacctcgaaccacactctgctacttgacgagtctgagcgcagatgctccaaacctgccagcaatttgaaaggtgtgcttggtgagttcgatgtcaggagcatgcatggagaaagagacggggttcgaggttgaggtgatagagaatgaacagagatggagctcgagttctacgtggtggagttggactgttggagctcgagctcaagcaacagaggaggtagagctcgagcattgaggcaaaaaaaagagttggagctcgagttgggaacaatggaggatgcaaagcttgatatcggggaggatgaagatcgaaacctgcaagaccagttagtgagtgtgcagatcatggagattttcacctttctcattattctttcttgccaagtatcagcgagaagagctccgtatgggcatggcaaatgttgagctcgatctgccttgctcagattcagtggttcacagtggttcttggaggagagagcagcaagagagagaagctagagaagaagagcgggttgaaagtgaaatatgttgcaaagatatctggcacaaattgaaaatggttagttaattctagtccaagttgcaactttggtaaaaagatatggtccaatatacaattcactctaaaatgaaaatggtcacggaatttcatgaccgcctgatcgttgtttccttacaagttgtattgttttcagccattaccattttagctatatataaaatttgatttttctaatttatttcaacgtcatattgatattgaaactaaactataaatatagtcaattatagatcgactgagcgtcaagtgctaccgtcgagtgctaccgattctgaccgtttccataattacgagagcagatggtgtatattgagaagctgcatgctcatcgacacagccttgtgttatcgtaatttattgtatggcgattgataacgctctggagctatggattttgttttaatttgtaactggaaaaaaattttctatcttttccagcccagacaaccagcgaaatcaagtctcccgtaaacatacttgtatcctaatttttttaatcagaaccccgtactgtactcgattgtcattggagagtttgattctgctatagcatactgcacactgtaaactgaagtgtttttaaagtttaaaatgaatttcaaagtttgattttaaaagaaatcaaaacaatattttaattgtcctcttttttttgcggggattttaattgtcctctttagcgatcatgaaaagagaaccaaaacaaaagatgaaaaacactataatatgaatattcgccatgcaggatgcctaacacaaggagccaggaccccttagttggcgccaacatgctaacacaggggttacgatcttgattggcaagtgaaacccgagccccaccaaggcatcaattttcgctaattttgaagcatttcatataaattgggacaaatttcgaacaagatgcgcatctagaaccatctcgagatgatcaaaattcatgaaattggatcgaaattcattgagattgtgaaccctactttaacatcagctggtacgtaggaggaactcaaactttccatcaccttttgtactattctcttttttttcttatcataattctgaaatgtacttgcagttttgattgaaatggaaaggaactctatccagtagtagcatagtgtagcatttcatgtccaatggagactgacaaatcatcaaatctgccggaaagaaagaaagaaagaaagaaagaaaaaaagaaagaaagagaaggcgagctacaaaaggtgatcttaagcattgaagcatcaccaagaatttcaacagaataacagcagcatatgggtaggctagggaaagaagaaaagaatagaccaaggaaaggaaagaagacagcagaagaagcatctcaaagcttttgatcttatatcaatgtttgagtggtatcctagtcacaaactcacaatgcctttagtgatggtgtggtatatcttgccagcgccgctaaatatataagcattgatagtcggctataacttttcaataaatgatatagagtaaaaagctagtacacaagacagaaatgtaatttccttgtctatcgtacttttcacatcaaaatatttgggctctgttcgtaataaaaacaaacaaaacgtttctcatgtaaaattatgttgatttgcactcacatgccatgacagtggagggtgacatagtgatgctcgaatatagtggagggtgtactataaatgaaattagcacacttatgttctcaaatagatgtcgttttatcatattagttttgtcgtcaaatatatgccatttaaggtcttctatgcatttttcggcattattcctaatgaatctagttagcgcataattaagctcatggctttgtacgtaacaaactgaggcaaaagaaacattgtgccaacctaggtggttggagcttgatgatgcttaattaggggcaaagtgtccatgacaggctaaatattgaagaagaggtttttttactgtccttgaggttgtgcagtaccaaatcctgaccgttgatctggcatcatccaacgggtagaaatcatccgtacctcatggtactgcacctcctcattgaagtggtactatgggtggaagggtctttctgtcctttactgtttcacgagagaaagaaaaaacgtcgggagagcatagcagcggcatggcggttggctcgagggggacggcggcgggcgcctggacgcgtgacggcggcggcgggctggacggcggctggacgcgcggcggctagacgcggcgggcttgagggggacgatggcgagcggacggacgcgcggcggcggtggcgggacgcgcggcggctggaaggggctggacgcggcgggctcgagggggacagtggcgggcggacggacgcgcggcggcaggcggctggatgcgcgacgccggcggccggctggatgcacaacggcggcggcagcctcgattggcgacaacgacggccagctggatgagggacggcgacgacggtggcgggttggatgggcgacggcggcggcagcctcgattggcgacgacgacggccggctggatgggggacggcgatgacgacggcgggctggatgggtgacggcggcggcaggcggccagctaaatgcacgacggcggcggctgcctcgattggcgacgatgacgacgggctggatgggcgacggcggcggccggtggccggctggatgcacgacggcgacgatggcgacgacgacggccggctggatgggggacggcgatgacgacggcgggctagatgggtgacggcggcggcaggcggccagctaaatgcacgacggcggggtgcctcgattggcgacgatgacgacgggctggatgggcgacggcggcggccggtggccggctggatgcacgacggcgacgatggcgacgacgacggcaggctggatgggcgacggcggcggccggctggatgcacggcggcggcggtgacctctattggcgacgacgacggcgggctggatgggcacggacgaagagatgttttttttgtccgatcatacccttgctaaatcaacggttagattagattggtacctcatggtacctcgtacctcatggtagcttctcaaggatagaaaaaatgctcattgaagaaagaattaacactataatgctaaatagaagagagaaagttatggaaccatagacatccttattggttttcatagatgctttacttctaaaagcctcggggaggccatgaactgccttagactgctctaatacctctctctaatttcacatttaacactttcattaataatatgtagtacgggctaaggtcgctctacccctcacatacaattctgatccgctcccatctctacttcactccatttcagatctgatg

SEQ ID NO: 65659 - DNA, 25020 bp, Oryza sativa
gtcatatatgtatcgatcggcagtcatgaataaacaagaaggaactaaatctactcgatcggctgtaggtattcacaatatatactccttgtatcgatatatacttaaatcaagtgattgggatagatcggacgccatgccgagacagtataaatcacttaaatcgaaatatatattaataatgggactacatatgttcatagcagagccgatcatatagatctagcatgtatcggctaatactccgataccactctatactaagatattaaagcaagtagaatatatcaaacaatggcctaatatacttaaatgcaataagatcttaaaataaatgccagatttaacatgtcaataaagcatatagagtaaatatagttaaatcagataagatcggctgaaactccgatgctaccctaatcggcaaccagaaggcaggctagaggttgattttctaagcatgacttaatagatcaaactcaactgatacaacattaagtatgaaaagaagaacaatatctagacaatcaagctgctggaagtttcatagagtggtagatatcttatataatctaagtcaatatcgaaatctaacctaatcggctgtcctctaccgatagatgttagccgattgtagattagatagtggtattgccagagattatgtaagatatatgatagttcgacgaattacataaacgagatcagagtatcacaaacatggaagcactaatcccgagaacacaagtcgtcataacaagttttacctcttgttgaagatcgaaaccgatgcagctcaacccgaaagcaagaactcgtcgaaataaaactaaagcaaaaagggtggcgatgcgccgaaattgtattgaacgtgtgtgttaaaagttacatagggctcgggtctatttatacccgagaattacaagatatgcccataacggacacgactaatatctttaacaaactctaagataccataagtctttacggcagacttttgcccaagcatatctctaaggaaattacataaaatatcctaattaatagatacaattgacttctcaagactctatccatgtgcggcaatcatcttgaagcgccttaattcaacccaatatcatacatcaagttgcattatcggaatcggttgtatcagcttacctagtccgactcagacccagccgatcctaatcgtagccgatctggactccagccgattcctgctctgtttctgaactcaatctccgcctccgactttgcttcgatctaatattctttcccgatgccgatattaccaaatttggttgttaacacatgccccccaagtccggaatatttggtaatgtttcggatttgctgtaaatcgaccccgagtaagttcgcactttgccgttttccgaccgttactgccatgctttaaatattaaacgtcaccctcgagaaatctcacaccgtgacttccgttttcaccgctcaagcgaaactttgtcttctctctctccagcgattcctccgacgcaaaagcgacttccaggtgacttcatcttcggcgagatttccgcctgcagcgatgtcgtcctgcaccaacccatctgatgcgccttcagccgagtatgctgaggtaagttcccgtcggcttgatcccctttcttagcagcagatcgattttctcttatcttacattgctctctttttctctgttgttttggatttgtagcatctcttcaacctagtcgcgattcccagcctttcgcacaaaatccactattttcttggcccaatcggcaacctcgaccccactgatttcatcattggtgaaaccaaccggatcccctttagactagccaaccctaacctgggtcactggaagaataccttcaagtcttggccatctctcgaaaaacccacacctgataaaagctggaccacctggtaccaacgcgtatcgtctagtaagaaagttcactgggatgagattggaatcggccaagcgcttgctctcaccatagccaattctgctaaggatgaacctctgatggctaccgccacctacttttggtccaacaccatcaatgctttcttattcaaccaagggccgatgactccaactttaatcgacatcaccatgattactggattagatgtaacttcattggctaaccctatgagtatgaacaccaagaaccaatttgacttcaagaccaaaagcataggtggctagtctggctatgtggcagcatatatgggccaagggtctgttacccctcgggaacatgtagctttcttgctcatgtggttagaaaagttccccttctatggatctagttgtggccctacaaccaacaggcaatttgtagctgaagccttagaatcaaagaaagaatttcctttgggcaaaatccatctcggctatctgtaccaaacattgaacaacgcatcggctaaaatagccgtcggctcaatagttggagcaggcggaccatggtggctgctgcaaacctggttagtcctgatagtcatgaaggttgtcaatcggccctctatgacagaagctgaattcccactgccagagccgattgcaggagacgatggagaagagcgcacccatcgcagatgcatgtcatatggagaatatgcatccacaccaaccgatgctggagcgaagctatcggctgagctacttaagaattggttctgcagctcctatgaaggttttaagaaagatgcacgaatctggtttccctatgaagactcagcagaccttgaacttccatcggactttagatttgaagacattaatcatgaaaaattccaaaaatccagagaagttcttatagctacaatcagcctatgcatcctccccgtcggcattcaccaagggagaaacatccaagtctcctacgagttttatcacccaatgagctcggccagacaacttggattgggccaactcccaatcggcttattctttgccgacaagattcaatgccgaggacaaatcacatccactctaatgatggatcggctacttaacctaccaagaccccctctgggcagcattgataatattgagttggcaggatttagaagcaaaaactttgacagatggtggggtgaatggaagctgcatctatttcatcaatcggcttcaatgtatatgacagatctattccctgacgtcataccccaggtaaactttgtcattactaaattgcataatcagttagccgattcattacttgactaatctttttctcctattttgcagacaacagagtcctcccctcctcatcaaagtaatagtggcaaggacattgaatatgctcaaggtctaattccgaatggaggtggactatctccccctgttatcagctaccatgcccccaagacttcaactcttcttcacggcctaaccagggaactagccgatgcacgcaagaaaaggaaaaccagatcatcggccatgagtaccttggtcttagctccaaagaaaaaggccaaattcaagaaaactaaaccgactgataagtcggctgatgatctacccgccttggatacatctattgaacaagctttagatgcagaggaaattggtgaagatgttgaccaggctgtagccgaaatgagtgacacagaaagaacaccatcggcttcacccaagcaaacgcctccaactccttctgcccccattcattttacaagagtaagtatctctctttgacatcttctaaaattacttccctcttcggctaattactcatagactttgtggttgcagaaaaagaaaactgctgtgaagaaaaagccagcagcaacgattgccaagtcggctccaccagtaagatgactttaattcttttacttaatcaaactcaaccggctctatataacacttgtctattctacagcctcctcttgcttctcctcctgtatagcaatcgtcaagtgaccagactccatcggctgtggggagtcatcacatcaaggaggaagaacaaccagctgctcctgctatcccagtaagttttcctttgtctcaacaattagatcggctataatttacccaactcttactttttccgaaattgtctctgcaggttctagccgatatcttctcttttgatatcagagattaccttgatgaggcagacgaagacacttcaagcaaagccctagctcccctatccgatgatgtaagaaaaacacttgaagacatctctcatcggctagaagcctcttctttagatagcttggtagttgactgtggatcaattaggtcacggctgcatgaaattcaggctctgattcccgaagatttggccgatgtcctaactccagccgcttatctcgagcaacatcagttcaagctggaaaaagccaagctaagactagccgaacgccgtgagcgcaaagagattgaggtcacaatccaagctaatcggcagcttgtgcatgaggaaaaaaccaaacttgatcagctatctgaaggtccgatcaaatccaatattgatcagcttgaagctcgcaagattgagctcttggtgcaacttgaagaatgcaatgccgcgctagatatggaacacaaaaaactagtcgatctcccaaaatcaattgaagaacaaaaaacaaggctgaaatcggctatcaagaatgttgcgaacttgaccaagtccctaaaagtcatccctggaactgatgctcaagatgcccaagctattgaagaagtagaacaaattaggcaaagggctattttggctatccagcgatacttgtctcaataacttttgtgtaataggacttagaaattttgtaatcggctaagacgttctaatactttactgtcttgacaatcctttgtgccgattaatatgatttttaatatgactttgaaattcgctcaaaaatttgcattgcattttgatatatatatgtgcccccctaattttacagtgtcaaaagcactggtaaaattataaaacaactaagggcgatataacaatatcagccactgtacatcggcaaaccacaaccgattacaccatgaaaaacaactaagggcgatataaccatatcggccgtctcaaggcgatgtaaacacatcggctgtcatgcatcggcaatgctagacgatcatgcgttaacccaaacacttgggtaatattgcttcaaatatttgccattgagcgctcgcccatagacttcaccatcaagcccttacagcatatatgctcccttagacacaactttataaatttggaacggtccttcccaattcggcgaccacttgccaaatttactatcacgagtaccaatcggcaaaaccaacttccatacaagttctccttccgaaaaatctttaggtaccactttcttattataatgccgagcaacacgttccttatccttggtaacctttgcaagggctcgcaatcgtgactgaaccagatcctccctctcatcggccataaggttgtaatactcatcgactgttaaatcgttttggaactccgttcttcgagagccgattctaacctcccacggcaaaacagcctcatgcccataaacaagtttgtaaggagggacttggatggatccatgacaagccatcctagaagaccacaacgcttcggccaaccgagcatgccattgccgaggataatcagaaattttccgcttaatcaatttgatcaaaattttattagacgcctcggcttgcccattagtttgtgcataataaggtgaagaattcaacaatttgatacccatgctatcggcaaactgaacaaactcatcggacacgaagattgaaccctgatctgtagtaatagtttaaggaataccaaatcggtagattatatgttcttgaactaattgaatggcatccccagaatcaactttcttcaaagcaatcgcctgcacccacttggtgaaataatcagttgccaccaatataaatttatgtcctttactcgatggtgggtttatcataccgatcatatcaattccccaacctccgaatggccatggcttaataataggattcatagccgacgtcggcgctcgctgaattgctccaaacttctgacaatcttgacaccccttataatatctgaaacaatcctccagcattgtcggccaaaaataccctgcacaccaaagtaaccacttcatcttatgagccaattgatgagtaccacaaattccttcatgaacttcgccgattgcaactttagcctgatcggcactcaagcacttaagtaacactccatcaatcgtccaataataaacctcatcatccaacagtgtatactttaatggcttatatcttaatttcctagaagccgattgagatggattattcaaatattgatgcacatcatacctccaatcatcggctgtcatcgctgcaatttcaactttaacatctttgatcatcggcttataccccgacgccccttgagctaaatcattagcttcaacattttgttctcgagagacatgctttaaagtaaccagccgaaactctttcattagttcgtggcacttctcataataaactatcaatgtatcattcttgcatccatactctcctgccaattgactgattattagcaaagaatcccccatgatttcaatggcatcggcttcaacttccttgagtaattgcaaccctttgagcactgcttcatactcagcttgattattagtcgcatacggtttaatagtataagcaaactcgaagcatgccccctaggggaaattataaccagaccgataccacaaccatgagtacacaccgatctatcaaagaataaagtccacggcactatatcaactgagccaattgaatcattatgatgttccacaataaaatcggccatagcttgtcccttaattgccttcaacgactcataccgaagatcaaactcggttaaggaaaatatccacttttcaacccttcctttcaatattggagccgatagcatgtccttgacaacgtgggccttgcatataacagtgcactcattggatagtagataatgcctcaaccttgtacacgaaaaatacaaacacaagcataacttctccataggggagtaccgagcttcagcatccaagagtcgacgactgagatagaatacaactcgttccttcccttccaactcctgaatcaagactgagccgattgacttctcaccggccgataaatataacctaaacggtattcctttttgtggaggaatcaaaacaggaggagagctcagatattccttaatattatccaaagccttttgctgctctgcccccaagtaaactgctgatcggctttcaatctcaaccaatggtgtaaaaggttctaactttccagacaaattagaaataaatcttctaacaaaatttatcttgccgatcatctcttgtaattctgtcttattctctggaggctaaatcttcttgatcgcattaacactcctttgagttacctcgatccccctttcatgaacaagaaatcccaaaaactggctagccgatacaccaaaagcacatttcgtcgggttcatcttcaggccatattttctggttctctcgaaaaccttcctcaaatcggttatatggtcctctatttctttagacttaacaaccacatcatcgatgtagacttcaccaaccagccgattaaattacgatgtatgtaattcatggctctttgatatgtagctccagcacttttcaagccgaaagtcatgacaacccactcaaataagccgattgcaccaggacacctaaaagctgtcttatgaatgtcttcttcggccataaaaatttgattgtatcccgcgtttccatccataaaactcaaaatcttatgtcccgaagcagcatcaactaattgatcggctactggcattgggtattcatctttcggagtggccttattcaaatttcggaaaacaatgcataccctgaccttgtcgtttttcttgataacaggaactatactagaaacccattcagtgtatcggcaaggacgaatacaaccagcatcatacaatcgtttaatctcagctttgacaggttcaagcatatcggccttgtacctcctcggaggttgttgatgcggcctaacccctagtatgataggtagccgattttcaacaatcgattggctaactccaggcatctcataatactcccaagcgaagcaatctctaaacccttttaagagctctatcagcttggttctaaactctggagataagttcttactaataaatgtcggccttggccgatcgcctggacctatgtctatttctaccagatcatcggccgacatgaaaccttgaccttgcttgtcatcgagatcatctactgtatccttagtgtagacatttgaaccctccacgacgccctcaaaataatagcttgggttctccatcttcgattggctgtatatcagaatcggacacttttagaaaatctccatcctagactttttcagataaacaatcaaggccatccatctctcaaagagctaaatcggcactggcaacattaactgacctgtcggctggcatgatctctatcttgtcgccttgccattgaatcaaacactgatgcatagttgaaggaatgcaacaattggcgtgaatccaatcccttccaagcaacaagctgtaagaacccttcccatcgatgacaaaaaacgtggtaggaatagtcttactgtcgactgtcagctccacattcagaacacctttggtttccgatggattaccaccaaagtctttgagcatcatgtttgtcttgatgaaatcctcggcatttctacccaactttctgaacgtagcataaggcatcaaatttaccgcggcctcaccatcaaccatcattttagacatcggcttcccattgacgtagccgtttatatacaatggtttaagatactgattctctgtcccctcgggtttctcgaacactgcctgttctggtgacagaaccaacttagccgattcctcttccgcctcgtcgacatcggcttgatcgatcccgaattcggctagcaaggtaaagaccatgttaaccggtgccgtcacaacactcttcccttttgccaacctctttgcctcatcggctgcaacatcatcggctacaggaaccagattcttaacacgccactcctgccttggctttgctttcttcagccgatgattaatttcttgttcaacctcctgaaggcgctccctgttcctcaatctttgaacccttctcttctgattcttcgtgaaaataccagaaggacaccattgattcttcctgattacattgtcctcttggccatgatcttgattcactggacctaatctttgatgaacggaaactcttgtctgccttagccgattacccttattatatgatcggcttgaactctcgacaatatcactgcacccaggcagttttcaatagatggcaacctcataccttcattccagcagaatctaaagaactcacaaccccaatgaggatcaaaaccatcattgtattcttcattatgcttctcctgctgcctgtcatacttcctctgatatttgttgataatcttagccgaattcacctaaaaaccccttgcacgggtcctatcggctgtttggccagctgtatgcaccatattaacaggaaaagggttaccatcgaccttcatcggctttttggaatcatcaaacctaatcttgcctccctcaatggccacctgaatctgctctctaaaaaccttgcaatcgttagtagaatgggacccagaattatgccatttgcaatacctctttttgcctaattcctcagccgatgggattgtatgaccagcagaaagttgaatttgcttctctcggagtagcagatcaaagatcttgtcagctttagtaataccaaagtcatacttctcctcttttccagaactttttacccattggcatggtatgacatttttactcctcacccattcggctgcagctatttcagaatcgtcctcgtcatcattcaacccatagatgtatggacaaacatgattaactttcttagagcttttcctaacttccgcgaacctatgttcatgcaaggttactttctgtatcggatgtgataagctatcaaagtcttcagacaagaacttctccctaatcggagcaatcataccctgaaagaccaaatcgactaactgggcatcagttaaactcaagctgaagcatttgttcctcatctccctgaatctctaaatatactcgtgcacgggttcatcatgccgctgcttaatcgctgtcaagtcagataatttcatctcatgaaccccactgtagaaatagctgtggacttgcttctccaaatcggcccaactattgatcgacccatacggcaaagaggaaaactaagtaaaagtcgatccagacaaagataaccggaacaacctaaccttcaaagcgtctatagccgatgcttcaccacactgagctaagaatcggctaatgtgctcataagttgacacaccatcttgtcccaaaaatttggataagtctggaactttgaactgattgggcagaggaactctctcaaaccagtcagggtaaggctgccgatacaagcttccagtctcttttggtttaagcccaaactgttccctcattacatcagcaattacatctgcccatggtcattgttgagctgccccttgtgactgttgctgcatgggctcgaactgaccgtattgagacgcaaactgaggttgagccaatccccctggctgatattgggcttgcggggaaggaggctgatattgataattcaagttacccccttggtaattgtgaagattcagctggatattacgtaccaagtgctcagggacaacttgaggcattaatgtgccatccggttgtacgtggtgaaccaagtgttctgggacaacttgatttaaaaattattgcaccggctgaccatcaggcgtcgcaaacccggccgatgcgcttattgaaccttggtgctggatcggctgaacaatttgctgtcttaacggcgtttgctgaatcggctgcagaggctgctgccttggtggtgtttgttgaactggttacctagcctgttgctggattggttatacaacctgctgaattgggggtgtctgctgaatcggctgctgctgaatcggctgttgctgtattggatcaacaacaggttgaggtgggagaaacatggcagcaacctgatcttgggttagccgattcgcaacctgcccactatgctgtggctgctctctcattaacaaccgagggttcaccggctggcctggcgccatggctgatgaagtaggtaggggagttgatgccggcgccgttggctgagtcgttggtgcaatggagggaaccgcctaagtagatggctgaacatcggtaatcaaagaccgataatttgggaagacacctccttgcaaataaaccgggcctacagcctcatgctcagctattgaaccatcaactattgacttcatcatgtttgataagatattgactaacaccctagactgattgatcaaagcatgatgcacaacataatcaacccgatcttggaagttattgaaaaatcctgtgccacatcgctattctgattaagatttcctccctgtagcccctgagcaccatctccatgcaccccgtcaccttgtactccacggactccttgagaattgtcgccttgatttcctagagagccgtcggtagcacctttaatactcggctgagccgagccgtctggagcttgtttcccatctccctccttagaagaactggtcctaggatcatcagcgaccacttttattttgtacttctaaacaagtgtccccttgcgggtctgcatgaatgagttcaagaactgatcccgtgcttgctgcaaaatttgcttcaaactctttcttctgctcgggtgtgaatttttcttgatcgatcggcatgacgtttccttcattgacgtcagcaatcctaacttcagcatcttgtccttaacagagtctgggcaagatggtggtggtggctatttctcagccaagaggaagaattgttggctgacttcgtaaaggtcccaccaggcatgccaaaagcgtgttgatagaaaacacgtggcttgggagatctgcttaactccagtgcaggtccaaagctcgccttcgaatgtatgagcatgccagttgatttgatcctgtaatcaacaaaaaatagaagcaaagaaaccgcggttaaatctataaatgatagtcgatcggctaggtgcagatgacatatcatttatctttgagccgatgttatatatgtatcgatcggcagtcatgaataaataagaaggaactaaatctactcgatcggctgtaagtattcacaatatatactccttgtatcgatatatacttaaatcaagtgattgggatagatcggacgccatgccgagacagtataaatcacttaaatcgaaatatatattaataatgggactacatatgttcatagcatagccgatcatatagatctagcatgtatcggctaatactccgataccactctatactaagatattaaagcaagtagaatatatcaaataaaggcctaatatacttaaatgcaataagatcttaaaataaagggcagatttaacatgtcaataaagcatatagagtaaatatagttaaatcagataagatcggctgaaactctgatgctaccctaatcagcaactagaaggcaggctagaggttgattttttaagcacgacttaatagatcaaactcaactgatacagcattaagtatgaaaagaagaacaatatctagacaatcaagctgctggaagtttcatagagtggtagatatcttatataatctacgtcaacatcgaaatctaacctaatcggctgtcctctaccgacagatgttagccgattgtagattagatagtggtattgccagagattatgtaagatatatgatagttcgacgaattacataaacgagatcagagtatcacaaagatggaagcactaatcccgagaacacaagtcgtcataacaagttttaccttttgttgaagatcgaaaccgatgcagctcaacccgaaagcaagaactcgtcgaaataaaactaaagcaaaaagggtggcgatgcgccgaaattgtattgaacgtgtgtgttaaaagttacatagggctcgggtctatttatacccgagaattacaagatatgcccataacggacacgactaatatctttaacaaactctaagatactataagtctttgcggcagacttttgcccaagcatatctctaaggaaattacataaaatatcctaattaatagatacaattgacttctcaagactctatccatgtgcggcaatcatcttgaagcgccttaattcaacccaatatcatacatcaagttgcattatcggaatcggttgtatcagcttacctagtccgactcagacccagccgatcctaatcgtagccgatctggactccagccgattcctgctctgtttctgaactcgatctccgcctcagactttgcttcgatctaatcttctttcccgatgctgatattaccaaatttggttgttaacatggtggtgtgagatgcaagcggctgggtggcggcgacgattcaacgtcccggttatcgccaaaggaacctcctctccatggatctccttccctgctaaggttagattcctgttttggtcgactgggcttggtggctggaggaacagggtggtggttcgaattcggcgatggtcattgtgtactagatgggaaagcgctagtgaaagccttgcatggcctttggctggcgtcgacaccgttaggcattattcccttccttggaagggtctttatggtgttttctatgtctctaccaatctccaagtgaaaagcttgatccagtcgctggccgacgagcggttgtagcatttcacgtcatgtcctccatggggatgctgttttggagagatctacccatgcaacgatggccgttgatggactcttgtgcttccgaagcactgtacacctaggtgtttggaatggccttagccgtcttggctactttcttgttcgtggtgggcatccagctctcttcgttcgtctttgctaggtggagtcgaagttgttacattgttacagtgcgatgaagcttggcaacgataacacattgcagtctctttctggggggtactggtgttagccgggtggaggaaatggtgcgtcgttttgttgttttggtgatgcctttgccaacgatgacgtgatctctatggagtcaaacctgttgcgtcactaggcagcaagctcaggcctcggcaacattgacacttgctttgcgaagttgaagctgtttgccgcttttttagctagcttgacattgatgtccaccgttgggtttcatcgttgtttagttggtagttggttagagttgtgtggtattccatgtgttgggttattctactagctgcgattgaggtgcttttggcgagtctcttcttgttgagagattgtttttttcttttccttgtaaagtgtctgggttttactcttgcttaattaattgaaatgaaattgacatttctcctatcggtttagtttttctttaaaaatatatcactttcacccctttctataatttttatagaaattctgaaaacttataaactaagtgagagtttcagaaatggccgtttcccccctgtaatccacggtcaaactttctatgcgctagacggctagagcctagatgtctaaaaaacaagggatagaatgacgcaccgcttggtgaagaactgaagttaatggcttccttcttccttcactacactggacaaggtcaccagtgacgggcccaaaccctcacctttgatggctttaggcttggtcagtgatcagtggtcactagtgagttcggtcacctttgacgggtggaagaccattactgatgacagtcacctctgacgtgctagaactctacggcccgtcagaggtaagtgtctgtgctaacccatgccattttgcaacccgtcatagatgactcacctgtgacggctcagagtaaaaaactatgtcacttgtgacgacatgtatgtgcaaaaccgtcactggtatggtcacctgtgacggcttttgcaatatgaaccatcagtggtgagcttacatctagaaaaaaaaataatttcccctaggatttgctaaccatgcctctggaaaaacagaacatacacatgcaatatatatgtctccagtttcagcccattgcattaaaagtttcaaactaacatcacatgaattccaagttgtcaccgaaaatccatagacattcacacacatgcattgcaagttctcaaattgagccaagccgatgcttcaaagcaccagaaataaatccagaaaaaaaagagaacatacttcgatgccaaaatactgaaaaatgagaaatacagcctaagtgccacaaacttgaacatagcatttccatctttggtttctgagcctgacgaatatggtatgacatacaaacttacaattagatcagcataagtacagcccccagtgcctgtaatgacatcattcagagaagtttaatgcaacaatatcctaacagcctaacaaccagatatatgttacagatgggatgacagtagcaggaacagcttcgatatgttacaaatgcatataactatgcaagaatagcctaacagctagataatcagcataagctgctccaaaacaacaaattaaaatggggtcactctgactgagaaggcaaaaataagtttacctcagattagtattcattagctagcttttcaaccatccttgatagtcatccatatgcatgtcagtagttaaatattatctgaaagaaacggaaatagatcaactggcagaggaagctcaccatttgtagaaagaactagcgtctaatttgttcagctagtatagaaattgggggatttgtagagtatgcaagaacacaaccaaaagaaacttctggtaagaggtctaacaaggaaaataaaaacagatttagtgatgcatcaacttaaatagaacaagaaaacaaagcgaaacaacatgcatgcccactatccaaacaaaatactagtacacaaagagcatctaactaatgatccaatagctcatgatttttgatggggttaaagctagatgcatccttggacaaggatttagccacaggaaccacaggagacgccggaattggttgactgcaagctcagatctggatgcaagagaaggaaagggtgacttctgcttagcactaaactgagtaaaatagatgaggcgacggtgactaccgaggatggggtggaaggggacagccgacgcctgctctccccacggcaggttgacctcgacgacgtggtgtggtgtggacggcggaccgcttacctcacgaacggatctggtatcgctgaagctaggaccgcaggatctggagcacccaaactcgggatggttggatccgcgacctgtgagttcagggtgtccggatctggagcccccgagttcatggttgctgggaccgtcagggggaggctgggggatgtagaagctcgtcgtcgaccggagataagcgacgatggacggaggggcttgtcgatggcgttgggcagccgcgtggtgccccattggccgatggtcctggcaccggcgttgtcttcgtctttggctcgatatgacctggatctggcgtggtggaggcgggaaggaggcggcgaccgtgggtggtgggcgaaggaggcagcgacccggaggcggtaggcgaaggagccgatgacggggtggcggagagacggcggcggcgaccatggggcggagggcgaaggaggcggcgacctttggaggtgggcgaaggaggccggcggtcggtgggaagaagagaagagagactgagaggaggaggagagagactgagcaggtggcggtgggccccatgggtggggggtgggggttccttttttatatgtcaaaattgatcacctttgacgggtgcaaacttaaaatcaatgacgggccagaagtcatatccgtcacaggtgacggcccatcacctgtgacgggttgtaactccctggcccatcacaaatgaggtcataccagtgacgggttggaagtcaaacttgtcactgtcttacctgtgacggcttaaaattctggcccgtcacaggtgaggtgatacctgtgacgggccacggctagatgcctcaccaatgacggtaaacctaacgacccgtcaaaggtgacggtcatctgtgaccaatttataaacccgtcactaatgtgccgtcatagatgtagggttctggcgtagtgcttaatcttcgctctcagctgtgatcaatgacaggaacacacacacatcatcagcccctaaaaccagcaaccatgcatgcctactctacactcaacaaataaatatacaaatcatgcatgcatgttcttcatatcggttatctggtcaatcacacaatcaccatcaaacaatgtgtgagattctcttgttacttaggtaccaagaagttatgcaagaacaagctagatcacacacataattaattatgtagctagctagccgccatgcgagcgttcaaagctatatccacgtactggatcatccacagcgcgaattcagaaatcgcaataatttaaaatattctcacgcaaaatcgtctataaattcgcatcaaaatctgaacccaaaacattccatcatcgcatgctttgcattgctctcccttctaaaaaacaatcagaagtcgcagacaagaaagagacgaaaatgtctaacacctacgtgtcccatgtcgctgtcgttgtaatcctggcaatggcttcccagtgcttcgctgccaccaccggcgccggcaatggcgtctcgggcgcggacgccggacgccgcgcgcgtgccgcgcagacggtggcggggatcctggcggtgcacaacgaggcgcggcgcgcggtgggcgtggcgccactggcgtggagcgcgggcatcgcccggtacgcgaaggggtacgcagcgtcgcggcgcggcgactgcgcgccgcggcgctcgccgctgttcaacttcggcgagaacgcgttcgtcgggaaggggcggcggtggaacgcgccggcgctggcggcggcgtgggtggacgagggccggcggcggtacgactacggcagcaacacgtgcgccggcgcggcggcggccgcgtcgtccgggtcgtcgtcgccgtgcacgcggtacacgcaggtggtgtggcggaacacgacgcaggtcgggtgcggccgcatcgtgtgcgactccggcgactcgctgctcgtctgcgactacttcccgccggggaactacggcaccggccgaccatactgatcgtgttatacatatagtgccgtgccccggagaataatcacatactcactccgtcctaaaaaaaatcaatttatacggacaaatttgaaccaatatatgtatgtgttcatctttacaagttattttttttatgggacagagagtgtaggtcgttgtgcatgcgagtgaattactattctgcccaataagccgttgtgctctaatgcttgtgcattatatatattttcttcaaatataatttaattttgaattagtacaatttgatctgtaatgtcttgagctaaattgtgaagattatgctctcgtattcatttttctgaaaaacaacgaaccaaacaatattcaaagcatagaatatcaatatatattttaaatactttagactagatatatacatgacaatttatgtttagaataggcatgaaacagtataattttatcatcaggttttgtgaagaatgtatatctatggatattattgctatactgaaggctttgtaaatgttcaaaacgatacgtttacacgacaggatgaagtaaattagaggcaatcagacagactagcatatttgtttgcaccagcgagagcggtggtgtcagacatggctgtgcctcgacgcaacctggggtatgcacagacctagcgttgccccacgaggccacgacacaaaactcaaagagatgccaaggacaaatacaagatgttacgtgtattcgaatggagattcataaatagaatgagttttttattttgtattattttgtattggtgtctattagtctgtgattgcttatgttatgtcagcatgtgggtaaggttgtttgtgagcatcatcattgggccatggatttttgacctgaagatacaaagccagaacatgatgaccataacaaccacaaacatgaaattagaggatatatcattataaacctggtagaacatttaccttgcctatctcatggaggattggaggcacaacttcatacaactttgagacctgaaaggaaataatatcaacagctcataactcccctaccctcactcttttcacagttacatgaatttattttggcttctcggattggttgtcatatagtttttttggagttgggcaaggggaaccggtggcacgccgttccagcgaccatggcattgtttcccttgtgcatggtgatcccctcgtgtccggttctgtcaactggatatgggcggtgagggcatgcatgtaggacacgcacacatgtttttttcgtaaaatcccctaataatcggagaaatcgtgaaacaatacttccaccatttacgagaaatataacataaagaaaagaatatgccgtttttagagatggcgctgaaatcctattaagaatgtccgcattattgtcattacgaacttgttcgtctcaacagtttcgactttcgagtctagtttgctcgtaaccacgagcgatcaatccaagtaataaacaacttattaacagtcattaatcaatcgaaattaacactcccccttgcataaccccggtaataaatcccatgagttaactatacaaagtaaaattcaaaagccaaacccccacaaaattaacagcagcaattaattaatcaatcaccgcagtatataataaccccgagttcaccacaacttctccacaaacaaattaatcaaccaacacaccatgtctcccttctactgctgcctcgccgccgtcctgtcgctggcgtcggcgtcgccggccgcggcgtccatctcggtgtccgccgccgcggagcctccggccaacagtttgttgccggcggagcagttcctgcgggctcacaacgaggcccgcgcggcggtgggcgtgccgccgctggcgtggaacgcgacgatcgcgctggacgcgcagcggtacgccggcgagctccgggcgagctgcgaggcgcggccggtgtgggcgtggggcaccgacggcttgtacgggcggaacctgtacagggggagcggcccgcgggtgcgcgcgggcgcggacgcgtcggcgcactgggcggagggcgcgcggtggtacgaccgcgacggcgactcgtgcgcggcgccgccggggcggtgctgcggcgagtacacgcagatggtgtggcgcgccacgacgcagatcgggtgcgcgcgctggttgtgccgctgcctgggcgacacgtgccctctcgtgttggacaccgtcgccgtctgcgagtactacccgccgggcaacatcgccggccagcgcccttactaacgcatatatatgccgcggtatatatatgtagcacatgcacgtgcgagctcataaaatgttgtggtgtaataacacgtgcgtgatcaactttcaagaacgtttttgttcttgcattggaacaaatgtttgacaaattaatactacatataaagccgtcaaaaaactgagaagcacgttctaattgttgaagaactctactccctgtttttttatatattattaaagcacagtacaagcgtggacgtttttaatgaaatgattgttacggttcgtattcctcacgccactacttaatgttctcaacgacattcaaaacaatcggtttttgcgtggacgctgccatgctggtcacttcctcctcggaagatgaaccgctatacgccgatcacgtcctccactaccatggctcgcctctctatctcccatgccacatatttttattctaataaataggggactgaggacaatgggagttttatcgccacccacttgtgctctcacttactgcgcctcatgacctcctccccattcactctagccatacagggtttcaccactccatctgcagagcatgaaaactagttaggaggataacaacagcgacaacatctcagataaaattttcaaaactttggaaattattattgtggacggcttctacagataaccgtctgcaaaattcttttttacggacaactagtccgctagtttaaatattttgaactatttaaaaacaaaccggggcccaccgatttatacaggtgacgctctgacacatctacctatgaaaagagttttcgtaggtggttattgaagacattcacttttgagaacttttttacagatgggtgtttcagacatcacttacgaaaaatcatttaaccataataatagatagtctcaagtacttcatagttctaattcctcgagtttaatccactggaaatgaccagtgctagcattatattacccgccatatctagcagtgccgccatgggtgcttggtagatacgcactctacctactcttccgctacgcctcctccacctgcactaaagcaaaggcaacgtctccacatctaggtgagggctgttttatcggatctgcacttctgtgcgcctgtacggttgtgccctgtgcaatgcgatgtcgtttgtcgagttgcctatgacgctgcaactcctctcgtctctcgggcatttctgcttctaggtaggccataggcagatactagactactagtattaggtgttggccccccaccatcatgggcccccagcgatcgcctcggctacatagccccagggccggccctggcttttcctgatccatcctgattctgcttttatcagagtatcaagcttgcttgtatgatgatagtacattgctttgttacctttttgctcgctgcctagtgctgcaatacatcgattcagtttcttgcttctatatgcttgtttatattaaatgcatgggaggaattaggaaattacggaggaaatcaattaaaggaaaaaaaatatttcactgcattttatatcttttatttggtcggtcggccacatgtgcttaataagttatgaaaatcttattgcttctacgtatgtgtatgttgtgtggatgtgataataaggttgtgatacgtgtactagcgaatcatcgtgcctaaactcttcggatattccggaattccatccctaggtcccgacattaattttattttctcctcttttattactatatctttgcgaggcaactacgaatcgggcgtcggatttttgagagaaaaatcgggtccccctcctgtgcgctcccctctacacattcattgcatgaatgctgcatgccagctacttgcttcctatgcctacatctcagctacatgcaatatccaatactaccctcactttcccctatcgatgcatatctagcttttcttaacatgtttaaattattttttctcttaaattattaatcccatatacaaataatgcaatatgattgcatagttgtatttttttaattaaatctttacaacaagatctaacataactatattttaatgaaaataattaattgatgctttatcacttataaaaaattgtttcaatttgcttcataagatgttccagagagatgcaacattcaaaatataataactgcaagaccgtcaaccattgcatatgaaagctattcacactttcacagtcggtgtagcataactcccctagtaaaaaaccatgagttaaaagtacaaattaaaagccaaaggactcacaaaacggcagccattaattaataagaacccccgctatatatatacaatcgcgagttcaccacaacttcaccccgaaaccaccatgtctccactctactgctgtctcgtcgccgtcctgtgcctcccgcgggcctccgcatcgccggtggcggcggcatccatctccgtctccgccgtgcagacccccgtcgagccgacgccggtgcagttcctgcgggtgcacaacgaggcacgcgcggcggtgggcgtgccgccgctgtcgtggaacgggacgctgcagctggatgcggcgcggtacgccggcgagctccggacggaatgcagcctgcggccgccgccgcccaccgcggcgcggggcaccggcgacggcgccgccgtctacggccggaacctgttcaaggcgtacggccggcgccacaccggcgcggaggtggcggcgttctgggcggacggccggcggtggtacgaccgcgacgccggccggtgcgcggcgccgcccggccggacctgcggcgcgtacacgcaggtggtgtggcgcgccacgacgcagctcggctgcgcgcgccgcacctgccgcaacggcgtcgacaccgtcgccgtctgcgactactacccgccgggcaacatcgtcggccagcggccatattgacaatgatctcatctgtttctgcgacacacgacacgcaatgaaatgtagtacatacgatcgatggttctggtgagtgattgagtttttggaacaaatgtttggagaaatatatgaaacatgctccaaagaaaattaaagggatactctaagataattaaatatggagatttaatgatggcagctgcgatgaggattcaaatatgtattgtcatcggagctagatttgttcgacctctccatttcccataatcttgccgaacaactctactctctcccaagtccgacccaaacacggataaatgaactttttttacaaggttatattttacctggcctctacatccaatcggatgcatgtgagcctttttaaattggaaacttaacccctcaaaacaactcaatctgaaatttactcatatggagatttgaattcagataacatttttacattaggaacttagcctatcaaacaacccaatataaaattcgctcatataaagatttgaactcagagccttgaggtgctactcaggtcacatgcccttccgcccgataaaagaacctggtgatcggtgttgcagacaccttatcactgttgcttgaataagtaggaacaacaatcttgacaaaattaaaaaaatacattttttaaaaaattggcctttttttcttttgtttggcacaaatgcaaggtagttgtgtggtttgtagcgaatccagaaattttcttatgatgtagaaggagcagctggaccagacttggcatgggccagttttcacattgaacactcatttttcacgaaaataaaacaaaacaaaatgaaattctgatggtcggtgatggctgagttaaaaatacagttatggtaatacatcattctacacattttaagggggcaaatcacacgaattccctaccttccattatgcttctagattcattgtacgtcctctatctgttgagctccgacgagtgatgaacttggcaaattttgtacatattcctcaatcttaaataaatttggttggtctatcttgaccggcccgacaaaaaaatgaacttggaagaggaagtaggaggtgttcccgacttagagggataagaggtgaggatgagagtaagggatggtgggctggtggccatggtggagtggcaaggcggtggtaccagtagcctcgacagtgggagagaaggtcggtggacttgtgttggcggggacgtgggatctagagtggttagggcgaatcgttaaggacggggaagaaggtgcaggggcactctactactgttcggaggaaagtgaagctaggggaagaggaagagaagggtggtgggtcagtggcatgctagggctggaaggcagaggaggtggggtgatcc

SEQ ID NO: 65660 - DNA, 47130 bp, Oryza sativa
aaccataatgacaaattttccgaaactttatttgtgaaaattttccctttcttccttctccataattctttgcaaatcattttatcaatctccccttcctccttcaacttgaatagttgttaagctttctggagaaacttgaagatgccaaagtcaagtcaagtgtatcgtggaacaagaagatgtggttgaactgaagaactgaagtatcgagctttcgagatggaatgaagttttggatactaccttagaatctaaaccactcttttgcaagagtataacatttgttgcttggttgtgtgtaggtatggtagcattttcatcattgacgagcgtgtaactgtactaggttgtttgcttaatcaacttgaacaatataatattttacacacatcagaccagtggaaacatggttaaggtcttatctttagtgtaacccctctccttctaccctctccaaatctacaacagatggtgaacactcgcgccagtggaaagtggaaataataacaacgatgagaacccaaccatcacacaagtcttggctcaatagactcagctcatgaacatgatgatgtagcagatggataaccagtttgaccaaggtaacaacaatcctccgccccagaaaaagttagctgaatttctttgtgtgaggccacctacattctctagcactaccaaccttattgaagctagtgactagttgcatgctatcgagaagaagttgggactgctccagtgcacggatcaggagaaagtcatttttgcttcgcatcagttgcatggacctactttagaatgatgggatcacttccgaatgaacagagtagaagaacaaccaatcaacttgactgacttcactaaaggattcaagaagacatacatacctgcaggagttgttgctttgaagaagtgcgagtttaggacactaaaacaaaaggatcacactgtgagagagtattatcttcacgagtttagctgtctagcatgttatgctccaaaagatgtgcgtactgatgaagaaagatcggagaagttcttggagggactaaatgataagatgtcagttaagttgatttccgatgactatatatgcgttgatttccgatgactatatatgctgatcactggtggatagctgcaagaggggaatgttggtttcaaaggaagcacagggtagtagccagaggcaacgtatcaagccactccaaattgaggaatcaagttctacctctcaagaatagtcgcaatagttcaagaatggtggtgagatcaactcagagaataatgcgggcaatgaagtcagcaacgagcaaactcctcaatcaataccagcttagccaaattagcctcaagaagacaacggtaatggaaggaagcagttggtgtgtttcaactgttatgagtcaagtcactttgtaagagagtgttcgaagctgaagcatcagatgtcacaaggtcaagtcaacaacattgtcgtcataggagccaatgtcgtgccaattgcgtcttcaagtgataaaactcagccatcagttccaaagcagcagtagcttccttttggccttagaataattattagagtaatgaaataagatagaatgcagtttacatatgcccttttctttctagttgttccaaatctctggacgagattcctggtaagggggtaaatctgtcacaccttgattttcgttttaaggacatataaattattcctagaattttcattaaatttcattatttacaactgaagttaaatttgggaaataaaatttcctaagtaaaacatggtctgatttaatttttgttaaattctccttgatgaactatactctctaaaaatttttcggatttttatagctcagttactaattttaataatacaaacaacatttcagtaattatttaagttaaaaaggtaataaatcctcttcccagtcttggccgagttgggcccatttccttccatctctccccgtcggcccagctcgagccagcagcccctcctcatccctcggagcaagtccgttgtcctccctccttcaaccggcccaagaaagaaacaaaagtctacttcacgttccccatgctacactgacggccctaacctccagccggcctccctcccgtgcccgtgcgccacaccaccgccttgtccgctcgattcggcttcctcattgcctcctcttccaaatttatcgcgggaatggaatccctcaatctcttcttctttaattgtcacgtccgaactaatttacacatacaattctcgtcaaagaatcaaccgaggtacacaaatcaataatttaataaacaaattcatcaatataatatcgttaaatacttacaaaagaaaagaaaacagcaccggacagatgatctagagatggcttcagctacactcccataggcagcttaagtgaggtataagccaaatgttttttgcttcgctactttcttcaactgaggtttatttattattgcaagagtgagcacatgaaatactcagcaagccacacaaatatgcaagtgcacaggaataacaaaggatggcataataaagggttcatttgcaaaagtagtatttagcaaatatttgagagtagtaaaacattagagtaattaatcatcaatattaatcaacactgaagtacaccaatgctgcacaggcctaaccatctctgaacaactaaccccagttgcacagatctaaactccataacagtagctaacaaattataatcaccaattattattattaatgaatagtgcggtactaatcacaaaaaacattgctaggcccacccatgaccgtgggcgcagcaattcgaatagttttattttggccagaggtgtacaaatttacccacaaaacactaattctacacatgttgccatgccccgaaataccgccatggtattgcaaaggggaaaactttgacaagaccatttgcataacatgcccaaccgaatgacacccactaagcatctgtctccggtagggatggccagttccctaacagggagactacctaatgcccaaacagtggacttaattgtctatcacctatcacctgtggacttagttgtctgccacgataaaaacacaacataccgtggcatctgtcgttggtcatattatactacagatctaagtcgttgcctattcttgctcgtggttaatatggttaatgcttcacaacactagctcgtaaactagtccttagttgtcatgaggacgtccaacacactatgtgctcacaactcaccattagtaaaattttatttgtcaagttaataaaccaagcactaccaatcagcactaccaatcgtcacgagatatcactaattaatcatcattaatcatgagggaagcattaattattcccacataaatgacactaaagtgtctaagcatggcaaagcaaattatactaaatactccctccatctacttttgatagtcatacttcatcttgacacacagaccaaggataagtgattctacttatcatccatttaaatatgctactagtaattcctcgtaaacaagcgattcattaatatttacatttctcgatgctcatgcaaccaatctggtgtggaagaatgaagagtcatgcattaaatctaagaaagtcattaagatgataagttgttggattgaaatatgcctattaaaaataaaattttcagatttggaaatatgactatcaaaaatagatggagggagtatctagttggaccaatgtataaagtccaaactagtcaaagtataatctaggttaacaaggaataaggtaatcagtacaaattagctatacaaaggaatatgtgttcacaccacacaatgacattaaaaaaatgaacatttgaaataaatagagaatttaaatataagatcaacatgctcaaagggattgtatatgtttgggatctgtcttgcaataatcggtcttcaattaatcttctgaaactcttccaatgcactcataaacctccaaaacgacagaattaaatgacaagctaacaggcaaaacgagaaaaaagaataaaaaaactccaaataaatagtacataaaaagtaaacaaacatgtagagcatgattttataagaattataagacttgaacagcctcattccaacttcatatgaattagttatgaattttacaaggtttaatccaattaaacctattaaagaaaagattacttcaaattaattggatggcagagggggaaaatgatgacggcagagctcggtttgactaagttgacagagtatcaacggattagatcactcgaggatggatgaagggctgacatcgattgactggattttgactatatcggacggctcagattgaactcgatctagggtttagagatggcgccacatggtgacaccggattttgacctatattggatgggagcgacgtaatggcggtgacgtggacagccacacaggctcgatggccggtcggctctagacccacacgataatttgaaaaacaacataatgcatataatttgaaacgagataaatttgtaagttgggatcaacatgttcaaaacatgttcaagggtatatttgcctttacccatgggattttcacactgaacttcacctgcaatagcaacttcctcggcggcaacgtctacatgatcttaaaagggataaaaacaaataaacaaaaagaaaaggcagaaaaataacaacaaataaaataactaattaaatcggaagatagagctcaacttttgaagaattaacttaagaaaataaacaggtcaattcggagttcggatggaggagatataacaattggaagattgaattttgagataatttggatggaaaggtaaacgaagatttgtggactgtctctttagtaattctggaacaagatattatttttggagaactgatgagcatgatccacccatcagtgggatggtatgtgcctaataggtcttatcgggaaaaaatagtggatagaaaatttggaagacacagagcacgatatgtcactattagaaaattagttgttgctgacagtcaaaatagagtttcgctggtggccagaagtgtcaccagcgactaacggccagtgaaaataatgcattttcactagcggccggctggccagcgaaaattgagtttcgcaaccggacatgcttaattagacagccgctagcaaaaatggtgcggcaagctaaagaggaccatcggtgataacaattttggggataaaaaaaatcaaaatcggtgttgcaggccgccatagccgtaaccaccactggtcgccatggctgcaaatacagcccgcggtggccaccgcctgccaaagcccacaccgcggtcaccaggtggtagaggggaggggattggaggagcccaggcgtcatcgtcgtggtagccgtcgtcgtcatcatggcagccaccgtccatggaggatccgttgttgcggcccagcggaaaagaggaggacgacgcaggaagccatggcggagaggaggaggccacgcgccgccggtgggaggcaggggaagagggagaggacccgaggggcagagaggaggagaaccgcccccgccgccagatctgtgccaccgtgaccaaccatggtcgaggtcgcttcatccatcaccgagccgcaaccctagccaccggatccgtgccacagtgacccgccactggatccacgcccctccgacttgccgccaccgaatccacccccctccaacctgccgccgctggatccatgcccctccaacctgctgccactggatccacgtcccctcccctctggctagatctgggaaagggagaggagggtcgggtcaccatcaccgctcccaggagcgtggccgcccagtcgtcgaggccacgtgcgctggaccgcgtcgctgcctcccctacactctgccgctgagctccgccacgcgctgccgcctgccgttgagatatggggagccgagagaagttgcgagagataaagagggagacaagtcgtgagagagagagagagagtcgctgctgagatggatatggggagccgagaaaaaaaagaggaagttaaaatttcagttccgcacgcgctcccacattttttgctagcggaagttaaaaggaagataaagaactgagatggatttttgctagcggtggcttaggtgggccgccagcaaaaagggtgcatcttcattgacagtcctcttaacttggccgccaacgaagatccattttcgctaacagtgctaggtgaggaagaaaaagctgagaatggaatatggctgcagaggcagtggtgcaacgatgggtggtcaacgacaaggaggtggtgccaatggacggcctatggtctacggttgatgatggcgtcgactgaaatttcggaggtagcagcctatgctctccagatgatggcaaacagcgagagacagcaccagatggtggaggtgaagccggagggttggaagatggtagaggtagtaccaggaaaaaaatggtggtggtagtgccaacaacgacgtggtttgggaacagtgaagtggcggcggtttgacaacgaggcgttggcgaggataacagtggtggcatctccgatcctttggatagtataaagaacaatgatgcacacaaccactgggatggcgttggaagaaacagagtggtgggcctggttgatgaaggagctactgctatcggaagatggaaacttagaatgaacagggaatatttttagaatgttccactggaatttctgaaataaaagtattatttttgcatgagattaatataggaagaacaagggaccagcgggtaggggtgacatagtgacgatggcacaaccaccggtagtttgatggtgctaggaacaaaagaaaagaccgacttaaggaagacaacaacgtacggtcgctagatgagaagatggaattgactaagataatgtcacttagctatgacagtggcgttgatcaatgatgtagaagaaggaagatgggagtagactgatactcaccaacgatgcaaccgccatggacgacgtgtggggatgacaactgtagcccctggcagcaggacgacgtgcgtgcgcacgatgcgtcacggtataggcgcagaaatggagaggatgcggtggcactagtcagctgatgaagatggcggatggcataggcagccaaggggatgaaggcgaagcaacggactgagtcgtcggcacatccgctacatcgggacagagatgcaatggcagcttggatcaaggcggctctagcgatggggaagaagctgacgacatctcagcgtgcgttaataaaaagaaaagggcagcagcactaggaagagaagatagcaatagggtaatcaccggtggtagaaggaacttctggagttgaggtgtcaaggctgcgttgggtgctgatgctgacattgccaaggaggagaagatcgaagggagaggtagtagacttaaaagggggaatgttcgtttaagtgggccagaatgggccttgtaagcgtgagtggttattcgacccaagtgccagactgtaagcgtgtgtggggagtgagtgggagtgataaaactgaacacgcaactcctgtaaacctttttatcgatttagaacttggcggtggcgattggcggcggcagcggcggaattcgttggaaatccccgtcgatataccttgtgtgtctccagttctgaatcctagtttaggcagctatcaatttggtatcagagccctcagatcttcttggtttcttgaattcccttggtcgagccgtaaaattccatgagataggtggggatccgctgtttacagtgatattccgcaaaagccttttggggctcccttgatctggttggctagattcggggtaggaaccagcgatcatcctggagcgacctcggtataccactaagcaagcggctcaaatcatggctcaagatgggaaactcgatctcttgttgaagatgatggaggaggccgagaaggagcgggaggagatggataggaagcgcgaggagtcggaggccctgaatcttgtggagttgcagctgttgaagcttgcgatggagtcccgcatacccttggtggagaaacaggtgagcgagttggggggttctgcgaatgatttggcgaagagggtgaattccttgcaggcaagtgtggagaaatgtcagcgggaagttcagcagaacgcgctatacaaaggggaatccagccaaggaccaactcaattcccaaatgatgatgacctcaatggaaactcaccgaatcctttcctgttcacaccccaacaaggatggcgaaatcctccgcagttcaattctgtaagcccatttactcctgagaactcgggttgtccaatctttgattctggaatggctagtattggtggcaatgtcccttctatgtcttgccctcagtttgatggagaaaatccccagatgtggagagataactgtgaaatttattttgaggtctatggggtacatcctgctaattgggttaaggttgctctgctgaatttcactggaagtgcttcgttctggttgcaatctgttaggaatgagttggtagggatttcctggttggagttatgtgatagagtgtgccgtaagtttacaagggataggcaagaaattcttattagactgtggtttcatgtagcgcagacaggcagtgtgactgagtatgtggagagatttgatagtctcatgcatcagctgttggcgtatgacaatgcccttacaccaaggtacttcctaactaagtttgtggatggcttgaaggatgacattagaggggcagttatgcttcagagaccggtggaccttatggagcttgcttaatggcattgctacaggaagaaatattggaaggaagcagaaaaccaagttacaggaaatctgatggaaccaatttcaacaaggtgttttcccgacctactcagccaactgtttggccaaaaagtcctgctcagactactggagatgacaggaagctgattgagtcagggaagataaggtcttggctctgaaatcttacaggagggctgaagggttgtgttttacatgtggagaacgatggagtaaggaccacaaatgttcccaaactgtgcagttgcatgtggtagaggaattgttggaagcatttcaaggtgatatggaagaagaagttaatggacttgattcctcccagaaagactccttgatggcgcttttggctagtgcttgtaacggcacagattctactcattctttcagagtcaaggggttgatacaggggactaaattactgatgcttattgactctggcagttctcattccttcttagatgagaatattgttcagacaatgcaaggagttacatcccttccacaacctgttaaggttaaggttgctagtggtgaagttctgatttgtgacaaacaattaccggattatgcttggtggcttcaggggagatgttatagaaccaactttaaattgctttccctgcctgggtatgatgccatcctggggatagactggttacaagggctgggagtcatgagaataatttgggttcaaaagtggttggaatatgagatcaatggaagtccagttaggattcaaggggtgatgcccaaggttgatgcctgtcctctaatatctggagataaactcatgggcttgtgcaaaatgggagctcttatgcatctgtttcagattaccagtgaaaccgacatacataaacctgagattcccattatgatacaagaagtgatgaatgaattcaattcagtttttgaagaaccacaaggactgccacctaggaggcgttgtgaccattccattccattaattcctgggtctaagccggtcaaccttcggccctatggatacaatccagcccagaaggatgaaattgaacagcaagtacgagatatgttaaagtctggagttattcatcctagtgttagtccgtattcatctctggcattgctagttaataagaaagatggcacctggaggctttgtgtggatcatagactgcttaatgctatcaccatcaagagcaaataccccctgcctgttattgatgaacttttagatgaattggccggcacaggttggttttctaagttggatttgagggcgggatatcatcaaatcaggttggttgctggagaggaacctaagaccgcctttcaaactcattttgggcactttgagtatcgggtgatgtcctttgggttgacaggggcacttgcaaccttccaaggagctatgaatgaaaccttggcttcggtcttaaggaagtgcgccttggtgttctttgatgacatactgatttacagtccaaccttggaagctcatgctcaagatcttagaactgtcttgcaactcttgcaggatcatcagtggaaggtgaaattgagcaagtgctcttttgctctgaaggaactcaattatttagggcatactattggagtggctggagtttccactgaccctagcaaggtacaagatattgtcaattgggctattcctactaccttaaagaagttgaggggattcttgggaatagctgggtattatcacaaattcgtgaagaattttggtgtgattagtaaaccactcacaaacctgttaagaaaaggggttgagtttgtgtggactccggaggtgcatgagtccttcgagcaatttaagaaagctttggcttcagctcctgttcttgctcttccggattttactaaaccttctgtcattgagactgatgctagtgagatcggaattggtgcagttttgtcccaggataaacaccccattgcttatatgagtaaggcattgggtcctcgtactagggggttatccacttatgaaaaagaatgcttggcaatcctattggcaattgagcattggcggtcctaccttcagtatgcagagttcactatactcactgaccacaagagcttgatgaatcttactgatcagcgcttgcatactccttggcaacaaaaggcctatacaaagttgctagggctgcagttcaaaatttgttacaagaaaggaatccacaatgaagcagctgatgcccggtccagatgtgaccataactcttctttggaggtggttgctatttcggtttgtaagcccacttggctggaagaggttgttaatgggtatttgaaggatgccaaggctacttagttactgtctgaattagccattcactctaaggctgactctccataccaacttaaggatggtcttattcgatacagaggacgaatctggttgggacagaatattgagttgcaatagaaaatttttagtgccttgcatgacagtagcatcggtgggcattccggatttcctgtgacttatcgaaggatcaaggccctttttgcttggcctggtatgaagaaacagatcaagctcaaggtgaaggagtgctctatttgtcagcaagcgaagccggatcgttctaagtaccccgggttattgcaacccttgccggttccattgggagctggcaaatgtcacgatggattttatcgaagggcttccaacctccaggcgattcaactgtattatggtggtggttgataagctatctaggtatgcccattttttacggctagctcatccattatctgccgcagacgttgctcagttgtacatggaaggagtttttagactgcatggtttacccctggccatagtttctgatagagatcgcatctttactagccacttttggaagcagctgtttaacagtgtgggcactaaacttcatatgagtactgcataccaccctcagacggatggacagactgaacgtgtgaatcagtgcttggagacttatttgcgttgttttactcattcctgtccaactaaatggtccacctggctatatttgggctgagtattggtacaatactagctatcactccacactgaataaaacccctttcgaagtattgtatgggcatattcctaaccaattgggcattactgttaactcttgtgaacttccaaatgtccagcagttgttgaatgaatgagggttaatgatacaactcttgcagcaacatttgaacagagcacaacagtttatgaagagccaagctgacaagaaaagaagttttagagcttttgcagtgggagattgggtctatttgaagttacagccatatgtccaaacttcagtagcagccagggctaatcacaagctgagtttcaagttctttggtccttatgaaattcaagagaagattggtgttgtagcataccgtttagtccttccggcgagcagctctattcaccctgtttttcatgtctcgcagctcaaagcagctcaaggttttaaaggggatgcttctgttcatcttcctgttcagtcttctactaaacaagttcctgtggctattctggatactagggtgcgcaagtcaggtatgtctgttattcctcaggtgcttatacattggtctgatgatgtgatcgccaatgcaacttgggaagacttggaagatcttcgtactcgtttcccaagagcactggcttgggggcaatccagttttcaaggggggaacattgtcaaggctgcgttgggtgctgatgctgacattgccaaggaggagaagatcgaagggagaggtagtagacttaaaagggggaatgttcgtttaagtggaccagaatgggcattgtaagcctgagtggttattcggcccaagtgccagactgtaagcgtgtgtggggagtgagtgggagtgataaaactaaacacacaactcctgtaaacctttttatcgatttagaacttggtagtggcgattggcggcggcggaattcgttggaaatccccgtcgatatatcttgtgtgtctccagttctgaatcctagtttaggcagctatcatgagggcgagagggtggcaccattccacgatggcagcagcacctctgcacgaaggcgacaacgacaacacatgggagaggaccggggattaaccactgatgaggacattgaggtggcagctatgttggaaactgggcaacgatgatattgtttgtgatctgcgaatataaccaaaatggttttctcacactagatgatgattagggaggaagaacgtgaaagcggcgcaggtgcttaccacgatagagaggtggcagcaatgccgggtggttgacaacaagttgatggcgatggtggatggcttgatggaagacggcgcaggaagtggggaagacgacagaggtggatggcataacagtgctgcgccattcgctggtaattgagagatctcccaacgatggtagcagtgctggaaatgagacgaccatcatgccggctcgatcttcccatggagcagctcgtgcttgcgatgacagcggcaacattggtgctcactcgatcggactgcaacacaaccgcgtctactcgatgtcccgaggcaggaacctaggccggattatagtgagcagcaatagcagcaagacatggtccggtggacgacgatggagagagaggcggcagtgcaagttcgcagcgaacggccggtggagggatgcaggcgtgtcgccggaggtgaggaagatgcatgggaggtggccttggccttggtgttgaccggcggcggcgacggcacggtgtggcaggaacggtggtctgcaaagggaaaaggagggggtgctggatctacttatagaggaggacagggagttgagcggccagccggaagatgtttattcatttttttagctgagacgatggaaattgaggtgactgactgatgatggttactcattttttggctttggtggagaaaattgatggaggggtttcgccggggatttggctggtgatgtgatggcacggccggggctagctgaagcgcgcaggcgggctggttcgaactgcatgcgaggaaatgagatatggggcttcggcctcctgctgatgggacttcggcctcctgctggccagaggaagaagatgaccgatcgagaaggaagaaagaaaagatgaacagccgggagacaagatccaactcatcaaaagagattcaattttcggcattcaacaagtgaaattgatgatggagaggaaaggattagggaatttctgttagcttcagctataatcatgtgtcgtattatcggttactgtaacgtgtctagtgttgtcgtttcttcagtttcgtcagactctgtttcggcgtctgtttctctgtttctttttcctgtaagccgagtcttccgggtcgtgcgtcgtgtgcgagtcatccggatttcagtgtcgtggtcgcatcgtcgtggatgatggcgtagtggtgtcagtttgagtctgtacatatttgctatatatatgagcatcagaaaacgtcgctggttggttcgcgacaccaaaaactctgttcgtgttcatcgtctttccaattcagagaattcgcgtgagagagagagtgaggattcacaatcttgggctttgctatcatttggtatcagagccatgtccgctcccgccagcggttcgtctcgcactcaccggcgaacaggccgccggctctcgccgtctccgccgcgcgtgagcgggcgacagctcgtcgtgcagcggattgttaaggaagatggctccgtctactatccaatactcagacgctcaaattactccgattgggcggtgttgatgcgagtcaatctccaggctcaaggtctgtgggatgctgtcgacaccggcgatgtcccgtatcaggaagattgccaggcgctttcagccatcttgcgagcggtgccggctgagatggtccggccgcttgccgagaaggacagcgccaaagacgcctgggatgcgctcaaatccatgcgagtaggcgcagatcgtgttaaggagtcccgagcacagaagctgcgccaaacttttgagtccatgcgattcaagaatggcgaacacctggaggatttcagccttcgtctccagtccttggagatgatctgtctgaagagaaggttgtttgaaaattgcttcgcgtcgttccccggaggtatcgccaaatggctctatcgattgaaaccttgattgatctcactgtttgatgaatttttataccaaaattcatagaaaaaataatatatcattgggcattaatttgcagcccaattttacgaaatacacgtgaaacatgtctctacgacatgtgggaccagaaaattcaaatatcatacaatgttcaaacatattcaaaattggactcgttttgttgtatgttttgattggaaaataatggttccaacagaattcatatttgatatatgattagggagatataaacatttgaaggagatcaaccagtgttaacctcgtatatccttaatttgtttgctgctcctcaccggttggtaattatccttatggcagtgtttggcaaatgtctaaaggaaatgatttcccactcatctttaaatcctaaccatttattctccctcatccatttaatcctaacccttcattcatttcctaatcccaatcccacccctcatttcccattatccaaacacaccctatgaggtgtgggatccaccgtcaattagccaagttaatcctcgtgattatctccagcacacacacgttctttttatctggagcacaaaattctttttatcacgcgcaggtcgttggattaacagacgcgctggcttatccagagaattaacgcttgatttcgctggcttgctgaaatctcggaagggattaggcgaggactccgtcgcctctactcttatataaggcgctgtccctcacgacgcaggaggtgggagaaaatccccggcgcagaggcggctggcagaggagaagacgtaggtaggcaactatgctgtgtgctctgatctgcttatagtttcacaaacccatatccaacatatacacaatttacacgtcgtcaccgagaagcacacatagacggcggaccgctgcgcggctcagcagcaatatgccttagagagccgccggcgctgatggcatctctgccggcgagtcgtccgtcctgaataacaagcagatcgatcttgtttttcgtcaagaaaatatcatcagtggtgtgcagacgagtccgatcctcgtggggttggaccgtctaagttatcaaatattggagttggatatttatttgtataaacttaggatgagtttgagccttattggcatcagaccaaccatgatttacacatatttatattctcgttcatgataaaaaatcggatgcgcatatttataaacttgggatgagtttgagccttattggcatcggaccaaccataatttatgcatattgatgttctcgctcatgataaaatatcggatgtgcatatttacttgtataaacttgggatgagtttgagtctaatcggcatcggaccaaccatgatttatacatatttatattcataccggaacaattatagatttgccttgtgcatgtcatgtgcgggagcaattccttctctctctaaattctaccagatggatgggagcaactctcaaaattcttgaagacaacaaaaacaatgctcgccaggagggcaaggcatgcagatttacaacacacgtcgacatcatggccgagtgtcgacgagatgaaatggccaatttatcaatatttgtgctatgtccgagaccgacgagtccggataacatattggctaaagctgacaaggctgcagtcattaactcattccatttgtctatgaccgacgaggttagatgaaaccatggccgagtgtcgacaaggccaggtcactatactattaacacgtctaaaatggacgggaactggatataccgttgctgggcaccgacgaggcaaaagcaatcacaaaatccatgtttgatgaaggccggggcacatgagtgggcaccgatgaggcaaaggtcacccgcttcaccaaattccctccgtatactaacatgatgatagtgtattgtgactgggttttggcaaaacaaagccatcagttccacattcactatattcaccgttaaatctgaaccaacctcaaccttcggcgagcaaccaaattttgatgttgacgatcacaaagcgcagcttaatcggaggtgttccataggctcgctcctatagatgtaattaaccggccgcctcattgctagcgccgggaatcagcggactgcacggaatctcctgtcaagatacctctccattaagcattcctcacgaaggcaaaaggcgaactcctacaggagccctcatgtatttgtaaacattcatgttaatgaatcatgattaataaaaaggcaatacagggtttccctattttctgtgtgttcgttgttttgttttcatcaaacactgaccttgctttctattgaggatctgactggccggcttctcaccgtcgacgatcaccccgactctgatggcgaggacgcgggtcaggtgctcttcagcgaaaaggaggcccctgctcactcaaacaaggaagctgggcagaactcagccggggggagggcgtccagctcacggcaaccacaccgcagcaggcgcgagcgcgacggcaacggctccgacggcaagtcaggttcgtcccaagcggcaaaccgcaatgtgtccaaggacaaatgccggtactgtggcaaacttggtcactgggccaaggactgttgcaaggcgaagcgagaccgcgagaaactggctcaggcaaaccttctcatcaccgagcctgctcaagccgcggacgaaggggagccgacactgctgatggcgcaagtgtgcgagcttgcccctgctaccgatcctgtcattactgacggggaggtgacactgaaggaggaacgtgctcacgtttctcttcaggatgaaggaaagcccgttgatctagactggatccttgacacgggcgcttcaaatcacatgacgggctaccgtgatgtgttctccgagcttcacaccaccgtgcgcggcactgtcaagtttggtgatgcgtcgagagtctggattgaaggacgaggcatggtgctgttcgcttgcaagaatggtgaccactgcgcgctcactagcgtctactacatccccaagcttcggagcaacatggtcagccttggctagcttgatgaggcgcattgcaagacggtgatcgaggatggtgttctcactttgcatgatccacagcgacagctgctgtgtagggtgcgccaaggagttgggcgcctctacgttctccacgtcgagctggcgcaaccggtttcccttctcgcaaaggggaaggatcaagcctgggtctggcacgctagatacggtgtcacgcccagaaattttcgaatagaattccaagcagaatgtgcattaaaatccccgtccaggaccggccggggtacacaaacgacaaagttgacatacagatccacgtcttacaaacattataaaagttttacataaatgcagcggaaaaacaaaagataactggagctaagccttgacttgaactacagcgggaacaccactccacaggcatcctcgatggcacggacgaagcctactcctcggagaaaccaccatctgacgcatactcaaactctggggtttggggaaaatagagcaagactgagtattaccaactgtactcagcaagtcataccggaataggggtatgatgcagggaattatcaagggatagctataatggttcatttgcataaaacgagcatttataaacagaagttgaaagcagtaaagcagttgtaacaattaatcaatattaatcatccactgtccaacgctataccacattgcaacaggcccaaccatccacctatactatccaatttcattagactaaactagggtgagactaatcacggtgaatctggttgatcgcccataaccacgggcacggccatttgaatagttttactctgatcagaggtgtacaactgtacccacaagacacaaccccacgacacgttttcgtgcgccggcatgccaccacgacatactagaaagaggccgtgacaggacccttcgcataaccccctctaaccaagcacaccacacctcaggtttcacccccactcctcgcaaggccgtgggcagtcccctctcgtgcctagatgaatccggaagccgcataggccatcgcaggacccatccaaactccatcacgcccacccttgcctggatgcgtcaggtagaggaaagctacactacaagcccagccgttgcccacactggcttgtggtaagtatgataagttcttacagggcatcccgcgaaccggtccttaactgctatgggtgcgaccaacaaaaccatgcacccacagcccaccatgtgatttattttaattaaccaataccgaagcggtggcactaatccaacattaccattagaatctacagtctatacattaataggattttcccctttgtgtgctagttgaacaaagcatggctaagcaatccctagtccaatatctagtcatgttataacccaagctaacaaaggagcatggtaccaaaatagcatggctgtaacagtaggtaaacatcacatagtattattgtaaaacaatgcagtatttgaaggaaaacattagaacatttgcaatataggatcaacatgttcaagtgaccggcatgacttgccttgctctactgctggaggaacctcgacgactatctcgaagtacaccggagcgtcggaagagccggaatctaagtgacatacatagcaaacaatacaaacacgctataatactactgaaacagagaacaaaaccaattttaatggattctacatatttttcttgatttactaagacttgaatgggtttaaacggagctcggatgaattagttatgaattttagaagattcactgtgtttttactataaacagaaaaatccttaattgaattattgcgcaataaatgcccagggctgacgtcatcaaagggagcgggtggcgccgacatgcggggcccgcatgtcagcggcgcaaggggagagggagggggcgccggcacgtgggccccacgggtcagcggcacaaagcggccggtccaccgtggactggggccacgcgggtggtccaccgccggtccacgggaccgacggtccggatcggcctcgggccgatcggacggcgcagggagcagccgccgggcttggctcggcttcaaagccggccggccggccatggctagaggcggcggcgtgcatgaccaccggcggcgaccggcggcggcggacggcgcgaaggcggcggcgcacagccggagcagcggcgcggccaaaagcaatggcgcacgcgggaaggggaaggaaaggaagggggagggattcctcaccggaggggacggcggcgaccggcggcagaaaacgagggaggcggcgaagtccggcgatgccgaggtgcggacgagtgacggcgacacctaggggaggggaggacaggaattagcgcagaggaaaaaaccccacggtggccatccatgtcggccggagtcggaggggagaggggactcaccggcgacgcgagggaaatgtggtcttggtgggatttcggcaacgcaaggcggcggctgggaaagatcttgcggcggcgaagctagtggtgacggcggcttagcgcggcggcggctctagcgggggcagcacgtggccgtagtgcggtggcaagcggtggcgctggcggcgagcggcgcgagctcggtaggaagcacgggagggagcggcgagagcggaaagggaaagaggaggctcggggcagcgatttataggtgcgggatgggtggaaacggccgggaaagcctcctttttgacctgcgacgtggggtggagagagagataatggggggattcaaaatgcgaatcccgccccttgcgagcgcgcgcgcgggccgggagacgcgggggagacggcggcgacgtggggaggacgcggggacggcgcggcgtgggcgcggcaggagcggaggaggtgggtgcggcggtttcggcggcggttgccgacctggggcgggcggccggaggaaggggacgacctcgacaggtgggacccacctgtcggcgtcccggagagagagaggggcggcttgggccggcccacaaggaggaaaagagcgcgcgcagcggcgggcggactaggccgacggcccaagaagaggaaaaaggagggaaaagaaaaagaaaaggaagaaaggatttatcctgggatttaaaattgcatgtgctcaattttaattggttaaaattatttctagggctctcaaaattccactaaaaatcttgttagcaaatttcgacatgtagaactcaagaaaaattccacatgccaattccgattattatttgcattggtttattagggtttactcttgcttttacaccgatattttcttgggaccatttataaattcaatttaggcttgggaggagaacttcagggtgtgacaaacctacccccttaaacggaatctcggccccgagattcggaggagctggcgaagaggtgcggatgggcggccttcaactcatcttctctttcccaggttgcttcctcctctgaatggtggctccactaaacccggcaaaacctggtgaccttgtttctagtcctcctttcgctggtctcaaggatgcgaactggcttctccacgtaggtcagatcttcctggatatcgatgtgctctgaatcggcttgttcttcgggtaccctcaagcacttctttaattgggacacgtggaacacgtcatggataccgatcatattgaatggaagttctagctgataagcaacttctcctcttcgttccaagattttgtatggtcccacgaagcgtggtgccaacttgcctttggtttgaaaacggtgtactccccggagcggagtaacacgaaggtacacgtaatccccggcttcaaaagtgagctcccttcggcggttgtccgcgtagctcttctgtcgagactgggcaattcttagcctctctctgacggtcctgactttctcttccgcttccgttagcacttatgttccgaacagttgacgttcgcctgtttgatatcagaagagaggtgtgcggcacttccggccgtacaacgcttcgaacggtgccatttgaagactagcctggtagctgttgttgtaagagaactccgcatacggcaagcttttgtcccaagctccaccaaaatcaagtgcacaagcccttaacatgtcctccaatatttgattgactcgctcggtctgaccatcggtctgcggatggtaggctgtgctgaaattcaaccgggttcccaattcctcttgcaatttctgccagaactttgaagtgaattggctccctcgatcagatactatctttttgggtactccatgtagacacatgattcgcaagaggtagagctctgccaaccttttgcccgtataagtagtgtgcactgggatgaaatgagcgactttggtaagccgatccacaactacctatatcgaatcgtggccagatcatgtcctgggcagacctgttatgaaatccattccaatttcttcccatttccattccgggatctgaagaggttgtaatagtcctgcgggcctctgatgttctgttttaactcgctgacaaacatcgcagagcgtgacgaattcagctatttccctcctcatgctggcccaccaaaatttttatttgagatcttgatacatcttggtactacccggatgaatggagtattgagtctgatgagcctcggtgagtatcagatccttcagctctttgtcatcaggcatgtgcaatctttctcccatccagactgtgccatgttcatcctcaaggaagtcccgggcttttccgaccctcatattctttttcagttcagctatctcaagatccgtcacttgagctgctctgacttgatccacgagcgtaggccgtgcttctagagtggctacgaacctgtgttcaacgattcccacgttgagacgttcaagctcctgctgcaattcttcacacatgtcctcggtgcatagggcattgcagtagcttttcctgcttaaagcatctgccaccacattggctttacccggatggtagtgaatgctcatgtcataatctttgattagttccagccatcttcgttgtcggagatttagatccggttgggtgaagatgtatttcagactcttgtggtccgtatatacttcacagcggttgccaatcagatagtgcctccagatcttcaaagcatgtaccactgctgccaattccaggtcatgagttggataattcccttcatgtggacgcaactgccgcgaggcataagcgaccactctgccctcttgcattagaacacatccaagcccgtggcgagatgcgttgcaatagactcggaagtcttttgtctagtcgggcagaatcagaactacggcggatactaatttcttcttgagctcctcaaaactcttgtcacactcagctgtccatttaaacttctcatctttctaaagcaactgagtgatgggtcgggcgatcctggagaagttttcaatgaatcggcggtaataacccgcaagtccaagaaaactctgaatctgtgacacggtcttaggtggggtccatttggtaactgactccacattcgatggatcaactgccacgccttgagctgtaataacgtgacccagaaatttgacttccgacaaccagaagtcacacttgctgaacttggcatataactggtgctccttcaacttctcgagtacccgacagagatgttgctcatgttcttcttcggactttgaatagataagtatgtcgtcgatgaataccacaacaaacttgtccagaaattccatgaacactttgttcatcagattcatgaagaatgcgggtgcgttggtaagtccgaaagacataagcgtgcactcatacaacccataccgagtggtgaaggctttcttcggaatatcctcttcccgaattctcaactggtgatagcctgatcgcaggtctatcttagaaaacactttagctcttttcagctgatcaaacaaatcatcgatccgcggcaaaggatatttgttcttgattgtgacctcattgagtgcgcggtaatcgacacacattctcttcgtcttgtccttcttctccacaaaaatgaccggagcaccccaaggtgaaatacttggtcgaatgtaccctttctgcagctgctcatcaacctgcttcttgacctctgctagctcgttgactgccatcctgtacggtctcttgtaaattggagcggttcccggtgccaaatcaatccggaattcaatctctctcttgggtggcatggtagtgaggtcttcagtaaacacttctgggtactcgcagactatggggatatcttccaatttcctcgaactcttcccctcggtgaccactgggatttccacctcaatctgattcaaggagaccccttgctttggtgagactagtgatttgtgttggcaacattttgtgacaagtcgacaagcacaatcgcaacacctaaacgccttgcggtgacatggagtcgccaaccacctcgatctagccaaaggaccaaatcaagatgggttttgtagaaagaaaagctaaaccggctagcggagccgatttagagatcaaaatcagcctctaggccgatttagatcgatatgaggataactacccgtctcgtgggcaaaacggaagttttacaggacaaacctacaaagaggtgtcgcactctcgctgcggcggcggatggtttacagcgcaaaccgacaaagatggactaaactagggtaaaatagaaaacatagttaaaaaacgattcaagtagattgtattcgggggttttacaatgaaccggccttgtcccttatataggggttggtcttgccctctacaggccctccttcacgtccaattcgggatagaaaccaatggaaacacgaaacatgccttcctgagcaaggaaacccgagacccgacgaaaacagagtcggactcagaccctcacggtctgaccgcctacataactgcggtcagaccggccctactagccggtcagaccgcccacatacctatggtctgaccggccctagtgaaggaaacccgacactttccaaactttggcaatttttccctatttcgtccataggtgccaaatttgggtgtaaacacatgcccccctgcctttttggtgaacatacgtgaacctaaaagcatagaacatgttatctcagggcgataatccaattaccggccataggacttcctaagcatcttaccaaatgctcgggaagtatttcttcaagctatttcccattaattgctctttgaaaacaccgtcttgaagtgtcttcatctccttcaaagtctttaaacgcttgtcgatgacgtcttcaaaattgcttcccatcaaggtcttgtaatcgtcaaccgacaagtcgtcttgcttgaaataccgaagagagccaagatttacctcaactggcaaaacggcaattttaacaatgttttattactcgactcggcttatccattagcctgagcgtagtaaagagaagaactcaacaacttaatatcataagattcggcaaaacttctcacttccttggacataaaagaagctcctttaatgtttgaggaataccgaatctatgaacgatatgcttcaaaataaagccaattacctccgtagtaatattctcgagcggcacggcttcggctcacttagtgaagtaacccattgcaactagcacgaaccaatgcccttttgatgacgaaggataaatttgaccaatgaaatccaaagcccaaccttggaacggccatggtttgatgataatattcaatatagtgataggcgctaatttgaacattgtcgatccgttaacaagcttcactccctctatagcatttgaaacaatcatcaattattttcggccaatgaaactccactctcctaagcaaccaatttatcttacggccgattgatgaattccacgaattccttcatgtacctctcccatagccactttagattgatcttcatctaagcactttaacaagacaccatctatgtttcggcgatacaatatttgaacacttgccaccgaatctttcgatcaaccttaagtgtaggatcttttaaatatctaatcaaaggaattctccaagctatttctaactcatgggcacaaatgtccgaataattaattcggccttttaatcaattgtaacgtgccccccagcctcctgtctgggatcggtcagaccggacacgcaatgccggtcagaccaccctgtctgcccggtcagaccggccatgcagagccggttagaccgcgggtaccaccagtcagaccggccgtgcaatgccggtcagaccacccctgatctatgactttgccaacttcatccaaacttttgaaatcaagcatcggcctttagtatataatttttcttcacataatagccagatgcttagtgtatcaaattattggaccaaaattccttctctctatacatatgaaaaatcataacattcaactaatatgtctagatgaatactaattcaattggctgttgaaacaataatcatcatggcatcacaacacttagccaattgaagtatgatcaataatgaatcaccaaagtcatatgtgtcacatgcatagattccaataaactaaaaatgtaagtaatcggcttgagcatgtatgcaaaatattaacaatgccaatgttcctaaagaaaaccactctagagcaaaccatcacagtgaccattgatattagccgaattactagtaggcaaaactttcatggtgcaataaatatgaaatctatatcttatatggtgatccataaaaacacatatgatttggctttaaataaatatcaaagagtcatgagccaaatcatacctcaaacaaattatatgccatcctaccaattctacttcctagaactggcatttgcaacatgtatgtataatatcaatttgataagcaaaaacacacatgttctagatagcaagcaatattctaataacatggcataggcatataatataatggtaaacacaataaacccatatcttgccttagcatccaacaaacggcggctcaaagatatgatgtcgtatccatcgccgttcatcttctcttggttccttcacgagcatattaatgtcttgccccccaagcaaaatcggctttcttgattgcacgatttcgaaggcaagatgaataccgtactaacatccatagcatcatgtgaaggagacttatctctaatgaccgatgattcttctctcatcaaattggatttatcactactactatgggaaatcaccggtctcttaacttttacttctttagatctccacacttgcttaggtgtcgttcgaagctctaaattgttacatgttttgttctccacatctttggcctccttttctttttgacctatggcccgaagacgctgtagcctcctcttttgagagcgagataagccagaaggtatccacttcggctgtggttgttttccaggagctaaacaatgattcttgatattttttgtcgaagtggaagctcctatgttgctctcaattttcccactcttctccaatgccccccggtcagaccggcctctgagcccggtcagaccggccacaagccgtcggtcagaccggccggtaaggtcggttagaccggccatagactggcggttagaccggccagctgtctcggttagacccccaatgttggcagtcacggcatcagcttcaatctcctttgcctgcgtggtttccaccgcatctccagtaggtacatgaacctcttgagactcctctttggcagcaacgacctccggagctttggcttctttcctcacccacaccttcttcacctttttcatttttttcacctttgatccaccggaccgattctcttgtggaaaacagtcttgtcttgagttagatgaacgatttggcactgtcctaggtgattccttccactcctgataatgcggcataagtggttgatgcatccacggcacgtaatacataaaaggataaccaaacggtgacattggatatggataccatggcatcacaaccggaggtttatatggagttggtatggttgatggctccgattgctttaatgtttgactaaatctcttcctacgagatgatcttggtcttttcgaatcactagtttggttatcaaatcgttaaccggctaatcctttcttgtatttagccataagcatctcaaaagtgagcttcggctttttggtcttttgggaattagatgacccatcctttgcaactttatgatattcggcattcgcattttttatcctattcttgggccgaagatccccaataataacacttttccctttctttttgtctacatcaataggactaacagggagagaatcactaacaattccggtcttaggcatagatgtaaccgaaatagtttcacaagtgaccggtgaagtatcaatcggtctttgctccattaagcttgcatctttgaaataaccatgaaactcatgctccatttgtgaccatgtagaaattgaattaggagcaagtaaactataccatgtagatgcaaagtttgacaaagaaagaggaaacaactttaacttaagcaaatcatcattaccggccttaccacattgatcaataaattggccgatatgctccattgttgttctagcatcctcacctgtgaattttgtgaagttgggcaccttaaatccttgcgggtatgggaccgaatctacgtgttcaggatacgatctttgatatgtatgcatagttactttggattctatctcactactatcctgcaagacattgtcactatcttttccaacatctacatgaccgatttgtaattcggtcttaggtgacaatgctatttcacttgagcttgtaatacaatccgaaccgtcatttagttcggctatatcttcgatggcattattctctaagctagcaacacaatccgaaccattacttggttcggctattccatcattgtctaaactagtgacacaatccaaaccaacacttggttcggctatattgattattgcgttatcatccaaactagtaagacagtccggaccaacatttgattcggctatacttgtcacggcatcattgcacaaattattaacacaatccgaattatcgctaggttcggctatacatgttattgcactatcatctaaactagcatttaagctattgtcatccactcggctttcctgagtcagagcttcatgcaacacatgatcaatatcaagaaatatctggccattcaatttctctttaatagaatcaagcaatccatcatatgaaatgttggccaaatctttgtcagttattttcaaactaaaacatcggcttttaatttctctaaacctttcaatataatcaacgacagattcattgtatttttgcctaaccgatgttatatcagacaacctatgctcagttttaccagtgcaaaaatgatcatgaaattgttcttctaattgagcccaagtatgaatagaatttgccggtaaagaagtaaaccatgtaaaagcattaccggataaagataaagaaaacaagcgcaatttaaaagtatcactattagcctcaccacattgcgctaaaaattgacctacatgctcccatgtggtcttaccatcctcaccactaaatttggcaaattcgggaactctataatttctaggaaacggcacattatcataataatcaggatatggctttttgtaagctctagcacgattcctagtttcaatcccgaatctatttctcataatatcactaatcacattctctatgttattaggcccttgtggatttggtggtgggtttggtagcctaataggctgggtttgtggcgcaatatgattatattggccttgcctagtatcgggaggatatcccctagaaacatcattataagcattaggaatatgtgggggaacttgaggattaatagtagcagtagatacaggaggatcaaatgttctaaagtggtacaaataactagcgttagtcgttggatctataccctgaatcgggacaattgcaccggtctgaccggcccagggcccggtctgaccagcgtcctgttgcgcggtcggaccggcctgagagccggtctgaccggccgtctggccggtcggaccgacggctatgttatggtctgaccggccgtcaggcccggtcggaccgaccgtgaataccgtcgcgtcggttttactacccatcggatctataggagattgatcaacagtggtataggctttatcctttaatgtgtaatcatccataaaagcacctagcctactccttaaaaacccatcaaccttctccttaaacattaaatctaatctatctttaaaattagccatagatgaatcttttgtagatgcaatttgttcgttgatagattgcgatacctcgtcattacttaccacgtcgggagcgagcataggacgtggcccgggcttgatgatcacaacttgatgagtcctagtagttaatctcatcaacgcctcccgtgtgagctcgttgatgtactcctccacagctttacgatcctctccttcgaagtcatccaatgtgaccggcatcacattagatggctccacctccgttctggatgatggcttcgtcatggcgaagtcgaagtcgagttgacgatgaacggatctcgtccccagcggagtcgccaaaaatcatgttggcacctttttgtgacaagtcgacaagcacgatcgcaacacctaaacgccttgcggtgatatggagtcgccaaccacctcgatctagccaaagagccaaatcaagatgggttttgtataaagaaaagctaaaccggctagtggagccgatttagagatcaaaatcagcctctaggccgatttagatcgatatgaggataactacccgtctcgtgggtaaaacggaaggttttcaggagaaacctacaaagaggtgtcgcactctcgcagcggcggcagactgtttacagcgcaaaccgacaaagatggactaaactagggtaaaatagaaaacatagtaaaagaacgattcaagtagattgtatgtcacgaccggaaataacccaacgggcgttccttacgtgagtgcattattccttgtcccaggaggcaaggtacaccaaaagttgatacagatcagagttcaacaagcggaagcgtaaatagttaatttattacatgggcagcgaaggcccagcacacacaaagacaaacgagaaacagcggaagactagggcgacgaccacaggcgtttgacggcaggcacgagctagacaccaaaaccttcatcttccagagactcctcttctgggtttgggaaaaaaattgagcaagactgagtacaaccaccgtactcaacaagacacacccacaagtgcataataaatgcaagggagtacaagggagttataatataaagggttagggttgcagtaaacagcatttaaagatacttagttgctcaaagctattttgtaaacacgattctagaactatacaatattatttatcaaggccgtgaacccacacgaacctgccttaacccaaggcctacgatgattcagaccgaaccggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacatgcaaccacgtgccacataccaccacggtatacagacggaagacgtgacatagtttccaacccatcctagccatagacaagagtaccgacccaatcccacctacggccggaacccccgggacaggtaggcaggactgagcccctagcagcaggacaccgaccctgtgccatgacatctcgactaccgggccgcagctcgtgtagccttcatttgccctggagatgtccatcgacccccgacttcgtccatctccatccgtgtacttttgtttataaccagactgagccacaaactaagccttacccactagacatgtgaaagtacggtagtgctttgcaacagaggcccgaagaccggtccttatttggccgaggtgctactatcaaaaccatgcaccccgagcccagcctaaaaccatttttggggattttgaatagagggggcggtgtgaatccaattccacaatactccaacaattccaaagtgtccaggtgatatgaatatcccaaagtctagagttgtaaaaccgcctaatgttacctaattaaatagcgaagcatctacctaaaatcatactagtggtaccatgagtagagtgtccactagctggggttttgtttattctagggtgaacaaggaaataataacaataacaataataaggtcataacaaaggtaaataggcatggctagataaaacagtgataacgcgggaatttaaataaagcgataatgcaataattttaaagcaacataattttataaactgggattcaatatgttcaaggatgatgtgacttgccttgctcgctttcccaaacgccggcttcaacttccacgaagagcggatcttccaaagctgcagcgtctacacgatcaacggaaaagaaaaggcttttactctaataaactccatataacaagcagaaacaaagcacaaaaatgggttcttggcttcttaaggaaaaattagagacttgaacggtccaattccgagttcaaatggccaagttatggccatttgaagtttatatgctctttaaatggatatttatgaatttcttcatttaaattttaatttaaaatcggatttattgcgtcagccgaggggaggggcgcgcggaccgggtccacgggagtggggcccacgcggcagcctcacggtccacggtggaccgggtgcacgcggcttacgccggccggcgccgtgggtcccacgcgtcagccgcacccgagggcgcgggcggctgacggccgggccccacatggcagccgcggggcgcgcccgaaggcggccacgccggcacagccgacgggaggcggcgcacccgcgccccgatggtcgccgccggcgaccaccggagcggcggagcggcgcccgagagaggggagggaaggggaaagtgaaacggcggtccacggctcaccccgggtcgacggcgacgacgggaacggcgaccggagcggaggaaggcggcggcgcggctcgggtcgacgaggacggcggagttccggcggtcggcgggcgaaacggaggggtggacgaggtcggcgaggttgcggtgaacccgaagaaggcgacgccgaaacgggagagggtccggggcaacgacggcggcggaccggagctcggcggcgacggcagagagagagaacgacggcgcgagctcgattccgaaggggacagagagcggcgagtggcggaaacggtggagggaggcacggggagtgtttatatagtgttgggagggggagagaacggccggatgagggggaatcggccgcggaaggtccggccgccattgatgcgccggcgaagttagggggaaactttccgaacgaatccgagggagagagagagggaaaagtggggggaaagagggagggaatcacggggagtgatttccctctctttattgcgcgcggggacggcgggaggcggcgggattcgcggcggcggcggcgctagggcacgggcgaggcggcgggagcagcgggaggaaggggatgacgggtgggccccacccgtcagcgagggtggcgggcgggcccgcccgtcagcggcacgcgcgcgcggggagggggccgattgggccgcgggggagaggagagagagggagggaggtgggccgagccggcccaagagggagagggggagggaaaagaaactttttagggtttttctttttataaaacctttttaactttgtttatttcttcttaattattatttgtgctctgaaaattccactaaaatttatttacgcattttaggcttttaggaaatatacaaaaatcctccaagccttattcgacttttaactttgcacattttaattgttggaggctttcacatggattttacttattctatgcacaattttgaggatgtattttagagtcgttttgggacacgacagtactaagctcttcttttcttaacccatgcatccccacaaatttctttgaaatgaaagaatgcgttgcaccagaatcaaaaagtactattgcagggattgagttaacaggaaacgtacccagtacgacctctggtgctgcttgcgcctcctctgcggacgcgtggttgacacgagcctggacaaaccttagcccggcacgccttggcttcgggcatttgtcagcgaagtggccaagctcgccatagttgaagcaggaccctggctttgtcccagcctccatcttggcttgagcggatggaactgactgtgctggtgccattggtgggcgcggagctgcactgaggttgggctgacctccctggtggttctggctgccactggcgccctggtggaagctgcttgagttgaaagggcggtgctggaggacgatcatggtggtaggtccaccttgctgtccgggagtgaagcgcggttgctggtggctcccttggttggaccggaactgcgccgcctttctcttcctgtccattttgttgcgctgatcctcctgacggattgccttgtcaaccagcctctcaaagtcggcgtagtctccagagattaactggttggtcagctcgtcatccaggcctcctaggaacttctcctgcttctctgcgtcagtgcggacatcctctggtgcatatcgcgctaggcgattgaactcatggagatactcagtcactgtcctgttgccctggtggagtgcccggaattccctcttcttctgtgccacgaccgcgtctggcacctgcgcctttctgaagctgcgacagaactccgcccaagtgacttcagtgcctggcgggcgggtggccatgtgattgtcccaccaagctgacgcggaaccctggagctggtgtgtggcaaaggcgaccttctcctgatcattgcactgcaggagatttagtttcttctctatggcatggagccagtcattcgcctccatggggttggtggtgcaagagaaggtgggtggcctgacgcgtagaaactccggcaacttggactgagggggagggggaccaaactgctgctgctgttgctcgtcttgctgctgcatcctctggtgcatctgctggtgctgctgctgcatcatggctgccatcatctgagtctgatgagccattacttgggccagagtcggattctcggggagtggtggcggaccattgctggaatcgctgttgggatgcacaccgtcagtgcgttctttgccgttgctgccctcgcctgttgtgcggctaccattcctggtgtagaccatctggaggaagagcagacgggggggtagaaaagaagaaaaacagatgctcaggaactaagctttattatataggaatttaaactgcaattgttctgatctgaattaaaacacttaaaacagcaagcaaaatccttattaagacagccatatcataggcacatgatatcgaccgtcgactgacccacaagcgagcagacctaaacacacaaactaacaggcaaatactaaacagtcgataaactaatggaaagcgagcctaatgctcggaacggctcctgcggtcggtggagtcgaaggcgtcctcctgcttgtcaccaggtccctctgagcggctcctggagtctggcagatacgtctcgccgctgcccggctctgagccactggaactgctgctgctgtggtcgcggctgccactgggagtggcaggcaaccaaccgccgttgccactggctgggcccctgacggctgatgctggagcgaaggagagagcggacacgggagctgacactggaacatgagctgggactggctctggagctgcaggagctgcggcaactgtggggcagaactggaggagctgcgggagctgcaggcggaggtgggttcctgggcgcaagttgaatgcacacgggtgccgtcgtcgacttgccgggcgtggtgcggatcaggactcctcttggcgcggggagacccttcaactgagcattctccttcttcaggcgtgctatctcatccttcagagctatgatcctcacgagcttcccaccattcaaggccttagacgccttgtgcagatccgagtgcatcctgtccattcccctcatcacggtgcacatgtggccgaaggtggtgtcgttctcaccagctatcgggcggaaggtgctgatatcatcgccacttgctcgacgagggtggaagcggtacaccgtgttgcagaagatgtagttgtgctgatcacgaagcctggccatcagcagatatgctgcctcctgacaggcgtgatctgctgtgcctccggatgcctcaaccacaatgttagcgaggcaggtacccacatagccatggacctccaggcgaacacggtgaggaagctcgccactgagcggtggaacagtcgagtactctggcacgttggggtagcccaccaccagtgtcatgcgagccaattctgccacaaaatcatccatgccttctccgcggtggttgggtgggtgctcggccatctagagaagacaaaggggtaggatcaatgcatgctcaaatccaattttaaataaagcagtaaaggactcaaataagagaagcgaataagagcggaattttatgcatagatcatttgcatgagagcgaataaataagacagacttacatagcgataaaatagtgagaaaattaggtacatactaataataacaataaaagcataaacaccttgcaacccatattcctgagctaggacctaatgcataccacccatcaaatcccgactaactgtcgaatatatctcaaataattttactaaaaccctagacttacttgtttcgacaaatctcacttaaacgagcgaccaagatttttcccttgaaccacaagaacagatcccaatttctcacggaacaaatccaattgcaaagaacatatgcaatgaaaaggattcagagggctcttaggttttccatttggcttgtcctacggtcaaggtcggctctgataccaacttgtcacgcccagaaattcccgaatagaattccaagcagaatgtgcattaaaatccccgtccaggaccggccggggtacacaaacgacaaagttgacatacagatccacgtcttacaaacattataaaagtcttacataaatacagcggaaaaacaaaagataactggagctaagccttgacttgaactgcagcgggaacaccactccacaggcatcctcgatggcacggacgaagcctactcctcggagaaaccaccatctgacgcatactcaaactctggggtttggggaaaatagagcaagactgagtactacccactgtactcagcaagtcataccggaatagggctatgatgcagggaattatcaagggatagctataatggttcatttgcataaaacgggcatttataaacagaagttgaaagcagtaaagcagttgtaacaattaatcaatattaatcatccactgtccaacgctataccatgttgcaacaggcccaaccatccacctatactatccaatttcatcagactaaactagggtgagactaatcacggtgaatctggttgaccgcccataaccgtgggcacggctattcgaatagttttactctgattagaggtgtacaactgtacccacaagacacagccccacgacacgttttcgtgcgccggcatgccaccacgacataccggaaagaggccgtgacaggacccttcgcataaccccctctaaccaagcacaccacacctcaggtatcacccccactcctcgcaaggcagcgggcagtcccctctcgtgcctagatgaatccggaagccgcataggccgtcgcaggacccatccaaactccatcacggccacccttgcctagatgcgtcagctagaggaaagctacactacaagcccagcagttgcccacactagcttgtggtaagtacgataagttcttccagggcatcctgtgaaccggtccttaactgccatgggcgcgaccaacaaaatcatgcacccacagcccaccatgtgatttattttaattaaccaacaccgaagcggtggcactaatccaacattaccattagaacctacagtctatacattaataggattttcccctttgtgtgctagttgaactaagcatggctaagcaatccctagtccaatatctagtcatgttataacccaagctaacaaaggagcatggtaccaaaatagcatggctgtaacagtaggtaaacatcccatagtattattgtaaaacaatgcagtatttgaaggaaaacattagaacatttgcaatataggatcaacatgttcaagtgacaggcatgacttgccttgctctgctgctggaggaacctcggtgactatctcgaagtacaccggagcgttggaagagctggaatctaagcgacatacaaagcaaacaatacaaacaggctataagactactgaaacagagaacaaaaccatttttaatggattctacacatttttcttgatttactgagacttgaatgggcttaaacggagctcggatgaattagttatgaattttagaagattcactgtgtttttacaataaacagaaaaatccttaattgaattattgcacaataaatgcctagggctgacgtcatcaaagggagcgggcggcgccgacatgcttggcccgcatgtcagcggcgcaaggggagagggagggggcgccggcacgtgggccccacgggtcagcggcacaaagcggccggtccaccgtggaccgggaccacgcgggtggtccaccgccggtccacgggaccgatggtccggatcggcctcgggccgatcggacggcgcggggagcagccgccgggttcggctcggcttcaaagccggccggccggccatggctagaggcggcggcgtgcacgaccaccggcggcgaccggtggcggcggacggcgcaaaggcggcagcgcacagctggagcaacggcgcggccaaaagcgacggcgcacgcgggaaggggaaggaaaggaagggggagggagtcctcaccagagagggcggcggcgaccggcggcggaaaacgagggaggcggcgaagtccggcgatgccgaggtgcggacgagcgacggcgacacctaggggaggggaggagaggaattagggcggaggaaaaaaccccacggcggccgtccatgttggctggagttgaaggggagaggggactcaccggcgacgcgagggaaatggggtctcggtgggattccggtgacgcaaggcggcggttgggaaagatcttgtggcggcgaagctagtggtggcggcggcttagcgcggcggtggcacgcggctggagtgcggtggcaagcggcggcgctggcggagagcggcgcgagctcggtaggaagcacgggagggagcggcgagagcggaaagggaaagaggaggctcgggggagcgatttataggtgcgggacgggtggaaacggccgggaaagcctcctatttgaccggcgacgtggggtggagagagagataatggggggattcaaaatgcgaatcccgccccttgcgagcgcgcgcgggccgggagacgcgggggagagggcggcgacgtgggaaggacgcgggggcggcgcggcgtgggcgcgggaggagcggaggaggtgggcgcggcggtttcggcggcggttgccgacgtcgggcgggcggccgggggaaggggacgaccccgactggtgggacccacctgtcggcgtcccggagagagagggaggggcggcttgggccggcccacaaggaggaaaagggcgcgcgcggcggcgggcggactgggccgacggcccaagaagaggaaaaaggagggaaaagaaaaagaaaaggaagaaaggatttttcctggatttaaaattgcatgtgctcaattttaattggttaaaattatttctagggctctcaaaattccactaaaaatcttgttagcaaatttcgacatgtagaactcaagaaaaattctaatgccaattccgattattatttgcattggtttattagggtttactcttgcttttacaccgatattttcttgggaccatttataaattcaatttaggcttaggaggagaacttcagggtgtgacatacgggcacctcaacttcgacgctctccgctcactggcgagccgcggcatggtgcgcggcattcccactctggagcgggttaccaaggtctgcgacggctgcctaataagcaagcagcgacgagcgccgttcccaacggcggcattgcatcgcgccactatccatcttgatctggtgcacggggacatctgtggacccatcacatcgtcgacacatggcagtaaaaaatacttcctacttctgattgatgatctaactcgctacatgtggttgtttctgttaacatcaaaaagcgaggctcccgctaccatcaagcggttcaaggcaggagtggaggtggagaccggctgcaagctgcgcgttctccacactgatcgaggaggggaattcacctctgtcgagttcgggctatactgcacgaacgaaggcgtcgccaggcagctaacgacgccatactctccacagcaaaacagcgtcatcgagcaccgcaaccaaacggttgtggccatggccagatgcatgatgaaggccaagaacatgccgggggagttctagggcgaggcggtcaccactgccgtctacatcctcaaccgggcgccgacaaagagcgtccgcgacaagacaccgttcgagtcatggcacggtcaaacacctgttgtgcactactttcacacatttggctgcgtcgtctacgtcaaggaggtgaaaccacacatcaagaacttgatgatcggagcaaggtgatggtctttctcggctacgagccgggttcaaaggcatatcgtatatacgacccggtggccaagcgcatcgtcgtgagccgtgacgccgtgttcgatgaggcggcatcatggccatgggcgtcacccggggaggaggacgggggaacgtctcctcaggaaaccttcaccgtgcgctacgaggtagtggcggtggacgtgccgtcccgccactccgactccatgtcgtcgccggctcacatgggaacaccagtgccatcaatctctgcgtcaccgggtgtcctagcggtggagtttgtgtcgctgcctgcggaaacacctgatgtcgacgacgacagcacagggccacgtcgtttttggatggtggccaaaatccttgacactacctcgccaattgagctcgactccgacgagcttcatgtggctgctgccgaggaaccaagcaaccacgctgaggcggcacaggacgcactctggatgcgagcgatgcaggagtaactcaagtccatcgaggagaacaacacgtggactctcgctgatctccctgctgacaagcgtcccattggcctgaaatgggtgttcaagctcaagaaggacgagacgggcgcaattgtcaagcacaaggcccgcctggtcgctaagggttacgttcagcggcaggggattgatttcgacgaagtattcgcccctgtcgccagaatggaatccgtgcggctgctactcgccattgcagctcaccttgggtcgtctgtgcatcacatgaatgtgaagtcagccttcctgaacggagagctagaggaggaggtgtacgtcgcccagccactaggcttcatcgacgacaagcacccacatcaagtcctgcgcctaaacagagcactttatggtctgcgtcaagctcctcgtgcctggaacgcgaagctggatgttagtcttcatgaactcgggttcacacggggcatcacagaacatgctgtgtacacgcgcgggaccgggaacgcgcggctaattatcggcatatacgtcgacgatctcatcatcaccggcgctcactctaaaacaattcagagtttcaaggaggagatgcactccctattccggatgagtgatcttggattactcagctactacctcggcatcgaggttcatcaaggcaacgatgggatcacaataaaccaatccacttatgcgcagaagcttttgaagatgggtggcctggcggcttcagcttccgttccaatggaacccagattgaaactgacgaagaacagcgatcgaccaagtgttgattcaaccttttatcgcggcttagtggggagtttgcggtacctggtgcattcacggccagacattgctttcgcggtgggttacgtcagccgattcatggagtcaccgcgcaatgatcatctcacggcggtgaagcacattctgcgctatgttgcaggtactatgaactatggttgcaaatttgtaaattcaggagaagagggaatccatttgctaggattttctgacagtgatttggggggagatgcgcacgatcggaagagtacctgtggtgctctcttcttcctcggctcaagcccgattgtatggcagtcccagaagcagaaagtggtcgctctttcctccagtaaagctgaatatatcgccgccactggagcagcgtgtctcggcatatggctggctcgattgctagctgaggtgctgggaagtgatccagggaaggctctcctcaaggtcgacaacaagtcggcgatctccctgtgcaagaatccggttttccatgaccggagtaaacacatcgatacaaggtaccactttatcaggcaatgcattgaggagaaaaagttgaggtggagttcgttccttcggacgaataggttgccgacattctcacgaagccactcggacgaatcaagtttcaagagtttcgcagtcaggcgggcgtcgtgcatattgtcacccggcgacaggattagggggagtttgttagcttcagctataatcctgtgccgtattatcggttactgtaacgcgtctagtgttgctgtttcttcagtttcgttagactctgtttcggcgtctgtttctctgtttctttttcctgtaagccgagtcttccgggtcgtgtgtcgtgtgcgagtcatccggatttcagcatcgtggtcgcatcgtcgtggatgatggcgtagtggtgtcagtttgagtctgtacatatttgctatatatatgagcatcagaaaacgtcgctggtttgttcgcgacaccaaaaactctattcgtgttcatcgtctttccaattcagagaattcgcgtgagagagagatagtgaggattcacaatcttgggctttgctatcaatttcgacgaagaagcagaaaagaagcatgtgcaacgaggggccacgaccacgacacaagatggaaaaatggatcaagctcatcaggaatgtttaacttttggtattgaagagagaaactgatggagcagaagaagaagaagaagaagaagaagaagaagggatcagtgaggagattggaagagacgttgctgcttaatttcatgcagcaggagaaacgttccttcattgcagaccaaacagaaacgacgtcgccgtgtccctgccgtggcgaggatggcggcatgggctggcctggaaccagggacaggtagcgtgtgctgctgggtgcaaagaagagaaagagagatcgatagagagagagagatacagaaaaattgaacttggaggcatcgggaacaacaagaaaagcaaaaaagaaaagaaaataataaaaagagaggaaaaaggtaaggagaaatgaggaacaagaaggataatagggttctcaatctagaaaaattcctcaagaatcccaatcctgtaaattatttggatttgttcaggagttttttggatagagaataattcacataattgagctccacttccaaacttaaataaaaatcaaataactccaattaatgaacgataaaataaaatgtataattagtttatttagtcaaattaaacactttttaattttcagaattttcattaagccatttcagacgaataaacacgaatgtgaatttttgaaattaggcaaattaagaaatacgaaaaatgggacgtaacacggcagcttccactcaggatgggaatggttaagtttggcccatttaaccactgaacctatccacaaatatgttttattgggcctttaggttgattcaaaactctaaatggggcaaatggtttgaacccttgaaacctaggaaacatcggattgatccagaccaccatcaacatcttgttctcgaggacctcgggtcctccttggcatggcggcagcgctccagcaccgtcttgttctcaagtcctcatcctccttggcgtggcggtgacgctccggcgacaagtaggtagtgctagtcctcaagagcgatggggaagaaagggaagtgggagagagaggaggaagaagagttgatcgttgacatgtgggatccatatgggtctcactcgtcacgctagcttgaattagacactataatgtcttgggacctcgagtataccggttttgcaagataaaaatgcattatatatggtactgcggtcgaaggacgtaattcaaacttggcgtcaagataaaggaccacaagtgaacttagtccactcagtaaataagcatgcatagcatacgctgggccaaaccggggcaaccatccatctgatcagtaagcatgcaatattggctactgggccgggcccaaaaaactcatcctattaattagtagtaatatatttcgatcaattttgctatatatttgtcgacaaattttctcgaaaaatttgacagatgtaattacagtacaatcacagtgtaattacactgtaacttgcatgtaattacactgtaactatagtgtaacttgtatgtaactttcaaaaatctctctgtaatatgttatttcggtaaaatagaggttgtgggaacaaatccttacacatatatatgcgctgtgatttttttcttcctcaccaaaacaaatcttgtaatagatttaactgttcaaaattacatgaaacttatatacaagtaacattgtagttacatgcaagctacaatgtaaatacatataagttacagtgtaattacactacgattgtaatataattacatttgttaaatttttaggagaaaatttgtcgacaaatgttactaagaaaatctgactaaagtgctccactaataataaaaaaataataaaatttattggtagttaggtaagtggtgttgaaaacgggagtacaagttttaactcagctagctagacagctaggccaagagaaacctaactggtggtatttctataattatattccctctatccataatagttgcacgtattatgtttctaatttttccaaatactaagttgaacttattagtagtgttagtagttaacaggatggccatagtcgggttaatccattttgtagctcgagggggtcgtcggcgtccggctcctagcttcatcctggttgcttctaccatggatgtcctcgtgggcttctctacgttgatggctccctatcaatcattttccaggttcaccatcaatgcctgaagctaagagcgcggcgagtttgttcaaaacaaggcagcgccggagtttgtttcttctctagttctccgcgagttttttttctgcatccgcggtgatcttcttcctcctctccagcgacaattttacaaggtacaggtgaaatgtttctccgtttgccttaggtgtttcaacctccatcttagtgaggctccttttgggttcgcacctaggcatcactatatgcagctagccatggcttctctgctcctattgtcgtccagtgtgtgtcgatccggccatattgttgtggacaaggcaaagagaaggacccgattgcttttcctgtttctttttaggtccttctttccatattgcagggttaaagtgtaattttcccatctgtcagggacctctctgttgtaagacttgctgtactctcagcttatctatctatcttctatctattatatactaaaagtctattaaacttcctacaaacgctctcaagacgccacatgggattcctacaaacgctcctaaatcgccacgtggcaatctaataaattggtggacccattatttcttactatttaatttatcaaatctatcttaacaaaaaaaaacataacccacctccctatctttcctgcccggcccacaccttccaatgtgtaccgtacgacgtacgtaaggtacttacatgcctcctccctcccctcctgctctcccccttcttctttttctttagttattaaaatattaaaaaattaataaatttaaaataaccataatttataaaaaatgtggttaatttttaattacacataaaactttttattcttccgtattattctatccattgtggtccattaacgattcaaaaggcaatataatctgtaatttaacttgtaagaaatatttagtttttatcatatccatgctattaaaattattatataaaatagaaaaacatgataatgtatcatttcacaaaacatgcataaataaattagatctactatacgaaaaaataaaaaacttatccatcacatggtattctaataaattagagaaaaattctgaaaaaaaatatataaccatcagttttcatttaaaatggtggacccgataatattaaccattagataaaaaataaatctccttcacccttccctcctagccggtactaaaagtccattaaatttcctacaaacactcttaagctattatgtggctttctacgaacgctcatac

SEQ ID NO: 65661 - DNA, 34066 bp, Oryza sativa
aaaaaataaataaataaataaactgaaaccattttaaatagtataaacttgttagctgattaaaattcacaatcaagtagaaactgaaactatagccaagcttacgtagttgtcaaggtgaacagaaacatttttagtagtataagttatgagtgagaaatcaaaactactatttggatagatgaattttagatattgatgcagaaacagcggtgcatgttacatcacacatatggagctttgtttctggtagaatatatgtatctaaaattcaaaatgagtcaatgtggacattgcataacggcatgtcaatcagcaagtacgtgatgcaagtaggtggaatgttataatgagggtgtgtttagttcctgaaaaaagttggaagtttgaagaaagttgggagtttagaaaaaagttggaagtttatgtgtgtaggaaagtttttgatgtgatatgatgtgatggaaagttgggaataggcgggaaactaaacacggcctgagatgctttgctttctattaataagcagttaccattcttcatagcttcaaaaagcacatcacagtaatatttgaaaggtgatatcctcattactcgacagatgtggtctgcaagatggtacgggtataactacaaaaaattaataaaaagtagcagtcatgaaagctttctagaaaaagtagtcaagcctagtaataaaattactttctccgtttcacaatgtaagtcattctagcatttcccacattcatattgatgttaatgaatctagatagatatatatgtctagattcattaacatcaatataaatgtgggaaatgctagaatggcttacattatgaaacggagggggtacttcctagttaattgaaaaattgttaatgtatgggcacaagaggtatacaaggatacaacccaaagaaaacattttaacaaaatgtagctgtcatgaaagctttctaaaaaaactagtcaatcatactaatacaattacttcctagctagttgaacaaattgttaatatggctgcaggaggtatgcatgaatacaacccaaagaaaaaaattattaacaaaaatgacaacaagtgtatattgcatatgaaatcagtcaaaacataccatttcacaaattgaagtatgaaaacaaagagatgcaaaaggtgtttctccactacttctgaatgctggttctaattaattgagagaaatttgagcaacatactgcaaggttcctgcggagatagcgcatcaactcctcatagtattctccctctttgcaaattttgcgcgcgaaacaggaggtccatggcaatcgttttcgtatgcaataatctacaatcctgccatcaatgtatttaggaagctggtcatcactcatcaggcatacatctttaagaaacacccaaatgcattatgcaagacaatactctgaaaatcctgaaactaggtcagaaaccaaaaataattgtcctgagttatctaacaagattatgccattccacatttgtgctaccttggatggctgaattggtgcagttgggccctgtgtggcttccatcaaaggtactgtaccattgataacccaggcccactcacactaacaggccaaacccagatgataatggtaggcgacatcacatgggctacacaagtcggtgacaatcccggatagtggataatttgaggaattaggataatgaacatttcggttgattaaccacgaacatgacttgaagaatttaattgacattcctatatataaatactttaatcagatcattcgcccattcatattcctaaacaccccagattgcgtcccaaaatctccaagcaaaaaagaaaaggaaaaaaaatccccataatctaaccgaacaaattaacttgcgagcagaaatgggattaatgcgcggatggatggaatgcggggtagatagatattatacctgcggtgccagtcgtccttggagacgagggcggcctggatgcgcttggggaggctctcccatgggagctcctccctgatcgccttcaccatcatctgctcctccaccgtcgccgccatctgctgctgcatcctcgatcgatcgattaattccttccccaccaccaccacctcctcccctccctcacttcaggattgattcccctctcgccgatcgagcaatgcgcgcggatgcagaggagagagagagagagagagggagggggatgtgcgcgaagaggaaggagcgcatgcagaggaggaacaggagagagagaggggcttcctgcatcgtttatgtcctttttttttcccgttacatatcggttcgctgtggaatttgattatatcaaatttttcttaatatggaatttaaatcattgagataaaaaaaagatcatttttgtttgcgagaaacacggtacataagcagatgctttgcataaatatgcacattcacccgtataaatgcacatgacgtgtgaaaaatcatgagacaatgtagtttatatttgttactctacaaacttttttttaacgttactccacaaacttgctcgacatagggagggagaaaaataataataaatcgtaataataatggtactggaaaaaaagaagaaagcctatgatgcattgggctattgcattcagtaggaggtggatgggctgggcttaaagccttaaatgcaattgaggttctagtgacttactgtggaattaggttaaactgtatacttccgccgtttcatgcattgtccatatttatatagatgttaatgaatctagacacacatatatgaatgtggacaatactagaatgacttacattatgaaacggggggaatatcattttctttgatacaaatttaaataattacaaaaatatcgtgacaagaatttaaaatataacaaaggttgtgatattgtttaggtcataaagtaaaaaaaaaaaagaagaagaaagggctatccctcaccttgcatagattacaatttaccctttgtcaatgtaaggggttgtttagattgatgtcatttcaagccataccttttttttatataaagttgttaaaaatatgcatacatttagttttttttttgtcaaactttggtaaatacataagaattcctgccaaaattttgttaattttgtcaacttgcctaaattagtaagttttatattggctacaatctgaatagtgcatatattacaatctactattgtcaatataggtcaaaggaattctcttaaacgaccaccacaactaaaggccatgttttgaaagtttatagtagctataacttcttcatcttcagctcttaaaatatattttaacataaattctatagctctccaaacaaattttaacatagattctatagctacataatgcaaaaaataaattaaaagctagaggctagagaacctaactttttaatttcagattctcaaaatttagctagcaatcaattgcttcttagaattggaagttcaccaaaaaatacttaaacagcatgccaacctcaaggacatactataaatggaagtactactagtattcattttctttatgtacaacgctgtataaaaaaattgaaggtgtgtacatgttttgcacgtagtgggttagtaagctggttagccgaagtgagcgtagtttaattggttatgttcttttgtgatggaacgagttcacttggatttaagttctagacttaataagggtactcgtatttacgactatttattctttcagtgatagagacgacatatctatcaacatcgagacgcttgttatgacttcatcaatatgaagatatgtcggttgagtcttctgaatatgctcataagggtaggatgtgcatttgtgcatttataggggtgaatgtgcatgtgttgtgagcgcttatatttatactaacgataatacttctacgatatttttgaatactccatccgttctaaaatataagggatttttgtcagatatgacacatattagtactacgaatctagatggggagcttgtccaaaagtattaaaatatgatgtatcctagtactaagagatgagtcatatcggatcaaaattgcatatatttttggatagagggagatgtagtttgtcacatagaattgttgtgtgtttagttcatgccaaaattggaagtctgattgaaattagaacgatgtgacaaaaaagttagaagtttgtgtgtaggaaagttttgatgtgatgaaaaagttggaagtttcaagaaaaagttgggaactaatgccatgttttgaaagtttctagtatctataacttcttctataatcttcagctcttcaaacatattttaacataaattttatagctctccaaacaaattttaccatagattctatagctatagaatgcaaaaaataaattaaaagctaaagactagagaacccagctttttaatttcagattctcaaaaattagctactaatcaattgcttcttagaattggaagttaaaaaaaacactaaatagcatgccaacctcaaggacatactacaaatggaagtactactagtatttattttctttatgtacaacgcagtataaaaaaattgaaggggtgtacatgttttgccacatagtgggttagtaagctggttagacatagttgtcagggttacgggttaggtataccctttaccctttgatgtacgtcacatatcggtatggcatacccacgcgcatacggatactccccgcgtacactaaggaaatccttcacaaagtctacggaggggaagagttttactcggacaagactgggtcatcaatgtatcgtatagggtctgttatctccgagttctacttggaaaccgcctgacctgcgatataaaagggaccccccgaggaggacctggggcatcgaatctcagagccaacacaaccctcacagcctacgaagtcggagcctgcaaggagccaaatcgccgggatctagttgaaccaactcgaccacgatctcaccggatccgtcaagttccattattccctttgtaacctgtgttttccaccatataatcccatatcaactggattaaggctattacctatcaaggggcctgaaccagtataatcctcgtcttttgtttgcttgatgtcgtattacgtagatccttgtaccaacataccccaataccctctatatccggtctacgggtaccacccgtcgacagtggcgcgccaggtagggggacttggtactcaaggttctactactatgtcatccagcctcgtcgacaacagcgtcaacaccaacctcagccaagtattccctgcttcaacgatgctgatgtggactcaagtcggcgaaatcgtcttcccgatttacgccacgatgtcgatctcaaccggtccgccaatgaccggaaacgagaacgtagtggctacaaaccaaggcgactccatgtcaaaaaatccgcccgccgggacggagaacggagcatcgacgacatccgagctcgagaaggattctgatgcggccaaaccttgtcgttccgacatgaactgtgagccgacgaagatgacttccgaagcgacaaggtcctggtgtcctatccacaaaaccaggaaacacattttgcaagcctgctgggttttcctcaacgtccgcgctgaaattcgcgcctgcaaagagcgtggaattcagcttatttctccaactcgtgatgtctattgtcctattcacaagacaaagaatcacgacctctcaagctgcaaggtctttcttagcgccatgaaagcgccatcccctaaggtccaacagtcacacatccccatcagggataaagacaaggaacgaggagcgacgccaacttcagatcgatttgttggggtaatcgatattgattctcacgaaccatcagtcttgcaccttctcgaagactatggatcatcgacaacaagcgcgccgcgagaggtattggctatcgaggatgtcggcacatcagtgcgcaccaatgcagaagcggagaatcaattgaccactccagcccagcacatcagagccgtcaacgctatactgagggaaaccccctacgatcccgttctgaacgacgatctcgcgcgttggacagaacgactacgggaatcagtgaccaacctcagcaacgcgttcgaagaggccactgccgcagcacacccagagcagccaccaactcgcgatgccaatggtgaaaacctggaacggagggaatcgcctcagcgagctacccctccacctcgtggcactgacgatctccgagatcacatcaacggccgccgagagacacgacgcacacgagacaacgtgaatcgttcccgacgtcatgtctcttcacagcgccatgataacgaaaatcaaggagaccgctcaaacgaggaccgagaccatgataaccgccacaaccaccacgatcacaacgatcgcgaacgacaggtgccagacgataccggtcgaggacgtcgccataacgacgacaatgatggagaccggagccgagacaacagcgggagacgatgacaggattctcgagatccaggccgatatcctcgtaaccgtacgccggaaccaagtgacccatcgtcatcgtcatcatcctcgtcttcctcatcaccagacagacatccacgaaggacacacgatcgccgacaacccaccacccccagcgctgggtgtagggctttcagtcgttccctacgtgatgtccgatggcctgagagattccgacctggagcaatagaaaagtatgatgggagcaccgacccagaagagttccttcaagtctactccacagtactctacgctgccggagcagatgacaacacgctggcgaattatttgccaactgcgttaaaaggctctgcacgttcatggctgatgcatcttccgccctactcaatctcctcatgggcagacctgtggcaacagttcatcgccaacttccaaggaacctacgagcgccacgcgatcgaggacgacctacacgcgttgacacaggactcgggtgaatccttgagggaatatgtttggtgcttcaacgagtgcagaaatacaatccccaaaatcaccgacgcttctgtaattcgcgccttcaaatctggtgtcagagatcgctatactacctaggagttggcgacaagacgcatcacaactactcagagattgttcgaaattgttgagcgatgcgcccacgcagatgacgcgctaagacgcaagaatgataaaccgaaggccgggggagagaagaaaccagccacggacgcgtctgagtcaagcaagaagaaaaatcgcaaaaatgggaaaaggaaatctcaagcggaagttctcgcaacagaatacgcgaaccctcccaagcgtccagacccacagagcagcgacacaaagaaagcatggtaccccatacacaagacggacagacattctttggaagattgccttgttttcaaaaaatcgctcgagaagcacattgcatttgaaaaaggcaagcgagtacgcgtggtcgaaaaggacgaggaggcggttcctcatgaatcggattcagcatatccagactccgacctccacgtttcacacatcttcggaggttccacaacgtactcctcaaagcgagaatacaagaaagtgaaacgcgaagtctattcgacatggcagggggctgcacccaagatgaagtggtctgaacagaagatagagttctcggaacaagaccaccccaagaccgccgtcatcccaggacaatatccgatcgtggtcgaacccactattcggaacatcaaggtagcgcgagtcctcatcgacggtggcagctcaatcaatcttcttttcgccagcactttggacgcgatgggaattccgcaaagcgagttgacaccaaccgatcaacccttccatggaattactccccaatcctcgtccagaccattaggcaagattacgttgcccgtgactttcggccaagccaacaacttccgaacagagcagatcacctttgatgtcgctgaattcgatacagcttacaacgccatcatcgggagaactgcacttgcgaagtttatggccgcatcccactacgcgtatcaagtgctcaagatgtcgggaccgaagggaacaatcactgttcaagggaacgcaaagctggcggtacaatgcgacaaacggagcctcgacatggtcgagcaaacacccagcccacccgccacgacggagccacccaagaaagtgagcaagaaaaacaagacgccgaaaccggacggcgcaatcaagatcgttccactctccagtgccaaccccgacaagaccgtcaagatcagggcgacactaagcgagaaataggaactcgcgctcatcatcttcctccgcgataatgctgacgtgttcgcttggcagctgtccgacatgccaggggtccccagggaggtgattgagcacaaactcatggtacgacccgatgccaagccagtaaagcaaagactgcggagatttgcaccagaccgaaaacaagccatacgagaagagctcgacaaacttctcaaagctggcttcatcagagaagtacttcatccagagtagctagccaatccagtcatggtgcggaaggccaacggaaaatagagaatgtgcgtcaacttcaccgacctcaataaggcgtgccccaaggatcacttccctcttcctcgaatagatcaactggtggactcaacagccggctgtgagctgttgagctttctcgacgcttactctggctaccaccaaatcagcatggcaaaagaggatgaagagaagacagcattcatcacgccattcggagtattttgctatgtcaagatgccgttcggactaataaccgcagggaatactttccagcgcacggtccagggagcacttagcaaccagctcggcaacaatgtcgaggcctacgtcgacgatatcgttgtcaagaccaagacaagcgacccattgattgacgatctgcgggaaacgttcgacaacctccgacgatatcgtctcatgctcaatccagagaagtgcacgttcggagtaccgtcgggcaagctgcttggattcctcgtctctggcagaggaatagaagcaaatcccgagaagatcaaggcaatcgagaacatgaagtcgcccacaagactcaaggaaatacaaaagctaaccggatgcatggcagcactgagcaggttcgttgctaggatgggagaacgagggcaacctttctttgctctgctgaagaaacaagacaaatttgtatggacacaggaagccgaagaggcattcgttgcactcaagcgctacctatcaaacccccttgtacttgttgctccccaacctaatgaagaattattcctctatattgccgccatgccatattccgttagcaccatcattgttgtcgagagagagaaagtacaacgaccagtctactacgtcagcgaagctctccacgacgcaaagacaagatatccacagatccaaaagctactttacgcggtcatcatgacatcaaggaagctacgccactactttcaagcccacagagtcacagttgtctcctcctgtcctctcggtgaagtcgtgagaaacaaagacgttgtcggctgcattgtgaaatgggtagtcgagctgagccagtttgatgtccactttacgccacgaacagccatcaagtcccaggtactcgccgacttcgtagccgattggactatgcctgataacaaatcagacaaccaaatcgacaacgaaacgtggacaatggcgttcgatggtgcactcaacagccaaggagcaggggcaggatttatcttgacatctccctccggagaccaattcaagcacgcaatccacctcaacttcagggcgaccaataacacagccgaatacgagggactactcgccgggataagagctgcagctgtacttggggtcaagcgactaatcgtcaaaggggactccgagctagtcgcgaaccaggtgcataaagattataaatgctctaaccccgagttatccaagtatcttgcagaagtcaggaagctagagaaaaggttcgatgggatcaaagtccgacacgtctaccgcaaagacaacatcgagccagatgacctagcacgacgtgcgtccagacgagaaccgctcgagcccggcacttttttggacatcctgacgaagccatcagtgaaagaagttagcggcgaagttagcccggacacccccgacgttagctcggaggccacaaaggcagaacgcaccgttgccgatatcgagaccacagacgactgacacatcccactaatcaaattcatcaacagcaaggagctgcccgaggatgatacagaggccgagaaaataacccgtaaagcaaagatctactgtatggtcggcaacgatctatacaagaaagcgctaaacggggtacttctcaaatgcgtctcgtccgacgacggcagacacctcctcctagatatacatgaaggcatttgtgggtcacatgccgccggtcggacattggtcgagaaagcttttcgacaaggttttttctggccaaccgcccttaaagatgcatgcgacatggtccagcgatgtgaagcatgtcaattccatagtaaacacacaaagctacccgcgcaagcgctccagactatccctctgacttggccgttctcgtgctgggggctagatatactcgggccattcccacgaggacagggcggctacaggttcctattcgtggcgatcgacaagttcaccaaatggatcgaagtagtacccacggggaaaatcaaggccgacaacgccatcaaattcatcaaggggatattttgtagatacggactaccgcaccgcatcataaccgacaacggctcccagttcatcagcgtcgatttccaggattactgcattgggctgggagtcaagatatgcttcgcctcggtctctcaccctcaaagcaacggacaagtcgagagggcaaatggcatagtactacaagggatcaaaacccacgtctacgacaggctcatgtcacatgacaaaaaatgggttgaagaactcccatcagtactatgagccgtacgcaccacaccgacaacgtctaacaaggaaacaccattcttcctcgtgtacggctccaaggccatgctccctagtgagctacaacatcagagtacacgagtacagaagaactccgacgaggaccaggaggaacagcgaaacgtcgatctaaatctactcgaggaacatcgcgaacgagttgccgttcaagcagccggctatcaacaggccctccgccgttatcacgagaagcgcatccgagcacgcatactttcgatcggcgactacgtcctccgatgagttcaaagctaagcagggcgaaacaaactctcaccaaaatgggaaggaccttacacgatcacacaagtcttgcggccaggcgcattcaaaatcgcagaaggcgacggtcgcgaattagcaaattcttggaacattgaccaactacgtaaattctatgtatgagtcaatatcatccgtacctgtaagacaccttacagtatcaataaagcctattcttaggcccatattacaatcaaactgttttcacccgatgatcccttaccctaatgacacctagcgttgaaacctatcctcatgtccctttacgccgtcttaacaaggcctccgaggaacctaagggatcttcggctggggacgcccagagccaataaggccttgtcagatcctatagagacgaaagaccatgtaagatctggtcgtgtaagagttctcgccgtgcgtattaaccaagctgcgaaatcggaaattaactttccaacttcacggctgggggctaggatcagagcttattcaaccaaggcaggtcaaaggtccaagagccttatcctccgagaaaatttctccgacgacaaggctgggggctagggagagtgtacgactcaaacggctgactaaagtcgtcaactgagaacgcactcttacacacgacatccggagtaagaaagatttgttaaagatagatttcttttctatttcacaaaatacttcttacagtttttacacaaatccaaagctatattacacctttttcctgagatatctatcacagggtacgaagactaccaagaaggccaacgccagtccatagactggaagatcttctccgccaacggcgccatcgacctcgctagatggtctatctccgctggagtcctccgagaacgagcaaaaccctcacggagaaaatcgaggtccatgcgcgggcgatgatctcgtaggcaagccaacacgtgccctccggcatatcggctcgatcgacgacactcctgcttcaaggcctcgtcaatacgcttgccgatgccatcgagttgagcacaggcttcgttcagccatgagatgtatccggccgccgactcctcgggatctccacggggcactcgaagttctctacagaccctggccatggatgtgcagcaactcttcaagtacgagttgaaccacacctcacgacctcggagtgtttccacagcctgctctttcttcactgcaagcatggttctctcgagttccgctacttcaaattttgtcttccaatattagatacgacgatcttggccagcaagagcactctcgagatctgctcaatgtgagaacaactaagccaagctatacgcctctttcgagaacatagttgatctagtcgggagagcatcaagggatgaatggactactaacctaaggaagtcgtcgccatctccgtccctgtagcaagggtctggtccacattgtcgggcgacgcatgtggttcaaacgcgagaaccggaataatcgccggtgactcgggctgcccgcgctgctggacatcctcgtcatcaacatctctacaaaggacaaaagctctcaagatcaacatacaagagtaagccagaataataattgcacgcacaaaggcggttaagattcagttttacacagcatgtcttgggagtacaagaggtcctactcttcaaatagggggagaacggattcccccagatcaccgacttcttccatcacctctttacgtgtgttgctagccgccccctgatccaagatctcgcgcagatcgagttcgggatgcgatagctttacacacgcgaggacgtggcacgctccggtgtagatcccgttcgatgtttcctccccgatcttggccgcatgcttggaggggatctcccccatcgccgtcgccagttccgcaagagaagatgtcagcgagaactcgtcgggattcgctgggatagtagacttaatgccgcactccctggcgagctgatgcaggccagtgtatgtgacccgcaacgagccacggatttccaacaggttgttcccgagctccgacatgcggtcctcaagcccctgccgttgtcgctcgttgccggccaccaactccctcatcttcttgaggtcttcacgagcttccgccaactagcgtaccagccggtcagcacgctcgttcgccgacgccgcttccgacctcgcctccgcaatctcgcggccgatgccactagcaccggcctcgaggaggcgccccatctcgacctggagctcctcccaggtgaggacagcagccggtggaccacgaccagccgcgggaccgctgactgggccgcttggtgttgcctcgcgactcccgggcgcaagcacgacatccgtcgaggctacagcgggagacgcgccggaagtccctccggactcgtcttgcgccgccttcgcccatgccgccctatgagacaactatgtttcagaaaatgctcgaacaaaatcacggagacgtaagttcatccacttacttctcgccaattgtcacaagacgttgtcgtcgtggaggcggggaagacgtgtccgaggcctaaaaaacggtcgatgcgaagtaaggcgaaattcttttggctgtataatctgacgacaggatagcttaccgagggggttgatgccttgcgacgatgtctgctcacagagaacttcctcccctttgtcggaatattgccaccacttgtagtagcagcagcagcatcagacgcctccttggcgaccttctctttcagagacgccgccacctgatgatctgcgagcggcccgatgatgttagtcagaagaagagcctacgcttaatcaagtcacaatgtgatctcggaaggaaaacgcagaatgcctgtcgagtacacttacattgatggcggcatcacgttcagccgtccctttttcacaaagggaaacggggatggcactcgccgttgtcggaccactgatcatcacctggccaacacgacgttccacggcttcgctgttcagacctgtgaatcgagaaccaaatttcggtaaatcgagagaaacgcgaacatgagcatgtcaggataaatgcgagaaagataccccgaggagaaacccgggtcgcgtcctccggtccggaatagtcaaaggctggatgggcccgagcctggagcggctggatccgcctaccaacgaagtctgcagtgactttataccccgacaagcctcgtactcggagatcgtcgataatgtcgataaacgactggagagagggggtcaaagggggctttgcggtccaagacgaaatcttgagcctcgtactcggagatcgtcgataatgtcgataaacgactggagagagggggtcctagggggctttgcggtccaagacgaaatcttgtccagttattctttgggaacaacgaaggcagggtccgagtctttgatctgaaggtagaaccacctagtccaccatttgctgcgagaagaagggcactggaaggggatataacacgacttcaggctatcccgaagtcggaacccgatgcaaccagacaccctgttggactccatccaacgcagctcgtagtagaagcgaaagagatcaagaaagggctctaccccaatgtaggcctcacaaagatgagaaaagatgctaagaaaggcgatagaattgggtttcaaatggagaagagaaagaccatagaagttcaaaaccaagagaagaaattcagaaggcggagggagaaaaccgcagagaatatagtcttcgatcgcaaccatgtgacctaagacgggctggggattagtacctcctgcttccctttccatggttccgcgaccgggaagggcgccgtcttcctaaagcttcttcagtgacgcactggtggaggatgatttgctgagatccatctctgatcggagatcgccggagaaagagctcaggtcgatgtactagggtttcttgtgggagcggagaagacgaagagcgcttgcaggcgggatgttttttgcatggggggcgaacttcaaaatggatcctcaaaattcctttaaatagacgcactaccgacggtgcgaattccaaggaacagagagagatgcccgccggaaatttctgggtccgttacgcgcggcggttttttggacttcagtttaaattcgctcgtgaccgttgggcttcaaatggtgctctcgactacgttttgtctctacggtcctcgcaccgggaacgacaacagtctcgacgccagaagtcgcgaatggttacacgagctcattttaagcagaagtcgggggctactgtcagggttacggattaggtataccctttaccctttgatgtacgtcacatatcggtatggcatacccacgcgcatacggatactccccgcgtacactaaggaaatccttcacgaagtctacggaggggaagagttttactcggacaagactgggtcatcaatgtatcgtatagggtctattatctccgagttctacttggaaaccgcctgacctgcgatataaaagggaccccccagggaggacctggggcatcgaatctcagagccaacacaaccctcacagcctacgaagtcggagcctgcaaggagccaaatcgccgggatctagtcgaaccaactcaaccacaatctcaccggatccgtcaagttccattgttccccttgtaacctgtgttttccaccatataatcccatatcaactggattaaggctattacctatcaaggggcctgaaccagtataatcctcgtcttttgtttgcttgatgtcgtattacgtagatccttgtaccaacataccccaataccctctatatccggtctacgggtaccacccgttgacagtggcgcgccaggtagggggacttggtactcaaggttctactactatgtcatccagcctcgtcgacaacagcgtcaacaccaacctcaaccaagtattccctgcttcaacgatgctgatgtggactcaagtcggcgaaatcgtcttcccgatttacgccacgatgccgatctcaaccggtccgccaatatccggtttacgggtaccacccatcgacagtagtgagtgtaggttaattggttatgctctttgtgatggaacgagctcaccttgatttaagttatataatatagacttaataagggtactcgtatttacgactatttattctttcagtgattgatgacgtatccattaacaacaagacatttgtgatgcctttatcaatacgaagatacgtcactgagtcttccgaatacgctaataagggtaggatgtgcatttgtgtgttcgtaggcgtgaatgtgcacgtgttgtgagcgcttgtatactgacgataatacttctacgatatttttgaatactccatccgttctaaaatataagggattttggtcagatatgacacatattagtactacgaatttagatggggagcatgtccagaagtattaaaatatgatgtattctagtatcaaaatcgcatatatttttggatagagggagatgcagtttgtcatttaacggccggggcctcccctgctgtgttctcttaaagaaaaagaaaaaaaagatgctgtgttctcttaaagaaaaagaaaaaaagatgtagtttgtcacgtggaattgaatgaaattgaaatggttaagtcaaagttggcccgggatagacggcggcctgtcagtggtacgtacgtgttgatccaaacctgcaacgaaagggacacgcacatccgcaattatgcatggcgacggtgacgcgcggacgcacctaagcacgggctactactggtactagtaactagtgtaagctagaactaacgttaggctggccagccggaccagctaagctagttgctcacaccaaacagcaaagcaatccaccgcgacgcaaattctttgctttcgctctcgatcgggaagagaagggaaaaaaaaaaggagaagcttttgttgtcgagggtcatggccagttttgaccctgttcttctggtggcatccatcggcctctcaaaagccccaacgtgagtcgcacgatattgtcgtacctacggcggtgcttttggccttatatgattattatggacttttttctttaagaatttcgctctatttgagctaaaactgtcctctaataaattattaggagaccctctatcgcccctcctcttcattctagcgatcgacccacttcagcgcctacttgacaaagccaccgatctcggagcgataagcaaattgcgaggaagagctgtgcgcttccgcacatccatgtacgccgacgatgcggccatattcataaatccgaacaaggaaaacgtgagtgctttcgctgagttgctaggtcactatgggcaagcgtctggcttatgcacgaatctgcaaaagtcccatgtagcaccaattaggtgcgacgatttggacctcgacgacatcctacaaggcatgccagcaactagagtaaacctcccgatgaaatacctcggacttccgctgactactacaagactaaggaaagtagacttgcagccgctcttcgataaatcattgaattgcatagccggatggagaggaagacatgttggcctggtaggatgatctaccctagtgaaggtggtgcttacctcgcagcttgttttcctcctgacaggcctaaaagcgtcaaaagggtcactcgagatcctagataagcagcgaaggaaattcctgtggacggacgaagaaaccttgacatatgggaaatgcaaaatcaactggacacaaacacgtgtccctactgcttcgggtggattgggcatcctaaaccttgaaaagttcgcaagggccttgcgtctcagatggctatggtatgaatggaaggtatgaatggaagtcgccggataaagcatgggtaggatctggtacaccatgtgacgacactgacaagctcctctttgctacaacaacaaccataaaatttggagacggcgcaactactagcttctgggagtcggcctggtgggaagggagaaggttgaaagacgtggcgccactagtctacgcgcagcttcaaagaaaaagaacagatcgctccaacaagcattgcaatcaaatcagtggctactcgacgtgacccttccagcggatacaggatggacaacggaactgatcgaccaacttgttatgatatggagcgctacccagacagttgagttgtccgagcacgaggaggataaaataacatggaaactcaacagtcacggtgaatacacggcggcgtcggcatacaacgtacagcttctcagcacaacggccaccaacttcaacaccctaatttggaaaccttgggccccatgaaaatgtaaaaccttcgcctagctagtcattcagaacagagtttggacttcagacaggctagctactagggggtggccgaatggctccgtctgtcctctgtgtcgctaggcccaggaaatggccctccacctcttggcgaattgccgctacacaaggcgaatttggatggctatggcgaactaggtggcatgcagtaccttgcatcctaaccagtggcaacaagcttcgtcgatcttagaatggtgggaaataatcacaagcaccaaagaagcccccaagaaggccctccattcgttgacgcttttggtcgccggggaaatttggaatgaaagaaacagcagaaccttccagtaaaaggagctctcgtcgaatggcctgctaacaaaaataaaagaggaggccagagcatggatctcttagcaggagcaaaacatctggaaaattggcttataacttagttcgttaggacctttggtcatgtttttccttttatactgtacagtttactccttctctattcaatgaaattggcggctcgccgattcattaaaaaaatatttttaggtctctttcactcatgacatattttttatgatgtctaccaacaaattatacaaattttaactatcgtatagcaaaatttatcttttgaaatggagaaaggacatgtgaagctaaagggtttacatgtcaaccacatccaccacaaactttattacttcttttgaaaaaaggacaatacaaagcatatatacataaattaagagatgatgtataaaatataatgataataacatcataatgataaattttattaactaaaatcctgttacaatgcacagaaaaatgctagtttacataaaacaactcatacataaagttacatacatagtggataagcacgttaaatgctgtgattatatataagatgaaatatagaacatacatacatatggtataatataaggtaaaattttatataactgtctatgctttgccaaaactatgacaaaacgacacatatgttagacgctagtatatcgtaaaattacatatttataggtcaaatttacaacaaaactaagatcggaagtacgatgtcgaaatgctatgtacagatttagtgttatttgtcacaaagctatttacaattaaatcataactttcttaattttatagtagagaatatgttaaagtgatgcagatagagttaggctttccttagtttttcataattatttttattacttttctagtatcgtccgctacttaaaaaataatttccctagacaccactttttttccagcgtaaaaaaccgtatgtaaaaacctttgagggtgtcccatgaagacctgcatgcgaaaattaatgaagagcacaacagggtgcaacacttctgttataatttttcaatcctcccaccgaaccctatcactcccctattcctctctatcctctgccctctttcacgtcctctcccctatcacctctcctccctctatctcatccctactcgacgggagcatggctggcaatagcaccagcgacgatgggagaggcagtggaggcttcgtcgcggctcacgtctagtggatccggtgacggtaccctcatgcaggtacgggagaagcgcgccgggggggagggtggggggggtggtgaggcggcctcacgaagagctgggcacagtggcctggcctcaggagcgcgggggtggtggtggaactccggcgacgacgccagctcgggacgggcagattcgctgctgccagtctctggaactgtggggcctcggtgacggcgatgatgataggggattgcggcgacggcggtaggttggagctagggtttcaattttcggaattattattttctcccgttggacgtccacatatatataacatgagcattaaactaattaaggaaatctagtagctagtcgtggcgtgcccacaaaaaaaatgcgactgatcggtactcctatgattaattgattgaggcagagagacctaattcctagttgatcttatgttagaaaaatgacacatgcatgctgctgctgctgctgctgctgctgcagggggagtataatctttgcttgttcatcacgtgtgcgattctcgtcattattcaagggcagttattaataacgctataatccagctgtccggaaaccccaaccgcgcggaagcagacgctgcaacgattcttctcttgcacgcacgcgcgggcaaatcacctttcgtaaatatcacagttcacagttataacgggtttctcaaaaaaaaaaacagttataacggtactaagcttgtaacttaaaaaaaaagatgatttgtgactactccctcctccgtctaaaatttacggatttgatacgggctaggattacgaatttagatatgggacctatctatatttgtaacggtagtttgtgtcaaacccgatattaaattgttatatttttggaaaaagggagtagtagtggaaccataaattacttaaatcctaggctaagttgtggtttaattaatgggttattgattttcttcaaaatttatatgatgatttaattagttttaaatttgatttgggagcaagagctcaagccataactacactagatatgtctccgctctatttgcaactacgtactactccttagtaattgcggcaaaacaagtcattagtttatcaaagagctgagcttttgaatatcaagttttatgaatcggaggacaatgatctgaagcaccactaagaatttttcatttttgttttaatcccaaacatacttgttatgcaaactactactaggatgaaacatgttcaaagcaattccaatttgaaatatatctttcgacaaatagtataattaattctaaatagaccataaaagtaaatgttgaatgcacttattaatgtaaaagaaatgagtgatttcacagtcttgatgatataccggagggaccatattttctaatataaaactggaggagtacttctcacacctccggtactagaacgtattctcaaaagaaatcatattttgttgcctcaaatagacacgaggaagaagactccattttttggcgaggtaaagtgattatcaccagtgcttaatcacgatgtaccaaaaggaaaaacggcaacctaattaaacattaggaaaaaattatataagtgaaatttcctggtgaattagacagtgagtcgctctgcctagctggtgaaatttctcatcatcttattctgattaattacgagatcgatcaaatttggcaaccatagtcaggattacttcacgagatcgaccttaatgtttctttaaacaatgaaacatacatcgtttacgtcagaaacaagtcaaccatcgatgttgacaccaagttagttagtggtaggtgttcagtcagtcaaagtatgcttaagtgaaggacagtccgaaacacccctgctgcatgcaaaaagtagcactaactaacaacctaacgcattatattttcgctgaaaaaatatgctgaatgatgagcttcctttacaagttttcttcttttctccgggaggaagtatcgtcgatcgatctccccaagtatcctcttctatgtaaaccctcgattgcgtcaaaccgctgggatagataattaaactgttaaacccctaaaacaaagggttctttaagaaaatttggaggaattcgaccatccgaatttttttctacatgatcaggaatagctatccaaaaatgctatgaaattcttttggaatggctcagaaaatttagaggaattttgacatgagattcaacctttgggataaaaaaatattttcctgaaccctatccaatggtcattactgcagttttcatgtatttttttattcataggatttgaagtactagtgcactctaattctgtattttatttatattttttttctaagtaaagatcgtgccaaacttatttgagtacttagagaccgatgggactagatagctagcttacaattccaattatattttttctccacaaatgaaaaaagagaaaggcccagggtcttctcagctagcaacgcaagctgcgagctagtcggttcgggttcgagcctcaccccctccttaattcaaaatcaatctagtcctttctagattggtcccattttcaggtttcaaaaaaacaaatgaaaaaagaaaagactcttgtctacagttggtgcttaaaatttttagataattatagtaggtgcttaataattaattaattttcataaggtatactagtgtacgtaactatttctggtcagatgatctcaaagactgatcatatcagattgtgtttttctacaagttgacaactccgattactttttaattattattaagaacccaacccactgggttgtagcaggtgaacaacaatattgttaggtactttaacctaatttgtatacaataaagattttcctttttttcctgatgacgaagcttggtccgattaatcatgatcgtgatagtagcgcaacttcaaaacatatataatatacaagaatatatatatatatatatatatatatatatatatatatatatatataaccagtctgttcgagacaggctccaacaaatggatgaataaaattttgagaaacacacacatattaccaacacaaaggtagttcgctaatatatccttttccccaactttagtttgttggatgtttaattatcggggagaaatttgttgagatgtatggtacttaattgacctttgaattttgatgagagtttggaggatcgatcatgtggcgcaaagcgtttggtagtgacagtgtgcaacagcacctgttggctagctatagggctgctaattttccagcatccaccttccaagccaattgatcggccctctatttcctttacaataattgtgtcatgttcttttatgtcataagttaaacaactattaataacaagattcatggtaggaggcacggcagatacgttattgcagctaccacgaggctaggttaggtacttaggtatgattaataaatatgaaaaccgtgttagttcctttaactatttgttcagaggacctgatcctttaaattaattttttgtttgcttattttaccttgtgaagtactaccctctaacttagcaatttagcatgagacaatgcctcactttaccttctaaatttcctgtcttctctcttcatacaagtatgcattttaattaagttggaatgattttattttaacattattgcttggctacttgttaccatttaaattgcaggcaattttgaattttagaactcattttcggagtttttttagggggtttattatattttctgcttttctgaattgcttttaatttggaccatttagaatcagagtataaagtactacttaagattatttttagtttcttagatcacttgtttggcttataagccacaaataaaaggattaccaagaaaacgcataagacttattaaaatatatagatatatttaatattttttgcaaattgtcatgaaaagttttgaaaatattttgtaaagaaattttttatttgtgctctaacgttgattgatttcctcatttaccattgcaaaattggcgctctctctctctcgctaattacccccattctcaacttttatcctttatatgcctattccgttagttttacctagcgttagtaggtgttaacagtgaaatttggtaaactccgaagtcatcatcggcatagagtcaatatcggcttcaaagtcctggaatcaaccgatgggaattatcaagtcgctaatagtcagattcttactgtattcggataaggaaattaatttactaaaggaagtttatccataagagaccgagttcaagaaggatgcgacatgtcagtttatctattaattaggaatagtctgttagtttccttttatctttaggaaactgtgttgagtgtccgataagaacttaaagtttctttcttgtccaacaaggattagtatctatccatgggtataaatatgtatatccggggtcattgtaaattatctcacagatcaatacaactattctcggcccatcgccaccctctttactgaggtttttacttatcatccggtggaacttggcacctgacgcggggttgcatcggctttcgatctccagcgaaggggtaagccctacgttccgctggccctgacaatcgtatcggctacgttggtgttgtctaacgctacctcttggatcgctctggtttggttggtatgtttgtctacctacttatcatatatcttagttaatctagtcttagtatctcaatttagccatattggttgattctcgcttgagggtttatgtcggtatcggctaaatcgttttactagattaaattatctaaggtatccaccaccctgaaaactagtcaaaagcttaattgtttagactttatgcttctttgcatactttgcgatgcatcatccatagtcgtgcttaaaatcataaaagctaacctgtctttgattataataagggtttgattggggtttcaaccgatgagttatatggacgttgcatcggcttataaggattgtatgcatgtcggatttagccgattacaccaaaggtttcattgtttatctaatctttaatgacatcggaccaccagccgatgtatgctttaaccttcggaacaatgcttattctatcatatcattgttaactgattggtttctacttgattaaattgttttcttattacattaccattagttgattgtctttatattgttatttacatcaagtgtcagattctacatcaaccatatagccgataattcaaaatcctattgctatcggctgccatcaattggtattactccattggcttgtcagccgatcaacttattgatctactatttacatatgtcagtagcaggatcaaactgactagcacgcctgtatctcatcaatattttagacatgcgcggaagctaagcagatcttctaggtcgttgtgttcgtcgataacacagtttcggcaccatcggccgagcgcggatttttcgtcaacagtaggcaagtgaaaaggcaattttgcccttacatttattttatgcacgacagttttattaattatttttgcagggacaatttttatagcaaccttattatggactggtagtggaatctctcatgaatctatgagctattttagtcaggaacctggagttattttagtaatgaagttattatgcatttagtatattacatgaaattaattgacattggttgctcgttgtcttatagccacaactaaaacataaacttttttaacttaatttagagttgatttgggggttttaatattattttcagacttatctttgtaattggaatagaattatagaagtataaaagccttgccctgaaattatttttggtttgttcatttgatgcatcttaacttttattgtgaaaactttaatcaacaaactttgttggtacattaattaaaacgataggcttagcataattatccttttacctatgtacttttctgctgaatagctgaatggatgaatgatttgtgataattattggagggtacaaacaaattaattaaatattattttaaagttcaaaaatggatctaaacatttttataacaaattctatcgacgtttgagatcacgactatggtatttgcatagtatggagatcgttggtatcagggtatatgcgagattgaggtaaaagagtcagagacaagaatttttatgcaggttcggtccccttatctgacagataaaagccctactcctgttgaccgaagctagtgttgctctatattcatcataatcacacaagtacaatatttgggataacctatctagccgtcgtcgacatgacagcacgaacaccaacacgtagtcgacaatggggtagtactcttcctcctctaatatgaactcgtcgagatcagagatggcgctagatccctcttgtcggcctccgcagacaccaaattaagtctgtctaggctaatctctcatgtcgatgtctggcggcatattggtttgttctagcttgcgtgtctgtcgtcccctctcgtcatagggggttttgtatttatacccatagatgtccccttgtacaagtagaactagggagacaagtatggatacgatccgagtagtcattgtcgtttccatatagaactctactttctttccttatccgaaactccttctatatacgaggtacaattccgtttaagacttggtatatggtgggcccaccagcttagtcgattactattgggtatgcggtatccataaccatgacaaattcatatatagaattttattttgcacaaattgcactgctaaggagcatgagataggggtgaaaatggtacggaaacttttctgaattctagacctattttcgaaaacggaatctgtcagtcaagatttttttgaattttttggaaacggaaacgaattcagaaaaaaaaattctcgaaaacagaatctaatatgataagggcagttttcgtcgaaactcggaatcggttggaaactttccagaaattttctcggaatttctagaaattttgtgattgaaatacctattgacgagaaatctgcacttggccaacgatgccaagtctgtgttggtgcgaattaacttgacgaacacaacagcctgggagatctgcttagctccagtgcaggtccaaaggttgataagatgcgggcgtgccagtcaatttgatcctgcaactgataagatatacaaatagcagatcaatgggccgatcggctgataagccaatagagtaattccagccgatgacgatagggttttgatcaatcgactatatggttggtgtagaatctaacacttgatgtaaataaagtcaatcggctgatgataatgtaacaggacaacaatataattcagtagaaacaaatcggctaacaatgatatgatagaacaagtattcatccgaaggttaaagcatacatcggttggaggttcgatgtcataaaatccacaagattagataaatagtaaaacctttgttgtcatcagctaaatccaacttatatgctatccttgtatgctgatacaacgtctggatacctcatcggtggaaaacccgatgaaacccttattggcaatcaagaagcaggctaggaattatggttctaagcacgacttagtagatcaaactcaactgatgcagcactaagtatgaaaagaaaatatatatctagacaatcaagcccttgaccgatttttagggtggcaaatatcttagctaatctaatatggcaaagcaatttagtcgatactggcataaaccctaaagcgaatctcagccgatataagtaaatcgagctaccaaactagattaactaagatatatgataaattaggtaggcaaatatatcaaccgaatcagagcaatccaagagatcaaagcgatgcagccttgaacaacaccaatgtagccggttgttaacgaaaaatccgcgctcggccgatggtgccggaactgtgttggcgcgaactaagtcaacgaacacaatggcctgggagatctgcttagctccagtgtaggtccaaaggttgatgagatgcaggcatgccagtcaatttgatcttgtaattgacaagatatacaaatagcagatcaatgagccgatcgattgacaggccgatgtagtaattctagccgatgtcgataccaactgatagcgataaggttttgagctatcaactatatgtttgatgtagaatctgacacttgatgtaaaaagacaatcggctcatgatgataaataacaataatataatccagtagaaaccaataagctaataatgacataatagaataagtattagtccgaaggttaaagcatacatcggctagaggtccgatgtcataaaatccacaatattagatcaacagtaaaacctttgttgtgatcagctaaatccaacttgtaagcaatcctcgtaagctgatacaacgtccagataactcatcggctgaaaccctgatgaaacccttattggcaatcaagaagcaggctagagattatggttctaagcacaacttagtagatcaaacttaactgatgcagcactaagtatgaaaataaacataatatctagacaatcaagcctttgattgattttcagggtggtagataccttagctaatctaatctagtaaagtgatttaaccgataccggtataaaccctaaagcgagaatcagctgatatggttaaatcgagatactaagactagattaactaagataaatgataaataggtgcttacattgacaagattagagtgtcaaagccctagccccgccgatgcaaacagccatgacaagtataaattcgtcgaaaaagtataaaagtaaaacaggtggcgatcgccgaattgtaatgatcgtagagatagtttactgatgaccctaggtgtacatatttatacccgtggatagatactagtccttgttggacaagaaaaaaactttcctaaagacaaaaggaaaacataaaatcattatcgaacacttaaacacactttcctaaagacaaaaggaaactaacaaactcttcctaattaatagataacttgccatgccgcattctccttgaactcggtcacatctggataagcttcctttaatatattaattttcttaaccgaatcctccaagaatccgactgctggcgacttgataattcccatcggctgatttaaggactctgaagctgatattaattttaggccgatgacgtcttcggggcttaccaaatttcactgttaacaccggtacaattgcctaggccagcggaacgtaggacttaccccttcgctggagatcgaaagccgctgcagccccgcgtcaggtgccaagttccaccggatgataaataaaaacatcggtaaagagggtggcgatgcaccgggagtagttatattgatctgtaagatagtttacaatacccccgggtgtacatatttatactcatgagtagatgctagtcattgttggacaagaaagaaactttcctaaagataaaaggaaaacataaagtccttatcggacactaaacacactttcctaaagataaaaggaaactaacatactattcctaattaatagataaactgtcatgccgcatcctccttgaactcggtctcttctggataaactttctttagtagattaatttccttaaccgaatctactaagaatccgactattggcgactttataattcccatcggccgattccaaaagtctaaagccgatactaactctaagacaaatagatgactttggggcttaccaaatttcactgttaacaataccctagacattttttaaacactaaacaatgaataccatggtgtttggctgttattttttctagaatatttgttatgcaaatctgaagttacataagaatatatctttttcctgcattgggatttatcaacaacattactctcttcaaggtagataatttattcatagattgtgttttgtgatgtaccgttgagacttaacaattagaattatatgattatgttttatgatgaattgtttaccgttgagacttaagaattggatttatcagtttgaggggtttttgtattccgttaaattttcattaccatacccgcgccggttcgttttcgctccattttcggtttcaataatattgattccattttcgtatatggggtttctaattccgaaaaaattatgaaaacgaaaacaataaatgtggttttcgtccgttttcatccctagcttgagaaacgtgcgtatttatccaccattatgttccatgaaaaaaaaacacgtcttaaaggattaaatttgacaataaagaattttctttagaaagtatggctttgtatagttagagcaatcaaccaaatagtttataaaaagaactatatatcaaataagcgaagttcatcctggcacgcttagcctacattctgaacatgaccaaggtgctcttcctttacctctctttggcacctgagaacacaatgcattgtggtttgatttagagcattctcatatggtagaagacatatcatctatgtttgtttcatttgttgattttcctttgtttctttgtgagttggtttaagcagtaacatggtagtgtcacatgcaagatactttttgaaaccgacatgcaagatactctctcacacagactacttcctccgatacaagggattttggagggttgtgacatatcttataactacaaatctggacaattatcttttcaaaatcgcttatattgtgagatagttgtagtatttgcttgctatgcatgtcatccaaaatcctagtactccctccgtacatgtaaaggaaatcgttttggacagcgacacggtctctaaaacacaattttgacttcttgtttctataaaaatatttattgaaaagtgatatatgtatacttttatgaaagtatttttcaagacaaatctattcatatactttttacattttcaaactcaacaacttgagagttaatcatgatttatatttccaaggtttgacttaaacattgtcctaaataacttcctttatgagtatggagggagtacagttcaaaggttaacactagtcatacccacattaaatacaacctattctaatattgaaccaaaactaaagccaacaaatcaaatgctaagcatcactttatattttccagattttggcccataaagcctttgcttgtcaaatgcagaaaaatccctagttgagcatcgtaagtcgaaatttcaaaattgcatttgctaaaactagtaacgatataaacctactaggaaccacattatctctgttcttagaacagcactaggtaaagagcatgcattataaacaaactgcacaatgagattttagtacttggttaaaaatatttttcatctcatctgtcaataaccaaacaaattctcaaattttttaccccttcggcgaaacccacaaaggaccaaaacctactgaacaaaaatcatatcttactagaaatgttcatataagagttaaattaagactgtgctccacccaaacataatatttacaaataattgcctggtctaggatccatttcactatcaaatatttacaacacgcaacagtatacaacatgtgaatgtaagacctgttaactcaaggatcacatgctgagaatccataaaaataaatgaaaaacacagtaagtcattagctaatcgcaaatgctacctgcagaagagtaggtaattccaactctggcgtagaagatggatgccgggaagggacatgaaaatagagcatctgaaaaattgcaatcaagccaaaagcagtaaaaatcaatttggcagtcaacaaagcagcacatccccattcaaagtgaccaaacagaaacaataccacaataaacctgattttttcgacaacctaaggaaacactgaatgactaaagtaattgtgccttcagaaggaaaataaaaaaaaaaaaacagcaggacaagcaggtggttttaacctcatcacttctaatagcagttctgagagaattaggagttatttatttggtttttttctgttaaaaaaatgtatttggttctgttgaaaaggggtttttgaagattatctgctatatatgtccaatgagcattggatgtagataaggagggaaaaccattgctggcagaggtcatgtatacaattcactatgcattcctataacagatggaatccactactttgaaaagaaaaaaagaacaatacataaatctgaaaggaagacttgtctaataaagaatcagtcaggaagtcaccatacatcttattagatggacaaagcttaccaatttgacagcaatatacttttgagacgtaataattgtacaggtacaatgcaaaaggaggattgcgtacctttgaaattgccgggtgcattgtccccctattagatgcagccaaaccaagtagcaaaccaagtctagttatatcatgctcctgcggtaaagtaataaaaaggttataccataccaataaacaaataatgacatcacaaccccattttctcctaccattttgagtacggaagtaatcaaaaggaggacaaagtgctgagtggtgactgaggtgcaaagtggtacagaacgatttagatataacaatgaatacttgaacacaaaattagtgaagccagttattttctttagtaatggaaccaaaggacaaaaggccacctgggagagatatcggtaagcgtcggtcatagttaaaactcgtagatgttcatgcaaaccaaatgcaagaagcagaccagcatgagtaaaatttggttcagaaggtctattatattgtatccaggttcttaacattttctcctgcaaatagaacatgactgttacacattcacaagtagaaggaaatacagagtaaaaggtggcaaagcatttgccaagagttgtgaactttgcagcttttgctactgctgggtaatatggtttatctgttttgtgatagtccagtttacttgaaaaggagcaagcctgagcccagcagcgacaccattgtgaaactcagcccaagatttgaattctgagacgcttctagtacttaggtcaagattaacctatataaaatagtgtaatagggtaaagaaagttacaaccaaggatctacgatgaaaagatgttgtaaaaattcaggggcagcgcagcgttcatgttatgaggtgagatagatcgaaggtggtagcagtggcaacatgatatttatcgcccttccctgctgtacatgggaagaaatgcagttggatgtgggggttggtgaataggcttagcttctgttgctttgttaataaactggttaaatagagtacagctgacatgagtagccaatcaaaaggactaaaaagagcgtccaaccaaccctgaaatatcacaggtagcttcatatcattaactaatatgggttgctatctctaagactggcatatgcagcagtaccagatatgttgtttttctgtcatgaataggggaggccccgttccacgcatgacataggcagtgatattgcaattatatcacagtattaatgctacatggcgacgtgaacagttgatttcttcagaatgcaagtctaccagaaaacagataaaatttgagttacataagaggtaacattactgttgcattctgttgtgcaggcaaccgaccagccaaaacaagctttgggaaaaccagagcctgcagcaaaagaaaat

SEQ ID NO: 65662 - DNA, 22179 bp, Oryza sativa
ctgctctttgccgttgcagcagagggggcggcaacggtgggctcgcggcactgctgctcctactcctcactgttgcgtaagagaggaggaggcgacgaggggagtatttggccagctattggcaagtggctgtggctaaccaaatttagccagccgggaggaatatttgtgttggcaacttttttgacaagtcgacaagcacgatcgcaacacctaaacgccttgcggtgatatggagtcgccaaccacctcgatctagccaaagggccaaatcaagatgggttttgcaaaaagaaaagctaaaccagctagcggagccgatttagagatcaaaatcagcctctaggccgatttagattgatatgaggataactacccgtctcgtgggcacaacggaaggttttcaggacaaacctacaaagaggtaccgcactctcgtagcggcggcagacggtttacggcgcaaaccgacaaagatggactaaaactaaggtaaaatagaaaacatagtaaaagaacgattcaaatagattgtattcgggggttttacaatggaccggccttgtcccttaaataggggttggtcttgctctctacaggcccttctctacatccaactcgggatagaaaccaaagaaaacacaaaacctgccttcccgagtaaggaaacccgtcactttccaaactttaacaattttcccctatttcgtccataggtgccaaatttaggtgtaaacaatttggtcagccatatagtctagctagctggatggagatgttgttgaaggctaattttttccttcgctagataaaatttggcttggagagccccttaggaaatgctcttataaatattatgcacgtgctaactaacttaggcgtcaacgtcaacgtgcacgttgattttctagtatatagtctggttgaaaactgagttggtatagctagagataaaaatgcaaatgagtatgacaattttcaatcgaagttgcgtgtcaattatttatttttgggtcggacgttcccgggacaaaggaagagtcaaactgcaaattaagctggaatttacaaagacacgatggtacatttattgaatcacacaatggcgggcgtacgacgacgaccgattcatgttgaccgaccctgccggtcgtgaggtgaccaaattaagaaccgatggattatccggtcccacgaaacagtgacttgagcttcctgatctccaggtcgtccagcacggtgaccttgctcaggacatcggttgggaggttgttggcgaagagcgcgaagtccatgatctgcaggccggggttggagctgctgtagaaggagaccgccatggccgccgtcgcgttgttgccgtcgccgccgccaccgttgtcgttgatctggaagtgcaggaggccctgcgggaacaccatgaggtcgcccttgcggagcgtgctggtgtacaccttgttggatgtagagctgatgaatccggcggacagggtcccctcaacgacgtagatgagctcggtgccgctcgggtgggagtgcagcggcacgatgccgccgggggagaagtcgacacgtgcggcggagatgtcgagcccgttcacgccgggaaacctggtttgcactttcgatttcggtcaaaaatttcggtaacattttgaattttacaaaattttagtacttttaactaaatcttaacaaattttgatcaatttaaaaaaactaaaaaattccgatgagataatcattaggatagggggaggagccaggtgtcctaatttacgataatttcgagccgaaattgtaatcatttacctagtggagaaggccgaggacagggcgatgttgaaggggttgacggtcgggccggtggtgactaggccgcggtagcagaagtcttcggcggtgacggtggcctcgggcttgcacgggtagccggccggcgtgtcgccgcgggccaggtcgccgacgcagaagtcctggttcagggccagggagccggaggacatgatcagggagagcaagggcaggagcagcagcatggcgttgcccatggtttgtgacttgtgagcatgcaatgccattgtacgcagtgtctagtgtcgtacttataagagagtgcaaagtaccgacggatgaccgtctaaaccagtactccctccgttctattttaaacgtagtcatgagtttacgtattcaattttgattgtccgtcttatataatttttttttaaaaaaataaaaaatagaagccatgcataaattactattcatatttttatcatctaataacaataaaaatactaatcataaaaaaattaaataaaacgaactattaaagttggacacgaaaactcatgacggcttaaatgggacaatgggacagagatgactacgtttaaaatgggatggatgtggtagcttagtagtccaattcatcacacacgtacaattctatatacaaataagtttcatgtactgaactacatatttaatccaacttgaaattgattaagtgatcctctagcttcttggagaagtcaacaaacagggtaggtaaacgactaatccaatttgaaaatgatttagtgacgtagtactctatctttctctggcgaagttaacactgctaaaaaaacatttttgtaagccgtcgataactcgtatccgcatgtgttcttcgaaccacctgcgactaagggatggcgcgcagaaatcgagattttcttgcacatgcgcatttccatggaaaatatcaaatatagacaaaccctataatcagttgtattatattgtattgcattgactacagagagaagataaaaactggtgtaaaatatatgctagaatagatttatctctatgattataccttgtatccatggttcgtgtttgactctaactctaactacacatatatgcacttttaacgatctccttctattgtaatgggagcgaagagaacgaatatgtttccatgagaattctatatgcaaataagtttggcaacatttattataggacattaaaaaacgtgtaatcagcttgaagacattgcaagaacacatatctgttgtgggacatcgtaaaaaactggtagttagctactgagcacatgcaatattattttattataactagagcaaatgaagagagaaatagtcatgaaagtatgattttgcccttatttgccatgtgtgtctcgcatatagcactgacgtcgtggtggccaagacatgaaccaggaggtggtccacgttgcgctcgcctgcaagtgtggtgtgtggcagagcatgagcgccaacgtggccctcgcgctgaagtagcgacgagtgtgggaatgatgcgtagtccgtgcctaggtgtgcatactccctcccccccctcccccacacctgaaacaccagagagtcgcctagccggcgacggcgactgggggtgcagttgctatatgcgagtagggcttggcaggcaaggataaaatcatacttttgtaactgtttctctctcatttttcttagatattataaaataatgtcatgggtgtccagcaggctaattaccagttttttcggtgtcccacagcatgtacgcgttcttgcggtgtacctcagctaattatatattttttggatgtctcatagcaaattttgccaataagcttcatcacacatatacaattctatatgcatataagtttgatgtactgaacaacttatataatccaactagaaatttattaagtgatcctctagattcctggggaagttaacaagctaccttagtgttccatggaatcgtgattgttcccttcaggggcaggcccaggattttaagattgggtattcgaaatggaaagggggtaaaaaaatttttttacaacatgagcacaatatttggtacgtataatcaacaatatggcgacaaaactcgatccggtttctgaacgaacacgctacttagccccgcaaatcgcagcaccacgtctcatctggttatcaaccgtgccgaaacccggttaatctcgccgagaaggctaatccctacatgcgaatcgaagaacacaagcaagaacgagatagattgcaacacaattgcatatgaatgattaagcactcgaatttggggttccacaaaccgatctagcggcgatactattcttgacagattaatctaagcaaaaaccgacttaaaacgatgacgactactgaacaaatataattagggatgtcctagggttgccctagggcgcacacccccttgggctaagtccatgacacaattacaaggcccaaaacccaaatcagattcggactggatgaaatacgtggcttattttgcagattcccggcagctcggtaggaattttaacacgggaccaaaaccatatgaaagtagactccataagctttctaacaagtactcataggcaccgaaaatccttctagatcagcggttaggtccatttgaagttgatgctatcaggaggcccgaatccgaatgcaaaacgtgtaaaactttatctcttgtcttctatagaccaaaagtgacatggtgagatggaagtagacttggagaaggtcttagtttggtccccaatcaacttctttgatcatccatgcattcgttacgctcggtctcttttccttcaccaaagcaagtatctctgtaaacaaaaaaaacacacgaaactcattgtgtagcaatgtttgttcaaatatataacaagtaaatccaatatagaacatatgcacatttggttgagtaatacataagatagtcaaggttatatccgagctagttgtgtcctcatcatgaaggacgaaaatcggatttggtgtaaagttaagggacctcaaatgaatttattccacatataaatgcagaaaaaaaagcccaaggcctagcggcatagtctgactcaccagcacacaaatccatcgggcatgcacgtgcgcttgtagggtacttcactagttttctctgtttctcatctccagtctcgtactttcctgttggccatttggcggcgtggcacggcgcatgcgaatttactttctctggatgattcatattcatgaaatgtgaaaacaataagttcaaagaggacctaggtttgtgatttagattaaattgaatcgatcaaatgagcgttcgttttccttgtaggaagataaaaatgaagatgatcaagtgcataaagattagtaacgtcattgagagaaattttctttaagattagacatgaatgaatgatgatgcgtgcaagcaatttctaagctacaaaaaccatcttataaacataatttcttttcattgtttgtcttatgtaagacatgacctacactatctattccatacttgggggtaaactaagatcttttaccctatttgtgtacttgtgtgtatgagtgactctgattcggctcttgaggattgtgtgggcacacccacgacaaaatacctaggtccgccacttggtggtgagatcgagctgcatattgatgagatggatgtcgagacacagtggaagatttatcgatctgcaacaactccaacaagaatcgacgggctgcaaattgttgaacggtgaaaatgctgatgtcattgatgctttcttggctaacaatagtgatgatgtgctgatgaagtgtacaacggtgaggtggtaatggcaatagtaatagcaacatgctttgttcttggctcctgttagctctccagtaatcaaatcacatattgttcattgaacagcttgccacactttttttccattaaatagtctcgacgtctagtagtgtctatcacaataaaccgtctgtcagataaaataaaatctgatctgacaatagagaatgagatgagggtagtgttatcacaatgttgctagaagccgagaaccatgatgtaaaaaaccacatggagtattgtgggagcggaaaaatagacaaaaatgatagaaaaattaagtagacacgtctactctagtttctacatgatatggcaatctcgtacatcaccgccggacccttgtgtattgcttaatttgtacgttcagattgcttggtagcattctgcattggtaagttagctctttgctgcataaattgatatcgagttcttccagagatggtgggaggccctcttctggcaaccttgtgatgcgagtacaatgccaaatctccaacctcttgagtgagggaaggcggtgtaatccggcaggaaaatctatgaattcgctgcacgcaaatttgagctcttgcagggacgagaggtgctgaagcgctttctcttgctcatccaatagtctctcctctccgcgtctgtgtttttcaagctctaggcgtttgagggagccaaggtacttgaagaacgatgtagaaaggattctgggatcatcgatctctagtctttccaatcgagggaataactcatcaacccgccctggaaaccaaagaaaagatggggacaagctggggcatttgtatactttcaaaaacctgagattgcagagggattgcgagacctctattttggtgagctgtgaacattctcgaatctccaactcttcaagtgccgtgcagcattgcaactgcagacattccaaacttgcgttgttctgcactagtaattttttgaggcggacgggcttccctataaaacagggtagcgccgtttgtagggaataatcatgtacgctcgcctggtcatcatttttgccgttatgcacagaagacaagctgaaattgcgagatttgtctgaacaactgcaatgaatcttcttcagagaggagacgagatttaacggaattcgcaggagtccgtcttcagctgagcttatcgaagcgtcacttggatgtcttgacgaggaagcctcaagatctaacaaaagctctagttgacacttttcctcctctcccatcgatagtctcgttaccgccaggcaatttcttaatgtcaattcctgtacgccctgcacatgttgcagtatctgagatagccacttccccgttattccacattctgtaatactgacaagttcaagagatgggcggtcattgcgatttccaattccagctaccatgtcttcacgggtagaagtaggctcttgcggaacatctgaagagaaaagattttgacactcgtctatcttcagcctcttcaaatggatcagttgcctgagtccttccaacgaaatatatctcagatttcggcattgtgatatatgcaaagtagttacaaacctactaaggttgtggtagggcaacactgttttatccatcgctgtcagcttatcagaaaatgagttactcctaatataaaatattccttcgtttgacctcatcgttggaagtgttgaaattccattgatgaagaactctgaaacagtagttgaagggggaaaaggatgaggcacagtgaaatcaggacaatcatcgatggtgaggttgctgaggtggggcaaccatgagcaccccaagttacggcagttctcaaacaacggaaagaccttcagaaccgggcaccttttaatcttcaggatccttaaactggagttgaagtccaccatggaagtgcaagagcacgtatgcaagttttgcattccaattaaaataatatcctgcggtgaacggattgagagcaccgatgcattcttcatctcgatcaacacaagctttctaagcaatgatagcccttctaaagaaagtgtatgccattctgcacaattttctagacgaagtgtttgcagataggtaagtgaagtggaaagccaagttggggctttagttccattgtaccaagatatccgtagatacttgaggttgtgatggggttcaagaccttcaagctcctcacttgctatgtctagaatatgatctaaactaggggcaccattgctatcactcatttgcaatctctccccttctgtttctgagtgcatagaaggttcggatatcatgttaccatcgcattcattttcagagctcccaccactgtcgtatctattcccgtcactgtcatatccattccgtacacccttccagaacaaatgtagtccctccaagcaatggttgcttttcaggcttgctccactggcctcttgctgagttgtaacgttttcaagtcgagacacacccggttctacgggctcgctcatgcattgaagttgtgttatctcaaagccaatagaattctcaaccttgaaatttgttagcttctgaagtgaggccatttctcctatgctagcaatggaagaacacactcccttttgggcaagatgccgcaggctgacaagattatttatgtcatcaggtataaggggacttccatatgaaccaatatctagtacttgaagatggtagcacttgctcagagcatggggcaaagcttcgtgggtcactctttctaagagaagatgaaaagctccatgggactctttgttcttaaatcttagatacctgagatgggtagtgttcgccaaactggaaaggaaggaatcaagatcagcataagctgcagtgatatgcagcagtcgcaaatgctgagcctccctgaaagcatcttggaaggatttaaaaaaatgatggttatattgcccaattagtaccaatgtcctcaacttactccttgacataactttcatcaaacttttctcaaattcctcattacgagataattttccattttgatacttgcagtatgcagaattagttactatcgacaaatgacgtatactcggtgctaactctctgcactctgatccatctatagttgcacattctgtttgtgaaaccagtcgtgctaaatcatgcataagatcatgcataacaaaaactactgatgaagaccaccaactttcagcttgctgaaagaaacccgagttcaccaactcagttagatattcccatcctttgtgctcgaacttctcactggatttttccacaaatccttgagcaatccatatttttatcagttgtgctttactgaaagagtaacccttggggaaaagagaacaataagagaaagattgctgtagctggttaggtagataatcataactgaacttcagcacatgcatgatgccatcagtatgtttcagggattgccattctttgttctctataatgttgatccaatggtcttcagtaagatttcttcgtagtagggagcccacagtttttgctgccaaggggttgccttttagctccttaattgttttcctcccaagattctctaaattttgattactaccatgttgatcagtactaaatgcatatgctttaaatagtgaccatatatcaccatcttccagagcttctaaatttattgatcctgccgttccacacctttgagcgacagtcagtattcgagttgtcacaatgatcatattacctgtcacttctgatgcattcacatgattaggtcttaaaggacccagtagtttgttccaacagtcttctgtagtgacatcccagacatcatccaaaacaatcagaaacttcttagatttcatgtgtttctcaagatcctgctgaagcatgttaaagttgcttattccttggtaacttcggttggagacacaccctaaaatctcccttgtgatcctaaccacatcaaatttatcagatacatggacccatatcttgatctcaaactgatttccgatttccggatcattataaacatgttgggacagagtggttttccctatccctcctatgcctacaattggtaggacggttatgtcattggatttatttcccatgattagatttttgatggattccatctctgcatctctcccatacattttgggctcaagaggataagatgatgttattgcatttggggccaggggtgtactctcacacctctgatttaaacttgcatacccacatagcctcataaccccatttacagcctcttgtaactgatgagtcatatgttggatcatgttggagagttcacccctgttccaaggatgcgtgctaactgcctcgtggagtgttgaagtgccatccatcctcatcctttttctgccaactgaattaccaggtgcatttggtgcaccctcaccggcactgcaaaagaatgtgatcgtggttcggcaattagcaaagtcagcgatataacacgatcttaagcagataaacgcagacggttaactcagcggaattaagagctactccctccgtttcataatgtaagtcattttaccatttcccacattcatattgatgttaatgaatctagatctagattcattaacatcaatatgaatatagtaaatgctagaatgacttatattgtggaacggaggaagtacgtgccttatgtggctacgtaaacattctattgaagattacagagcttcaattctccgtttttatatttgacttttattaccatgatctacatcataatggctgacgcgctaaaacgcatctacatatgcgataacttaaaaagatgttccttatatagaaataaaatttttaaagcgggttacatcatcctcaaattactcttatcgcaccctttttttattagtagtggtcatagtaaaatctttaatgcattagttgactattaatccataccaaagggcaaatggacttattatagttactaggaatgtagcctgtgtatacgcacggacatgttgtttaatgttgttagaatttttattacgaatatttatgtgtggatgatatttttgaaatatttatttaatctattttaaacgtgtatttgttaataactggtttggtcgtattactactagaaactgtatatccttaaatttcttagaaacaaacgtgtcacaataatggagttggttcgtagctatttgtattatgtgtgattctatttttaaaatttttcgagtttccgaacttatataacattttttattttgtatgccatagattactttaagtagcattttaattttattatatatttctaaaatatattttctattaaaaatatacttcatccattttatattataagactttctagcattgcccacatttatataaatgttaatgaatctagacacctatcaatctagacacataggtgtctagattcattaacatctatatcaatgtgggcaatagctaatgatactacttcatctagccaaagatgatttatattacttatacttcctctgtcacataaatcggaggagttaaattttattctaaaacaatagaataatttatatgtaactgagacaaagtaattttttaaaatactagcacgataatctccaaagtaccgtattatatttttgacagatatctatagtgtaatgcacgttagttcagtgtctggtttcttttcaacacctattctttctaacgacatgagacacctttagtaatttggagaatacgtatgtacatttaaattagcattgtatattcatcaagtttttttacacctaagatatgatgtgaaattattatcatagcgttaattattacttgtcggttccatatgttttgatgtattttgggctatagacattatcaatttattgatttaaaggaatacaacgggatcacaaattggatatataattttaaaataatttaaaagatagaacacttaaaaagcattgattggacattttatattatatttgtgtaaatttcaagattattatattttatctttaaattgaacaaaactagttgggcagcccgcgcaattgcgcggctagcatcaatttaaaatcatatatttttacatataattttatttaaaattttattcccttgattctaataattttatattttctttaaaagccatgctagtcgctaccccttactcttttgacactttttttttgcttactcgatctacctctgtttctattcatcctctttagaactttataaattaggccttatagtttttagagtttattgtcttgttgggtttcgttttcataatttttagaagtatctttaaacatcaccaatttactactctacggccgtccactaccacctctctttattgtcatttggattttaaaattagaatataattattgtttgtattccttttttactttttataagtctcatcaaatcgttagtggcttcgccactatactcatctacagcccgcctgctgcctgccctccttattgttgtagagattttaaaaatccttaattattacttgtcggttccatatgttttgatgtatttagggctatagacattatcaatttattgatttaaaggaatacaacgggatcacaaattggatatataattttaaaataatttaaaagatagaacacttaaaaagcattgattggacattttatattatatttgtgtaaatttcaagattattatattttatctttaaattgaacaaaattctatttttaggactcccaatctttttggctttattataagtatgttttctattgttccggcaaatgatacgtaatcatcattgttctttaaatcatatgtacgtatggagtactttttctggttaatagctatatgtttctcatgtatccgtatatacgataatttttttatttttaaataataaatctaatataatggtgtaaaataaaaaaactaaattgtgttgttttcatttctacatatgtatatttaaattagcgttgcatatttatatttgtgatatttgagaccctaaaatatgatatgaaataaaattagcatcacattagaaatagatatgcatatttatttgcgaggagtagcggtgggctcctgctcgtgtgccatttttgagcctggcagacgccacgtcacctgatctaagggcaaaatgactatcttgtccttcttcttaattcatttctcctccccttcctcagtcccttttacatctttccttttccttgccagtgagctgcttaggctccggcgagctccccgccttgtgctcctccctccctcactcgactccctacatccccagcccctcctctattcctactgccaacgtcatcaaggatcagcgggcatggctgtccggcaatgtgatgccattgctggtgcctcactccatcatcgatgtcatcgttgtcctctgagcacagagcgtcgtcctcctctcggatcttctccactctcccccgacgtcgacggctgcgtcagacccagccttagggcttcccctgcctcattgttcgctgcccgatgcaggaggtgagggtgcacattgggtggtagaagagccaggggccgttcgtctcctccatagccattcggcagcgggacgctcgaggtcctcttcacgtcgtcctggccttggcttgatggtttggcattggtggtgatggcatcaccagctcatgcgcaggaagaaggttgaaggagagagaccccaagctggaggaagaagaaaggcaaaatggtcattttgccctcatatctggtgacgtagcgcctcaccagctcaaaaatggccaatgagaaagaaatcatctctctccaatggtaaaaaaagcaaagttctttggaagagtggcatttgagaacacgccatccgggaaagtggcaaatagtccaaaatcccttggaccgcagcattgctgggccgcgcgcgcttcatgggctatgtgcgtgaataccctagcaagccggcgggggtccgacaaggccttttttttcctttcgatttttcttttctttttttagaactttctttctttatttcagaatatattttcttaaagggctcatatcatgaaaaactaaaccctaatcagataatatttttatcttggatataatttttgtttacccgttccaacgcatgggcattttttctagtctaattttgaatttaattttgttttaattctaaatttaaatctgtcgacgagtgatactcgtagaccggataagtagagtattggggtacattggaacgagggtctatgtagtacgacatcaagcagacaaaagacaaagattatactggttcagggcccttatcaggtaatagccctagtccagtttatatggaattgatgatgatgagaacacattacaaagagagtagtcgaaacagatggtaccgacgagatcgtagtcgagagattcgacgagatctcccactgagttggctccgtgtactccggcttcataaacttcgggaggtgtgttgaagatgagatacgattccctgaacccctcccaggggtcccttttataccgtggatcatcttgccccccaagaaaagcttgaggatatcggacctggtacagtataacagaaactctatcctttccgagtaggattttggaaatcacttgacccgtagagatattttctataatttgaagtagtttccatgtgacatttacaggaacaatccatatacgcgaaggtatacctaatcgatatatctcgtaagtcgtaggacatgaggtatgccttatctgtaaccctaacaaattcaatcccgagttgggctttagaaggactgttttttttcaactttcgttatttctattccaaatttaagttatttataaattgtatttctacttaattttttttctaatttaggaatttattttattgtttattttgaattttaattaaactcgtgttgtgttcgattattatttcaataatattcttttatttcgaattttagtcatttcaaaattgtattcctactcaaactcttttttttttccttttcaaatcccagaaaaaatattttggattttaattaatcacatattatgttcttatatggactcttttttcagtattgcttatttttaattcttaattcagttatttattagattgtattcttacattgactaaattttagttatttaaaaattgtattcctcttaaactctcatttcttttcctaatataagaatttattttattttttattttaaattttaattaaactcgtgttgggttctagattgattgttttttttcactattttctatttcgaattttagttatttcaaaattatattcctactaaaactctcttttttatttttcttttcataattttctaatttttattccgaattttaattaataaagtattaatgcattattataaggactcttattccaatattgcttatgtttaattccgaattttaattattatttttaatactgtattcctacttgaacaaaatcttagtcatttataaattgtattcgtacaaaaactcgcttttttatttttctgatttaggatttttttttattttttattttgaattttagttatttcaaaatttattcctacttgaactttcttctttctttttctaatttcagaattttttctgaaatttaatttatggattcttatatggattcttcttccaatattacttatttttaatttcgaatttcaattgttttttagattgtatttctatttgtactattcttttctttttcatagccaacatgggaatttctagccttcatagctatcgtgttgtctttttttatatatatagatagatagatagatatgggaatttctagaaatctaaaggcagtatggtgtctctttttagctatcattcacagattggtagtatacctggaagggtctggtggcggaccaattgcttcacgtttcttcttacaattgtcactcttcagatggttgtgtaaaactgacgtccctttgtcggaaccgcacttgaccaccgtgtgacagtggatacatctggccttcaccgcctttccgttttccttttccgtgatatcgaagtcctcccaagccttggatcgttttttgccaccactgctactcgctatgccagcgttgcaactcggtctcgctgcttgctctactccatgttcatccgcgcatgaatctgaaccaagattaaaacgtgcaacggaaattggaatcaagtgtactacctcttttcaggttacaagactttctagcattgtccacatctatctattctatctattatattattaaaatagctctaaaagaagacaccacgttcgctgtgggggctagaaatttccacattaatcgaagaaaaagagaaactattttgatcgttagattatagctgtttagatttttcaatggtgcagattaacacatgaaaaatattggagtccaactagaaaacgactacagaaaattgggaccgacctatattctatatagagtgatggcaagttaattaaacctttatgattaggattaggagtcggacatatttgcatggagatcctgtaatcaaatacagagtacaaatctaaccagtgtaggacacgttaactcaaggtagaaataaaaaaaaatcaaataaccaatacagttggaataaaacaatgtaagaatatcattatgcatgagcaaatggaccaggaacgtaacattaggcgtgcaagtaggaatacattttaaaaataactaaaattcggaataaacaataagtaatattgaaagaagattacatataagaatccaatacgatattaattaaaatttagaataaaaataaaataaaacccaaaattagaaaaataaaggacataagagtttaagtaggaatacaaattaaaaataattgaaattcgaaactaaaaataagcaatattaaatgaagagtccatataagaacctaatacaatattaattagaattcagaataaaatataaaataaaaataacataagtttaattaaaatttgaaataaaaatcaaattaaattctgaaaatataaaaataattataggagttcaagtataaatataatttataaataatataatatcggaataaaaaatatgaaattttcaataaacaccatccatctataaaacgcaacaatgacgaataacaataaagagggaagaagcaacaaagtcgtaaaggaattaagtgacagcagttgatgggacatctaaaaactataaacaaaacccaaatagaatcccaatggcgatcaaaaggagggacgacggataggccgttaagtagtacgatcacggtggttggctggatttctagaaagtaaaaaaataaacctcaatgatattaaagagggaagacaacaagggtaaaaacaataaacaaaaccacaaatagaatcccaatgacgggtaacctgttaagcagcacaaacacgatggttagcaggaaagtaaaaaaataaaccataatgagaatcatgttcgaattttaaaatcacaatgacaattaaaagggaagacatcgggcgggccatataggagtataatggctaagctgctgacggtttggtgggacttctacaaagttaaaagtgaacaccgacgatcattatatttgaattttaaaacccaaatgacgataaagagagaaggagacggacgggcataagtggagtagagtggcggcgtttgatgggacttctaaaaattataaaaatgaaagccaatgagttgattaagtctaaaatttataaggttctattttaaagttcaaaggaggacgaatagatgccgtagtagatcgaacaagcaaataaatgggtgaaaaagagcaagaggtagcggcaagtgtgactttaaaaaactataaaattagaaaaatagagatgataaggttagtcttttaaagtcctaatatacaaggaagctatttaacaaattttaagtaaactcatatgtaaataattttgtatggatactatccgcgcaattgcgtaggccaccttgctagttcatatagatggatgttaaagattctaggcatatgggtaatataaaaaattcttataatatgaaacagagaaagtacgtacgacgtcctgcgttacgaagaagggaagaacaatgtattttttatgtacacgctttacctccttggagctgatgctggagcctgtagtattcgagctcgtcgaccgcgtcgtcggcgtcgtacagcacctcccttagacgaccgagtgatcgggccagcggtttgttcgcgatcgccctccccttgacagcaccgaccaccacctccaccctctcgacctcagaccggagcttttcggtgtcatcggcgagcccgacctggctaatccacgcgccaaacttgtcgttgtccaggttctccactatggtatccgccagccatccaatcgaggactccagcaaattaccttctatctcctccatccgcaaatgagaagttattagtaactcttaaccgatggtctatggttataagcaaaatacgcgaatgatatttgggaacgggagcaccggagcagccgagaagagaagaacaaacaacgacaacaaagtacaattacagccggggggactcaccgcagcccgcatataaaagcagtacagaagtcagaactcagaagtccgacatggttttggaccgagtgagagacgatgactttgctctccccatattcaaaaggataaacctcgagcaagcctttcaaaccgcacgcattttagatttcgcgtcgtcagatttgcatatgttatcattacgcatacgactgcagcaatttgactgaggatataaacattgtaatgaatgaacttttagagttgaaataatccctccccgacacggctgactcagaagctctgcagtacgcaaataaaacaatttggagaaccgcacgctgaaagcggaagatggattctaatccctcaggccttgttcggttgctagggattaaatcctaaggggaagcaaaccagggagggattgagtgaatccccccaatttcactcaaaccctgtggggactaaatcccttgtttcttccaatccctctcttagaaactctgtgttcgttttgacagggactatagcagctattggcagggaatataggagcgtattgctagctctctttatgatctggacttgtattactactattagtacatttggttaccactatttacctaaaaccagtagtgctagtaccctgtgacggcagcgtaggagcaagatcaaaagtaccattagtccatttcagagaaaactagaaaacaatatacacgcatgttacaacttcctggatcaagaaagttgatgccaatgtagtgccagccaaaattacaggaaatgcttgtaatattccaattatatgatataataaaaagattgttctgattccatttaactgcttgaaaggttgttaaagatggctgaatgaactgcattcaggcattgttgaagatctgacatgtcacaatgtcaacaattacacctgatcaagaaataagctattttcagttggaggcatagtgttattatccaaaattaatcattcattcgatggttaattagtggccactggtttctttagcacacacatcagtagacactgatactgagcaagttgaatccatctgtggcgacttcgatgattgattagtctaaatgcacaacaaaatccaaacttctcccaacatccctaaaatgacacatcagtaatacccttcattggatagttaattagtctataaatgacaccatcacgaaactgctaccatcaaagaaattctatggaacatccctaccagtcaatttcaaggagtctgcaaggaaaatcagtgagtagacatcagtttacctatcacagaaatagagaagaaaacaaaactactaccatccaattattctttttccttctactagacataacgcaatgaacattataatgcacaaagtttcagaatcaattgtatagtagatgtgaatcttgagttgcctgaattttaagaagatatagaaatcatgtatagtggatagacagatatatttccgagttgagctcgcttccgtgtggaccgtgtaaaaaaatggcataacagtgaacccaaatccatcaccaattcacaatcggctcaaatctgatttgaggagctgggcatagccgcaaccagcagttgggttcttcatacgcaatcgacaagcagcaccatgttcaaggccttgttcttgatggtggatgaggaggagcccttgcagttggagacggagataaaccaagaaacaaggaccaagaaccaaaccctaggtaggataggaagaagagaggagaaggaagagagactcaaaagtgagaaggtggccagcggaggagacggtcgccggaggggagagcgccgcgtcgtcggagcgccgtcgaatcccagtcacgtccgtgtcaaggagcaaccactgtccgagggcgctaagtcagttgcagaagacgctggagatgatgctgattccggaaggagggaagatgaacttgaagcagctgaaggagaagtggtgcgccgtgcaacaaggcccgtcaagataaacctgaagtactatgggcctgactgggccgtgtaattaagtctaattcctgtaatagttcttcgtgcgagaggggaaagaactgagtaggtgaggaagataagagagagagaacacgaggtgaactctgtctttggcgaccatggtggcgtaggcggcggtggctccattcctgtcggaatcggagaaatatctcagtaatagagttgccaattccttcgtgttctaatccgtgcgttcattctggattgcttttcctgtgcaagttcgttaacaattggtatcagagcctctacgctccaagaattccttggcgcggttgtaaaattccagggggaggattggaattgttcttagaacagattccacaataaggcaacttgccttctcttggttaactgagttcgggaaggagcgggggattctagatctagttgggttcgctcacaaattccaggatgtcgcaggagagtaaacttgatgtcttgttgagaactattgaggagaatgagaagaagagaatggaggcggaggcgaggactcgggatgatctcgctgatctgaagaagatggtggagatttgtcttcccaagatggaggagaaggtggaaaaactcagcgagtccgtgcagacactaagccacaaggtggagctgatggaaggtggcgcgatcaaacaagaaaccgctgcagatgcttcagcacaaggaactccatggttgcatggtaagcggaatcctcctcccatctcacctagtccattttctccggattctactgtgcaatcaccaacttcttctagcatcacaccgatctgagtactagtcttcctcctatgacttgccctaagtttgatggtgagaacccacagatgtggaagagcaattgtgagcaatactttgatatctatggtattaatcctatgcattgggtcaaggtggccacactcaatttcagtggtaatgcagcattttggcttcagtcgatccgttctcaaattatgggtattacttggcaaactctgtgtgacttgatctgtgctagattcactagagatatacaggaagcactaattagaaaatggttccatgcgcaacagaacagcacagtcactgaatatgttgaacaatttgacagtatcatgcaccagctaatggcatatgacagtgctctcacccctgtgtattttgttactaagttcattgaagggctcagggatgatgtcaggggtgcagttatgctacagagaccccaggaccttgactcagcttgttcaattgccttgctccaagaagaaatcctggaaagtaataagtctactacacacagaaggtctgataatcacattgcgttcaggccagtaccaaaactcaacaattatgtgccagtgcctccaggacagagatctgtagctgttagtgcacatgatgacaaaaagggagtggaatctgctaagtccagagaggacaaatttgcttctcttaagtcttacagaagggctaagggtctttgttttgtctgtggtgaaagatgggggagagaccataaatgtgctacttctgtccagctccatgttgtccaagaattattggaagcaatgcgctctgagtgtaattctgatgacatcctgacagctaaagaccctattgaatcagtagaggcaattgatggaggattgatggctatatctcagcaagctttgtgggggtacagaatcatccaaatctattagattaaggggatgggttcaaggaacagagattcttatgttgattgactcaggcagtacacactccttcatagatgagagcattggcag

SEQ ID NO: 65663 - DNA, 72212 bp, Oryza sativa
cgaaattaacctgacacatgatgaaaatgaatcgctgttgaactggtgaatcgggaatacatctcaaggtgggaaagacaaagccaaagaaaaaaaaatcaatccacatgctggtagcatgggaaatattgtgtgagcggaacaggcgagtatttcaaaatcaagaaaaaaaccttgctgcagctactagacaagattcatgatgaagtcaaactatggagaatatgtggagcaacaaacactgcgagattatcggcctaagactctttgattgattagtggttttctccctcttctttttttcctcttcttttgctttttcttttctttttctttttatcttctttctctccttcaccgttggtgatcatgtaaatagtatatcccctacttaatataacaccagctgtgctggctcgttttttttttaaaaaaagaattattagcagagctagcactcgatcttatatatcttgatcgacgatcaccttgctccacacctctcaatagctctacatatatatagtaaagaacattcctttcaggattagttgtatgcaaaataagaaacgtgttatcgtatgattaaattagtattaattattaaaagtttgaaagattgatttatttgattttttgaagcacctgttatatatgaagtttttcataaaacacactatttagcaatttgaaaacatgctaatcaaaaagagtagctaagctcaattagctactcccttaattaatccaaaagtcttaagcatattttaacttttggttttctaaataaaattataatttttgtagtctatgttaatgtaggatgagtttttttttccgcgaacgctaatgtaggatgaattaatgtttccttgattttaatgacaaaagagatatctccatcgatggagggagtatttagaacatgccattagttttgacatgtttaccgggaaattgaagagcaatgtccccagatcgaattcgagtactggagaacaaccaatatttagatagcattacaactccaaacaaatctaggacaatgggcttggaattttaaactaactgttggacagcatagtttgcatggatatagagcactagtaacatttgttgagaaaaaaaatagttaatacaaacaatttatttgaattaatgattcctggggcaaagatcaattaaggaggtgggtaaactcttaagggagctaaccaactcaataatcgtacgtatttatatgcataataatcaatggcaggacccgtccgtcggtccgtgtttatgctaacagagactttacggattaatttttcatggtaattgaactaatcctatacaaaccttatataattcttagtatgttccaatgaagcccttgccggtttagctaggaacgacttaaaggtgcatattgttctgcacgctccaatttgtgatccatgagtcatactctcttctttcttattattggacacagctaactaatataaatttatctataaaaacattaaatcatgatgttttggtgagcacacatagaatagcatctaacgtactattgataatacgacatcttttcaaatatctatatcttttgaaaagacactatatatcaaagattttataaataaagtagtacctattggcaaataaaaagaaactgagggagagtaagtaaaaaatgtcgcagtacaattatgttgtacctaacaataaggctactgctacagtagcatggcactattccgtgcattagatgaatcacagcacgactacaggcacatataacttttcctctaaaaacatgagcgtttcagtgtagcacctgtggttttctgcgctggatgatcgccaaacctagtgatttcccctgaaggcctgaagctctaagacctcgttaatttaggaggtctaaaataggatgggattttagccatttcctcggctcatcccattgctcaaatttagctatcaatgttttgagaataatctacattgaataagctggattattataataagttgatacagaataagttgtgagttatttgtttctctggattattgaaggcatctaagggtagtgggtctttagccactcaataatctagaaaaagctccttcagatgagattattagattatactaatctggttcatagattataataatctattataataatctatcataataatctacttatttgttttagcttgctcattataatccaaattataataatcctaaactgaatgaaacagtacctaaccatccctacatgcttatgactggttggacggaaaatactcccagccctcaccaactgaccctgatccctgagggtgtgtttggataatgagaaatgaggggtgggattggtattgggaaataaataaagggttagtattaaatggatgagggagaatgaatggttaagatttaaagaggggtgggaaatcatttcccttagatatttgccaaacactgcttcatggcttaagccgaatggcattgatgagccaaaagggattgcaccttttaaatagtatgtgcactttcttaacttctatttttctcactttttgcacgcacgttattaagctattaaacaatgtgtgtttctaacatttttatagaaaagttgcttaaaaaaattatataatctattttttctaatgcttaattaatcatataatacatcactctgttttgcatgtcatgaaaatgtctcaactttctcaaacgaacacagcgctaggcgggaataagattagaagatcattcagatggaaacagatattccatccatgatctgcaaacagtaagggctgtgtttagatttaggggtgtaaagttttggcgtgtcacatggaatatacggataaacatttgaagtattaaatgtagtctaataacaatcggtcagtaaaccacaagatgaatttattaagccatattaatccgtcattagcaaatgttcactgtagcatcacattgtcaaatcatgacgtaattaggtttaaaagatttgtctcacaatttacacacaatctgtgtaattagttatttttttgtctaatttaatactctattcatgtgtccaaacattcggggcctgtttagttactaaaaagtttttccaaaaaatcacatcgaatctttggacacatgcatggagcattaaatatagatttttaaaaaaactaattgcacagttgggaggaaaatcgcgagacgaatcttttgagcctaattagtccatgattagccataagtgttacagtaacacaaatgtgctaatgaaggattaattaggctcaacagattcgtctcgcggttatgaaattagttttttttatccttgtccgaaaactccttccgacatccggtcaaacgtccgatatgacacccaaaaaaattttattttcgaactaaacaagcccaaaattttgctagggggtctaaagagggcctacataaaaacatagcaggccggccgtctactgtttcatgaaaaaaaaactgggaacagaacaatgataagttaacatatgaaccttgattttgattgatctctatttcatttgcatcaactaatctttggaacacaaaattacgccaaaacaattgcatcaaatatgaccgtcgtcgtggtgcgtacgaaaatcacacactgttttgatttgatgaaccatttcctcggaattgaatagcacatttccgtttgggacaatatttatccagctgctagatttcccaatttcctttcttttttttatctatgaacgagcgccacgtgtcagccgccggagcagcaggcggcgcaccggacgaggccgttctcgttgcacgccgtgcagacgcggaagccgccggtcttctcgctgtaccgccggtggctgccgtcgcacgtgccgcagggcacgaaccgcgtcccgccgcacgacgcgcacggcgtggccgccgcccgcgccgcgccggccaccacgcggtggagctccccgctctcgtggaggaggcgcacctcgtcggcgtcgcccacgaggcggcccccgacgaacagctgcggcagcgccggccggtcccggcgcatgagcgcgcggagctcggcgaggtaggcggcgtccatggacacgtcccgctcgtcgacggcgacgcggagcccccgcaggatggcgcgcacgtcgcggcagtcctcgaacgtgcctcgcacggcgcggagggaggtgaagtagagcaccacgcgccgctcgcccgccaccgccgcggcggccgcctccgccgcgacggcgaacgacttgcacgcccggagcttggtcgacgacctcacgcggtgcaggacgttccgggagcccggcccggggggcgcgggcgccgcgtcgtcgtcgtcgaggacggagccgatgccctggtggtcggccttaccgccgccgccgccgccgccgccgccgctgctgggcggcgacgccacgcacgagggggagaaggacggggactgcgtgagccggccggtggcccggccgcggcggacccacggcgaccacatcgcgccggcggcgagcgatcgacggtgactcggtgagggaggagtggatcggaggaggggagaggagaggagtccgcggtgcgcgcgcgcgcgcgatggatttggcgcgaaattagttggtcgccctgccccctctggcttgctaattttaaccatgcgttttaactgtctccgctgcttatttgtggcgctggatttgcatcgggttagtttcctttgatctcttctcctggtgctgacttttttttggggccaactcatagagcgtgaggatgacaagtgggcccatggatgtgatcgacagaatttttatgtggacactttttttttcgcaagatactatcttgcaaccattaaggcaacaaggccttgttcggttacgcccggatttaatccggactgggaataacaagtataataagaaatttacatagatacaataagagaccgggatttatttcggaccgggaaccaatttactcatgatatagacaataagaaaccgggaatcaatccactagtcaagaggtgtggaactaacccagatgttttgttgtccctatgatgagtaaattagtttccggcccggaataaatcccggtctctcattgcatctatcacaaatttgttactatacttctcattcctggccgggattgaatccagatgtaaccgaagaaggcctaagggtgtttagatccaggggtgtaaagttttggcgtgtcacatcaggtattatatagtgttgcactcgcatggggtgttcgggcactaataaaaagctaattacagaatcgtccgtaaaccgtgagacaaatttattaagtctaattaatccatcattagcaaatgtttactgtagcatcacattgccaaatcatggagcaattatgcttaaaaaatttgtctcgcaaattaatcgcaatatgtacaattagttatttttagcctatatttagtacttcatacagatgtttgaacgtttgatctgacagggcgaaaaattttagggtgggatttaaacaggcctaattctcgttcatgtatatgttcataacggataaaattagaatattatcaaagcattttgcagtgcaaatctatagaagtgtatttggcgtgaaaaactattttgcttactcttagaagcaaaatggctcttccatagtagataggagtgcctttttcaaaaaaatagtagagaggagtacacttctttaaattttggaacaaaaatatgtttctatatttttttaaaagaatatttttttaaaagaatatccataatggaactaagtcgtggagaaacttaaatcgtgaagaccagcaaaacgtgtaggcccagctaaaaattctcttctcttcggcccagtaggcgcaactaatgtactgagaagcttccgtagcttggaccaaaagcccataaaagtgttaggcctgaatcgttatcgcggcttaagccacagtgggccgccttgccgaattatagtgggaccggattaagccacacgatatcgtagcgcgcggccttcttcaaatcggagtcggactccgcatcgcctctgcccagcccagcccagctgacgataaatagccacgtcacccgcactccattccctccctttctctcccgcccaattcaatcaccaccatggctttttcctctactccccaccttcgtcactcttgcttctgcttccgccgctgtcatcttcgatgtttctctcaccgcagctccccgctgctccatgccgctctcccgtcctcaccatcgtcgttccagctggcctggctgatcgtgaggtgggctctgccgacgccggggtggtgcaagctgaacttcgacggctccgtgttccacgacgggtctcggcgagcgagcatcggtggcatcatccgtggcttcgactgcggcggtgcctcgccttcaccgagaccacggagcactggacggttggtgtggtggagggccgtgcgatgatccggggcctgagactcgcactggcgtgcttcgtcgagcggatcgtcgtcgagggcgatgacctggttctacgcagatgaggatccttttaatttccttcctcccttaaagctgaatctcaccatttgagaagctatggaatcgtcgacccccttaccaagtagactatgaagtcactttcattttttggttgtgtatgctatgtgtttgtgccccgtcatctaccaagtacttcctccgtattttaatgtataacgccgttgactttttgacaaacgtttgacctttcgttttattcaaaaaatttatgtaattataatttattttattgtgacttgatttatcatcaaatgttctttaagcatgacataagtatttttatatttgcatagaatttttgaataagacgagtggtcaaacgttggtttaaaaatcaacggcgtcatacattaaaatatggagggagtaaattcgacaacaaagctatccgatgtatatttgtggccgccatgcacgaggagatcctctccttcctccgccgtttcaccgagttcgaggtgagacacatgtggagattatggataccccatatctacacggcatgtatagtccgactgggtatggggtgccatgtatagatagaatatctttaagatgactcgggttaaattccaaacttgtatgtcaaggaaatacctgagatcctagtcggttatggttgtattttatctgtaattacatattccgttaggatatggactgcattttgtaatacggactccttcccctatataaggaggggtccgggtgcctctaggggcacgattttcacccagatcatacgatcaataatacactcggcggatcaatccccggacaggagtagggtattacttcttgattaagaaggcctgaacctgtataaaattccttgtctctaaacccatccacttttccatcttgatagccacccccttttagtattgccgaaatcttgtttcgaaaattggcacgccaggtaggggctgcgtcaagttcttcgccaaccagtgcgatgggtttcatttccggcatcgacgacttcgtcttccctcccgggcaggcgttctgattcggcagcctcgacttcatcaccaacgacttcggcaagatttctctcctcgactcggattcaaaccagtcgggaagagatcagatctccgccccgttcggtatcccgaactcggccgaggtctaccccaagatcatatccaccgagttggcttcaaacctctcggacaaggttcaatctacttcaacacgacccgatcaagatgatggggcctatccgccgatcttgatgaaactccccgacgatttggctgctgtcttcaccacaagggcgtcttctccccataggcctaggcgggatccggcttcagccccggcccggcctagctccatggaagtcggcgtcatactccagcctctcggcacggtttcgacggaacaactggacggctacctcagctcccccggcgtcgacttgcaaccaaccgagatcgtggagtacgatgacttcggctaccgctacgactaccgcaacctcgacgacttcaatgaaggctttgaagacaactacacgcctctctacttcggcattttcatggctgacaacgagacagaagaacagcgtaaagcccgagaagcagaagaactacgtgtacaacaggaagccgaacgacgccgactggaagagaaacgccaagcacaagagcgagaacggctgcagcgtgagcaacaggaacgtgaacgggctgcaaaggaggctcaggaccggcgacgacgggccttggatgccgggcgatgagcacaagaacttattgggaagcaagacgtcgagggaactgcggttttttgcgcctctcaacaggacgcggttgcagcgatcaccctcctcgacaccctcctcaaggaagacacgctcaatcaagccaatcacgtcgtcaacatcttgaaccagaccaagaccatgatcgccgcctcggtcccgattaactctgcaagcgtccgcacgccgactggcagccgagttcctcatcttcgatcccaagactaccaccaaccaagccttagcgtcgcaggtgcgggatctagtcgcaggagcaagggtcacgacgagcgatctgtccactcaccccccgagcgacacagggagcgtcgagttgaacgaccacgctccccaccttgcaggcgccccgtcgatcttcgcgatactatcaaccagcgccacgcgacaagaggctacgctccccaccattcaccagatcgctacgatgacgacgtggatggagtcgctgccttcacaagcgacctgcgtcgagtggattggccagccggcttcaagccgactggaatcgagaagtatgaaggcaccactaacccggagtcttggctcaccgcctacggtcttgcaatccgcgcagcgggaggagacagcaaagccatggcgaattatttgcctgtggccctagcggattctgcccagtcctggcttcacgggttaccccgtggcacaatcggatcatgggcggaacttcgtgaccacttcatcgccaacttccagggtacctttgaacgccctggtacacagtttgatctctacaacatcattcagaagtctggagaatcccttcgagattacatccgacgcttttccgagcaacgcaacaagatctctgacatcactgacaatgtcatcatcgccgccttcaccaagggcattcgccacgaagacctagtcggcaagttcgggcgcaagcctcccaagacagttaagcagatgttcgaaaaagccaacgagtatgccaaagccgaagatgccattaccacatccaagcagtcaggcaccacttggaagccgaagaaagatacgccgactataggggggagtggaagtaccaatcacaaggatcgcaagcgtaagcccaaggaacttgtggcaaatactacaccatcctcccgacaacgttcgcgcatcaacacttttgacaagatcatgaactcccaatgtccgcatcatcccaattccaatcacgcggccaaagattgctttgtctacaaacagtttgtagaacaatacgccaagaacgcacgcaaaacctctgacggagatcaaagcacgtcaaagaaaaaggatgatgaagatgataccccgactggttttcaagaccattgcaaggaactcaaccacatctttggcgaacccctggcttatgaatccaagagaaagcaaaagctaaccgaacgggagatcaacgctgttcagcccgacacgccccaatatcttcggtggtcagagacaacaatttagtttgaccgctcggatcatctagaccgagtggtccacccggggcggtatcccttagtactcggcttcgaagatccctcattgatggtggcagtgcactcaacatccttttcgccaagactctggacgacatgcagatccctcgcacggaattaaagccgagtaattcaccctttcatggagtcatcccggggctatctgctacaccactcggccagatcactcttccggtcacttttggcactggggagaacttccgcacagaaaacgtttgcttcgaagttgctgatttcgagacagtgtatcatgccatactcggacgcccggcattggccaagttcatggccgttccgcactatacctacatgatgatgaagatgcctggccctcgaggagtcatatccctgtggagtgacatcaagcaagccgtcacatgcgacaaggaaagctgcgagatggcccagatccgcgagagcacgctcgcccgagaagaaatccgactggctgcgtccacggcaagcgaaggagaagtgcctgcaaccaagataccaaagagcggagaaagcgacgccaagaccaagaaaattcctctagatcccttgatcctactaagactgctgtaataggcgctgagttagattgtaaataggaaagcgcgctcatcacctttcttcaaaataataaagatatctttgcatggaaaccatctgatatgcctggtattcctagagaggtgattgagcactctttacatgttaaggaagacgctaaaccaatcaagcaacgactccgccgtttcgcataggataggaaggatgcgatcaaggaggaattgaccaagctgttagcagcaggcttcatcaaggaagtccttcatcccgactgactggccaacccagtcctggttcggaagaagatggggcagtggcgcatgtgtgttgattacactgacctcaacaagtcttgccccaaagatccctttgggttaccttgcattgaccaggtagttgattcaacggccggctgcgagctactcagttttttggattgctactcaagatatcatcagacccgactaaaggaatccgactgcttaaagacttcattcatcacgcccttcggggcctactactacatcaccatgccttttggattaaagaacgcaggagaaacttatcaacgcatgattcagagatgtttttcaactcagattggccgtaacgtcgaagcttatgtggatgatgtggtcgtcaagaccaagcagaaggatgatttgattacggatctagaagagacctttgcgagcatccgtgctttcaagatgaaactaaaccctgaaaaatgcatcttcggagtaccgtcagggaagctgcttggatttatggtgtcccatagaggcatacaagccaacccggagaaaattagtgccatcctcaacatgaaaccgccgagctcccagaaagatgttcaaaagttaaccggctgcatggcggcgctcagtcggttcgtttcacgactcggcgagcgggggatgccttttttcaagttgttgatgaaaactgacaatttccagtggggacccgaagcacaaaaagcctttgaagacttcaaaaaacttctcactactccactactcttagcttcaccacatccgcaagagccactgctgttatacgtgtcggcagcttcccatgttgtaagcacagtcctggctgtttagcgagaagaagaaggctatgttcaaaaagtccaatgaccaatttatttcgttagcgaggttttggctgactccaagacaagatacccttaggttcaaaagctattatatggtgttttaattaccgtcaggaaactatctcactacttccaaggtcactcgatcacggtggtcacatcgtttccactcggggatatacttcataatcgcgaagcgaacgggcggatcgcaaagtgggccttagagttgatatctttggatatatccttcaagccgcgaacttcgatcaagtcccaagctttagccgacttcgtcaccgagtggatcgagtgctaagaagacacgcctgcagagaagatggagtattggactatgcattttgacgggtcaaaaaggctttcaggcactggagcaggagttgttctaatctccccgactggagagaggctgagctacgtattgtggatacacttttctgtttcccacaacgtggcagaatacgaggcgcttcttcacggactaaggattgcaatctctttggggattcagcatttaatagttcgtggagattctcagttggttgttaatcaagttatgaaagagtggtcttgccttgatgataacatgaccacttaccgacaggaggtatgcaagttggaagacaaattcgatggacttgagctcacccatgttcttcgacacaacaatgaggcagccgacaaattggctaattttggttcaaaatgagaagcagccccttttgatgtgtttgttgaacatctctacgagccaaccgtaccacggaaggaaacaatcgaggccacggacactcaagacgtaagcatgattgaagccgactggagagagcccctcataagatttttgacaaaacaagaacttcctcaagataaagatgaagccgagcggatttccaggcacagcagactttatgttattcatgagactgagctgtagaagagaaacccatcgggaatcctgcaacgctgtgtttctttggaggagggaagacaattgctaaaggatatacattcaggcatatgtggtaatcacgctgctacacgaaccatcgttagcaaggcttatcggcagggttttttctggcccacagctgtgtccgacgttgacaaaattgtgcgaatatgtgagggttgtcaattttttgcccgacagacttatctaccggctcaggagcagcaaaccatcccgttatcttggccgttcgcggtttgggggctcgacatggttggcctgtttaaaaaggctatcggtggttatacacatctctttgtagctgttgacaaattttccaagtggattgaagccaaaccggtcatcacaatcacggcagacaaggctagagatttcttcatcaatattgtgcatcggtttggggtacccaggaggatcattactgataacggcactcaattcacctgcggagtatttaaagatttttgtgaggacttcggcatcaaaatttgctatgcctccgtagcgcaccccatgagcaattgacaagtcgaacgtgccaatggtatggtacttcaaggaataaaagcgcgagatttcgaccgactgcaaccctatgccggcaagtgggtagaacagctatcatctgtactttggtccctgcacaccactcccagtcgggctacgggccagtcgccgtttttcctggtctatggagcagaagcaatgctgccaagtgaggtggaatttgaatctttacgatttcataacttcagcgaggagcgctacggagaagaccgagtagatgaccttaaccgactagaagaagcccgtgaagcagccttaatacagtcggctcagtatttgcaagggatgtgccgttatcacaattgcaatgtttgatcacaagcttttttagtcggtgacctggttctgagaaaaattcagactacacgggatcggcacaagttatctcccttgtgggaaggaccgttcataatttccaaagtcactcggccaggttcttaccgactcaagcgagaagacggtactcatatcgacaactcttggaatattgaacatctttgtcgtttttatgcttaggcattacttttgtatttcccactttgactgctaacgtcaagtttttccttgagttatcagtcggggctactataataataatggagtgtgatttttatcaattcaatttgcttacctgatttattattgccctgtttgattttttggcttggtcaatgaggactgaaagttttttaacaacttttacgggttttaggctcaataaggtttgataaaagcttttaagaaatcaggagctaagtttaaagatcaagcacagcataaattcatcagtattgtacaaattgtgcctccatcatcatcatcatcatcatcattgttataatacaacatcaatcggtatcagttttttcatcatcagagtcattagatccagtcggctggaggtcgttgtcctggaatatctcaactacatcaacggctatcttatcagcagctttctgcgtatcattgatgaggtcgagaacggcttcttcgcttgtctcgtctgcaaagccatcaatggcgtcaatgtcaatcttcgggtacaaggacttggtcattgtcaatgccaagctcgctcccatacttccagcttccttgatattcttaaaatatgtatccgcagcaattctcagcttgtcgaagatttcggaagcatcaaatgcactcggaccattgttattgaagaacatggcttggacaagtggtgtagtggcattggcgacttcatctctggctccttcaagcttcttgattttgttaactaagacgtcgaattgagcttgggatttgatcttgcagtctacacaaataaatctatatcaatgactaggcatgaagatgagagtggtgttttgaagtattagttaccagtaccttcgacgtctttcagagccgagtcactttgttttgccaattcgatcttgtctttctccagagcttggatccgtttttccagttccgatatcttggcggcttgcactgtatcgcttcttgttggttgatatcacaaggatagcagcataaataagtgagacagggatgagaattatcttttgactaaccactcagctcaaagttggaatcttgaagctcggtgattcggtctcttagatcatgttcagtcttcctggcgagctctttagtttcatgcagctggtttcgggtggcctcaagggttccaagatggggaactagtctctcaagagtcgtagtcttcgcctcgttcctgagatggattctctgcaaagcaaatttatccgtatttgagcaaagtggctgacaggatggttgaagctgtgtacaggaagacttacatttacaagacgagtggcttggccgagtgcctttttcagtaggcatacttcctcgtcttccttttgcttatttatcacaattccctgtggttgcatgtcatcatcccaccacttgactaaaatgggtgggcgagaatcttcagctgactgtatctggaggatctcttcttcgtcgccaatcatcgggccttaggcattcatgaataatggtgaaacaattgaagaaagtctgttggatcaaagcagatttgaagggtttgcttacctgttatgatttccggtcggggacgaggaggtctttgtaccctaacaggagaactaattccaggatcaacaccggtgtctgtcttgggagggctgttagcttgagcttctacttctgggatatctttatctggctctgtacccgactggtttccagtcgggggctcctgattagcgccagttctagcttcggccgactggttcccagtcgggggcttgttgctgggttctacattgtcggtggccggttgattatcactcgggtgatcttctgcagtcagcccggtttcttttgacgggcctgtctccatgtcagtcggctcggagtcttttccagaaggatatatgtcagatggcttcctacaaatttgagttatgctatcaatactatttcaatagtgggtaagcagcaatacaaggaagatggccaaatgatttgtacctggaagattttctgattttcgacatgggacgactggatgttttcttcttcagattagtttgccttggttgttttccggtcgcttctttgtcgccagttttttcagcatcatcgccctcatcatcactcaggaccaatttcctcttgcgagagtctggctggctagtttcctcgaggtgtttggttgagtatcagaccgaatttttggtcccccactcgcctgaccagtctgccggctgggtgatcggcgttgagcgatcggaagatccgacttcaacaaggcgaattcctgagcatgatatttcgaactttcaattagcttaacagaaggcaaaagcgtgtttttgagaaaggctgaaatgtttgaatacataccggtggaggaggattgaaggcgttgtatggcaccactagtagcaagtgcgaataactgactgcggtagcgtttgagaagattttgtacattctctccttcatgactttaaagtcaagagagtctggatcttcatggttcgggtcatgcttgccgttaaattcaaaggctgtacgggatctctctttaattggagctagccggctgttgataaaatgccgggtgatctgttctccctgcagaccttgctcctttagcttcagcatacggtccatcagggcaagtgcctgagcagcttcctctcccattggaagtgagttccaagtgtcctgataaaccggaggaagacacgagtactcggggagtgcaggctcggggttttgtacatagaaccaatttgcatgccagcctttgtttgaggttttgaagggcatggagaaatatttttggcttagtgttcctctcagttgaaatccagctcccccaactatgcatggcttgctcttgttcggttggggtttgaggaagaagatatggcggaatagggcgaaatgaggcctgatgcccaaaaatgcttcgcaggcatgtatgaagttggcaatatggactatggaattcgggtttaggtgatgcaagctaatcccatagaaatccaaaattccccggaagaatcttgaggttggaagagagaacctgccatagaagaaatgagaaaataccacgacctcgtgtgtgtcaggggttgggaatgcttcgccgcatgctggacgccacccaatgatctcctttaccagaagaacaccatgcaccaccatctccttcaggttctcctctgttacatcggagggcgcccactgactctcaaagctctctctctctctcttccgccatggatgcgatctggataatatgatttggttcggtgaatggctgggaatggatgggggattgatgcggtggatgcgcaaatgatttctatggagttttggaagatggatttgggagaattggagaaccctagttccgttggagtggtttcgtactgtagcggagaatggggaaaaatgacgaaagtctcggcggggaagacgaagcggcagttggttttctgctgttattagggtatcaggagtgctaatgggcctgggcctgtacagtacttcaggccaattttattatcagcgtggctagttgtgatccttagggacttgggcatttttgcttcggcaatttttgctcacaacagtatggcccaatgctgttaaaatcctttttgacgcagttagataattccttggaattactacgatgcaaataaaaaggtacccgacagaaaggtgttatactacttttgtaagcctttttaggttgcgaaggctgtttgggttttgttgagatgattggtttttgaacagtcattctctcggcatgatatatgcttattttgattatggcgtgagtcatagcctaggctatttagactcatcaattatcatgatatcatatttataccatatttgatagatcttttgagagtttttacttagattcttgccatatgtgttggtttatggacctttagagtattttttactcgggcctctttatatcttcatttttggtatattaaagctaaagcagtcggctggatgttttattaaacgtcgcatatgcttagctgtgtggtactttgggtaattcggttgtaaaaccactcggatggatattatttgcacttcgactatatgtttagcctttagctacttacatagtcgggggttacacctaattaggtgcatctattcgatgcacccgattatttatttttagcccttcacaatctttgattttggtactcgggagatcaatgcagaagaaattgaagcactcggattatcattttgtgctacgagaaaaggctattttgtcgactgtaaatgtctcgggtgctactgtggagattatggataacctatatctacacggcatgtatagtccgactgtttatggggtgccatgtatagatagaatatctttaagaggactcgggtaaattccaaacttgtatgtcaaggaaatacctaagatcctagtcggttacgattgtattttatctgtaattacatattccgttaggatatggactgtattttgtaatacggattccttccctatataaggaggggtccggttgcctctaggggcacgattttcacccagatcatacgatcaataatacactcggcggatcaatccccggacatgagtagggtattacttcttgattaagaaggcctgaacctgtataaaatttcttgtctctgaacccatccacttttccagcttaatagccaccctttagtattgtcgaaatataccgagagggaaactgcgccggcatgtggtcggagagaggagggatgccggccgccgtctgggagaaggtggatgacgatcggcccggggtggtacacgagcgcccccgcaagaacaagtgaagcgcaccaagaaacaagaagcagccggcatgcgagccgagccgtagtctctgatcaaaagttcaagacttctcccaatttgtgattattgtagttgtacttgtacgattagtgtagctaaatactattcattgtagaaatagatcgatgattcataacactaatgatgtatttattcactgattttgaaataaaacaataaacttttatatatgcgtgctctgtttcttctcgtgtgttgtgatttgtgctgcgtgtgattgcggtcgtcttcgatgcggcggtgtggggattggcggcggaggtggattaatttgcggcgagcaaagattccacggcgatcgtcctctcctctgtttcttggaacgcttctctctgcccaaccggaaacccgagctcatgctctcgccgccggccaactctccatcaagaagaagcactctgctcctcactgcccaagcaccacgcatctagggaagcgctgatgccagggggatgcgttcctcatctccatcgagcgccgggcccccgcgtgcgacgccgccgagctctcttccttccctggtggtgggggcctcgagcttcatctccgcccttgcgtacccgtcgcccgctccctcatcgctcgagctccacctccgcccacatgccggatttctggagaaagaaatctgcttcagttttcgtgcacgggagatgtttgctgtattgcctaagtgagttcctgtggccttgtgtttttatatcctcctattaatgaagctcctgactgttccctcaaaaaaaataataataagtgagttcctgtggttgttcatccatttgggccctatgggttcaaattatgttactatgttgtgaaaccaagtgtgtttttggtttatttgtgatggaaaattggcaatgaaatgtgtaaccatgagttggttttgagcgagaaatttggtttggaatgctggcgattgtcaacgtgagtacatgcgactaatgcggtcaggttgcgatgtctatactcagaatcggatgtttggtttcatgtgtgtaggtaatcgaagtcaactttgatcaatggcgaggatcgggactatgctcaggaaggagcagaggtcttgcacggtccagaagctgtgacaaggtgggactgacgtcatgatttctgattgtcaacctgggtcgacggcagatcaggactaaactcagtgaggagttgagatccagaacgataaggaagtcgtgtgacaaggttgagatcaaggtgacacacggtggacaaacaccgtgtcgggaggttatcgcaacgggcttcgcaaaatcaactgcaagcgttgaaattcgcaaagaaattggaattaagacgtattttgtgtgcagcgtataatacatggcgtatggtcgatgtgtacgccatgtattcgcaaagaaaattggcaactaagcgtataatgtgctgcatgtatgtgtgtcaaggacaacgaacacatgcatggctcattggtgcagccaagactagggccggccacgaggcaatgcggacggtgtgatcgtaatgggtctctaaaaattagatgcctttaaaatatacatattatgatatcaggcctgagaggcttagaggaaagacagaagaccaatcggtgatcgagcatatcgtgactgcttgattgtattttaaacttattagtgtgaaattcattaatgataataagattttaaatattatcttgtatttttatggtgaatgggggcctttatttttttttgagcaatgctgcacgtactaaatttttcttactaaacttttactaacaatcatttcaaccgtttgatttaagtagatggaagttacaaaaaatctagatgcacttatagcatgacacattagtgttagtaagaatttaataagaaaaagttagtacatatagccttttcctttttttttcttttctataccgggccacagaaagtcaggccggccctgcccaagacatgtatgctctaagtacatgtgtgtacattagcttgagcagtgcatgcatgcacgaggagacatgcatgtgtgctgtgatcaaggttatcattatcccgattcgtatcctagtatcttacgatactacgatcctactaagccgaaacggtaccgatcccatctagtatcctaatttttatagtatatcgatcctactattcattactacacgatcctacgaaatcttaggtgatatcccgattctacgatccctatgatgctacaaaatattatttaaaataacatggtttgaaaataatgttactaaatatgctcaaatttatatgaaaatcagttaaatatataaaaaccaaagtggtttctcttgataaatatctctgtttgcatgacatatatcattactgtatttttttatatggaatggctatatataataaatataaatattaattaaacttaaaaaagaaaatcttgtagtatcccgatactctgatacgatcctacgatacgatattactttgagcaaaacgataccacctagtatcccgatccccgatcttgataaccttggctgtgattggttggcagaggccaagccaaccatccatctgtgatcatgggctaggccaggatgccacatggctgtaccggattggcccagtccaagatggagcaggccgtcatggtccaagtgacggcggcccggctccgtctccgcgtgcgtgggaaagcaacggagacacgtaggatccgtacggtgcgggacccacaggcgacgtggtgcgcatcgactgggagacagacgcgtggcgacgcggcttcgatacggaggagaggcgcgcgcgtggagcggcggcttcactcgctgtcaagcgggccggccggagcacgggcgcccctggcgacgtggcgacgccgggttcgcgccgtatgatgcgggacccacggcgcggagagtgtcaggcaagtgctacggtggacgtgactatcacttctaaatttatttatttggcaaaattttatacagaaaattcaaaaatatgcaattagctatgggacaccgtaaaaacgcgtatttgctgtaggacatcataaaaaactggttattagctcctggacatccgctgcattattttattatttttagaggaatatgagagagaaacggctgtgtaagtacggttctacccttcgaattaatttttctttattcttccttattcttctctctctcattctttctctctttctctctcagctatttcttcaagtgagcctgagggagagggagagcgctggtgatggcgtgggccggtgtagcgcctcggctggggcggcgctgcgcggtcatgcgggaggtggtgcctgagctagagggcaggttgtgccggcgcagttgggcggcatcggcgcgcaggcaagggcggccgggctcggcggcgcgaccacgccaggagcgcggctgctccaggccaacttcaggaggctggaccggatggcaccggcgccggcgcggcaaggctcaagccgtcgctgcgggcgctcttctcatgcgggatcttcagcacctgaacacacccagcactcagcccgacggcgacgcccaacaacaatgtcgtagcagggatgagtgggtctaagggcggatcgagcatgccattgggttggttgtggaggcggcggcaccggcggtggagacggcgtcgtcgctggttgtggaggcggcggcggaggtgacagcggatgcagcagcgggcggcggtggcggcttcgatgatggtcgacgagcccgacagctgcggtgacggaggcagcggcgagcagtgctgggaagcgggcggcggtgatagtttcgatgacgatcagcgagccggcggctgcggctttgacggtgacggttggcgagcggcgctgggaagcggctgccaacaatggggattagatagggctaagggcaattttgtctttttgaaatttctctctcctctttttgataagaaatgataaaatattacctcaggtgtcctatagcaaattacacaaattttatggtgtccatcagcagcgacgtgattttacagtgtctcccagccaattacacaattttcggatgtcctagggcaaaatttgcctatttattttattcactcataaacttagaggcaacccatataatgtatcacctttagtacacataccaatacctctaatactttcacacttttcttgaaatttgtatggaggttacctcttgatttaggggtggctcatcatctctctcctcatttctctcctccaccttatcactcaatccaatatggcactcttagaggcaacatatggggcattatagtacttgccctcagaagccgtttagcacagctctaactcccaactccaacttacctagagccggagttgtgccaaacagtatagatccttagattttcagagtggagttagtagagttactcctaaaaattgaagtgggtggagttgggttttactactccacaactctactccaccccaaaagatccactatcctttatttttaacatatttacaacaaaatgccagtgaactaccctacctaacccacctcacccctcaggccctcatcccatactctccctgtttgctagcgatgcgcagcgactagggttggcggcgcgcttcttgcctggcgacgcgcggccggcgacgcacggcggcgcgcggatgtgtcacgcccggaatttctatccaaaattccaaacgcttacatgtgtgtgaaccctcgtccaggaatcaactgaggcacacaataacaaaattgataatagagtacaattattactctaattattaaacgaataaaatatcattacagaggtagatagttcctctcaatcaataaagatctaagcagcgaaaaaataagatacacggcgcagacgactccactccacaggcagcttgaccagggctacacctaatcctccacaccatcagcacactgtagaactcctcctctgatgaatgattgcaaggtgagtatatgacatacttagcaagccacgcagcaaatatgcaagtgcataggataacaaaggatggcatagtagggtttcatttgcataaacaacatttaataaacatttcagaatttaataaaatagttaagtagtaattaaacaatattaatccaacgctatacaacataccctgttggataggcccaaccattctgaacaaccatcccggctgcacagttctatctccaaaccaggaatataccattccaaaccaggagctaatcaaattattaccagttatagcatcttttattatgatgagaaatgtgaaactaatcatgaaagatattgttagacccgcccataaccgcgggcatgactattcgaatagttttactctgtccagagatgtaccactgtacccacaagacacagccccacaacatgtcaccatgcgcctcaataccaccacagtacctcagaaaggagctgtgacagtacccctcgcacaacacaatccaccacagcacaccgttcctggatcataatcacccccttataaacaaggcatggactccccagcgacccccgtgggcttatctccgccacttctcagtctggtgccccgcaatgaaccatgctatacaaaaggtaaagccgttgcccacgctggcttgtggttggcacggttaatgtttcacaaccgaaactcgtgaaccagtccttaattgtcatgtgcacgaccatcaaaaccatgtgctcacaacccaccattatcaagttttagttggcaaattaattaattaaccaatcacgattgaccatcgtgagctatcattaagccatcattaaataatagtgagtcataagtatcccagttatatggactagtgtttctaagcatggctaagcaattatgtctaacatctagttgaaccaatatatataaagctcaactagtcaaattataatatcccaaggtatcaaggaatcaagtaatcaataacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttggaagtcttcaaattcttctcctgcaaaaacggactctccagaaacgtcggaatctaaacagaaaagagcaaaatcaccaaaacagcacacaaacaagcatgaacagtacatgtggatatttttaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttgaaaaggaaaagagaattactgcgtcagcggctagggttcgcggtggacagggtgcacggcggcggctcacggaaacgaacggccgagatcgatccatccaaaacgaacgaccgagatccatcggtctacgaccggtctacaacggacggcaacgatgacgtcggcgatgacgtcatcatcggcggcggctcgggcgtgcatgctcgccggcgaacgacggcgcgacaacgcgaacggaggacaccaacacatagagggcgtcgtggcgaactcaccggtgaccaaaacagcggcagacggtgatcggacgacgtcggcgacgaggaagaagcggcggcgaccttcggcttgacgacgacggcgatgctccggcgatcgacagcgatagcagaggggcggacgaggttggcgacggcttggcgaacccgacggcggctttcccgagcgacgacgacgaccgaagcgacggcggcgcacggctggagcgacggcggcgacggcgacgctaggctgcacggggctagggctctacgggcgacgagaggcgaaggcgagggtggcggcgggtagtggcgggcttgggggtcaatttatagcggctaggaggcggcggcgaaggcccacggcgaccggcgatgcgaaggaaagtctagggttcggaggagagagatcgatccgaatcgaactcgaatccacggatttccaaacgaaattagccgacgattccataagagaaaagatagaggggatcccgaagatcatttcccctctactaatttcatcggaaacggaaaggggcggccggatttggaaggagatggcggtggcgcggtgctagggctcgggcggcgggcggccggaggtagacgacgacctgacaggcgggccccacctgtcagcgtccgagggcgcgcgcacgcggcggctccaggcggactgggccggcttgggctggggagagagagagaaggttttgggccgactttcggcccaaagccaaaagagaacttttaaaaccttttccaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaactagatcttctcttctaggcttttaaaataaattctaataattccaatttagacaacaatttatatattttggatttttagggtgtgacaggacggcggtggcgcctcggggacacgcaggcggcggcggaacggccgacgatggtagggcggcggctcaggacgcgcggcggcggcggtaggactcccggtcggtggcttgccctaaggtacaaatccggtacatctcctctattttcctctatttattttcgattttagttctagactaagaacaaaataggctgattttgcatgtatgttgagggtgattcttctttgtatatgataaggattaacatcgcaacataagccgattgtttcattcataaagggttcattcatctaggggttgatgatcctatttttggatatgaagaatggagatgattgttcattatatgaattgctgccattggtttatgcattcagaatggtatgaatgcttgcaagggaatgcaagcaatgatttgcatatatctgtccaatgcatgttacttctgttggaaaaaaagggaacactttgggtgattttgcatttatatttcatattgtgacaaagtgaatttttttatgcacatacatgagtactgctagcctttgttcagtaaatataaatatttttttatgttagtattgaaaaaagaaaggtgtgattgggtggatggcagggatggctcaaaatgagtcttcaaaaggtgttaagatggcaatggattgtgctgattagaatgaccacaacactagaattgtatgtgagctttttgttgatcaagtagtaagtggtaatcgaccaaattgccatttatcaaatcctaggtacgatgaagtcattgaacaatttgccgcaatagcaagtttgaggtacactaggcttcaaattaagaataaacgggataaacttaaggtcgaatacagctattggaagaaattgagaactcaaacaggactaggatgggacaacacaaggcaaacagtgatggcgactgcagaacgttggaggaaattgaaatcggtaagtattttataataatgtgtaaaattaagaattgttctactaggttttatgttctaactcaattttataatgccatgttatgcaggacaaacccgggtgtgcaaagttcatgaaggctagctagcaaaatgaagagctacttgagaagatgtttgaagacattcgcaatactggtgctgaccattggtctttaggacaaggcaccattccgacaaacaccactcatgcaattcatattgccgatgataatgaaattgatgaggaaactgatgaggatgaatcaactgccaagataaagagggatggtggtggatcaaagatggataaggggaaaagagcaagagtggatcccaaaagatggtacaggagatgtccaagagtaatgaactctcagcacagacattatcatccattcaatcatttgctaggtcgagcgaggatcttctgggttgttccataaaggatgttatggccttggaggaggattgtgggctagttgaagggacaaatgagcacctcattgcaactgagatttttataaataaaaggatcaaagagtgatgtttgtcaattcattgcgcactcctgtaggacatttttcatggcttaagaagaagtacgaagtgaagtatggaaactagttgcatgtggtgttgccatggaatctatccctttgttttaattgtattttttttcatttcagaaaactatctatggtttgatttcagttatgaactattgttggtttgtatcaccttattgtatggggtgtttccaattgtgaacaattattttcagacctatttcatgtaattgtttgcgtatgttcagacttatgttatgcaattttagacctatgttatgcaatttcatacctttgttatgcaatttcagcaagttttcatgaatatcatgttgcataagttgtaatttatgttgcataactttatgtgtagatgtcaagtgatagtgaagatggttcatcggatgaggaatatgattatgatgagtttaccatgcatttgttcgaaactgtagcatccaatctttcttcgactagaaaagctgtagagagttataacacactctacttggaaaaggctccgccaaggacatcacgcctcagtgggatggaatgggtgcaagaaacgttagccacatgaggtgaatgctataagatgcttcgtatgaatgggaacaccttcattgtattacatggtcttttggttacaagcttgaatctactatacatatgcatacaatggaggcacttgcaatttttctatacatacttggtgatggctcatcaaaccaaagagcacaaagccatttcaagcattatggtgagacaatttctaggaagtttgaagaagtattgcttgctgtggtagaattggggcgtgatatcgtgcgcccaaaagatccaaacttccctactacccatgatagaattaggagggatcatcgcatgtggccacatttcaaagattgtattggagctgttgacggtactcatatccttgcagtagttctagatgaagataaggttaggtatattggtaggtctaaattgaccactcaaaatgttatggctaattgtgatcatgacatgagatttacctatgcatctattggacaacctggatcgatgcatgacaccactgtgttatttaatgcactggaaaccgatatagctatcttcccacatcctccccaaggtaattgccacatattatgtcttgtctatttttctatgaagagattctaaattggaatatttctaatgtttgtatatttctaatttttttaatcgtagggaaatattatcttgtcgatgttggatatcccaatcgtccagggtacttggcaccatacaagggacaaagatatcatgtccctgaattttggagaggttcaacaccaactggtgagaagaaaaattcaacttcttacactcgagtttgcgcactattattgagtgatgctttggtgtatggaagatgaagtggcgagttctcctaaatatgcctagctttccgctaccaaagcaaaagatggttgtggcggcaacaatggcattgcatcatttcatttgtgaccatgatgcaccagatatgcattttcataggtttgataggaatccagattatgtgcctaccattcccaagagatttatattattaatgtactaaaaatttgtattatttgctaattatgtcaactattttgtcaattattatttaaccttgtaattttgaagaaattctaaagaaaaaatatacaattatcacttatataccatgaaaacaacaaaaaccacaagggtattattgtcaacctccctcctatcctctcttttaggagttctggagctgacaaagctagccaaacacttttcagctggctccagctcccattgaagttggagtttggagccttaccaaacgggccctcaatcatgagtgcgggagcggctcgggcaggatgcgtggaagcttctgattcggcaagacggtgaggacatggattgatacatccgtttcagcgagaaaaaaaatggatcgatgatgtggcaatcatccggagctattcctttgaggagaaggaaaagcgagtggctgagatggagtttaggctagggattagccctaagggcatttgtgacaatgtcttaggggggtttcaactataaatagagaggtggatgcaagggtgggggtgtcatttttgtaatctttggagatgctctataatagagtttaggtgtgggtttggagtgtgtttgcccgagtggcttttgtgtttgaatttaaatttatgttaaggtgcgtgtttgctcctcattgagcggttgttttgcaacacctatgaataaaatgagttgatgaatttcgtttcatttttgcctctctatttaaattccacaagttaaattccgcttttgtttttgcgatttggatttttcgataacggttttttctttctctctctcacctctcccctagttttggtttttcttctcacctctttcctaggtctggttttctaataacaattttgagaaatcaattttgagaaacacttttgatgagtactttcaatggcaaatcttgaatttcatattcacccctctaaagcaattcttggtgtttcatatgtgcactagtttacaacagaattatgcatatcacacagaaattcagaaacaataagctcttctcttattagatccatttatctattgaaacttaacttttatagcatgattgacatccttaatttcaatttatcgtattcagacatgctaaagatcattttgcctatgcttcctttcgtgatctgaaatttattctcttatagtaaaagatttcttggaaaactatctgcttagattctactatctctgaaatgtatatttgagttgtactattgaaaaacgagtaccatttgttttgacttttaatcacacgtttgcacatgtgtgtaccatagtgtgttttaccattttttagaattaacaatgtaacaattttaattgggaaaatatgttcagcgttctaattaattagcatgtgattgtcatggtttcagttagatattgcatcattcatttgtttggcttgtcctgcttcttcgtcttcgacggcttcctcaccgtgaagaagtaccatatattctctccgtaacccttgtatttctctacaagtaattattcatgcatgtgttgtgcatgcacttatatcaccatggttaattaattatcatatatgtattcaatggttgatcaattgttttacactgttaataaagtgaaataattaaaaaagattggttaccgatcaatttgactggatcgaaactaataatgtcaacctcgttgatgaagtccgtgggtgcctgggcggcctacgttgctcgatctcgccgcggaggtagaagtcaacgagctcctcatccaagaccacgaagtggtggcctggagacaactgcagcttcggcaccagcttgtgtctccgccggcctccattgctcgccggcgctgccaccaccgagcagtcgccgccattgctctccgttttcatctgacgacgacgtagtattttgtgtggtacgctaggaagaaagaaagaaaaaagaaaaaagaaaaaagaggaacgtaggtattgatagatatatcaagacatgatgtaatcatgctcttttctctactatgtttcttaatgcttattctctctataggtgttgcacggcactgtaacagagaaacgttatgttctagtaggaatgcaagtgtagcattagtctgtttaaaaaatcttcattatagatggaatattttcatatatttttagtttcatatatttttagtagctaatattgctagttcttttgttgttgaacatggtacaaatttgtatccttgttctaaaatctgagattgtattaacacttgttttgcaatttgaatcttttgctttaaaattgaaaatctgagagtgctttttttgaaatttgatattgtactagcacttgtttccttgttgattttactgttatcaagttgtcatcgttgattgccaatacagtgtccctgatgccagctgcctcagcaaagtcagagcagtagtcagattacttgtttacattggcttacaaagataggcatgctggttcagagtaaaagtccatgaatcataagatatttttctcccaaaaagagtttacaaggagtacatgaatgaacatccagatagatattttcccctaaaaaaagttggatagttttacatgaacatgaattaactatattttgtccaattgctacaacgcttaaagattttgtcctgaagttaagctaaaactataattcaaaatgagtactgctgggctcaagttctcaacttttcaagttatggatataacctttcccctaggtgattttacttaatttaaattggcaaatgaagtgaatttgtccggttctttttttccgataatggaagctttattaaaactcactcaaatacaccaagatgataccttctaactgagctcagtcacggcctctgtatgaaatgcacacagccacaaaacatgatctaactagaccctcaacacaaaacaaagaaattagtgactatcaagccgtagactagatcgccgcgacgccacccatgttccaaggcaaaaaaaaaaaactcccgtgccacctgttccaaacgacacaataccaccataatagtatcctgaagaccctattgtggaggataggccaggtgcgtagctaccaggtgactaaagcaataacctgcaaaggagaagacaccatcttgttgtcaaaaattacctcgtctctggttagccaaatggaccaacaaagagttgttgcacccatcaaaagtagatttctcatgtccttaggaacacatgtaagccaacgcccaaacatatgattaacattttgaggaggttttaagttataagccatatgaataacggaccaaaccaaacgagtaatatgacattggaagaacaaatgttgtatggtttcgtccttgtgacaaaagcaacatttcgtatgacctttccactttcgcttagctagattattcttggttagaattacgccctgacgtaagtaccaaaggaaaatctttactttgagcggtactttaaccttccaaatacgtctatttatattcgtgatgcctgtatggacaagagctaagcaatgagaattgacttaaaagactccattgggggtgagatcccatcgaaattcatcttgatcctgtgtcaacaccaaatcagctatgcgaggccataaattgtgacaagtggctaattttgctccgattaaatctcgtctccatgaaaagctcggaggattgttttgaaagatttgtgacatagtcgactgtttatgcttagctatgttatagagacaaggatattgatctctcaatgaggtattacccaaccctttatcatcccaaaaccttatttaagagccgtccctaatacgaaaggactcgaacctaagaaaatctagtttagctttcataaggttggcccaaaaatatgagtctcccgcattcaaaaagcctgagataaaggttgcgatcccaaatatttattacgtagcatctgttgccacattccatatgtggtgagtaatttgtatagccttttgctaagcaacgctacattctttacctctaggtcgcgtattccaagccccctttgatctttgggtggacagatgatgtcccatttagcaagctggtatttcttcttatgtccatcccctttccaatagaacatagatcgaaggtagtcaagtttcttacgtaccccgctaggtattgcaagaaaagacatcatatacattgggagactgctaagaactgagttaatcagcgcaagtcaccctcccaacgagacaagttttcctttccagctactcaatttgttttcaaatctttcaaccacttctttccattctgcatttcttaacttcctgtaatggatcgggatgccaagatattggaaagggaaattgccaacctagcaaccaaagagttgattatattgatatctgtaatcaagcgcttagccaaaacaatatagttcgcttttataaaagttgatcttcaaacctgataggtgttcaaaggtcagcaacaccgacttcatattttgagctttatgtaggtcatgattcataaaaagcattatgtcatcggcatattgtagtatggacagtcccccatcaatcaatgtggtatgagaccttctactgcccttgtgttttggccctatttttcaagggtggctaacatgtcagcaataaagttgaataagattggagagagagggtctccttgccgtaggccttttttagtctgaaaaaaggccccacgtcattattgactttgactgccacacttcccccggaaatgaaatattcgatccaagaaatccacttgggcaagaaacctttcatccgtagagtttgtaacaaaaagggccatttgaccttgtcgtaggccttttcaaagccaattttgaatatcaccccattcaacattttcttgtgtagctcatgaactgtttcatgtatgatgatgactccatctaggatatttcacccacgcatgaaggcaatttgagttggattcactacatggtcacccaccgaactaattcggtttatggcgaccttagtgaataatttataattggcattcaacaagcatattggtttatattgttagattcgatttgcttcttcaactttcagaattagagtaatcaccccaaaatttaaaccaaaacttggaagaccgccagaatagaattcattaaataaattaagcaaatcatgcttgatgacttcccaaaaatttttggtaaaattcaacagggaaaccatctgacccaggagctttgttatgctccattgcaaagatcgcttcctttaattcttcctctgagaaaagggcagtaaggaagttattttctacttgtgtaacctgagccatatcttcagttatggtctcatcaagcgaaaacggattttctttggtagtccaaagagtctcttgtagaaattcgtaatgtatgttttcaacgcatcagccccctatttttccttcatcctggtgtagaaagaagatcctcttcttcctatgtttgccattggcaatttgggttaaaatattttgtattattgtctcaaaagagtacatccgagacttttgcgcgttggtaccatttaatctcctcttcatgaagtaggcttgtgagatgatccctcgattgatcaagaagaagtctagatcccaaaggagtctagcctctgcagcgatgtccagagagtcagtggtttgttgaaaatgagcttttttctgtttaaaaatgccattggtatgagcagaccaacctctaagaaatcgacgtaaagcgctcatcttgttattctatctttgaattacattacgacccttgactagtctattccaaacttcgacaacacattcatgaaaatcgtcccacaaaaatcagctgagttccatcttgaactgcttaaggtttccagcgaaagccgcttcctctgtgtcaaggaacataggcatgtgatatgacacccctctatatctagagcatggaccgaaaccagagggtatatggattcccatttctatggaagtgaggatcctttctagcttctcgtatgtcggtataggaagtgagtttgcccaagtgaattgcctgcccgttatagtgatttttgttaagtcaaagatatcaatcacagcattgaagagaaaaggccaacgagcatttgtatcgatcattgttttcttggcactacttctcataatgttgaaatccccctattaaagtgggtagatgattttgttggcatgtacaaattgattccgccaagaaactagatttaaatccatcttgggccggaccatacactgccatcaaaatacatttaaaattatcctccctattgttgatatgaaatttaataaaaaaacccccttcgacaattaaagatagatccaagatagccacattaataccaagaagtataccctccttatcttccttttggtggaaggcaatgccagacaaaatcagcacctccagtgaggcgatctgaatttgtctttgacatttcgtcctttcttgtatcaagcaacgcaacaaagtcgagcttttttttctctaagtatatctgccacataccgaaatttagtcaaatctgaaagacctctgcaattccaaaagatacctatcatgacgaaaccattttggtgtttttttggatttttgggacgagtctttcgctcttttctttttgaagatgatttagattttctagtggaaaccaataagtcacaaattttgttactttggtccacatcctccatatcaatctctgaaatatcctttactaagtgatcgggtagggcaccatcaatatcgtcgccctcgtcatcacttgacataaaaggatccatctccgacacaaaagtattggtctggttattttcattagatttggttcctactttagatctatctacctcaatatgtttcaaggcattaagcgagaaagaaataggaaaattagagttacccaaagtaactcctaaagatctaaagttggaaacaacattatcaagaggtagagatgaaaatggctgtggaggggtagtagcagtaccttgatgaaggatgcattacgggcatagttatcaagaccagaccggaccggcatcggttcaggaaggcatgtctcgtagtgatagagacaatgctaactgcctaagtgcagtcagtatttgctaactaatcacatgtctgtgatttggtttttaacctcttgtgtctgtaatccatggatccaaggagtttgccttcactgttaatcactagcacgggatagctcatctgtaatgggtgggaagcctcatctgtgtcggcgaggggtacacacgaaccaaaagtcacttatgtgaaaagtcatctgtgttgggtcggccgccgtcacagatgacaatcatctttatcgataaaagacggtcacggatgactctcataagtgacggttcataagtacgagaattacaatttttgaattttaaatatataaaaaccctaaaaaatatattttaaatattactagcatattctaaatggtatatgcatacatgtcatatatgagatttgaacataagacttctcaacacatgcaaaccaatcttaccatctcacctacagaccacatgttgattggtaatcagatgttattcttttaactattgtccaaatatgaaacacaaatttgaaactctagatgactttaaataataatgctttcaagtacaaagttgcagatctcatcgagctctagaactttagtgtagggtatatctccattcaaggtcgtttgaaaaattcaaaaaatatttttgaaatatatcacatcacctgtaacacttattcggagatgaaaacaactttaaatgaaaatattgtcaattagaaagttgtacatctcatcgaaccctttgactttgatatagactatgtctccatctgagatcatttgaaaaattcaaaattacgtatttcaaaatagctatcaccacttataaggcatattcagacatgtaaactatctcaaatttaaatattattagttttaaggtcataaggtatgtctctatttaaggttgtttgaaaatttcaaacatttgaatttttcctcatacgtgatggttcgtgattgtcactcttcatggataatgctatccgtgaagggtgttaattaagtcccgtcacggatgagtgctctcatctttgatgggttatctcattacacctgtcacggatgacatgttatccatgacggggaatggttgtgacctgttatgttataggtcatatgcgatgtgttagaactacgagtctacgatctgacaaagatgactttaaattggtgatggggcatggtttgtgactcgttataggtcatccgtgacgtgttagaactacgaccccacaaagatgacatatcggtgacggaccatccccgatagtcatatcttaaacatgatacttttttaaaccgttagagatgagtcatccgaaaaaggttgcattagctcgacacatatgaatcgtcaaggatggccggacttatactagtgaattatcatgtgctaatttgatcacacagaaaatatgcgttgcaacagaaacaaccacaaacagccgtccagcgtggtcagggaaggaagacaatatgtcggctcaactgcacgcagccgccccgctggtatctctacgcaaagcatagctctgtttagatttcaacttttatatcacattgaacttttctacacatacaaactttcaactttttcgtcacatagttcaatttttttaaacttttaattttagtgtggaactatagacagcccattctgttgttccagacgcgccgccgcaagaacctttccaagtgccgacgtcgcaataccgcgcgtctctgcctcgagcaacgctagtgcgctatcacgcattatatctcaagggaacccaaatgaacttattccccctatcactggtccggcccatcgacaaacggcccaggcccaactgaaatgcattttatttatttcatttattttttcttttcctccttgtcccctctcgttagggtttcccctttcgcccccgccaccgcggcaaaaaaaaaaaattttggaagcctcgacgagcgggacaacgccccgcgcttttcccccacttctccttcccctccacctcgtcgccggcggcggcggcggctgcggcggtggagagcgagatggctccggcgatcgggtcgcggcggctcacggtgctgcgggagttccgcccgcacgggctcgcggccgaggaggccgacggcgagggcggccccggggagcggccgccgcaggactacgactacttcctcttcgacccggccctcgccgcctccccggccccggagcccggggaggaggccgcctcctcctcctccggcgccgacggcgaccacgagctcttcatccgtgggaatcggtgcgcacgacatcgcctccgctctacagtgactgtatattgttggtggggattgggagttgggggcatgattaagctttgtcatcccgtcgaaatgggggaaatgggcagaattgactttattgctctgtgatcgcagcgaaatgtagcaacaactatgcattaagaatctttgaatttcattgttcgatttccacctctaagtcatttgtatctctacgtccgggagaggcatatggttttgcagactcacactaagggtgtgtttggataatggaaaatgtggagtggaattgggattgggaaatgaatgaagggttagaattaaatggaagagggagaatgaatggttaagatttaaagatgtcttttagtggatgggaaatgatttccctatcccattagccaaacagggcctaagtaatgcaacttcatttttaatttactagaacttgtagtatgcttatgtgtccccaatgcatttctgcgtattggcttctatattttatatgctgctatttgttctagtggtcaaagagcaaagatgtgagcgcaatagggcattttaccttcagcgtgcagataagcacaatgcatttccaggtcaatgtcgtactctggaatgctcctccgtagtcaccctaggaggcatgcacatatttaaaactttcactttaatattcacatagacatttagagtcaccaaatttagtgatattattagattcgtcatcatgcatatttccatatcaatacatttaatctctttagctaagcatggtcaaagcctcaaaggcatctatggcagactagatgctagcagaaagaaattggttaggtggatttttgtttctattgatatctgaaaaatgtggcatgaacttgtgtgtttaattgattgatcgatctgttttaaatttaaagggatggaagttgagttcatttatttcttttttatgataatttatttcatttttttatgccaaagtttgatttgcatgtttccagtgaattagatgaaaacacataatataggttgggtgaagtgggaaatttctttttgatgataatttatttcatttctttcatgccaaagtttgacctgcatgtttgcagtgatttagatgaaaacacaccaatataagttgggtgaagcgggaacacactagttgtgtggtggttaggcaccgagttgtggtgctacccgcccagggcttgaatcctgggttgtgcaaaacaaaggttgacctcgctgagtaaaaggctttcagaattaaatgcgactgtgtcctgggcctccagcatccagcatgtttttcgacttacagtggaaatgctctggggatgcctccccatagagtcgagttttttttttaatatataagttggatatgaagttatatatcttgttgatggtactatattttgtgcttaactacttgaattttgtagttcaattgattctttcatttggtaaatgttgatttcttgtatcatcagtatgatatgttcatgttttccctatcttgcaggataatatggagtgccggctcacgtgtccacaaaagatacctctcaccaaatacagtcataatggtattttgactattttgttttgcttgtttaacaagtaactatcttcccttatctttttctttttcatataattgctcataaaattagaactgtgactgctgatttctctgtgctcgatgtgtttcctcctctgagtacttaatctgatcttttttgtttctgtacagacatgtttctttattctcctgcacctctaaattgttttcaatgtttttactagagctgaaaattgctccttcaatgcttcaactatctactctgtacacattttagttgtacagtactaggttgttgatctttccggagaacaaaatgagcatgttgacatgaagcaatacgatccttttttagcttacagtgcattttcttttcatttagcagcatgcttctgattactaaaaatctacaatgggtgctcatttgctgatgttgaactgaactgtaggcctgctggtgtaggatggacaaaactcgtgacgcacttctatgtgttctgcaggtcgatactttatctatatacaatgtaaatggtgagtttaccctcttactatatagtgtagtgccaaatgatcgctgaaatattatcccttaattttctcatgcacatgatttaaattgcaggcgaggttgccagtattccactaccatatgctgtttcatcaatatggcctcttccttctggccttctacttcagaaatctactgatggaggccatatggtattatcctcaacttcactgctaaaatcgagggatttaattcgtcctaacaaggaatttggattgaattacaatgtttcatcccaagtcaatactttggagactgtcagtaaagctgatggggctattttttcgtctcacctcatcttgaaacatccacttgaagagcctcaggtatatttgtgctgcatccacttgaagggcctcagatatatatatgtactactccctccgtttcacactataagacgttttggcctctccatttctcatctggattcagtaacatccataggaattcagacacatatatgaatgaagcacatacatcgatccatgcatgaatttattcaaaacccaaaacattttgtaatgtgaaacagaggaagtgtatgtttttgaccatgatgcaagtttttgagatgaatttgccttctcttccttcaaatttggtagattacaaatgcattgatttctccatggtggcatgttttccttttactattactgagtgccaaaacagaaaggtgcacatattttgcttattttactgcttttgtgatttttataaggtgtcctcacatttttagatctaaagtttgaagttgtcaccaacatagccagcaatacttctgtgagaaaaatatgctgctatattgattttgaaagtgcacttgtatttgcaactattatcttgtggtcatgattttgtagttgtagggaatatcagtggaaatatgctatctctatctgtattccatgcattgttcactggacattttatgaatatataagaagtctgattgatttctttatccattttgttggttgcatcatgaccaaatatttttaggcaacatattttgaagaatggggcaggttggatatgatgaaagattttgatgaaaaaactatatggacaagtgatatagtacctctaatggcatcatatcacaaaggtactattttttcaattttttgatctttacatttcccattattttgtggcttgaaatgaaaattgatttttcatgtggcaggaaaatttcagcactctgtttggcaaattgatggtacaacttaccaggaagaaatcaatgacaatgcagtgcccccaattccatgtgatatttctatgcataagtttgcattccgtaagatatggcaggggaaatgctcccaatctgctgctagtaaggtttgctccattccaacttcatgaaaagagctcttttttctgtcatattttccattttccatctatggccatatctttcaatgttgtattgcttgttttctgattgattcattagacaaagtaacacgttttttgtgctgttaagatcaacacaaaagaagaggttgttttgaaatgatattcattatgtaatgtaacataataagaaaaatggggcatggatagattatggccacaaccgatatatacttctcatttctttgttgcagggtctctgtttgtagctttgaatagatgaattctaggtacaataggacaatggtgatcctttccccctctcttctgcaattgtcaaatgtgctccgtgccagttgaaggactttaccaaatgggcattagtgaagctttactttttttttttgtagggagtgttcatgatgacttagaggccttccatgagcctgacgctagtgtacccctatgaaatttgcgtaataagataatcaaactccgtttaaacataatttatatctgtctctgttgtttcccttttttgtatgggattgtttccctttacttgttcatactttgcaattattttaccaccatcattttctttgatatgttttggaaatgactccaatttcctaccaggttttcttggcaactgacatcgatggtacaccaataatttgttttttacttcatgagcaaaaaatattgcttgctgtgagatttcaagttgacgagaataatggagaatcctttggagatattaaacctcacatgagctggaacattcctgcattagctgctgcaccagttgtcgtaactcgcccaaggtggtttgccttagcacatggttctgaatcctcaaggaactatttttaatgctgctatttgtatcttgcagagcatgggctggagtccttccctttacggacatcctcattctaactcctgacaatgatctacttctttatgtatgttcactgtggtcatgctgcaggcatacgttctttcatcatgctcatatgcttatgaagtcatgttccttctgctcctttacattttgatcctaaataatgccctagcagctgcctttctttttgtgtacatgacctttagttcattcatgtgacaaatctggttctccattgctttagtagtcataatagcagctgcgcttttctgttgtatatgattaaattctagtttcagtttaatattagggtgtttgttgcagttcgcaccaggtttaagcaaagtgttaaatttgcaccatgtattttggtataatgcttcacttagtagcatgtttttagcttgcccccttccatctgggcttcttttgctgacatggcgcaacaagcagccaccttaccttagacctgatctagaaaagctgtgtgcatcatgtgccatgtaatttgcaatcatgtcaggacacagaattagtaagtttcatggacaaacaaagaattaaagcatgaatccatcacaatgggtaagtttcacggcaaaataagttaactaaatatccagtgccatttgttgaataaacagcgtgacctccggatgtatcatagcatcactgcggattatagaaaaatacagatgaatgacactacttcacacatccatatttcacaccacataggcaacagataataaatcatggtttatttagtgtctgaaccgtgattgcaatttacccggtgcaatatgctcaggtatgcttctctagataaggttagcaaggtggatgtttgtttgtccttgtcagcaaacagaagggggcaaaaggcggccaaagtgcaacaatattctaaacatggtgcaaaccatagacttttcttaaacatggtgcaagctgcaagaagcaccctaagtcctggttcaaactgtaattcttgctcttcttttatttgtcaagtgcagtctggaaagcagtgcctctgcagatatactcttcctactgaattggggaagggtatattttcaaattatgagctaaattctggggttacagagttttactctgatatggagatcacaagcataacggatgctgttgaaggtcgtataaatgtgacatgcagcaatggtctggtaggttgacatatattgctttagtatacttgtggttacttagaatggtgtgaattcctggctgtattttggttgtgtttttctaagtttttttttgttgtgttgatttttggttatttctatatgtttgggttcattaaaaaattggggatagtctttctgttggtagcaatttgctggcttatttgtcaagtctttaggtgtgacgtgttagaactcagaagttcatactgatgtgcttctttatgcaatgtagaaaaactgatgctatggatttggtgttatacttatatattttatgattttatccatgatggctatgttgtttgccattcagtaaaggttgttgacttcaactgtcttcatattcttttctttgttaacacaacatttatgcggaggaaggcaatggttgatgccattttagtttataatctgcatcaagttactgaagtgaccatagtggatatacctctaaacctcccttgcagtttctttcgtttgcgcaagtgacacagttatctcttaaattcggttgttaatttttattaattatgttttaaccctaaagacttctcaaggggccatataatgttgggcatgctagcagcggcacagtttcttgggcatttgtttgatttattgctagcttaccacagttgtaaggatgcaattggctagtgcactatcccacataaaacctgcatattagttcatttttcatccaccagttcaaaaatatatttataaatataactacaattatgattgagtgggtttgaaatcctgcaagactgccccctatgcagctctggcttgccacttattttagccaaaatggcttcatatgtcagactcaatttcttgcccaaccttccctaacttgtggccatcattttattggccacaccctttgtggcaaaccccatctagactaagatcgagttatcacaaggttagacatggaccaatgctattactaaaattcttatcgttctgacttcctagcatatgctgcgtctggtttcaccttcactgacatgagcctttcttctaatcgccgagagtcacattttgatgttccaatttcattattgtttatttactgttggtgctacaatgtcaatgcccataataacttgcctacttgaactgttcaagaagtatcagtggggctacctgtcactaatgcagaagggggctaatctatacaaaatatgattgttcttacaaactattctcctttccacgttcttatctcttatgtggctttgatgttaaagctcattttatctccaactggataatgccttgacttttacggttttacctttcagttgatcttatggaacatttttacatattttgctctctccagatgctccgatgttcattacgcaagagcccttcctcttctctggttggtgactgcataaccgcaatggcagagggcttgcagagctgcttttacagtcattttgtttctcttctctggggtgatagtgatgctgcttacctttgttcgagctctcatgtggattcagaatgggaatcatttagttatgaagtagaaaagatttgtgcaaaatatggacagatttcaccagctaaatcatccgaatcgccttgcacagcttgggactttctgatcaacagcaagcaccacgccaagtacggcaaacaatcccgaacctctttgcctatgtcatataatacaagcagcatgagtttccactctttcccccaagacggaaatagtgcagatgtttcattttatattcggtttataagtgaaactttggacacattgcatgccctatatgagaacctgaagctgaatattttgaggaaacagtaagcgcttcctattctttttgtctaaatgttttgtttgttgatattgattatctaagtgtgatcatgttgatgtttgtttattattactatacaactcctgtgaccttaaatgtttggtacacgtttttgtttatatttcataccatgtattgcattcttgtaagcttgtggtccaaatttacatagaatataatttttggatcccaataattgtgtaatttggcaaaacaattagttttcttctcttgatggtgaagagaactcaggggagccttgcctccagaggtgtgggtgttatgtgatagagccacagatatttacaacatacatgctgctaatcagtggacatctaagttcttgaaaggttggttcctctaccaactggtaatgaagagcttagagttccgcaatacggcagtagtacgagcacttgctttttctctaggggtggagcaactagttaatgggatattgactaatgggactatatttttcttttagcatattcagtggtagaatctatgtttcagtgtcagcaagaaggcatttcaaccatcaataagtttggtgttcgtgattatattttctgatcctatgcataaaaaattgcatatatcagcaagttactgctgcttttctagatctacaacataagattgatgtgatcttgaatgggttgagatgtctttcgattatatatatcagcacattgttgttaccatgtatatggcaaactgtcttgatccattttaaactatcttggctttgtggtttccttttcagggatctagctagtcttgcttccttgttatgtagagttgcttcgtcccttggtgaaaacagttatgtagattactattgccgagactttcctgacaacttggttgaattccattccctatcatctgctactgccttaagagctccaccatgcttatttcgttggcttgaaaactgtctccgtcatggctgtgatttgaagacttcagatgatattcctgctctaatgtgcaaggaaaaaagttctgctgtgagctggggcagaaaagtggtgtcattttatagtttgttattaggagcagaaaggattggaaaaaatctctcttctggtgtctactgtgaagtagccagtggttcagccagaaacaccgaggaacttactgttctcactatggttgctgagaagtttgggcgccaacaattggatttattaccaattggagtatctcttgtgcttcgccatgtctgtccagtatcattgctgtttgttataagctggtactgaatttttcttaagatatcattttatattacaggcactggacaaatgccgtgagtctcctccagatgactggcctgcacctgcttatgttcttgttgggagggatgatctagctatggcaaggatggggtcaggaaggagagaaaatgggttttggaacaatgataatctgacatcaatatcagtcccatatatgctacatttgcaacctgtaactgtactgacgactgcattggatgtccctccatcagaaattttgaattccgaggatactgattctgtttacagatctgtagaagatggaatggaacacatcttcacctcaacaacacaactgcgatatggtcgtgatttacgtctgaatgaggtttgtcttggtattttgttgttttggtctacagttgtcttttgagttgttgtatttaaattgtagtattatctactgaagtccaattcttacttcaagtgattgtccctacagctgcatatctttcactcctttaagttctatataagttgctgagcccacatggagatattacaactatactgaaattgaaacttaagataaattgcagaaaacttcaactgttttgtccaaactataaatttgcagcaactttaccaagcatttgggataactacaacagtagcacatgattttatcataaaagaacatttcgtttagcatgggacatctgacaggtcaggtccatctgtcatacacacagggccagcttgcgcatggcatggtgtatggtacactgtaacagcatgagcattgtatttgtgtatgacatgcaagcttgttgtatcagattgtcctgttgctaacggcagtgcctatgagatacagtttctgacaaaaatcgtgtgctattgtggtagttttctgatgtcccacgatagttgtagaaaaaaataagttttgatatataaagttgtaggtgcaagtgcaaatagtttcatgaacatagctattgaccactgtaattccgtgactgtaaatgacctgtcgtttttgtcaaggagttaaatacatatctatccttgacacatccacaacaggacaatcacttagcttgcataagatataccggtctttttcaaccttatattgtcattgtccgtcaacttggcttgatagtgtttattctaatattctttatatattgcttcttattctatcatattgttttaactaggttagacgcctcttatgctcagcaagacctgtggcaatacagacacccaataatcctagtgtgtctgatcaggatctacaacaggttctcttcatgctatttgattgcaattactgactacatatagtaaattatcgtttcacctaacaactacatttattatcacattatattattgtttctgcttaaattcgaattacaagaccatgctcccattgtcactgtgaccttcctccatatgctgtgcatttccgctctgtggatctttcatttctttatgatatgtcatttcagttttcttaagtatttatatattcaaaatactggtaaaaaccattttttgtcagggtactaattcagttcttatcgtgatctcaacagttatgagtaaccttgtcccaacttatttcttgtattttcagcaacaactatggaactttgcacaaagaacaacagctttaccttttgggcgtggggcttttactttagctacaacttacacactgttaacagaggtatgacttcacagtcattataaccggatggttatggttgcatcttatccagtattttactaccttggccagttgatgttctctatgtcatcttgttatggggccattttcttttgctgcaggctctggttttcccaaagcttgttttggctggtcggttgcctgcacaacagaatgcaacagtaatgttacctcttatgtaactcaaattttatctgttttctggtagacttgcattctgaagaaatcaactgttcacgtcgccatgtagcattaatactgtgatataattgcaatatcactgcctatgtcatgcgtggaacggggcctcccctattcatgacagaaaaacaacatatctggtactgctgcatatgccagtcttagagatagcaacccatattagttaatgatatgaagctacctgtgatatttcagggttggttggacgctctttttagtccttttgattggctactcatgtcagctgtactctatttaaccagtttattaacaaagcaacagaagctaagcctattcaccaacccccacatccaactgcatttcttcccatgtacagcagggaagggcgataaatatcatgttgccactgctaccaccttcgatctatctcacctcataacatgaacgctgcgctgcccctgaatttttacaacatcttttcatcgtagatccttggttgtaactttctttaccctattacactattttatataggttaatcttgacctaagtactagaagcgtctcagaattcaaatcttgggctgagtttcacaatggtgtcgctgctgggctcaggcttgctccttttcaggtaaactggactatcacaaaacagataaaccatattacccagcagtagcaaaagctgcaaagttcacaactcttggcaaatgctttgccaccttttactctgtatttccttctacttgtgaatgtgtaacagtcatgttctatttgcaggagaaaatgttaagaacctggatacaatataatagaccttctgaaccaaattttactcatgctggtctgcttcttgcatttggtttgcatgaacatctacgagttttaactatgaccgacgcttaccgatatctctcccaggtggccttttgtcctttggttccattactaaagaaaataactggcttcactaattttgtgttcaagtattcattgttatatctaaatcgttctgtaccactttgcacctcagtcaccactcagcactttgtcctccttttgattacttccgtactcaaaatggtaggagaaaatggggttgtgatgtcattatttgtttattggtatggtataacctttttattactttaccgcaggagcatgatataactagacttggtttgctacttggtttggctgcatctaatagggggacaatgcacccggcaatttcaaaggtacgcaatcctccttttgcattgtacctgtacaattattacgtctcaaaagtatattgctgtcaaattggtaagctttgtccatctaataagatgtatggtgacttcctgactgattctttattagacaagtcttcctttcagatttatgtattgttctttttttcttttcaaagtagtggattccatctgttataggaatgcatagtgaattgtatacatgacctctgccagcaatggttttccctccttatctacatccaatgctcattggacatatatagcagataatcttcaaaaaccccttttcaacagaaccaaatacatttttttaacagaaaaaaaccaaataaataactcctaattctctcagaacttgctattagaagtgatgaggttaaaaccacctgcttgtcctgctgtttttttttttttattttccttctgaaggcacaattactttagtcattcagtgtttccttaggttgtcgaaaaaatcaggtttattgtggtattgtttctgtttggtcactttgaatggggatgtgctgctttgttgactgccaaattgatttttactgcttttggcttgattgcaatttttcagatgctctattttcatgtcccttcccggcatccatcttctacgccagagttggaattacctactcttctgcaggtagcatttgcgattagctaatgacttactgtgtttttcatttatttttatggattctcagcatgtgatccttgagttaacaggtcttacattcacatgttgtatactgttgcgtgttgtaaatatttgatagtgaaatggatcctagaccaggcaattatttgtaaatattatgtttgggtggagcacagtcttaatttaactcttatatgaacatttctagtaagatatgatttttgtttcagtaggttttggtcctttgtgggtttcgccgaaggggtaaaaaatttgagaatttgtttggttattgacagatgagatgaaaaatatttttaaccaagtactaaaatctcattgtgcagtttgtttataatgcatgctctttacctagtgctgttctaagaacagagataatgtggttcctagtaggtttatatcgttactagttttagcaaatgcaattttgaaatttcgacttacgatgctcaactagggatttttctgcatttgacaagcaaaggctttatgggccaaaatctggaaaatataaagtgatgcttagcatttgatttgttggctttagttttggttcaatattagaataggttgtatttaatgtgggtatgactagtgttaacctttgaactgtactccctccatactcataaaggaagtcgtttaggacaatgtttaagtcaaaccttgggaatataaatcatgattaactctcaagttgttgagtttgaaaatataaaatttatatgaatagatttgtcttgaaaaatactttcataaaagtatacatatatcacttttcaataaatattttttatagaaaaaagaagttaaagttgtgttttggagaccgtgtcgctgtcctaaacgacttcctttacgagtacggagggagtacaccagagttagaatgaatcaagataatcttctattgtgggtttctgccttttataatttattctttgccatcttgttgtcatgtagtctgtaatagcaatttcttatccctgtcacctgctattgagtgattgatcattcatgattataagcttttacctaatatttttttgttgtaattttttatcaatcgggtaagctacattccctgcaatttatgccttcttgcaggaaatattatccatctgctcttaaaattttcatattttctattcttccagtcagcagcagtgatgggaattggacttctctatgaagggtcagcacatgcattaaccatgaaaattcttctggtactttcttggccgtgctatatgattgggattcctttcactttctgttagttttcttttagcaaaggatcacttcatttcagttgtccatgacactaatgttgagagggtaagggaaaggacattagctacccacaaatatcaattgttcatcacattttgtctgcaagagttatatacacacacaagacagtcatgagtgccccattggccaatcctagactatggggtaaagccatagtatactataaacatatctacacttaatcttttcctttggcattcaatattctatcagttcgccagagcagaaatactaaatatgttccttttttttaatctcctgttggagttggatattttgccctcacagcggtttcatatctacaatttttttggtttgtttgtggctcagagggagatctgacactgacctatccgagtggattgtagaatggctttaggtgaacgagggcacaaactggcaaggaaatagatctagagtagctggttaagaaaatgatctgcagaactgtagggactatgagacagtgttattcatccttttgctttacttaataaatctgctgtccacttaaatagaatcatggatgtaacaaaccaatctaaaagacactaagggtacaaagaaggatataattgaaccaaactaaagataaggaaataattgaactaaactgaatccgaagcaaagtctaccagcttcttgggctatattgatgtggcattgtgcacatgataatatatgaaccaatttggactaggtcatatttttttttccttttcctaatgttgtttctttttacttatcttgtgctcattacattcagggtgagattggccgaagaagtggtggtgataatgtgctagaaagagaaggctatgctgttgctgcaggctctgcattaggacttgttgcattaggtgaatttcgtttgacagattcatgttgcatatcttaagctggcacttcagcacaaaaataaccgaagcttttgttgaaggtcgtggaagcaatgctttcggattcatggacactttcctggaccggctttttgaatacattggcagtaaagaagtctaccatgtaagatcttattagccctttatccttatttatctaatgctgagtgctgccctaagatggttggttcttaatgcgtatttgttcaaagcatgtcatgacttgtgagttttgatagtacggaaagaatggagataacaactatgctcaatgggatgacaagggttctgtgcatcttgtcacctttggcagagtggtgagaagatagatagattgtgttttttttttcttgattgcaagttttcaaccataagccaggagcccaggagtagaactactttaatagagccagccctaatacaaactaagatgaaggcttctctttaagcctggatggcgtctatggcttgctgtgccaattcacgccatccagtgtatctcccccctctcctacacacagtgtatctcctcccactatggtactggtgcatactacatggtccaggagacaaggactttgtacccccattacttctacctctgtttgataccttttgctttatattatggcattctcatcttgtgaagcaattcagttttgctaatggttttataaattattgttaatattatcaggaaaaacacttaaatgcagcaatagctgctgatgagcaaagtggcaacaccggacaggtactcactctttgcagtcatggcacatccataaattacatgtgaaccatatatttcatttctgttactatcttgtttgtacagatgatggaaggagcacaaataaatgttgatgttactgcacctggagcaataattgctctagccttgatatttctgaaagtaacatcacttagtcctttgtatcctttttaaatcctctagaaacagtctacattttagaaaagattcttagggttttgcctaactaatgcccattttacaggcagagtcagaagaaattgcagctagactcagtgttcccaatagtcactttgatctgcagtatgtgagacctgattttgtaatgcttcgcattgtagcacggaatttaatattgtggaacaggtaatcttgcaatttcaatctgaaatcttagtgtggctttgtgataaatcatcaacggacttccagtaaactggcataaagctaagtattgtttttatttcgtagaatacaacctaccaaagattgggttgagtctcaagttccttcatttgtcaactttggtgtttccaatacgagtcaagaggctatggacagtgatgaattggatagcgaagctctgtttcaagcttatgttaatattgtcactggagcatgcattgcacttggtgagaaatcaacatttgttctgtaaatccctttcttcaccctatccctgccagtattactatactgcttgctatatgtgatctgggagtctggaaatagcatttatatgtgttgactttgtcccacgtctgcttgtataagtgggtgaatgattatctgatgattctgagtaaatctgagagcaggattgaactagggacaccttttctctgaaatacatgttgccctttttcacttatccattgaccagtgcttgtctaattagtctaaccatacctacagataggctaaccctcttaaccttcattttcccctctggaattgttgagcttttcttttgcttaaaagttgactttaaagctgtccctcttcactgttttggacgggtggatcaacatcgagtacttctttcagttgagaagagatatctattggcttacgttaactcctagggaaggaaacacagaagctatagcctattatatagctcaactctctcccttcctgaatttgcagcaaagcttctctatctgtcattaaaggcatggcctgttgctgcagtatgccatctcctttgccgaactatctattatttattgattatgggttcattaaacaccatcctggttactgccttcgtacttctggtggcactgcatttcattgatagaacttacttaaatttgcaaatgcacaagactattggtgttggttaaccagtagaaatggcattaaatattcttatgaacctagcaaatttttctgccatttacagcagttatcaataatttcaggtctcaaatatgctggcagtagaaatagtgatgcccaagaactactctacgcttatgccgtccattttctcaatgaggtaccgacatacatgcctatccaatgttgttcctatattggattctgataatattgttaatatttcttatgcagatcaaacacatatctattcagactgcaagcatattgccaaagggattgttgcagcatgttgatcgtggaactcttgagctctgcttgcatcttattgttctctctctatcactggttagttagaatgcatatttctctgttttatgtataacaggtacaacattcttgttgtatttcaagcttttcatgaagtcttttagctttacatatcttaaatatgggtgatcattataataaaatcaattttctcgactttgtttttgtaatttgtgtttcttttttgttaggtaatggcaggatctggacatttacaaactttccgcttactgcgttatctgaggggaagaagttctgcagaaggacaagtaaattatggactgcagatggctgtgagtattattactgtcatgaacaactgtgttctctttaaattcaaaaccagatgaggactgattatttcattgccctttttagaagtctaatggggcaactttttttgaattattcctgccaaaagaccctccagattcctgtaactaacctgggactatttcaaccggttcattctgtaaatagcatctttttatgtttatatttgacctgatgttcatataggaatcctggatagtttagtgagagcttgtctggtttatatgcccaagtttgcaaactgtactcagatcttagttaccatatggttaattcatcactgcatgaagttcaaatataaatctgccaatcgcagtctgttaacattctgatagcttattttgtgagaacactgagcaatctggacagatagctccggcaggtcatttacgatgtgtaggtctatctgtgcatttacctgtcttgtctacaatgcaggtaagcttggctataggattcttattccttggaggtggtacacacacattctcaacttcaaatagtgcagttgccgcattactcatcaccctttacccacgtttgcctactggaccaaatgataatcgctgtcatctccaggtggttttcctataattctgagttctacacttttcactattccctccattctgagttctatatgtcgttttgactttggttaaagtcaaactgctccaagtttgaccaagtttgtagaaaaaagtagtaacattttcaacacaagacaaatatattatgaaaatatattcaattattgatttaataaaactaatttggtgttgtaaatattattatatttgtctacaaacttagtcaaacttggagttgtttgactttgaccaaattcaaaacgatttataatctgaaatggagggagtatattggtagcttcccttgttgtaaacaactaatgttctttgtatggtactgtaaataggcattcaggcatctgtatgtaatagctacagaacctcgatggattcagacagtagatgttgacacaggacttccggtgtattgtcctcttgaagtgacagttgctgaaacggagtattatgacgagactaattactgtgaagtgacaccttgtcttctgccagagcgctcagtggtatgtggactctaacaacatttgtttgttgcaaaaaattatgctgaaaacgatataaagctttcagacaagtaaacacatctttaacatgtcagatgacactaaattacagcaaatttactgatctatctacaaattattttccaactgtgaacaagatagcattactattttcggtttaccattaacttataaacttatgaatagaagttaatggaaaaccaaaaaatagtaatgctatcttttaaagggcaaacatcaagtgcaaaacctattatgtgtgcacttgtgtggatgccctcaggatgcaaaaaagtctgaaattattggtgtcgctctgttagagaaatgacattaatgactgtgcagacttgatatcaaatatgatattgtttgggatacacaagaaaatccaaaagttatggtttacactgttcaacatcattccttttagatactccatctgccccaaaacaacttcatttttcacaatcttatttgtttcaaaataacttcatccttcaagcgatcattgcgttggagtttgtaaaagtagaggacaaaagcattaggactggataaagtggggagcaattgcatggggatttgataaagtggagggcattctagtctttttggttctatattggtatgtgaggatgggtaaaaagtgatgttattttgggacagaggtagtagatatttctctcacttagttcaaacacaatcagctttggtcatggaaatcaagatcatacagtatctcttctcttcatctataaatgtttttggaattttgggaattgtatggaaagttcatgcaggtttacacccagactgggtttctctccaatgaattgcacaatctgaaaaggctatttctgttgcagctgaagaacattcgagtttgtggacccagatattggtctcaggtgattacacttacacctgaaggtatgcaactcttctaaatatttcatgtttcttcagaaaacatatgtattcttatattttctctctttaatagataagccatggtggaaatctggagacaggactgacccattcaatggtggagtactctatataaaacggaaagttggatcttgttcctactcagatgatccaattggatgccaatctttgctttctcgagcaatgcatgaggttatattgttttcttgctcttctgacaaaagactatgtgtctaatatttctctattggcatgtagtttgactgttttgtatcaatctttaggtttgtgatacaccatccacgagctgcagtaatcaggcaaacagtgctactcgtagttcacttagagtcgatcagttagtaagcacattttctgctaatccaagcttgatagcttttgcaaaactgtgttgtcagtcatggaaggacaggcaagtgatatttttgatgttttctttgtttgattgttactttatatatgcagtaatcactacgacctatttggtgcatcagtgtctggcttgctttctaatgtttagttatcaatgtccaaatgcaggcgcaatggcagttttgaagagttctgctctcaaatactttatgaatgtatgagcaaggataggccagcactattgcaggtttcttactgaatttttgttcacattttgttaaatctccagtgcccatgaattatcatgtatttagtcatcattatctcttttccaggtgtatataagtttttacacaataattgagacaatgtgggagcatctaaagattggacattttcctttctctgattctcttttcctttccagcttgaaggttagtacttgcttttaagttctccagatctgcgatgttctctttgttactagtttgggttactcacagagcttctggaaagatggttccagcaaaattcctagtcccacctcaagaaattgactagtttctattttttctctttattatgctgtttctcttcttcttattgtactttgtcttttttaggattctgttttgccagcttctttgttgaagatatctttatctattagatcaattttcacatactttacctcgtttcgacaaaaaaaaattaaattgttctgtatcccagatttgctaggaactggctgttgtgctgagatttgaaactaatattttttgctgtgctatgatacacttcttggccatataccatagcagcttcacatacatcttctgctctgatgtgttgtacctttatttccttcttatagattagaaaatgaacaacatttggtaatgatattatgatctttctttgaacgtgcaggttgcatcagcctataatgaagcactgattgatggtagaattacaactggaggcattattcagtccacatttttggaatcacttatgaagcgcatagagtacatcttcgcagaattgccgaacctgcatgacagcttcatcaattacctgaacaaaggcaaatggcctgatgcacaaaacgaagcagtgctcctttcttggtatctccagtggtacagcatcccacctccccatattgtgtcatccgcaattgaaaaggtgaagcccagaactcggaccagcttgtccatgctcccgcttcttcggctcctgctgccaaccacacatctcgtggggctcatggagattgagaagcttcacatgactcatggtcacgagggcttgaccttgcactgaaaatgcaagaaacgtttagcaacgagtgagccgattgtgactggactgaatagtatcagggctcattgttcttatctactagtaaggatcatacctaagtgctggaatgccaaggctttgtgtggaggcctcaatcatgtgatcctaccttgcaatgctcatattgccatctgatattgtaccctatgatcctgttgcatttagatgtaagtgtccattttggctttagaataggaatgaccgaatgagtgagcctagtttgagcctttgataactgctacatttgggctcaatgcaacatgggttcccagtgtatgccgaccggtttcaataaactggtggttacgaattgagctataatagagcacattttgtttctcaggctagtgattctattatatcatttcgttttttataattataacctatttaatgagacttttcttgttggtataagtttttgaatattggtcaaaatcccggctcctaagctggtcaccacatgctggctgaaataatttaaatttaggggaccacctatatatatatttgttgacacattttctactaaaaatttgacagatgtaattatagtacaatcgtagtgtaattgcactgtaacttgcatgtaactacagtgtaacttgtatgtaagtttcacgtaattttgaatcgttagatctattacaagatttgttttggtgaggaagaaaaaaatcacagtacacatatgtgaaaggatttgttctcacgaccactattttactgaaatagtatgttactgagagattcttaaaagttacatacaagttacagtgtaattacatgcaagttacagtctaattacactacgattgtactgtaattacatctgacaaatttttgggggaaaatttatcgacaaatatatagcaaattcgcacagccaaacggtttattaatgaccaaaacataatttgtatataaaacttgtgtccttcgcaatttaaaaatgaaactactttgaaaatactcaaaaattgacttcaaaattaagttttaaaatttaaatattgacaacggctgattcttttttggaagcgacgaggctctttatctgtacatttcaaaaggaaacaagaaacattcaaatttgaaatgtatttatcgttacatttgtgaaatactactatataacctgtccctttttatgcttgtccctatagatgattgcattgtgattattattctactagcaaaagtgcccgtgcgttgcaacgggaagtgttaagaccagaaaattaaggaaaagtaaaaagatttatattatgtaattaattgaaatacaaattgtttacacccaaatttggcacctaggattaaaatagggaaattgccaaagtttggacgatctaccggtgtttcctctgggaggccggtctgactgccgtgtataggccggtcagaccgcggcctgaactccggttagaccgccggcatgtggccggtctgaccggcagagtccgagcccaagtctatttcgtcgggttttgaagtttccttgctctggaaggcatgtttcgggtttcctttggtttctatcccgagagttggacgtggaggagagcctgtagagggcaagaccaacccctatataaggaataaggccggttcattgtaaaaaataaataaatcaatcaatcaatcgaatcgtttttcatattgcttttagttttctcttagtttgtccatctttgtctatttacactgtaaatcgttcgccgccactgcgagagtgcgacacctctttgtaggtttatcctgaaaaccatccattttgcccactagacgggtagttatccatcgttctatctagatcggctccgctagctggtttagtttatcaaaacccaacttgatctagtgcttgctagattaggatggttggcgactctagaatcaccgcaaagctttaggtgctgtgattgtgcttgtcaacttgtcacaaaaagttgccaacacaaatttccttcaaaatttggatatttttttaagttggaaagtgtataattaaattaatttacaagtaaaataggtgctacctgttggatttattctttttaaattcttcataattaactacactctttggaatttcattgaaattttcaaagcttaattgctaattttgacaatacaaacataatttcagcatttattcttcagcctgcgaattaaaatttaccgttcgttctcttttgggtaagcgaaggtgaagtgttatttgatgcggattctggatgatttgttgtgtgttggacttggaatgttgcggacaaaaataggtgaggatggaagaaaatttcaccagaagaggttagagatattgaacgtataaacaatgaaatcgaatagaaatcagacttatttctgccctttttacatacaatcagacttttttctctctttttttcattttagatggacgacaaaaacattttcaaattttttaagtagtagagatagagattagccattttcgttttcttagggagtattgtcacggaaaacatagtaatttattaatatataactaattaagtactagtaaaaaataattaaaaaaatagattaatatgtttttaaagcaactttcatatagataatttttgcgaaaaatgcaccgtttagtagtattagaaggaaagaactcagtattaagggacctgaactgaacttatttcgtgcggagcctatgttggtatttcataaccttacagagaaaattcgcaagcacacgtaaaataccgatgtagcacttcacccgaaaatattctcaggtatcgatttccatagggaacgggtattacttccatatcaagttcacccaaggacactaagctatggtaggcgaaggatagagagaatttcctagtgggatgcttaattttaatcctaatgcaataacactggcagctcttcctagatgtcactctactacgtacccagacagggaggacttaagtgctcttgagagctgtcatcagctctacacccacctcaaacgtactgtgggatacgcagcaattactagatattaattacctaaataccacgtctaaacaattaatatctactctagtgtttataactcactaaagcaatcactatattttagttgattatagggaacaataatcctgtatgctgattaggaactaaccaagaagtagttctcacaagtaaatctaaattactcagaaagatatttctattgaaaacagagtaattaatagaataaaagaaacaggagaggattaccaacaactccggaattcctccgacttcttctactctacctcttcctaattctagtatacaaatagtacaatagagcctcttataattcagctcaagcttggaagtgtgtgaaaaagtgaagtctatttatagggcaagtatgatggttggaatgatgcgaaatatctaaattgccccgcaatcgtcatcaggagagcatctggagcgtccctgccaaaccccagatccaacggaggaaaccagggttcggccgaaccccgaacctaggctggcccatctggctgccaggtttggtctgggcctcctccttgccctgccttatccatttcttctaattttgggctaattctccggagttttggtgaagtctaaaacccaactcttatatggatagatttcttctcacttttagtctaaatttcctcccaacttatgtggtttataacttgcatcaaatatgcaccaacactcatggaatatgttagaattaacacctatcactatattggatattttattatctgagttttacgcaggcgttggcggcacaacttttgcacttaacagccgccaacagcatacacgcggcccatgaggcggcctgggaaccgtggcccgatgtgggagaaggcgtagtcatccgatctgattgacggtctagattgatccgggtctatataaaagttcggcatcctaaaccctaaccctaaaataatttcctctgcctccctctctatctatctatctatctatctatctatctatctatctatctatctatctatctatctatctatctatctatctatctctctctctctaaatggcggcgcctctccctttctaccgcagcggcgccgctccccctccccctcccacggtggcgggtggcggcaagcggcaacgccctccctttcagtaggaggggaggcagcgggcaggggcggtgccctccctctgccggatccagcgagaggggaggcagcagcggcgcctctctctctctctctctctctctcaaaacgacggagccagcggcgccactcccctcccccaccggcgaaggcgtcgttccacctccccctcccccaccggcggggacgccgctccacctcccccacccatggtggcgggcagggacggcgccctcccctccgtcggatccagcgggaggggagccagcggcggcccggtgtccctgtgatgaaggcggcggttcggcggcgacggtggcaccctccccttccggcgtcggtgtttttgtgcttgtgatgttcttgggttgtcgttgttgttgatgaaatatgtttttgtattcttgtagtagtgttttctctaggattttgggccaaatttgattcgtactcgcattaagcttcaaattgaattgtttttatgtttgttcgcccttttttccgttattacggacgacggaaacgttttcaattttttaagtagtatggatttttgtaagttaggtttatgaaaaataaatgtgttttaaaatacttgttttatcagtaatcgctggtaatttttaaaattcaaaattttgaattttgaatagttgtctaataataaaggtaatcgaacatgtgggaaaaaaattccttgttcttacgttggtcgagagtgacttgtgatcgcattttatttcagatttaaataggggaacattgtgtaggttaggttatgtgttgtatctataagaagagtaaattgcacccacggtgtattaacttggcaggtgggtataatttggtgcaagaacttgaaaaatgagtgttctagtgcaacaacttgacatgtaagtgtaatttagtacaagaagtttataagtgattgcatacatgcaacaacttgcaagatatgtacgattttgatacaataagttaagaagttatccgacaacttaattatttggagcacttttttttatacatatttaatttttaagtacttattttgacaatatactagcgtggatttatatataagcatatttatatttttattctaataactaataaatgaaagtcaattaaactggatgtagaaattattatatttcaattgagatttgggaaggtgaaaaaaacaaaaattcttaaaggtaattggatgtaaaattgtcaagttttgtactagaacgcacccacttgtcaagttgttgtactcgaacggtcaattctcaagttcttgcactatatcgcacccatccgataagttgttgtatcgtgggtgcaatttactcttacaaggaatagtaaatggtgacttctatatataatggcacaaattatacacattaaaaaatccacatgatttctccttttaattgcctaatcaactctttctactcgtccccctccggattccgatcaggtgcagtcacaatagtgactacaactttggcagtaccgaatcatccaaccatccagcacacaagggatagtccagattttactgtgtgcatgtgtcatgcatcattttagcaatttgatcaagcacagaatagcttcagttcaaattttgcctgcaatttcactccttttgatatgaattttcttgaacttcaagaaaatccaaatatagttaaaaaaacaaaatagacacatacttcatttcattatattgaacttcataatatcttgcacatagaattgacaaaatgagctagagtttaactattttctctggaattgggtgtcatgcatccactgagacaaaagctttgaaaatcaactagctaagctattgctaggttaacccaattagaaaagctttcacggtccaaaagtagatcatcatttgcttccaaaatcagcatgatgccttctaagttctgttgacctcttcgaatgaacttttaagataagatgacatcttcaacatcaatagaaccctagggaaaaaaagataatatccaaattagaataatttgttagcacatatatttatctttgaagaaactggtcagcatactagtagaagttgagcatagctgctaattgcttcatattcttgatgttcttccacatcagtttgcaagtttttctcctttgccttttcttcatgctgcataatagatttgagaaggggctcaatttatagtcccattttaacttgttacatagtagggtacaaatatatttacctttctattttttttttttgtgtttttgcagtttatcaatccaatttgttttccgttatgttacacgtttccggctctcttttttttctggctctcctttttcttcagaccagagacatatgtgccaagttctgagataactgggatgctgactttgcaactatgccatcattgtaaatttgttttattttgtcctcaacttttttactaacggcatgaagtgcttcttccacaagcaagtactacatccgtttcaagttataagacgtcttgactttgtttaaagtcaaactgctttaagtttgactaaatttgtaggaaaaaacaataacattttcaactcaagacaaatttattatgaaaatatattcaattattgatttaataaaactactttgatattataaatattactatatttgtctataaacttagtcaaacttagagtagtttgactttgaccaaagtcaaaacgtcttgtaacctgaaacggaggggagtaacattcttcaaagtctgcagctctggaagccaaaggaagaaattcctggtacagatatacctaagagtagcatgcagcttgaggttttccactatctgtttcccatggatgttttccactatctgtttcccatggatatcttgaatagttccacattttgcttatcgagtccaacgcttcaatacatattttttctggcaacattcaaggcatgtctacacagttgacctattctctcaaacaatcgacaactccatgacacggtctgatcaaaagggttggcagtcaccttgtcaccttgtgctcatcttcaagtatgaactgatcatcaagtgagccaattgcaattatgaaatcattacttctatttgatccttttgtataggcagccatggatttctcatgtattggttggtataagaaattgagttgaatttaagcatgtgtccataaccatgaaggtatgatctaacaaggtctaacaaattgagttgggtggaccaaccgccaacgcattacattggagaatgcaataaaaaaaataacattgggtttggtggtttggcagagaaccttataatgatcttgtgagataactgttttgccaaaaaggaaattaggaaaatgatagacttggaaggacacaatgaaaaggaaatgaatcacaaggcaacagccaatttgtatattgactgttgcagctttactggaacgtttgcgacagttcaagaaaattgtccacgggacaaaccgaaaacaattccccaaaagaatttagtaagattatatacatgcatccatggaaatacactcaccttttttggacgggaagcagagaaagcattctcctcagaaacaaccgcattcaaactctcagacagcatcagagctctcgtctagggctatcttggttgcttacagctacatttctctaccccatggccaccattctgtttaaaccctaggtgaatcaacagcatagattcctaaacctagaaaataatttatggcctcggccgccacttcttcctcgctaaacgatctaatggattccaaatagacaaattcttcactgttatctctgaggttgattctcaatcggctcaaccggcctcctttgagggctcgagacgatgtgaccgtaaatgaactcgttccatgtgtctggcaacccaggtaggcaccagtggatgcagtccgcgaacttgcgggggttcgccttctgctccttcgtcaggagcttcccctgccgcagggtgttcaccgatgtgtgcgcgtccttgcggatctctgacaacgccgttatgttgatgaagtgcactggcaccctcttcatagccttcgttacgtgatgagctgtcgagaacagatcccagtccgtgcccacctccaatttctttgtgtaattgatagctggctgcgtctcagagaagcattttatggcatctggttttccccagccctcgctcctgtataaaagataaaagttatcatacaatccatgagcacacccagccattttcactagaagaatcgcacaagatatgacaacagaataacattaccactatctgaactttcaagctaacagcaccattttaatttcctagctatgtaaaggatttaactgtgtgttttttgtggatccctctgagaaatcaattgacacacggacacacgacccacacacacagaggagggaggacttactgcatatgcacaggtgagacactcatgaagaagactgtacttcttttcggatctacatgcttttctacccatctagaccatgtcttgggaccttccggtatgcagctacacgttccatttcatcgtatttcactggtttctttgaaaaggacccaccatgtctgcaatcaaggtgcatttacaagcttagtctagcaatatactacctccgttttttaatagatgacgccgttgactttttctcacatgtttgaccattcgtcttattcaaaaaatttacgtaattataatttattttgttatgagttgttttatcactcatagtactttaagtgtgattaatatcttatacatttgcataaaatttttgaataagacgaatggtcaaacatgtgagaaaaagtcaacagtgtcatctattaaaaaatggagggagtaggacataataatattccaggcaatcccaaagattttgtccagcatgtctcaatgtccacaaggataaaaaattaggttttagaagttactcacaaaattttcatctctggtgtattcatccaccaaatataagtgttgaaaatcaagtagtccaccccttcccaattcgctgcatgttttgcaattgatgttggcttgattatgcggtcaacgatgctatgcatgtttggatcatctgagtttgactcaactagaaaaggtgaccaatagaactcgatagtagcattgtactcctgaaatattccatataaatgttccaagttagaaatgtaagacattagccattattctttggtcggcaaaaatagaaatgtacaaagacatatagctttggaatctattagaatttttattaattatagtgatattttataaaaaccagttatagccatattgttagtaattgtctgtgactctgttttgtaaaccattaaactattccattatttgtcatgttagggaacagtgcagtagctaattacctcaaggcggaagacatttagagagtcattcttgacaagtgatttcttctcccagggagcctcagattggacaaggcacaccatggactcccattggttccgattcagcgaatcccccacaaacatcagtcgtttgttcctcagtttctccaggagcaacttagcgtcaaatctgggaattttttgtcaagccacaaaatcagtttttttttttaaaaaaaaacatgtaacaaaaactgcatagtatagattatagaatatggatttggttggatgtttttcttagaccaatacttagggctcattttgatcaagagagattaggcccaaaaaattgaatcaaaatccctgctcatcccatggaatttggtttagccttttcctatccaaccaagaacagttcaacattcatacacttgagtttcctaaccagaaaatactatatcaagatttcatgatttatcagcacataaaacttgtttgcaacttgaaaatacggtccagggtctcataaagactttacctgttagaattgtatgatagacatgcataaactctaatatatcccaatatagatatgttaaagttagttcaaacgctgtcatccagcaactactcaggtttcaaaccactcaggttcccctcctaacaactttctgtaacaaacagaacttctctatcaaccattgaattgattaatacatttgaagactacactgatcaataggtgcagtctcttttctcgttaattatagcacctaaccaattaaagtacaatatataccaatcttggttgcaaagaaacatagctcatgagtacaggtttcaatggatcaagcacaccagatctactttgtggtcataatgcagcgtgatgctgcacaaccacttgccttaatggaactttggactacaaacaacaattaggacaaaacccttgcaagaattagaaaaaaaaaatctccgcaactcctaatgttaaagtaaaacaaaaaaccatccttcttaatttgcaagtactaaccagctggtgtaaatgtaaaatacacaagttgctacgatgcaatgatcccctaagaactatagcaaattggcaatggcatcctagaataatatcgagcaacagtacaaacatgtcagaaacccctccccggagtagttagctgttaacagaatcaacatcaccatgctgctttcccccacttaaactagttcccggtccactattttatagcctaatcgtgcccaaaaccagtgacgggctgacggcacacatggaatgacatcaggcgagagagcaagtagtactgtagtatcaacgaccattgccattgtcgtgtacacccacatacgcaaattgcggcaccagcagcagcagccggagaccttcgagcttaccacccacgtcaacaaaaaattcggtagaacagacaaagcagcccaaaaaaaaacagagagagagagagagagagaagagacgacatgatctcatcgctcgcaatcgcatctgcggtcgaacacctcaccacgccacagaccacacatgatctccgcagcagccagccgcccacacgcagcacgcgtacacccgcgctttccagttcacgaaacgaaagcgcacgcccgccaaccccaattgtacgtacttggcgggcgtagatacgtacgtacacgtatacgtgtacggtatacatccgtagagcgagcggatatgcaggggaagggaatggtggggggggggggtggggggggagtagtacggcggcggcttacctggggaggtcgcagccgtcgggctgccaccgccatttctggtagtcgtcgtcgcggcggccgttgcgcatgcaggtgacctgctcggtgaggaactcgcaggcggactccttgtacagcggcgcgttcgcctcgtcgtacacccacctccccttgtacacgtcgcagctctcgccaccgtgatcccctcccacctgcgcctccgccgccgccgccgccgccgacgacgacgacggcgacggcggcggcgtctccgtcacctgctccagcagagacggcggggtctcggctgacgacgctccggagtccgcggccaccggctgctccggtggagcctcgccccgatccgtcgcctccaccgccgattcgaccccctgcgccggtggggagcgcacctcggccgcctccgcctccgcctcctcctgcggggagtggttgttcccgaaaccgtcagtacatggagagagaacagcgagga

SEQ ID NO: 65664 - DNA, 41432 bp, Oryza sativa
ctcaatcgggcattagtatggagcccgtcaccgatgagtcatctgtgacgggccctacggcaaagcccgattgagatagattaatctctatcggccgtaaactaaggcccgtcaccaatgactcattttccatctttcatttgttgtgggtgcaaaatatatagcagctgtgtaataattcattttattagtcataatacattttcggatagtaaaagatttcaaatggaaatatggtcaacaacaaagttgtagagcctttcaagatctactatttttattttggtcattattctatataatttttttcccaatagcttgaaattgatttcgacaatatgacaaatctaattaacagcatttgtaaatactaaatgatttcaaattgaaatatggtcaacaacaaagttgatcatctcatcaagatctacaacttttattttggtcatttgtaataaaacaaaattagccatattaatgactacatatatcaagtctttgcaataaaacaaaatactccattcattacaatagataagtataaatgcatcagtcataaggttatgccttcggtatgatctgaacgagcatatgccacagactcttggggatcatcgtcaaggtcaatgtgaggtcttacatgaagattatggttgtattcttcttcatcgacgacgttgtcaactcctacaatttggcgctttccatccctcacgatgtgcatcttcttgtttgaagggtcttttgtgtagaatatctgctcgacctgtttcgcaagtacaaatggttcatcggcgtatcccaccttagatagatctactaaagtgaaaccttccttgtcggctttgacactagtgcgtagattcacccaacggcagtggaacaaaggaaccttgaacttgacgtagtttagctcccagatctcctcaatgcggccgtagtatgtgtttgacccaacttgatcctggaatgcatctatacggacgccgctgttttgcactgtgcttttgtcatcttgtttgacggtgtaaaatgtgtatccatttatatcgtatccttgccatgtgtctatggtccaagacggtcccatccccaacaattgtactgtctcatttgggacatccgtggacattgtcacacgattcttgaaccattcgttgaaccgagaattatgttctctgttaatccatgcatcagatcgccccaagttctcatctcggattttcgctaagtgctcctcaaagtatgggacaacttctgccatatgttggagcacagcataatgagcctgcacgtacgacgcttgatcgggcctaattcttttccttccaattgtgccaacacctgacaaccttccctcgtgacgagacgctggaactccgataggatcggcatcggacatgtaattgacacagaactcaatagcctcctcggtcgtgtaacctttaatgatgctcccctcgggtttagctctgctacgaatgtacgactttagaactcccatgtacctttcaaacggccacatttcccttagaaaagccggaccacatagttttgtttgcttcaccagatgaacagagagatgaaccattatatcaaagaaagacagtgggaaaaacatctccaggtgacagagggtattcacaatatcggtctgcagcccatctagatcttcaggatctataaccttctgtccaattgcattgaagaaggcgcacagacgttggatcgtgtgacgcactttcggtggtagaatgcctctgatagcaactggcaagatttgtgtgattagcacgtggcaatcgtgagacttcattccaacaagttttagatcgtccaatttaacatacttacttatcctcgctgaatagcccgatggaactttaatatccttcaagcatgataacattgcgatcttctcatcctccgacagtgtgtggcaggctggagggaggtacactttacctatctctgcatctcgtttgggctggagttcgctgcgaatattcatgtcctgtagatcaaggcgcgcgttcaacccgtcctttgtcttcccgggaatattcaacatcaggccaaccaaactctcacacacattcttttctacatgcatgagatcaatgcaatgacggacatcaagatctttccagtaaggtagccgccaaaatatggatttttttcttccacatacccttctcctttgtcttgctacgttttcttttcttcccaaactcattgcttatgtccttgaccatattgtggacctcatctccggacaaatctttgggagcaggctgaagttctctcttaccattaaaaattttcttctttcttctaaatgtgtgacgtaccgggagcaacctccggtgacccatgtataccatctttcgtgatttcttcagccaccggtttcgtggatgttccttgcaatcggagcatgccttctttccttttatagtttgtccggaaagattaccgagtgcagggtagtcattaatggtgcagaacaatagaactcttagcttgaagttctcctgaccatatgcatcccaagtttccacactttctttccaaagaatctccagatcgtcgataacaggctccaggaatacatcgatatcattgccgggttgccttggaccttagattaacaagcacaacataatatatttctgtttaaagcataaccatagcgggaggttatagttcgcaataagaactggccaaatgctgtgagtactactcatgtcaccgaaaggattcatgccatccgtacaaagacatatcctcatgtttctagggtcggcagcaaagtctttgtgttttcgatctatattcctccattcaatcgaatccgctgggtgtctaagcataccatcattccttctttccgtggcgtgccaacgtactaacttcgcttcgttcgggttggcaaagattcttttgaaacgatcaatgataggtagataccacacaacctttgccggaccacccctctttgacttatttccttcgtcagcacttttctttcgcttgtatcgtgaaaccttgcagacaggacaagcatccaagtccgcatattgcttgtggtacaatatgcagtcgttgggacaagcgtgaattctacggacctctaaccccagtggacacagaacctgctttgcttcgtatgtcgtctcgggcaatgtgttctcaacaggatgcatagccttcaaaattcctaaaagatctgtgaaactcttgtctgtccatccactacttgcctttaccttcattaggttcaaggtaactgacaacttagtgtgttttgctttgcatccagcgtacaaaggcgtctcggaatcacttaccaacctgctgaatttcattccatctctctcattctgggctaggtcctcaacatcacgtaacatgtcttgcagcagatcgtgatccacatcaaccatttcaccgcccaatggagaaggtataaacatgtcatgctcattttcatcttcctgattatgcacacacttctgtctgctgctgctccacttcctgattcttgctctccatgcttcacccaacatgtatagccctccatgaatcctcgttgtatcagatgaccgtgtacgtcctctccgctatcaaacatattctcattcttgcaatctgcacatggacaacaaatgtaatcactgtttcttcttatccgatcctcctccgcggcgttcataaaatttattacgccctttcggtactccgtacaatgacgtttcaattttttggcatacatccaacttcgatcaattgctaaaaaaaacaaattagaggcacatattataagatcagtattgcaaaagtaagatgtgatgaaattgctcaattaatgatttatattactcacttgattgatccattttgatcacttttgggaatttaatttctgttttccttggaaaaaggacaaaaaatcgccccctacagcctcccaccaaaatagtgaacagtgggatacagttacactaggtggtggggggtatttatactgtgcaacaaatatctgtaacggccctaaaacaatcaaccatgacgggcatacaagtaatctctatcgggccttaataaaaggccgtcaaaaaagagtgtcatctgtgacgggcaataaacttatctcaatcgggcctctagttggagcccgtcacagatgaccctcatctgtgacgggcttcttttagggcccgattgagatatggtaccctcatctcaatcgggcctcaactatagcccgtcacagataagtgtcatccgtgatgggctttagttttatgccgatataccatggctgtgcgaccatatctcaatcgggcgaaacttcggcccgattgaaattacttccttgtgacggcccgcaaattccagtcttgttatgggccgtcacagatggaaggatctgtactagtgtaaggtagcccaagtggcgaatccaggataaaaattgaggataggctggactagaagtctaaatttaagttgataatgctaaaataaggcacatgccattatcaattcaaatgtaacacttacatgatttaatagaaaaatatacttataaaagaataccttgagtccttgacttaagatgctaattttcttgggccttagcaaagagtaaagtgagcagccacctgaatatataaatgagcaaaattagtattgcataaatggtagaagtaaacaaatgctaactaaaagaagcaacataccacataccactaagctgttacaatttattcacgaggaaaggatattttgggggttttcaaggcttggaatcgcttcatgattgcattatcatcaatacttttgaatatctctcgctcagtatagcataccatcaaatcattaagccaatcgtctgatatcttattggcaatcgcacgccgtcgacggctcgacgccaaaaaaaacggaaaaagtacaccgaaggtccctcaacttatcatcgagttacaaaatcattcctcaactgcaaaaccagatatccggtgccccttaactaatcaaaaccggtcacaataggtctttcggcggttttgaccctggttttattctatgtggcggctgagtcagcgtgggaccaacatgggacccatatgtctggctaccacctcagcctcctctctctctctcttcccctcttctctcccttcctcatctctctctcccttctttgactcagccggtgagaggacgagggcatcggcggccggccacgggcgatgcagcggtggtgaggggaggagctgtgggcgggcggtgggagaggggcagcgcacaggtgggcggtggaagcggggacgtccacctcagtggtagcggccgcatgctcatttcggcggtggcatggaggtccctggcgacgacgaattccgacttcgccgcagggctctcgctgacgctcgctgcgtctctcggagacgcagctcggcgagctccatgtcttgccgtgctcgtgccttctcggcttgcgccttctccaagcttcgtcttagctcatcaagaaggcgcattggtgccgcctaggtccttcaccgcatgtgccttgccggcctccgcttcttctgatctcttgtggcactcggtggcctcatcctgcaccaggtcaagctcaccctgcacttgtttgtgcctctgcacgcagcagtcgacactagaaacgggcaaatcacaagaaaatcaaaatgctaatcactgtctaagcttaaccacaagacaagatcagtagcaatggagatcgatgtaatttacttctctccaatcaacagttcatccgaacttggtaacggcgcccttgacggaatcgatgggcgcagtacggtgtcgatgttcttttgatttcttgttaaatatgtgatccgaattttgggcccacaatatattcggattagtttcctagtagcactttatgtctatcctattaggtgtctttcttttatcccctatatatactcttgtaagccgtacaggaaggggtgacgttcccattgttattcccctacgtttgtaatcaactcctctataatgatgattgccagtcggcgcccgtggttttttcccgtaagggttttccacgtaaaatttgtgtctccgttgtgcatcgatttttataacatctctgaacgaagcgattgtcgatctccgacgccgtcgccgggggccgaccgcctataggcggccacacgcggccatggccgaagcaccacgttcaggtactccaagaactcaccctccatctcatcaaacgaattcgccacggcgccccaagcttaggaattgagcaggaagctttcccgcatgagctcctactgtggatcgcatgagtccgtggtgccgccgccgcgttattccggagggaaatactatgtaaccgcgtccgtgtcgccaccggccgccggacctcctcccacctcgctccagtgaccttctccccacccgccagccggattgcccggagaagagaaaaagttagagagagagagaggaggaaggaaggggagggggaaaagagagggtgctgaatcctaacatgtggggctcacgtgggtcccacgctgactcagctgccacgtcggataaaaccggggtcaaaaccatttaaggacattaagtgaacggttttgtaagttgagagatgtcatatatatggttttatggttagggacgattttgtaactcgatgacaagttgagggaccttcggtgtactttttccacaaaaaaaaatccccacagggcaaagccaaggccagcagccacgcccacgcagcctccagactccaaaaccctaagtcaatggataaaatagacaaatgggccaagtgggcttttgctaaagtgataaatgggccattttatgcatactgcgtaccggttcagctacctccatcgctcctgatcttcttcctcgcgccaacagagacagttcttcacctcttctcttctccaagccttctccagctactcccatgggatagatgctatataattaattttttttttgcaaaaatcagatggtaggctcgagcctgatgaagcctacctcttggatccgtcctgcatgaagggtgaaggctggttgaagcgcgtgaaacgaggtgttgaggcggagcaactgcggccttacatgctaccggtggggagggttaacctggtggcctttgccagatatggctaccacatcatcggctagagcattgcttggtgcctcgtcgccgcccccacaactagtgctgcatcgtcaccactacctcctcgacacccctagttggcgtcgcctcgtcttgccttcccgtcgctgccacaggccgcagccgacgccctcagcccacctcctcgccgccatggctgctgtcaagcttacggataaggcatgcctcctatcctacgactcatcgaatatacgccctcagcccacctcctcgccgccatggctgctgtcaagcttacggataaggcatgcctcctatcctacgactcatcgaatatacatatacggtataccttcgcgcattcggttcgttcacgtatacattaagaaagtttatctctaattatggaaaatatctccacgagtcaagtgatttccaaagttctacttggagaggataaggtttatgttatatcgtaccagatccgatgtctcgaggtttgacttagagattaagatgatccacgctataaaaggaacccctaggcgtgggtggaagagatcgaccaaaaccgccaacacacccatcatagtttacgaagccggagtactcggagccaagtggccgtgagatctcgttgatccccatcgattacaatctcgtcggaatcgtcagtttcgtctacttctttgtaatatgtggtattttcatataatcccatactaactggactagggctattacccatcgaggggcctgaaccagtataatctgtctcttttgcttgtttgatgtcatacaacgcaaatccctgttccaacgtaccccaatactcaaatcatccggtccatgagtattactcgtcgacagtgacgcgccaggtagggagggcttggtgcttaaggatctgccaatacaacttcaaaccatcctgacggcagtaccaacaccggcgtcaaccaaggagtttcagcctcgacaccgctggtctggactcatgtcggaaccattgtctttccaatctacaccgctacaccaccacatggcgccacctccgccattcacctcgtcatcaccaccgtgatgccttgatggaggagagactgagtgcaggggagagagaggggaggagggagagaggagaccacagagagagcagggggaagagagaaggtaggagtaggagagttagaatgataggttgggccactttcatttttgtcacgtacgtaagagtctagtcaacatgagtggactaggtcaaattgccatatcagtaaaactaaccttccatactattagaggacttaatttgaactgtttttgtaagttgggggtattgcggtttagggatgcaaattaaattcgagataaaaattacagccggaaagtggacttattcctcgtaacatgcatgcgtccggaatgcaggccggccttctctgatgggttaatctaaactaaactttcaactctccccaggtaattatgaacatgaaagttcttatatttgagtttgaaaattttacaattttagttgaaaattattcgatttgacagttcaataattcgtgtagagagttgtccgagaaatacaaaattttatggataattaccttaattaccatttcgaggagaaaatctgttcaaattgatttgccgaaaactgagaaaaaccagtggaaaccaaacgacatttatagggataccaactaaaacggctcggttttataaggaataagttcatctgaggtcccttaacttgtcaacgaatccgattttcgtccctcaactgaaaaaccatacacaatgagtccctcaactatcataaccggtacagatgaggtccctcggtggttttgatgacggttttggttaacgtgacatctacatggctaatttgactcggttttcatctgacgcgacgcttatgtggcaattcgatccagaaaaataataaaacccgtgggacccgcatgtcagtttcacacacgaaataataaaaaaaatcgtaggacctgcgtgagccccacatgtcatcctcactcctccctcctctctctattctctctctcccctcctctctatccgttctctctctccgaccgatggagcagggcgagcggcggctggcaaaagcgggcgacaggcgggacggagcggctggccggtggagcagggcggggctgcatcgggcgtcgcgacggacctcgccgcggggccggggctagccgccgccgccgccggcaatccgaatgacgatgggggagatggaggccgccatcgccgccctccccgcgaagaaggaggcgctgcaggagaatggctggccgcagggaatcctccagttcacccacggcgctgcttctgcttctgctgttgctgtttctgcatcatcttgccctgttaaaaagacacagtgcccttgttctttcgcaattgcaactagcatctccttctctacttctactcacttcacacctcagctcagctcatctcctgtcatctcagctcagctcagctcagagagagagagagagagctgcaggtgtgagctgatcaccaggaagcagaggcttttttcagattacagttatatatctgaaacaaccagattcagaatcaatcagcaaaggtagatggagtttcttgtttcttttgtactactacatgactatatccatatctctttttcttctacttcttgtcttttgtttggttttgtgtgttgttgctgtgtgtttcaacaagtcaactggatagatagattcatagatattatagtttttatctgaggttggaggtttcccctctcacccaccacacattttggcaccccaatcctgaatttactgttcagttctcttcttcttctttatcgattgatcgtccatgcatgcatactggtatatagtgctagtgctcaagtgatcatccttcctgatggtgaatctcttttgagaaaagaaaagaagaatatctctcttatcttggctttttcctgatgatctgagcactgcaatggccacgtcgtcatgcagacaggcgccgcggaagccaccgaggccggaaaggacgacgatgatggcgatggcgatggcggaggatgggtcggcgtcgtggtttcagtactcagaggagatgctcctgccgatgccgccgacgcccttctgcacaacgccggcagtcgccgccgtctgcgctctatggccccgcgtgccgcggacctgacctagcccgctgtcccgcgtgtcgatacccgggggggggccggactcaagggattcattctttttcgcactaatggaggacatgaattctgggcaaattatctatgttacagtctattaaaaaaaggacttctaataagaaattcttctgctaaagaataggctcgcctataaatagaagcttcggcgcactctatattttgcgggacaagaaagaaagagtcaaagccatggatatcgctgcaagactatcagcgattcctcaagaaatcgctgatatagaaaacactaagctcgaactagagcaaatgctgggtgtcctcggggagcctttatttctggctttcgtcgatccagcagtgatcatacaagatgatatagttcttgttcagaaccaaatccgcattcttgaaaacaggaagaaggcgctgctggaagaacagcaatcgctcatcgtgatggctgcccaccacggtgactaaaatagaaaaaggtagttactcgtctatctcaacgtaaatgaacgaagtcacttaaggcttcctactactactgctccttcttacttattttccttaaatcataatatctgactatcaatacttgtatataatgaaataaaacatggtgtccaacttagtggtaaggattattactaattatttccactagtgttggtgaaatatgtatatacaggtattttgagaagaaaacacatccgtcgagcgacaaactgcacctctgtgcattcaggatacatttacacgtattggaggccccataagtcaattaaaaaactgcaaatgggcccaaccatcatgccaatgggctgagggtctcaaaattagtgtccaggaggaaaaacaggtccaacggagccctcctgggttcggccgaaccacttatgaggctgttgatcgcgagattcgacgtggacggccctgattacttcctgatggtggttccggggtagcttggttatttcgcataggctgtaacagtcatacctgcctataaaaggaggagcctactctcatttccaacacacaactttgagctgaattacaagagactctattgtatcttttgttcattagaataaggtagagagtgaggggaagctctcgaggagtgcccggaagtttggcgctcatccgacttctacctcgatgagtgtagcttcttaggaggaattccggaggagtaccggagctgtcggtacactctgctccaggttcggagaacttcttctataaagtaagtattcgtgttcctttcttatgttatttaattactttgtctaagtaaaataagatttccatctctgcgggttcattgtttagtatttgtactaagtgctctagtactaggactctggatagagaaggaagttcctgcgcaagtattagagtagtaattaataacttagacgtggtgtctaggttagagattaccttcccacggatttgtcagagataggcggcaggtggtgacagccttaaattccgtcccagtaatcctccatattcggatacatcataaagctatagccggaaccacgctggcagaccagcaggggtcggtgcccgaagcaacagatagaaaattacctttgcttagcttatataattaacactcatagaaagtcctctctagcctacctaccatcagttgttgtccttggatagccttagccttaggtagattatacgcgttccctgagttcgatatccttttggggtcacccgaaggttaagtgctacagtggtattccgtgctcttgcggatttatctgtggacgtaagaaataccaacacccgccgtcggccgctgcccgcccagctcctccccgcgcgacgcccgcttctgccgaccgccgctcgcccctctccatcagccggagagagagaagggatagggagaagaggggagagagaggatcacatgtggagcctacgtgggtcccaccattttttattattttatgtgtggagctgacatgtgggtcccatgggttttattatttttccagattaaattgccacgtaggcgctacatcagtgccacgtcagatgaagaccaagtcaaattagccacgtaggcgccacgtcagctaaaaccgccctcaaaactgccaagggatcttatctgcaccggttttgatagttaagggaccgttgtgtttggttttccagctgagggacggaaatcggattcgtcgacaagttaagagatctcagatgagcttattcgttttttataaaccgatcagtagggtgaacctgtttaacacacaggccgtgaacctggcccaaatccggactctcggcctatccacgtgagtgggtcgcgggattcaggcccttcaaaagaacagatgcctccgttgtagaaaaaatgaaagaaaataagaaaggaagaaacaaagatggtatatatccatttgatcgatggctacgtgtagaaaaaactcgcgtgttaataagaaaaggcatgcaagtccaacctaacacttctcaatccaactatggaataaaactagacttggactagtataaattttccttgctacactagtcaagagtagaaggcgaggccatccacatcatctatggataaattcagctgctccctctgcccgtagtacaagaattttgtctttgcactaatttatcataaaatataaaatgtaaaggctagatttttgtggtcctgggactttatatactattactatagtttctttttcacctatcaaattaagtattattattttgcccactgtagtatttttttaccatgacttatcgttctgttacattgttaatttttttttcaaaaatggtataatcaacataggaaggagtagctaggccattacccacaaggcaaaatactccgaggatgaagtattagttccttgtacaatggtttgtttaaaaccaaagctgagtgatgtatacagattgattttttccgtttggctaaaatcaatttttgcatgtggacgtgccagatccgctccaccattgcccaggccagatccgctccgctaccgctggatccgcatgcatgaggggcggagcagtggccacatccggcctggagggagaggggggaaccagatccgctggtgccacgtctcccgcccgccgcattcccgctcggcggtggaggaggagcctcccgccagccagcacaagtctctcttgcctcgctcccgcccgactgtgcaagaggagaagccgaggagcatcctgctgctcctgccaccatcactcccacccagcggtggagtaggaagtgggagaggaggagagaaaaatgagtgggggagggagtaaggagataaggtgagagggtgtggaaaaatgaaaagaagagagaggagaagaggtgaaaaaaatttgaagtggctaagtgggaaaagagaggaggggagaaaaaaaattttggacgagaggaagtttttttttcttgcggatcacttaagacgcccgcatgcaaaaataggctcatttttgcatgtggccccttaataggtccaccaacgaaaatatatttttgcatacgagcctcttgagaagctgcatgcgaaaatagaggttgatttttgcagaagcaaccaattatgatctgcctacaacctataggggtcctcgtacattaaaattgtttttgtattaatggaaattagcacaaaacaaatacattaaaatcgttcttgtattaatggaaaatcgtttttcgtttttgtattaacgaaaaatccctagcaccagccacaaatatactggtaaggcttgtgagcgaacattcccccatcgataatctcgcgaatggatctatatatacgaggatgattacaggacgcgccatgaagtagtattgttctattcccaattttccatttcttttcacatgatcctcctatacatatcaagcttttttgttttttccgcttccttttttcatatttatttctttcgttagtcttttttatagttttattaatggaatttttaatatgaattattttttatagttttattaatggaatttttaatatgaattatttttttatagttttattaatggaatttttaatacaaattatttttgtggatacttagaatttagcaagaaaaaaactttaaattaccaacgaaaaatccttagcaccagcaacaaatacatcggtagggcttgtgagtgaactttcacccaccgataatctcgcaaacggatctatacgaggatgattagaggatgaaccatgaagtggtattgttctattcccagttttccatttcttttcacgtgatcctcctatacatataaaccttttttgttttttccacttcctttttttcatatttctttcttttgttagtcttttttatagttctattaatggaattttttaatatgaattatttttgtggagactttcttcatacattaactttatatatgcgaagcccaaaatatagactttacatatatagagtttctatatagattttatgtatatgaactttcaatatatagactttatatataaaatgtttctatatagacttcatgtccataataaaatttatatttgcaattagaaagtttagtgcataaactttaatagatattaaaaatgctgatcatgcagcacccaatattttttttgaaaaaaagaatccaattgaacgaatctagtaaagtaaaatttgtgtggcagcatggatttggtttataactgaagaaacaaaaaaagtaatcacataattaggcatgaagagatgttatgccatgctagacccaccccaaatacatagcatactcaaaccccactaccatgatatgttttatttcgttgcctgtcacgtggcgtgctgcgactcgacttttttactcatgataatgtaacttttgtggggctaacaacaaatcagtcgaccaataaaaacaatatgatatcgggcgctcgctctttgtacagcttctttcttcttgatttttcctcctctgctgcatgcatgctaatacaacaactttctttttcgtatttcttcatgcatgtgtaactcaacatgtttcttctttttctaatataaacctttctcaaactttaaactatttttaatggtaaattaatgattcaatctgtgacccaattacaccattgtgttctttgatattaaatcgtacaacaagctctcacatgactatatattgaataatatatataccatatttctaattgaaacatttttatattatacttgaaacatttaatatataattattgaaacatcataaaatatttactgaaacatataacaccattacgtgtaacattttaaaatgctctagtgaaatatcataatatatttatttaaacatctaaatacacatgatgtgaaacattagccaaataactattgcaacataaaaaacttaaaaaatatgcaattaacatagtcagtttctaggtgaaacattgacttcaactatcgaaacatgtatattttttcatcgaaatatatttgagtgatatcttattgtaaatatttaattgtgacaaaaataacggtataatcgaataatcgattggataagtaacatatgagataaaatcattttacgaaaacatagggcatccaatgtgaacataacaagggtcataaggttgagttggcagcttgtgactagccttaggttgtgttcggcagcctatgttcccaatacctctcccgcatattctacgcgcgcgcttttcaaacggctaaacagtgtattttttataaaaagtttctatacaagaattgcttaaaaaatcatattgctccatttttgagaaaaaatagctaatacttaattaatcacaagctaatggaccactccgttttctatgcgtaggagatttgttcccatattctccaaatgatctcagccttaaatattgtggaacgtaacaataggccattaaatgctaaagttgaccgtaagcttatggcttggtcacaagagaaaaaaaaaagaataaaagtactgcacaaaggagggagtcaattcattccttgagtaatactacctccgtcctaaaatagttgtcgttttgagttttttttttataatttgtggtcattcgtcttattaaaaaaatatgaaattattatttattttatttgtgacttgctttattatcataagtactttgagtgtaacttattattttttatatttgcattaatttttcatacatgaagaatggccaaacattataagaaaaaagtcaaagtgatcactaattagggatggaggtagtagaagacttcaaagaagcactgtattttgactaagtgggacccatcttatttcctcccataggttttaaccattgtggagtttgttatagctagttctttttcactgagcccgaccgttatattactacccattgttacatgtacattgagaatgcccttacacccaccaataaggttgtctatttgctttgctactccgtagcagtagtactctacagactcattatgcaagcacgcgagcattctggtctccgaattttggtgtcgacctcaggcgaccggacagaagtaatctccaacttttgttggaaattaataattatgtgggacccaactgagaactgtctaactgcgatcaaaatcatcgtggcagtaagtcaagatgcctggttaactaattagggcgtatgaacaagtcatcgtggcagtgcaactgcactgcaaccacgtacggtagcaccattccatggctgtcctcctaaacccttcgtcttcctcaagcagcaaagcaacgccgcggccgccgcagcagcagcagctactactactcttgctccacttgctgctcgttgccgtccccgccacctctctcaccttcagctatgacgcggactccttcgtctccgaagatttcaggcaggaggacgacgccatggtcaccgccggccggatcgagctgctcggtgaggagttcgcggcgcgggccaggggacgcgcgctgtacaagcggccggtgcagctctgggacggcgccaccggcgaggaggccagcttcgccgcgagcttcaacttcaccatccggtcggtggctggcaggggcaacgccctcgccggccacggcatgacgttcttcctcgcgccgttcatgcccgacatgccgcaggagtgctacgagggatgcctcggcctcttcgaccagagcttgacgaggaacacggcgagcgccaccatgggcaacgcctcaggcgccgccagcttcgtcgccgtcgagttcgacacgcacatggacgggtgggacccgagcggccggcacgtcggcgtcgacatcaacaacgtcgactcgcgccgcgggaactacgtggtcttgccggaggacagcctcgtcgacgccggcgtgatgtccgccacggtgtcctacgacagcggcgcgaggcggctcgacgtcgccctcgccatcggcggcggcgccgcaaccgcaacgtacaacctctccgcggccgtccacctgcgaagcgtgctgccggagcaggtcgccgtaggcttctcggcggccaccggcgaccagttcgccagcaaccacaccgtgctctccttcaccttcagctcgacgctgccgacgaggacgaccaacccgccgccgccatccacctcgtcagccaagacggctcatctcagcgccgccgtggccgcagccggcatagcactgttactcctcgtcctcgccatcaccatcctcattcgccgagcgaggaaacgccgccgacgcgacgacggcgtctcctacgacgactccctcgacgacgacgacgaggaggacatggagtcgggcacggggccacggcgaatcccgtacgcgcagctggcggcggcgacgggcgggttcgcggagatcggcaagctcggggagggtgggtcggggtctgtgtacggcgggcacgtgagggagctcgggcgggacgtggcgatcaaggtgttcacccggggggcgtccatggaagggaggaaggagtacaggtcggaggtgacggtgatcagccggctgcggcaccggaacctggtgcagctgatggggtggtgccatggccgccgccggctgctgctggtgtacgagctggtgcgcaacggcagcctcgacggccacctctacagcaacaaggagaccttgacctggccgctcaggtacgtacgtatgtgcccatgttaccatcgatcaggcgtgttcctaccttgacgaagtggcttttgtggggcccacatcttggccgcatttacgatagcgctgcctgtagattccatcaacagggcaatttggctggactgatgaaaatacattaaccatggatggtgacgtgtccccgagtcccggcgtccgggtgcatgaattatgagtagatgattgctccagtccggcggattgtaccggtaggtaatagtatcggaaggtacaaaatcaaatctagtcgtctaaattgggaaccggaaaagagaatagggaagggtattgaacatttgaagtcactcaaattatagtaatcagtaaatgacagaggagagctgctggatgggagtaaatctcttatgattaacaaggaagggagcccgcccatttacgtgggcatgtatcgtagattgtatttcaaaacactataaggatggaatataaatcagaaaacattttcaaaatataaactgaaaataaagcccgcagagatacactgacatcttatttgttgttcaagaaaaagaatggtaaaataaatcatacatcactatatatatatatatatatatatatatatatatatatatatatatatatatatatatatatatactgtaagggaatgtaaattttcttacaataaaaaagaaatatatttaccgtaaaatagatggtatattttaatatactactaaatatgataagaataagaatacatctcatatttaaataaaaatcattttgtcgtggtcatatataaactcctctattgttattgttttaaaagctatgtgcatttttaataaatgaaactgtattagtaccactaaaataaattatatattattaatacactaaaaaataatctacactacttaactcgatgttcatcacttatttccacatcatcgactgtatctaccaaagctttcttatataatgccctgaaacattggttccacatcgacgtagccgtgaccctaaagaccagcctatggcaccattttaacacttagttcactatgagcacacccacaaaggattgcattagtaagaatgtcactttagatacattgcctatagtgatcttttactgacgccaccttaactcaaccatatgtatatgcctgtaatatttacgatggcatagtaaacactagacgctgcattgaaggacatggagggacaaaaaggaggaggtgatgaaaatagttataatttttgccccctacttatttttgtatagtattatttttaacaaaatcatagttgaaaggctattgacaacaataagtgccggtgtttatgatttttgttgattagtatttctttccgattttactattaatatattgatatattttttgatttatcgtttttctccgtagtatatgaggtagataattaagttttgtcttttcactggtggagaaaccatctttggtcggtcggcccaattccgtagtatatgaggtagattgatttttagtcccggttatttgaaccgggactaaagatagcgatctttagtcccggattcgtagtcccggttggaaaaccgggactacagggggttatgaaccgggactagaaagcatttctccaccagtgttttctggaaagtgagacgattataaatataggtagtttggttttccatctaataagtgagaaagaaaaaagaaaaaaaaaggaatgatgtgggcccagtgtacgtatcaaagtatggacgtacttgttgtttttgggaatacctatacgtgcacgtactatgcgagtttttgagataaatttaattatattttttataatagatctaatggctagaaataatgggcctatcggattttaaaattttttaaagcgccacatagcgacttaggagtgtttttaggagtgctatgtggcggcttagaagagtttgtaggaagtttaatgaacttttagtatataatagatagatgttgatgattcttgtcctacgagaaccataaactactccatcttagattataattcgttttgaatttgatcaaaatcattttactctaaatttaattaagtttataaacaatataataagacaccaaattattttcattaaatctataattgaatatatttttttaatatatttgtcttatgttaaaaatgttactatttttttataaatttggttaaacttagagtagtttaactttgatcaaaactccttataatttgaaaggtgggagtaattactactgcctctatggctctatcccaattaatcataccctaaaatttgtacgtcttagtttctaaatcgatcattatctaactgttatctatttgcttattcgtgtagaagtaaataacattgttctatatatgttcgtttaggtgtgcagtagtaaatgacatcgttgtatatatgttcgttcatctgtgtatgagtaaatgacatcgttgcatacctcacattaattcaactacacgttttcatatccacatacatgcctagtacaacatcatgaccgatgaggtttacttctaaaaggagtgatattttttgcgttgatctcggtaacatttgcaaatatgatagatcaaattggaaaggacggggaaaaatgagtagtactctgatcgaaagttcgattttatcttcgcataacagttagtaataaggtgatgtattatacaaattaccacatcacatttatattcgtactatcgtaatagttaggagttaatttggagtttttctctaaaaagaatgctataaattcacaataactcatatgatctaaaaaaatccgaaattaagcgcggtattgcacgtaaactcatatgtaaattctctgtgaaaatcaaatatactttccctgtatctgtgtatcatattatgtgactaatttttgtcaggtaccagattattaatggactagcctccgcggtgctgtacctccaccaggaatgggatcagtgcgtcgtccatggcgacatcaagcccagcaacatcatgctcgacgaatccttcaacgccaagctcggcgacttcggcctcgcgcgcctcatcgaccacggcatgagcctccagaccatgaccgccgttgccggcacgccgggctacctcgacccggagtgcgtcatcaccggcaaggcctccaccgagtccgacatgtacagcttcggcatcgtcctgctcgaggtggcaagcgggaggcgaccaatggtagtgacacctcgtgcagccgctgccaccgcgggtggtgggaaggacgacgacgacggcggcggacaggtgttccgcctggtggagtgggcgtgggagctctacggccggggtgatgatgatcagtcgtcgctcgacgccatcgccgacacacggctcggcggcgcgttcgaccggtgggagatggagcgtgtggtgggcgtcgggctgtggtgcgcgcaccccgacccgaaggcgcggccggcgatcaggcaggcggcggaggcgttgcagtcgaggaagttcaggatgccggtgctgccgccgaggatgccggtggcagtgtacctgcagccgttcgcggcttccaccatgaagtactacggcgacagcatgacctccgttgggtcggaggttgttggttactcgtcgaccagccttgcgacggcgacgctgtcgtccagctctagcttgccatcggccatggctaacaatgacagcttgagcccaagagaatgagggttttggttatattagaagttggtcagttggtactgccgtactggtagatggcacatggtagataaaggatatactcccatgttgcaataactcattccaatctgcttgtaatatttgaatgaactggtgtccttctgctccactagtggtgaaatacccaaggcaaaatttgctacaagacacctaaagtttgtggcatttgctgtgagacatccaaagaacgtgtattttctcgtggacaccgtaaaaatgtggtaattagctgctggatatctgcctcattattttattatcccttttattattttcggtggaaatggagagagaaagagcattgaaagtaccaaaacacccctgacactgtttttcttccagcttctgttcttctttcttctcctctcacactgccatgccacagcagaccaacggctccatctggcaagggcaagcacgatggcatccaggtacatgctagccccgtgtagcagatgtccccgttggcctcgttctggaacgtatgtattgacacctgcagcagcagcaatgccaagccgagccgtgtgcaaactggaaaacggcgttgattcgataccccttagcgagtgcgagcagcaccagcaggagcaggaagggccccaaggggagtaggtatgcagtatgcccctgatttcgctcgcactactgctccttgcgaggtcaaggacggagaggaagaacagaagaggggatctcaaaagggaaaaaaaatgaaaaaatgagccatccctgtcgatccacccgtggcggaaatggcggacggggcatgcgtcccgcgcaaggatttggccgacggcggcggtgcccacttcgccgctaccccatccgaagcggagccctggggaggactcctagcagcggcgcgccgccccgtgctccagcccagccagtcccgcaccgccccgtgctccagcccagccagctccgcgccgccctgtgctctagttgctgctgcagcggcggcgcccacttcgccgttgccccatccgaagccgcaggaggaagaagatgaacagagaaagagggattgacaagtgggctcatggacaaatctgtctttaaccaatgtctctctccgtttctatcgaaaataataaaataatgagacgagtgtctagcagctaattaccacatttttacagtgtccacgagagaatacacgttctttgggtgtcttacagcaaacgccacaaactttgagtgtcctgtagcaaattttgccaatacccaatgttaacaccaaaatttagtatggctttttagtgaattcaattaaggaaagaggtcgattcatgtatgaaagtttaccaagatcaaactgacttcaaagaaaaaccgtgaagacagcgactaggcggtttcatatttttaagtatatccttaaatagactggatttgttattttcctttggtcttattttagagagccacatgggagtttaatagcgtttgtaggatgttaatggacttttagttttttaaatatataataggtagatagattaacacagtaaaaaattaattggactaattgtaacaatgaattatatagctaatttttcaaagaaagtcaactcttctactatataggtacatcagtatatttgctttacaagtaggcccatccttggtcatgcagttaattttctcggcgctgcattttgttctttttttagtatttcgtttgttgctactcctaacttccatgtttgagggaatacactggaattttccagaacatttttttactgctttttacccaccaaatccaacggttttgccatctcctttttctctatccaatggtgattacgtggaacaatctggtgaagtttcaagatttaggacccatttgaatcaaaggatttatataaaaattttataggattcaaatttcatacaaaatttttctatttcgtcctttgattcaaacgattgaaacttttcaaatcctatgaaattcctatggaatgacacatagcatatagattttggaggaaacttagcaagaggtccaacctcttggaaaatttcctttgaatctatctctctcatatgatttctgtgtttttaccgcggtccaatcaaacgatcatttttgtatttttcctatgttttgcaatcctctgttttacacttcaattcctattagaatcctgtgttttttctattcctccaatcttttcaactctgcgattcaaaggggtccttaccgttcacttttatagataaatatatagatatatactccctctgtcccaaaaaatgccaacttctggctatgtattcggatatagcctatatcgtagatacacagctagaggttgattctttttgggacataggaagtatgtaacatcttttgagaagtaaaagtgtaaaaacatgtaaagtgggcatccctttgaggccttgttaggttggcccgggtttggccgggattgggctgcaatccccgtggattggatagacgcggattgaaacccggcccacagaaaagtttgcattcggttaatcccgtcgcggattgaatcgaggccgatccggcctttccccctcgtcctaggttgggaaagaaacagctacccatatggagtggaaaaaaaccctcgcgcacaggagaagagcagcgcgcagggaaagcggtggcggtggagcggacggttaacgaactcgcacaggaaaagcaatccagaacgaacgcacggattagagcacgaaggaattggcaactctattactgagatatttctccgattccgacatgaatggagccaccgccgcctatgccaccatggtcgccaaagacagagttcacctcgtgttctctctctcttatcttcctcacctactcagttcttccccctctcgcacgaagaactattacaggaattagacttaattacttggcctagttaggcccatagtacttctggtttatcttgacgggccttgttgcacggcgcaccacttctccttcagctgcttcaagttcatcttccctccttccggaatcagcatcatctccagcgtctttagcaactgacttagcgccctcggacagtggttgctccttgacaatcccctccccttgaaatttggcttgtccccaagccaaagcagtaggaaatcgagtgcgtaagtcctccatgttttcccaagtggcatcctcggctgcagaatcagaccagcggatcagcacttgaagaacagcatcggtagccctcttgaccaccctgctatcaagaatctgagaaggaacttgcagagcagagttagctttaggcaactgaagtgatgaaagctctttataacccttagccgcccttaactgagatacatgaaagacaggatgcacactggcagttgcaggaagctgaagtttatatgctactgtgccaattttccgtaacacctaaaagggaccaaaaaacttgaaggccaatttatgattagctcggagtgccactgaggattgccgataaggttgaagtttcaggtatacccaatctccaactgcaaaagatctgaaacttctcttcttgtcagccatatgcttcatttgctgatttgctctatgtaaatgctgttgcaccaatgcttgcatcagtttcctctcctttagccattcttgcaaatcaggaatttcacaagtgtccacattgattccaaaatgcctaggagagtgcccatataggacttcaaatggggaagtctttaaagaggaatggtaagaagtattgtaccaatattcagccaagtgcaaccatgtgacccatttagaaggattggcatgagcaaaacaccgcagataaatctcaaggcactggtttactcgttccgtctgtcgatcagactggggatggtaagaagtgctcagattaagttttgttccagaagcagagaaaagataagtccatagctggctagtaaaaattttgtcacgatctgatataatcaccaatggtagaccatgcaacttataaatattcaacatgaacaccttggctacttcaagagcagtgaaagggtgggccaaaggcaagaaatgtgcatatttagaaaatttatccaccacaaccattatgcagttataagatctttgacttaggcaaaccttcaataaagtccatgatgatgacttcccaagatccatcaggaacaggtaatggttgtagaagccctgggtacttagatctgtcaggttttgcttgcagacaagtttgacattgctgtacaaaatcctttacttgagatttcataccctgccaagcaaacagtttcttgatcttactgtaagtgactggaaaaccagagtgtccccccattggactagcatggaactcagcaatcaattgtgactagagagaaggatgattaccaatccaaatgcgccccttgtacttaataattccagactgcaactgaaatccaggtttgcagtcaagctgaacagacaaggctgaaagcagatcagaagaatagggatcatgttcataccccttagcaacctcttgcaaccaactgggaacacaactagagatgatggacaactcagaatcactttgaaactttcttgatagagcatctgcagcagcattgctggtccctttacgatagcaaattttatagtttaagcccaataacttggtgaaagccttgtgctgccatggggtatgtaaacgctgatcagataagtgcatcaagctatggtgatcagttagaattataaattccccaagttgcaagtatgacctccagtgatcaactgctaacaagatagccatacattccttctcataagttgatagcctgtcacaccctaaaaattcaaaatatataaattgttgtttaaatggaatttttagaaattattttaaaagcctagaaaagaagatctaattttaattaataaattccaatataaagtggggccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaaacccctctctctctctcctcggcccagccggcccagtccgcagccgcagccgcccgcgcgagcgcgctgtcgctgacaggtgggtcccacctgtcgggatcgtcgtcttcctccggccgaaaccctagcgcgtcgccgccgctttccaattcggccgatcctttccttctccggccgaatcaatagaagggaaatgatcttcgagatctcctctaccttttctcctttggaaacatcggctaaatcgtttggaaattcgtggattcgagtttgtttcggattcgattttcccgaactttccttctcgtcgccggccgacgtgggccttcgccgttgcctcctagcccctttaaaaggctccccggtgtctcctctacccgccgccacctttgccttcgcctctcgtcgtcggaaacgccctagcgccgtgtgccctagcgccgccgtcgccgccgtcgctccagccgtgcgccgccgccgttccagccgtcgccgtcgctcgggaagaccgccgtcgtggtcgccaagtcgccgccgtcctcgtccactccttcgccgccgccgaagaccgccggagcaccgtcgccgccgtcaacccgaagtttgccgccgcttcctcctcgtcgccgtcaccgtccgttcctcttccgccatcgctttggtcgccggtgagttcgccgtgccgtccgctacccgttggtgtcctccgttcgtgccgaagcgccgccgttcgccggcgagcgtgcgccgtccgagccgccgagccgccgccgccggtggtgacgtcatcgccgacgtcatcgtcgccctctcccgtgagccggtcgtggaccgatcgatctcggccgtctgttttggatcaagtcgatctcggccgtccgttcgcgtgaaccgccgccgtgcgctcggtccaccgaaaccctagcccgctgacgcaataaatcctcttttccttttcaaaaaataattcattattgcgtcataattcaattaaaatcagtttaagtgttttaatccgatttaatctttaaaaattcataactaattcatcttagatccgatttagttggttcaagtctctaaatttttctaaaattgagatctacatgttaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgagctttatttattggttcaactagatattagatataattgcttagccctgattagaaacattagcacactattgggataacttatgactcactattatttaatgatggcttaatgatagttcacgatggtcaatcgtgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcaaggggtattgtcacaactcttttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctgtcgtgattagtcccacacttctcaccatagtaaatgatgctataattggtaataatttgattagctcctggtttggaatggtacattcctggtttggagatagaactgtgcagccgggatggttgttcagaatggttgggcctatacaacagggtatgttgtgtagcgttggattaatattgtttaatacttaactgttttattaaattctgaaatgtttgctaaatgctgcttttgcaaatgaaaccctactatgccatcctttgttatcctgtgcatttgcatatttgctgcgtggcttgctgagtatgtcatatactcaccttgcaatcattcatcagaggaagagttcttcaatgaggctgatggtgtggaggattaggtgtagccttggtcaagctgcctgtggagtggagccgtctgcgccgtttatcttatttttccgctgcttagatctttattgtttgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacatagccctcgatttcggggaccaagtgccttgctaatgtaggctattgggtgtttgttctgagacaggacagccccaatccctgaatctgaagcatcaatttcgacagtaaaaggcaaactaaaatcaggtaatgccagcactggggcagaaaccagagcttgtttcaattgttggaaggcagtttcagtctccaaagtccatttatatggcaccccttttcgtagtaactgagtgattggtttactgattaatccaaatcctttcacaaactttctgtaatagccagccaaacccaagaatcccctgagtttctttttggttgttggtgtttcccaattaacaatctcttgaatcttgcttggatcagtagataccccctctgcacttatgacatgacctaagtaggtaagttgctgttgtgcaaaagaacacttggataactttacttgccaatgatgttgctgcagcagggttaacacttgcttgaggtggtcaaggtgtgagggcaaatcagggctataaataagaatgtcatcaaaaaataccagagcaaacctcctcaggactgatttaaatgtctcattcatggcaccctgaaaggttgctggagctcctgtcagtccaaaggacatgaccttgtattcataatgaccagtatgagtgtgaaaggctgttttatattcatctccttccttcatccttatctgatgataaccagcctgttttatattcatctccttccttcatccttatttgatgataaccagccctaaggtcaagttttgaaaaccatttagccccaggtaattcatctagcaattcatcaatcacaggcatggggtaggaacacttgacagtgatggcattcagttgtctgtaatcaattactagcctccaagtgccatccttcttcctgactagaagggctggagatgcaaaggcactctgactcggttggataacaccactttgcaacatctctgaaatttgtgcctcaatttcatccttgagggctggattgaatctataagggcgaaggttaacaggcttggacccaggaagtaaaggaatgtgatgatcacatattctctttgggggtaatcccttgggtctaggattgactgaatgtcatcagggatttcagtcttttcagaatgagatatagacatcaactgtaccataaatagcagtgacccaaccttagccattcccaaacattgatcaggagtaatagaggagcatctgtcggtttgatgagtaacaccatacagtctgacaggctgcccatcaatcacaacctctagccatttgttaacccaatccacctgcataggactaaattgttctagccagtccatgccaagaatagcatcataagagcccaaattcaacagcttgaagtcgctcttgaaataatgaccttgagtccaccaacgacaccccagaatttgctgtgtgcacttcatagtaccaccatctgctattttcacagttacagatctacttaaaggaatgaggcccacaagcttgctgccaatgctctcatctatgaaggagtgtgtactgcctgagtcaatcaacataagaatctctgttccttgaacccatccccttaatctaatagatttggatgattctgtacccccacaaagcttgctgagatatagccatcaatcctccatcaattgcctctactgattcaatagggtctttagctgtcaggatgtcatcagaattacactcagagcgcattgcttccaataattcttggacaacatggagctggacagaagtagcacatttatggtctctcccccatctttcaccacagacaaaacaaagacccttagcccttctgtaagacttaagagaagcaaatttgtcctctctggacttagcagattccactccctttttgtcatcatgtgcactaacagctacagatctctgtcctggaggcactggcacataattgttgagttttggtactggcctgaacgcaatgtgattatcagaccttctgtgtgtagtagacttattactttccaggatttcttcttggagcaaggcaattgaacaagctgagtcaaggtcctggggtctctgtagcataactgcacccctgacatcatccctgagcccttcaatgaacttagtaacaaaatacacaggggtgagagcactgtcatatgccattagctggtgcatgatactgtcaaattgttcaacatattcagtgactgtgctgttctgttgcgcatggaaccattttctaattagtgcttcctgtatatctctagtgaatctagcacagatcaagtcacacagagtttgccaagtaatacccataatttgagaacggatcgactgaagccaaaatgctgcattaccactgaaattgagtgtggccaccttgacccaatgcataggattaataccatagatatcaaagtattgctcacaattgctcttccacatctgtgggttctcaccatcaaacttagggcaagtcataggaggaagactagtactcagatcggtgtgatgctagaagaagttggtgattgcacagtagaatccggagaaaatggactaggtgagatgggaggaggattccgcttaccatgcaaccatggagttccttgtgctgaagcatctgcagcggtttcttgtttgatcgcgccaccttccatcagctccaccttgtggcttagtgtctgcacggactcgctgagtttttccaccttctcctccatcttgggaagacaaatctccaccatcttcttcagatcagcgagatcatcccgagtcctcgcctccgcctccattctcttcttctcattctcctcaatagttctcaacaagacatcaagtttactctcctgcgacatcctggaatttgtgagcgaacccaactagatctagaatcccccgctccttcccgaactcagttaaccaagagaaggcaagttgccttattgtggaatctgttctaagaacaattccaatcctccccctggaattttacaaccgcgccaaggaattcttggagcgtagaggctctgataccaattgttaacgaacttgcacaggaaaagcaatccagaatgaacgcacggattagaacacgaaggaattggcaactctattactgagatatttctccgattccgacaggaatggagccaccgccgcctacgccaccatggtcgccaaagacagagttcacctcgtgttctctctctcttatcttcctcacctactcagttctttcccctctcgcacgaagaactattacaggaattagacttaattacacggcccagtcaggcccatagtacttcaggtttatcttgacgggccttgttgcacggcgcaccacttctccttcagctgcttcaagttcatcttccctccttccggaatcagcatcatctccagcgtcttctgcaactgacttagcgccctcggacagtggttgctccttgacacggacgtgactgggattcgacggcgctccgacgacgcggcgctctcccctccggcgaccgtctcctccgctggccaccttctcacttttgagtctctcttccttctcctctcttcttcctatcctacctagggtttggttcttggtccttgtttcttggtttatctccgtctccaactgcaagggctcctcctcatccaccatcaagaacaaggccttgaacatggtgctgcttgtcgattgcgtatgaagaacccaactgctggttgcggctatgcccagctcctcaaatcagatttgagccgattgtgaattggtgatggatttgggttcactgttatgccatttttttacacggtccacacggaagcgagctcaactcggaaatatatctgtctatccactatacatgatttctatatcttcttaaaattcaggcaactcaagattcacatctactatacaattgattctgaaactttgtgcattataatgttcattgcgttatgtctagtagaaggaaaaagaataattggatggtagtagttttgttttcttctctatttctgtgataggtaaactgatgtctactcactgattttccttgcagactccttgaaattgactggtagggatgttccatagaatttctttgatggtagcagtttcgtgatggtgtcatttatagactaattaactatccaatgaagggtattactgatgtgtcattttagggatgttgggagaagtttggattttgttgtgcatttagactaatcaatcatcgaagtcgccacagatggattcaacttgctcagtatcagtgtctactgatgtgtgtgctaaagaaaccagtggccactaattaaccatcgaatgaatgattaattttggataataacactatgcctccaactgaaaatagcttatttcttgatcaggtgtaattgttgacattgtgacatgtcagatcttcaacaatgcctgaatgcagttcattcagccatctttaacaacctttcaagcagttaaatggaatcagaacaatctttttattatatcatataattggaatattacaagcatttcctgtaattttggctggcactacattggcatcaactttcttgatccaggaagttgtaacatgcgtgtatattgttttctagttttctctgaaatggactaatggtacttttgatcttgctcctacgctgccgtcacagggtactagcactactggttttaggtaaatagtggtaaccaaatgtactaatagtagtaatacaagtccagatcataaagagagctagcaatacgctcctatattccctgccaatagctgctatagtccctgtcaaaacgaacacagagtttctaagagagggattggaagaaacaagggatttagtccccacagggtttgagtgaaattggggggattcactcaatccctccctggtttgcttccccttaggatttaatccctagcaaccgaacaaggcctgagggattagaatccatcttccgctttcagcgtgcggttctccaaattgttttatttgcgtactgcagagcttctgagtcagccgtgtcggggagggattatttcaactctaaaagttcattcattacaatgtttatatcctcagtcaaattgctgcagtcgtatgcgtaatgataacatatgcaaatctgacgacgcgaaatctaaaatgcgtgcggtttgaaaggcttgctcgaggtttatccttttgaatatggggagagcaaagtcatcgtctctcactcggtccaaaaccatgtcggacttctgagttctgacttctgtactgcttttatatgcgggctgcggtgagtccccccggctgtaattgtactttgttgtcgttgtttgttcttctcttctcggctgctccggtgctcccgttcccaaatatcattcgcgtattttgcttataaccatagaccatcggttaagagttactaataacttctcatttgcggatggaggagatagaaggtaatttgctggagtcctcgattggatggctggcggataccatagtggagaacctggacaacgacaagtttggcgcgtggattagccaggtcgggctcgccgatgacaccgaaaagctccggtctgaggtcgagagggtggaggtggtggtcggtgctgtcaaggggagggcgatcgcgaacaaaccgctggcccgatcactcggtcgtctaagggaggtgctgtacgacgccgacgacgcggtcgacgagctcgaatactacaggctccagcatcagctccaaggaggtaaagcgtgtacataaaaaatacattgttcttcccttcttcgtaacgcaggacgtcgtacgtactttctctgtttcatattataagaattttttatattacccatatgcctagaatctttaacatccatctatatgaactagcaaggtggcctacgcaattgcgcggatagtatccatacaaaattatttacatatgagtttacttaaaatttgttaaatagcttccttgtatattaggactttaaaagactaaccttatcatctctatttttctaattttatagttttttaaagtcacacttgccgctacctcttgctctttttcacccatttatttgcttgttcgatctactacggcatctattcgtcctcctttgaactttaaaatagaaccttataaattttagacttaatcaactcattggctttcatttttataatttttagaagtcccatcaaacgccgccactctactccacttatgcccgtccgtctccttctctctttatcgtcatttgggttttaaaattcaaatataatgatcgtcggtgttcacttttaactttgtagaagtcccaccaaaccgtcagcagcttagccattatactcctatatggcccgcccgatgtcttcccttttaattgtcattgtgattttaaaattcgaacatgattctcattatggtttatttttttactttcctgctaaccatcgtgtttgtgctgcttaacaggttacccgtcattgggattctatttgtggttttgtttattgtttttacccttgttgtcttccctctttaatatcattgaggtttatttttttactttctagaaatccagccaaccaccgtgatcgtactacttaacggcctatccgtcgtccctccttttgatcgccattgggattctatttgggttttgtttatagtttttagatgtcccatcaactgctgtcacttaattcctttacgactttgttgcttcttccctctttattgttattcgtcattgttgcgttttatagatggatggtgtttattgaaaatttcatattttttattccgatattatattatttataaattatatttatacttgaactcctataattatttttatattttcagaatttaatttgatttttatttcaaattttaattaaacttatgttatttttattttatattttattctgaattctaattaatattgtattaggttcttatatggactcttcatttaatattgcttatttttagtttcgaatttcaattatttttaatttgtattcctacttaaactcttatgtcctttatttttctaattttgggttttattttatttttattctaaattttaattaatatcgtattggattcttatatgtaatcttctttcaatattacttattgtttattccgaattttagttatttttaaaatgtattcctacttgcacgcctaatgttacgttcctggtccatttgctcatgcataatgatattcttacattgttttattccaactgtattggttatttgatttttttttatttctaccttgagttaacgtgtcctacactggttagatttgtactctgtatttgattacaggatctccatgcaaatatgtccgactcctaatcctaatcataaaggtttaattaacttgccatcactctatatagaatataggtcggtcccaattttctgtagtcgttttctagttggactccaatatttttcatgtgttaatctgcaccattgaaaaatctaaacagctataatctaacgatcaaaatagtttctctttttcttcgattaatgtggaaatttctagcccccacagcgaacgtggtgtcttcttttagagctattttaataatataatagatagaatagatagatgtggacaatgctagaaagtcttgtaacctgaaaagaggtagtacacttgattccaatttccgttgcacgttttaatcttggttcagattcatgcgcggatgaacatggagtagagcaagcagcgagaccgagttgcaacgctggcatagcgagtagcagtggtggcaaaaaacgatccaaggcttgggaggacttcgatatcacggaaaaggaaaacggaaaggcggtgaaggccagatgtatccactgtcacacggtggtcaagtgcggttccgacaaagggacgtcagttttacacaaccatctgaagagtgacaattgtaagaagaaacgtgaagcaattggtccgccaccagacccttccaggtatactaccaatctgtgaatgatagctaaaaagagacaccatactgcctttagatttctagaaattcccatatctatccatctatctatatatataaaaaaagacaacacaaaaaatatgaaggctagaaattgcccatgttggctatgaaaaagaaaagaatagtacaaatagaaatacaatctaaaaaacaattgaaattcgaaattaaaaataagtaatattggaagaagaatccatataagaatccataaattaaatttcagaaaaaattctgaaattagaaaaagaaagaagaaagttcaagtaggaataaattttgaaataactaaaattcaaaataaaaaataaaaaaaaatcctaaatcagaaaaataaaaaagcgagtttttgtacgaatacaatttataaatgactaagattttgttcaagtaggaatacagtattaaaaataataattaaaattcggaattaaacataagcaatattggaataagagtccttataataatgcattaatactttattaattaaaattcggaataaaaattagaaaattatgaaaagaaaaataaaaaagagagttttagtaggaatataattttgaaataactaaaattcgaaatagaaaatagtgaaaaaaaacaatcaatctagaacccaacacgagtttaattaaaatttaaaataaaaaataaaataaattcttatattaggaaaagaaatgagagtttaagaggaatacaatttttaaataactaaaatttagtcaatgtaagaatacaatctaataaataactgaattaagaattaaaaataagcaatactgaaaaaagagtccatataagaacataatatgtgattaattaaaatccaaaatattttttctgggatttgaaaaggaaaaaaaaaagagtttgagtaggaatacaattttgaaatgactaaaattcgaaataaaagaatattattgaaataataatcgaacacaacacgagtttaattaaaattcaaaataaacaataaaataaattcctaaattagaaaaaaaattaagtagaaatacaatttataaataacttaaatttggaatagaaataacgaaagttgaaaaaaaacagtccttctaaagcccaactcgggattgaatttgttagggttacagataaggcatacctcatgtcctacgacttacgagatatatcgattaggtataccttcgcgtatatggattgttcctgtaaatgtcacatggaaactacttcaaattatagaaaatatctctacgggtcaagtgatttccaaaatcctactcggaaaggatagagtttctgttatactgtaccaggtccgatatcctcaagcttttcttggggggcaagatgatccacggtataaaagggacccctgggaggggttcagggaatcgtatctcatcttcaacacacctcccgaagtttatgaagccggagtacacggagccaactcagtgggagatctcgtcgaatctctcgactacgatctcgtcggtaccatctgtttcgactactctctttgtaatgtgttctcatcatcatcaattccatataaactggactagggctattacctgataagggccctgaaccagtataatctttgtcttttgtctgcttgatgtcgtactacatagaccctcgttccaatgtaccccaatactctacttatccggtctacgagtatcactcgtcgacagatttaaatttagaattaaaacaaaattaaattcaaaattagactagaaaaaatgcccatgcgttggaacgggtaaacaaaaattatatccaagataaaaatattatctgattagggtttagtttttcatgatatgagccctttaagaaaatatattctgaaataaagaaagaaagttctaaaaaaagaaaagaaaaatcgaaaggaaaaaaaaggccttgtcggacccccgccggcttgctagggtattcacgcacatagcccatgaagcgcgcgcggcccagcaatgctgcggtccaagggattttggactatttgccactttcccggatggcgtgttctcaaatgccactcttccaaagaactttgctttttttaccattggagagagatgatttctttctcattggccatttttgagctggtgaggcgctacgtcaccagatatgagggcaaaatgaccattttgcctttcttcttcctccagcttggggtctctctccttcaaccttcttcctgcgcatgagctggtgatgccatcaccaccaatgccaaaccatcaagccaaggccaggacgacgtgaagaggacctcgagcgtcccgctgccgaatggctatggaggagacgaacggcccctggctcttctaccacccaatgtgcaccctcacctcctgcatcgggcagcgaacaatgaggcaggggaagccctaaggctgggtctgacgcagccgtcgacgtcgggggagagtggagaagatccgagaggaggacgacgctctgtgctcagaggacaacgatgacatcgatgatggagtgaggcaccagcaatggcatcacattgccggacagccatgcccgctgatccttgatgacgttggcagtaggaatagaggaggggctggggatgtagggagtcgagtgagggagggaggagcacaaggcggggagctcgccggagcctaagcagctcactggcaaggaaaaggaaagatgtaaaagggactgaggaaggggaggagaaatgaattaagaagaaggacaagatagtcattttgcccttagatcaggtgacgtggcgtctgccaggctcaaaaatggcacacgagcaggagcccaccgctactcctcgcaaataaatatgcatatctatttctaatgtgatgctaattttatttcatatcatattttagggtctcaaatatcacaaatataaatatgcaacgctaatttaaatatacatatgtagaaatgaaaacaacacaatttagtttttttattttacaccattatattagatttattatttaaaaataaaaaaattatcgtatatacggatacatgagaaacatatagctattaaccagaaaaagtactccatacgtacatatgatttaaaga

SEQ ID NO: 65665 - DNA, 76520 bp, Oryza sativa
tctactgaattgaagatgggtaatattcaccaatacttgacacttgatagatgtagaaatgggtgagatgatcatctttgctcatcagttttatttgtttaatattcaccaatatttctggttaactgtgtggtactggtgttcgtttgagtttgatctggaacaatgagtacaaaggttgataagttgatcaaagcaagtaccacctatgaacattgatgagcttccatctgaaatacaaaaaaatattggtcacctcgacagcctagtttcaaactcttcctggacatatgacaacaagctaaccttgttttttagcagcttcttagaacatggtaattttttttcttgctcattttatcatttctatggtaaagtatacagaaaagaagcagtagttaggatgacatggcgtctaactcttcctttgttcaccgtgtttggtatgatgtgattttgttcaccaaactttcctcgctgtctatgttagaccagcattaagctagtgatttgtagctttaaactttctttttgaacacgtacacgtcaaccaactaacaatatattttagtaacagctaaacatattaagatatttttattgttccttataatgacccctatgttttattccaaaatttcccttagcttcatgcatattatatcagcataatcaattcagtgattttgtaaatttgtggagatgtcgatgtctcattacacacctttagtccatatcatattaacaatttaacatacttaagccaatgattaacagaattgctgggcaccttcactgtcgacatgaatgatcatataattctcttgaggtcttaatgatattttggcacagacattgattttgataggtgatacattgtaattattacctgaatccgtggtgatacttaacaaaacatggcagtaaaatattttcagctcagatatcaatgagttctgttattgggcatcattcagatcgaccagtgaattttgttcatcataatgttttatgtcaaaacccttgttacacgtacttagagcaccaaagaactatgtggtgttgtgactatcagacaaaagtgttcgtcattgatctgtagaggagccaaacatatgaaatggtcctacattagtgatctgtagaggggatccaacatgaccctacattagtgatctgtatggggacccaaacatgaccatacattaatgctggtgtttaaaagaagactgtactgattgagcatttgagctgttgccagggaaggtatcagccactcacccttcttttagttcatcctatgtgttgctgtgttattctgttttctagtccctactttggtactatacactctgtaatctactactactctatgattagtactagtatctccttttgagtgaactattgctttcacttgactggttcagagagctacagtagtagcttctcagtgactgcaagaactgaattaatgaaaaaaatggtagtacgatgctgatgcattgtgtggtcaccaggaagctaaatgctgccttgctgtgcttacctgtgggagtaatgtcggtcaggggaggctcttcaacacacttgtcctctacttgatgctgattgtggaatctttgactgcttggtgctggtgatctctgggagagaaatgaaggaccctgacattgcccacgtggtttattttatgaagttcatgtgcatagtgaaaacatgttgatttttttaattaaattgtttgtaaaaatttagcttttaccactaattttcatgcaactttctggataaacttaggcctggtttagttcacaaattttttttcccaaaaacatcacattgaatttttggacacatgcatagagcattaaatatagataaaaacaaaaactaattgcacagtttgtatggaaatcgcatgacgaatcttttgagcctaaatagtctatgattagccataagtactatagtaacccacatatgctaatggcggcttaattaggctcaaaagatatgtctcgtggtttctagacgagttatgaaattagttttttcattcgtgtccgaaaaccccttccgacatccggtcaaacatccgatgtaacatccagaaattttattttcgcgaactaaataggcttacggaaacaaattttgaaacgcccaaccaaaatatgtgaaaacatgttgatgtttgaactgatgtacccacagaagtagaacagcatgttttggtgtccctacgtagtactagtaccactagatgctccagcttttctccgttggaaaacgttcaatttaggtccctcgactacagcctttgttagattcgtgtgtccctaaactcgtaaaactagatatggaggatctctaactattaaaaccgggtttagtttatgtggcatgtttaacctggtttttatttgacgtgccatttacatggaattattattaacaaatactccctccatcccaaaatgtttgacgctgttgacttttttaaaaatgtttgaccgttcgtcttattcaaaaaatttaagtaattattaattcttttcctattatttggtttattgttaaatatacttttatgtatacatatagttttacacatttcacaaaagtttttgaataagataaacggtcaaacatgttaaaaaaagtcaacggcgtcaaacatttagggaaggagggagtataaaactaaaatacgtggggcccactaacatgtgggcccatctctctttctcccatttgaccccttcatctttgtcttcaactgctgccggcgtcaaaacttgcccgcttgttggcaccctccttatgttgatgttgatgctgatgccgagttgccgacatagcgggacttgacatacctggtgtagctgccgccatgcccaagggaaggggtctattggtttcccacgaccaccaccgtgggccttgaggatagggaggataccaagccactgtcgtcgcctcgatgatggtagttccaccccaagtcgccctcgatgatgatggtgtgctggagatggcgaaagctatcgatccggcgaaggctacaaaggtgtcgacgacaacgggggtggtgtagaggagcttgggcacgaccttggcatgtgtggtgcttgaggtcgaggagggtctcctggaaggtgctatggaatgcggacctcgtcgagggcttcctagacgtcgtcgaagatgaggttgagtcaccgctaacccctacccaagccaccattgaccatctcttctggcggtaatacggacgtcgctttctagatcaggaggcctagggcgctagctcaacctttgttgctttcggcagggccggggagccattctgtgtgtgaacatcgatcgtcaagggctccacctctcagcccactatcgatggggatgcatcgtgtccaccttatccctaggcggtcaccatccctttcctcctcctcgtcagcctgtacatgtggatgccaaggttgtgacctgcgttttgtacactatgtccttccactcgacgtaaccgacgtcatggtgcaggccggtggtgaatggcggcagcgcaggatggatggccaggatggagtcgtcgctattgtagctccggtggctgggtggtgggccttgagaggggcgagtggcgcaacgaccatcatcgaactcctctacctaggaagaaggtctctggttgtgctgcacacctccgccgtgcatccacatatcctaattggcatgacgccctgtggctatagatggcctaaggcctgggctcgacggcccgtcccaggcacaacacgacccaactggtgtcgagcccgtgttggcccgggtcgatcgttgggatgtgcctagacctctgcctcgtggaccggcttggcatggcgcaatccaatgattagggaggcaaaatagatgagggaggccaaatagacttattcgaaggaggagcacggcccgagtcttattgggtcgtgcctaggccgttggtgcagtccatgagcgggcatggcacgacccggcatgtaggtcgggtcgtgccggcccgactgatcttgggcccgggctaggtcgtgctcaaactgagctagccggcggctcatttggccatctatacatgcgacaggagagtgaggaataaggaatataggaaagatggatcccaccgacatacggcctcaacatatttcttttattttatcttcgcttactgggattacacgtcagctaaaaccaccctaggaagctgccgaaggactttacaacggttttttagatagttggggaacgctatatacctgattttgcgaataagggacaccgatgaaactcgacccgtagttgagggaaataaagtggactttttccgtgtccatttgatctcggctcttgggccttagctgggtgctacggtgccagacaataataattttgggctctctacgaacggtctgcacgtcactggagctttgtgtttgttctgtccagcatcggctccatctgggaatcgttgtcgagccctattcaacgactgggtctccaagagagaaaatgaagcatttcttatggttttgttatacgtttgtcgataattatttcattaaaatcacacatatgttggtgtaattaaaatatactccagcatgcaactgtaactagcatgtagtaaatagtagaatataagtcccacgtaaatacagaaacatttctattgcgtaactcggttcttttatttgtatgggactatatactacctacattgtaatagttatattattattattattattattattattattattattattattattattattattattattacattcgtatgattttaatgaaatgaattgttgataaatttatagacagtcccaagtatcctctcaaaaaagaaaaaggtgaacatcaactattttgtttctttcgatcctgctgtaaaaaaaaaggtcttctcccatcaagccgcagattgtagtagttatccttttccactgccattttaggtaaaagctgttaaaaaggttacaaaaatatcattagactatatatttctctttggtcatttttttaagatcgtaaagggctttcccatatcaaaagctagctaatgagaggtgaggggctttctcatttatatattaagttatttctccttccacaaccaatatggaactattcaacaatcttcccttcacatattggtgtctctcagccgttcaccgccctttcaccgtatcccaacagtccctcaggtatacagtccccgcaggtgcccacggtccatcaggtctttacacactttgtccatcgggtcagagatgttgaactagtgaggctctaatatcaattgtaagatcgtaaagagcatttctcatcccaaaaactaatcaataggtgaggggccccccacttatatattagttcctttgtccttccacaaccaatgtgggattattcaataaattttaatttattaaattaaatgatgctaactttttattcattaatggggagggattatttttaaaatatatgattattttgtttttcttagcataagggtttcaattgcttctctagtatattatttatgtgatattaaagtataattatacgaaagtacttttgatgacgaatccctttgcctggcaaggcggcggcttcctcagaaaacgagaataacattgattttgcttcacatatgattgagatgtcacaccatgttgaattctacatgaattcctcaaaacatgtgtttggatgtactgcaggaaaacacaggaaattagaattatatgttgacatgttagagagaaaatagaaagagaaagagaaagagagaggatgcattggaagtcccaaaggaatttgaaaaatgaggttagacatcatgctaaaattcctcaaaatgtgaaggaactttccttttatacgtttttcctttgaagtaatcctacacaccaaatgacttatatagatattttgtcattgattggattcatctagatttcctttaatgaaaatcccttcaacctaaaggagtccttaccgttgaaagagcactgtgtgtgcataaatgtaggtggttggtggagttgcggggtggattaggggtgaaaattggataggtatttccgaccacccaccttacttgaggcttgcgggaagaatatgagatagaaaataggatactcggtactatccaagtttgaacccgaatttgtaaaaaaaattgggttaaaataggagaagagttgtatccactcgtatgtcccatattataaaatatatatgaaaatctattataaattcacctaaaacatgataaaagattgattaatcactattttacttgatgtatcttttttaacattttaattgcatcactatatttaatatcaatgaattagagatacaaatagatatctgttcccgaatccaatttagaggaaataatataggataatagctgggtgagtgatatgttatctaacattactcatacctagtttcgaatttaaagaaaaatatgggttatgatgcggaaatgccatgatctgaccgtatccatctgatttcacccctagggtggataagtgaaccacgactctagatctagctaccaccaccacaaactcgatgcttatttgatatacatgtatttaaaagaaatgatacttcaaggtgattcacacaaagttatacgattaattaacaatgatactatgatgtttaactggtatgcctatgacttgtttggaacaaaaacacattattttcacgtgaaaacagttcataatgttcaaacatgccaaaattaaatgctaactactctgttgacagtactaccttcaagcattttcaggacagacgtagctagggtatggtagttggaggagcagttatatagcccttgtataaaggcataaagcaaaaggaacctagttttctatcaaacgtgtactagcaactacaaccagcaacgccatggattgttagttgagagtcttccatatatatcatgtcagttatccccagctcctaggttttttctccagctatgatcaatgattcaaacgagtacactttaaatttgtccgatccataggtctgaatattccatctgcaacttttggacaatctggaccattcacctaacctggtgcagtagttcttgcatgcttgcgagtacaatatatataaacatcaaatattattggaacttagaaattaagtcgacttttgtgtcttgactatcattgagcaggtaatctgaatgggcatccaaacatcaccatacaggcatttctagtaagtttttggacttctttttgatgaaatttttggaggatgagatagttcagggtatatcattccattcaagatggtcatcgagtttggtatatttaatttgttataattaatgactacttcatttgtgaggtcatcgactaagatctagaaagctaaggcgtgtctatcgagttgttgatgatcaaattagcgatgccgactcatagctaggtcgccgacttgttcagtggcgttagtttgtcaaggaacaaagacattctctcttgattgatactcattcatatgcttttatatgtgccgtagtttatcagcgttgtagtcgtgctcatctttcttgtgcgttttaagatgtggagcacttttttgatagattttctcaattatatttgtaatctcttctattttaatataatctaacctgtttttgctttgttttttttttcatgaaggaaaggaactagctaatctagtgcagtcgcttcctgttgattcgcatttactttctgaacccaagcaaaaacgtaaccaatgatatcatatcttcatattgtagaattaagctgccagatactagtacttttaacaactaatgataaattaaattcacgtcatgagttccttctttttcttccatgggccaaatggctagaaactgcattgacaattattttgcttatcactcagcagtacacaagtacactgtactgaaagaaaagaaagaaattaaagaaagacagaaaggacgaaggggaaaagttatctaatcattcataacttctcaaatacaccatccataatgttgaattgcaaatccatcacagagaatatggataattgacactttttccactcttctgtaccccataaaattctcagctagccattagggaggttttgtgcctccttcacaggattttgttaggtgcttgatttttccttgaaggacaatgcaaccagaaactcctatgactgaacaatctgccactcatttgcctcttccaaccaactcatgtatatattgttgaagtgtcactaggagagggaaaaaaagataaaaaggaaaattacaaataaagttgatgaacaggaaatatgggacagtcaaattcctgatgccctttgctccaaccaaaagatgagaacaaccattctgacatgaccgatataggggcatacctgaacctgatgttcagtatttataatgtccttttgggaattatgtgatggttgcacctctttccagctctctcttggcttagaatccaagaaaaagataagtttatcagcaattcagcattacttactgacatatatatgaatcaccaccaactacccttgttcagtaagcattggtatgattcagttgggatagttgcctagtaggttgcatttcattcctttccttttctgactcccatttttcttgttcttggttggccatgaattctaactgcccaaatcttgcttagctgtaggctacaatgccaaaaggagaaaagatggcctaatctttttgtttagtgataggaaaaaaatgcatttatttcttcggaacaattagccgctgaaatataattgaacttctataatactcccttcgttccaaaatataaaagattttgggtggatgtgacatatcctagtactacgactttgaacatgctacattcattcaaaatcccttatattttgtgacggagggagtataataggttatacttgcattggttgcttactttttaattgacagcctacttgatatagctagttagtaccaatctatactgcatccctgtagcctgtacatgttgatttatgcagagatgaaagctcacagaggtacagattgagcaggatcactgatgattgatgaaacaaccaacctacctgatctgatacacccatctaaactaaaagagcattactaatatttgtaataatatttcttcctacatatccacaatgactctcatttggatgttaattaaccaaacaatagatctctcagcctgccattaggcactgaaaatgttgcagattcatctcctcctgacacatgtagtgtgtggccaatactgacaatgactgtcaggtaacaaatcagctcaaacatctgtaatcacaattctgacagtgactaagcaacatttaaagagctcacacattattagcactaattaattttatttatcctaaaaaaaagtgcagtaattagctagcaaatccagcctatataatccccagccaaaactgatcatatcctccaagcttgaacgccaagatcgagatcgccggagatgaaggcgccgccgccgccgtcgccggtggccaagagggcgcgcgtctcgccgttcgtcttcctgctcgtgctcttcctcctcctcttctccttcctctacggcgaagacctcaaggagctcctcggcagccaagctcaagcgcggccgagcctccacttcaatgccgccgccgccggtgatgggatcgagctgccggccgccacggcggcgacgaccggtaatgtcaccacgcatgcatggtgcatctcgtcgcagttgatagctagctcgaatttgttttgacgtgttgtgcgatgggagcagaggggaggacgacgacgaggaggtggcgggggcggctgccgttcgcggcgaacggcgacggcgaggaggaggaggaggagtgtgacgtgttctcggggaggtgggtgcgcgacgaggcggcgcggccgctgtaccgggaggcggactgcccctacatcccggcgcagctggcgtgcgaggcgcacgggcggccggagacggcgtaccagcggtggcggtggcagccgcgcggctgcgccctcccggcgttcgacgcggcggcgatgctggacaggctgcgcgggaagcgcgtgatgttcgtcggcgactcgctggggcgcgggcagttcacgtcgctggtgtgcctcctcctcgccgccgtccccgaccccgccgcgaggtcgttcgccacgtcgcccgaccagcagcgctcggtgttcaccgccgcggcgtacaacgccaccgtggagttctactgggcgccgttcctcctccagtccaacgccgacaacgccgccgtccaccgcatctccgaccgcatggtccgccgcggcagcatcggccaccacggccgccactgggagggcgccgacgtcatcgtcttcaacacctacctctggtggtgcaccggcctccagttccgaatcctgtaagcatcccaagaacataattaaccatagcaagcaggcaacgacactaatggcgagacacgcagggaggacgggccgttcgacgccggcggcaactcgtcgacgacgacgtgggtgtcgacggaggaggcgtacgcgatggcgttccgggagatgctgcagtgggcgagggagcacatggacttcgcgacgacgcgagtcttcttcacgagcatgtcgccgacgcacggcaagagccaggactggggcggcggcgagccggggggcaactgctacggcgagacggagatgatcggcgacgccgcgtactggggctccgacagccggcgcggggtgatgcgggcgatcggcgaggtgctcgacggcgatggcgccgacgtgccggtgacgttcctgaacgtgacgcagctgtcgctgtaccgcaaggacgcgcacacgtcggtgtacaagaagcagtggacgccgccgacgccggagcagctcgccgaccccaagacctacgccgactgcgtccactggtgcctccccggcctgcaggacacgtggaacgagctcctctacaccaagctcttctacccttgaaaataattaaaaaaacaactagaagcttctagaacaatccatgtaggagtattatgtaatgtatgcatgcaggcatgcagctaggccgcggcatctagctaacatggttcaatatttcggaaagaaaaaaaaaggtaaaaaaatccttccatgaatctagagaacacctttgacttcaccaactctccctttctttggtcgaagtaaaaacattttaggggacaaaaatttcagaaatttcaatctaaaattttaaaattgaacaaaatctaactgagttcgaccaagattgttctagatttttttttaaaaaaaatcattttttaagaggaagaaacatcctatagctagctataagaaaacataagaaacaagaagtgcacattctagtagctcttttagtggcaaattaaaatgttgtgatttgttttccttttgttttggtcaattaccatatgtgtcaattgctgtgcagcaatgtagccttgatatgctgctaaaaaaggagaaagcagttagcattttatagtttttctagcctttttagatgctctaatgagatggcttacttgataaaacattacagtaaaccacactttgctccacctaattcactggtttctagctatagcttctcatgaccaccagaatagcagatcagtaacaatggcctcttcgtgttgtcgtgtagtagattctttacccgttccggtctaccacgatttctatttatacaccattgaacctttaaaaatcaaatcttatagttttttagagtttagtgatcacgttatgttcttttttatagtttttagaagcactatcaaatgccgccactatactcctttatggcttgcccgcagcatccctttttagtgttacttggatttgaaaaattaaacttgatcatatttggtttccttttttaaactctggaagtcccgccaatcgtcgcgaacctactcctttatggtctacccgccaccgttcctccttttaatcgtcattagaattctaaaaattgatcctaatcatcattggggtgatgtcccatcaaccgtcaccaccatacacctttgcagctcgtcttgccccttttctttttttgtcatttgtaactattatattctagatatatgcttttttaatattcattattttttattttgaatttttttatttctaaattgtattcctatctgatttttactctatatttaagtaatctcatattgtattttacgtggactcttctttcatcgctacttattctttttattctgtgtaactgcgtggctaatatctatacaaaattatatattttttacacatgattttctttgaatttcattttttttaaagaaccacagtaggggaagcccccaccgttaagattttatattaataaaggggaaaaaattacaacaaatttaaccactataacaatgtatctctttcagaatttttgactctatgaactaaaagggagagatcattcctaaagagaactctccaagagggaacagagggaacaatgttttaaaaaattaaactattcctctgcttccaaatattccaagcagcataaagcaccttctcaacaaaatgggtagagttatatgaatttctggccgtgaccaacatttcaccaaagcttaaagaaagattccaaactacaccaaattgcgcccaacattgagtgctaaaaggacactggaaaaataagtggagagttgtttcccttgatcctgttgaacaaagtacacagagcaaggaagcattttgaggggagcaatgccttctgtctaacatgtcataagtatttaaccgatcaatcaagaggagccaaccaaacaccttgactttcatagtacaactgctcttccaaatccatttaatataaataggcacatggacacgagaaaaattcatggcataaattttctatgaggaaaaaataccgttgccccaaacatatgtccaacgatcactctcatcattaagatgctccaaggtatctgcagatgacattgccaaatattcctgaaaagcttgctctgaaagtggcaaggcaaagagctgaggtagatcagaagtagagaacatcagaactgagagatttgaattcctggcaaaacaatatattctgggataaaccaaggccctgactttattgttccacaaatcttcccaaaacaaacaagattttccatcttgcacagtacatgccgagatgcctctaaaaatatccacaaattgcaaaacatccctccaccaaaaagatcctttaggagtaatagcatgaggaggttctgcagtgtagtaagtattccaaatcaaactgacccagggaacaggatatctattatagaacttatgcagattcttcaagagaagggcattattttgcaatctaaggtctattacacccaaaccacctctatctttcggatgacaaactctttcccagagaaccaaagacttcttactagaattaatatcatatcccctccacaggcaatgtctcctagctctatcaatactttctatgactgtctttgaaagtgaaagagagcacatgtagtaagtgggaagggaggaaagaacggcattcacaatggtcaatctgtccccataagataacaaagcagtggttgttgagagtcttctctctactctatcaactataggagcaaaatcaataatcttggtcttgtggttccaagaggaagacccagataagtaaaaggtaacttaccaatagagcaaccaaacaattttgagagatgatcaactttttccaaatctacattcagaggaatcatgcatgacttactatagttaatcttaaggccagttgaagaggcaaaagtgttcaaaattgccttgagacagaaaagctctttttgggaagcagtcaaaaaaagaagagtatcatatgcatactggacaatcggaaattcattactaggtgttgggattggcattgtaagaactccctaagaacaagctttattgactatagattgtaacaagtcagctccaagaacaaataataagggtgaaagtggatcaccctgtcttacaccccttttgcaatagaaggatttgccaggaacaccatttaggataactgaagaagaggctgaagaaaaaatctgagaaatccagcttatccatttaggatcaaagcctttctgcctcatgatgtccaatataactgaatgttcaatagtatcaaaagctttctcaaaatccaattttaaaagaactatttccctcttagaatgctggcactgatgcagatattcaaaagaccaagccaaacagtcctgaatatttctagccttaatgaaaccatattggttttggtggatcaattcaatgatgacagattgtagcctatcagccagcaccttagtaagaagttttagagccacactctgtaaagaaattggcccgaagtcatttaccttttcaggagaagacttcttagggactagagttataaaggatattaatactctcaacaccagagaaccctaacaaaattgagcacaaagattatagaagtcctgtttaattataggccaacaggccttaatgaagcaaccattgaatccatcaggccctggagatctatcaattggcattttgttgacaaaccttatcattatcggataaataggcatctcattcgtcttacaaaccttatcattatcggataccccttactcctctgccattcaccaccgttgtgtcctaaatcaagtgtttttcaatactttttttattgttttatccaaatttttattatttataaattcatactatttgaactctagttttttttcttaaatccgaatttttatttcttatgccagattttagttaacctcgtattgagtcctacacattattcattcaatatttattttttattttaaatttcagttatttctaaactgtatttctacttaattctcatatttattcttctagtttcggaatttattttattttttattatagcttttaattaatcttgtttgtgttttaaattttctcttatttcaataattcttatttttattcaaattttagttatttaaaaattttattcttagctgaactattatatttttttgctaatttattattttcttctattttttattttaaatttttattaatcttgtatgtgttcaacatgaactattctttcaatatttcttattttttgttacgattttcagttgtttctaaattgtattcctacatgaacttttttatttattaaattcgaaatttattttattttttactccaaatttaattaatctctaaatatgttctacttggcctcttaatttaatgtttcttacttttttgtccgaattttagttatttataaattatattactatctaaactcttatatttctttttaatgtttcataatttattttatttttattctaaattttaattaatctcacactgtattctacatgaattattctttcaatatttcctaatttttcttccggatttcagttatttctaaatagtattgcaacttaaactcttatggttatttttaatttcggaatttattttgtttttacttcaaatttcaattaatctctaattgtgttgtacatggactcatatttttatatttttttactttttattacaaatttcagttatttcttttttgaggaatttcagttatttctagatgtattcctattgagactcttgttttctttttctctgattaatgtgggaatttctagccttcaaagcgaatgtgttgctccttgcaaagttgtcttaataatataataaattatttatttttgtagttggagatatcgagaacactaattagcctagtatacttagcgttttatttaactattatagaaaaacgaaaaaataaattattttgaaagttttaaaatatgagtagaatttgaagctgaaagtttgaaattttgaattgaaaattttaaaatttggctagaggtttttaaagttttgaattaatacttttaattttgagttcaaagttttcaagttagagttgaaagtttcaaatttgaaagttagtcgcacagatcaatttgtgtatgagtaactaacgttggactaagtcaacgcttaatagaagctaaaatttaaattttcaaccttaaatttgaagttaattttagggttttttcatcgaagtttattattcaacctttacttttagattgctaagagcaagtatataaaagttgtatttatgaattatttttcgtttacaaatatgttgtttaattagcttattccacaaataagcaaaacaatggggccattacggccataactaccatcggactaatcgatttcataccgggcgggcccaagattttgagattgggtattcgaaatggaaagggggtaaaaaaaaattttacaacacgcgagcataatatttgatacgtatgatcaacaatatggtattttagtactgcttattgaattagaacttgcgacaagatttttagcaaatttcttgatttattatgatgtactttgtgaaagaacatatgcagtacaatctaccaaccaagtatatatcgattagtatcatgccatcacagcacagttaatgtacaaattaggcaaccttgtaaattgggttcgaatttgagggaggcagcctgctaggctttcttgttgggcttcttttgatcaataacgtttattttctttatttctttgcatacatacgaaatatatacctcagggggctgctagctggcgcgtgcgcgccagcagcgagcacctcacctccctaattatctatagtactattagttaacacccacttaactactaatgactagtaattagggaagattctcaagatttttttttcttttttgggagatttttgtaccaacagattgaaaatttttaagttagatttgaaaacttttgatttaagatttaaatttaaaagtcaaattttgaaaactttccactcggatttgaaaactttcaactcagattcgaaaactttcaactcagattcgaaaactttcaacttgagattcgaaaactttcatgtccagatttaaaaaatttgaaaactttcaacttagattcgaaaactttcaagccaagatttgaaaaaattgaaaactttcaacttgagatttgaaaattttcaactcaagatttaaaaactttcaagtccagatttgaaatatttgaaaactttcaacttgagattagaaaattttcaactcgagatttaaaaagtttcaagtccaaatttttaaattttaaagttaagaattaaaaattactagtaaactaatcactagtaaaaaaactaatctaaactaattacgttacgtacggtacggtaaaaacagcgaaaaagaaaaaaaaagagaaagaaacagcgaaaaaaacggtaccagcgagaaagaaaaaaaaagagagaatctaccaagcgaagaaaaggagagagagttcagaaaaccgatcgaagttcaaagacgaaggtatgcacacagcttaatataatgccttaatttttcaacaggtttcagtacttcacgcgcataataataataataataataataataataataataataataataataataatagtaataatagtaataataataataataataataataatattattattattattattattattattattaaagcgaatttgataagaatgaacagtaaaccagcaaattccacacatcgaacaagcaatctaatcctcttgatatgttaccaataattaatttctcagtgttgacatcgaacaagcaatctaatcctctcgatatgttaccaataattaatttctcagtctatcaaaaaaaataattagtttctcagtgttagtggtgaatgcgtacgtggcaaacatcgtcagataagagggatcatcaatcaatatcaaggaaacctccggccaggcgcataacacaacacgcaagtacgcaacataccaatattgaaaatttcaaactcaaaatcttccattgcacacaaattaaaaccaaatacaaaatcacgcacatgataaattaacagtacgactaactaggggcaaatctctttatttatttattactcacgcaaaacatattgtatggtacctgattaataattataataagcatctgtgatacatgcatatctatctaagagattttacggtcctcgagaaggtacggagggataccaaattttatatttccgatactatataaggtacgaagatttgtaaaaaatactcaagaactataaaatttctctatataattaaatttcctaattaataaccacttggaattgagcatgatggaatcatctcaattaattaaccgtcttcttggtcggtgtgcggccttgtagaggactgggcatgttgtgcaacgggttcgatccggtgggaaccagacgctccgtcacggccaccgtgggctcgtcggcggcggccggaggagtcggcgcgccgttgtgcacggggctcggcccgctgctggggacatcgtgcctcatcacagccgccatcttcttctccacggcggcgggacgacgaacatctcgcgccgccgcggccgtcgtcgtcgccacgaacaccagcagcaccatggcgatggcggcgaagaggaggagggagcagcggccgtggttggcagcggcggcgccggtggccattgttgacgacgtcgtctagctgtgtctgcttgtgcggcggtgaagatgctagctagctagcttcgtgcaacgacgacgatgggcgagtgcgtcttggctgcatgcgatggagctgtatttttataggcataagtatggaatgtgcgttgtaattattggtagggtaattttatcatcgttattaagaaggtatcaaaggtatcatatttttaaatgtaaaatttggtatcttagatacgggagtagtacctcaggtacaaaaaaattttggtacctaattcctttattggtaagtttattatcgggtgcgacgttggacgtcgatcgatcgatcgatccccatcgtgttatggaattctaatggcgtttttgtaaggcagaaccttctttttttaatttttggcaaaagtattaattgcaccagttatgtaaaggtatctgtgtcgtatggtaagtactttattccggttaattatatgataccagaggtactactatatgtatactgcgattttccttcttttctgtttgaattttgaaaggtaacatcttgattatatttcgttggcagctaggatatgataacttatactgtactatgttaattagattgtgctcgacatggcatcttaatatataaaaatggcgaaccatatattagtatatagatttattaattaagaacataatttattttctacctatagaaatatccaccgcaaatatataaggaccataatttgtctgttcggaaggcccgtatttggcccaaaaccggcataaattttgggctcgtatatggtatgcatgcactcgaataaatataccctgatttcaaatataccctgatttctgcatgtttcaacatctcaccgcctctcttgtctcttctcttgtacacttacaaaatttgaatccaagagctaaaattttgatcgatcttattgtgtccatatatgcttaaaatcctccttctcccaagcaattcctcgacgagagattctgattcactggtattaattagttccgtgaaaaataattataggtatattttcttcacaaggaaaaaaaaaagaattcccaggtctatgcttatatttgcaagtctatctttcctaaagcaaaatctaggaggacacataggaagacaaagttttgctcgttatccatgccaatctgccatcgcatttctgttgtttttacaacaataattcaataactttattcattactatgtgcttttaggaggcacaaatactccattttggtgacccgcatatctgttggtttaattttgtcttaatttcattgttttaatttatgttcctttttttttctcatgtctagcttgttcggttctcttcgatcaatcgatcgcgtgtttcatcttattatgtctttcagttggtggttctgctcatttctggcattccaagctaggtaggttcactgctgaattcattaattaataacgcgtgccattcataacattcaaacgaagacgatacgagaagccaatgataaatcaaaacaacctacgctatatatattccattatccatgcaatcatgacaataaaccacactttttattgaaatatcttgataattaacaaaacttgcgtacatgctcacttgatgctagctcaagatcgatcagataaacatcgagatctgatacgcattgaatcatcaatctagcacatcagcatgtaatgcaaaagtacgtgcttcaaactagggtagcccactcatggagaaggttgatgattgtgtatcgggttcgggccgctaggaacatcatgcatgattctgactcgagacgagctaggtggatgatggggaggagggtggtcattgtgtatcgggttcgggccgctaggaacatcatgcatgatcccaacacggttgccgcgagaaccggccgccgccaccaggacgttgccgtcgtcaccatctgccgtgccggagaaggaaggcggtggacgcgctgccgccacggccgccaccgccacggcgaacaccagagccatgaagagaaggcagcgccggcgctgggcgtgggtggtcgccatgagctacgaattcttgaagcttttgttatgatagtggctatatgcttgtgagaatggatgatttgctacggtggaatgccggcccgttatttataggcgggcgtggctgtgggaaggcgtactgattatttgcctacacatggtaagatattatatcgttgcatccctgtgattttgtgctcgatcgtcagctgtaaatgctgagaaatatgcatggcaccagatagcaggccggatatcacgaccttattaccatcgtttacacccgtatcagatacgagctgattaattttccatttatttggggtatgctgcccccttgattctctatagagattaaaacccctactacgtcaatgtcaattcaatgttcgtcgcaaaaattagaaaataaagtactgctgcatacgttgttttctcgcaaaatgtatcggaatagcaaaaaaaaaaaaaaaaactgaattagggtacagaaattatagaaactttggtacctactacggacaatatcttaactacttaaaaaatcggtaactttccgatcctcatcatgtttccgttcgatttcgcgctaattcttcgtccatacgagtgcatcatgaggcagataaagcaaaaaaaaaaaaaaacatagatacactactataaaagttatttttcttcacgaggccccatgatttttgcaaacggatcataactagtggcgtctgcaaaaatcgagggtcattttcccatacggccgcttaagtggcccgtatggaaaaatcgatttttcccatacgggcctcttaagagggccacatgcaaaaatgagctcatttttgcatgggaaaaagtataccgaaggtccctcaacttgtcagcgcgatacaaaaacgtccttaaaccccaaaaccagatatacatggtcccttacctatacaaaaccggttacccgagatccttagttggttttgacccagttttgacctacgtggcgcgtgggccccacatgtcagcgtgccacgtcaacccccctctccccctcttttcttcctttctcccatctctctctctcactcttctctcgcaggccggccggcgaagcagagacgcggagcggcggtggcggcaggcgggcacgcgcgcggcggctggcggaggtggtggccccctagcagcgggcatggttgtcgtcggcgccctttcccgacgccggccgtactgcgcagcgctcgcccacgccgcgccgccgcggtggggcatggtggtgaggtgggagggagggagctgggagtgttgaggcggaggaggaggaggtgtggttaggcgcgagctcgccgtcctccccgcccccttcgtgccggtggggcgaggcaggaaaaggcggcgggatggtgtggcgacgtggtggcggcgggctgggcgcaggcgggcgacgcgacgcccaatccgacgcgggccgcggtcgcgcagctcgcagtactgcggcgtcaagttctaccgccgcaccgggcgatgggaatcgcacatatggtaagcctcctcgtctcctgctcgttctttccattttcgagagctcaacgaaggaggaaggaggagagagaggcaaggggagcaaaagaagagcagcatggacgggtttggtattggattcgtcttgttttgggcatttctcgcttctgctccttttacctttgtttttctgctcctttcccaatcgcaggacgtacgatctagcggcgatcaagttccgcggcgtggagggctggaggccgacatcaatttcagcttggaggattatgggggatgatctgaagcaggtgagaacaagtttaacgagatcattgtggatgagcaatctgaccaaggaggagttcgtccacgtgctccggcggtagagcacagggttcccccggggaagctccaagtagaggggcgtgagctgcgccgtgggcgccatcggcgtcgacgtcgccgcgaacctcctccggacgcacgccatgtcctacgccgtcgtcgtccgcacgtcaccaacaaacgcgacggccaccagaggatgagagagagagaggggaagagaaggggaaaaagagatgatgtggcatcctgacatgtgggacccacatgggtcccacgctgactcagccgccacataggacaaatccggcgtcaatactgccctgggactttgggtgaccggttttgtatagttaagggacctcgcatatctggttttgtggttcgaggacgttttcgtatctcgctaacaagttgagggaccttcggtgtacttttccttttttttttttgcatgcggctcacttaagcgcccgcatggaaaaatcgatttttccatacaggccacttaagcagccgtatgcgaaaataaaatttgaaaaatttgaaactagtgtatctcacttatatgaactccaaattggatgatttttttcctaaatgtttctaaaataatgctctatcatgttattgtgttcttactggtattattttagctatttttttcttgtgactttgttttatcaattaaaatttgaatttcaaaacttcaaataatattttgaagcagtaaatgatttaatctgaaaaagtcatcaataacaaagttgtataactcatcaagattattggcagtatgacatgaggcccttcgaccaaacctgccaaaaccatgagaccagcgaggattcaagcctgagacgtccagattagtcggggcgaagcccccatggcgaagactatggagcaaggacggcgaaggaaggagaatcgcgtgggtacctcgcgaagccaaaggcctcttgggcgaaggatgtaaggcgaagcgtgtatgctgaagggagatgacttcaccatagcaagtttggcctcgctaaggccgatgaggccatcctagcttctcaagcccaatggccgttgggccagcgatcgcctggcggcccattaggagtccatataccttaattacactgtatgcccatataaatgtccctgtcgtaagggcaaccgtgtaaattcccctgtgtaacctaaactctagtagtaagaacctgtaatgaggctataattagtctcctagagccatgtaataggggatcctaagaaaaattctcaatttaatacactttacttcttttccaagcactgttgagtaaccacgtctttcaacgtatacagttttcgtttcgacaacaaagatctataacttatattttgattatttcttcatccgataaagtgatttgcaagattgttcacaaaatgtacatctcttatatattcttataaaactatataagagaggtacattttgtaaacaatcttgcaaatcactttgtcggatgaaaaaatgaccaaaatagaagttataggtcttgatgagttatacaaccttgttatttatgactttttcagttgaagtcgtttagtatttaaaaatattgtttgaagttgtcatattttgaaattcaaattcaaactgtgtaaacaaagtcaaatataaaaatgaccaaaacaaaagttgtagatcttgatgagctatacaactttgctattgatgacttttccatttaaaatcatttactacccgaaaaattattttaatttgttatattttaaaactcaaattttgtatagtccaatcaaactcggatggagaaataaccaaaataaaattggtagatctcaatgtattctacaaatttgtttttgacaactttttgatatgagttaatttaatgtcataaaaatcaatttaaagtttaaaaaacacatgatttttgcatgcggacgcttaagtggtccgcatgtaaaaatggtccctcttccttctctctccaccagtttaaaatttttcacacctatccttttatcttctagtccttcccttcctctcctcttagagtcttctctctttcactctctctctctctctatctatctcactctcagaccaagagccagcgcagtgtggcgcgcagcagtcgagggcggcgcgaggtggtgccggccgagggcatctccatgtcctgttggggtgacatctccatgtccaacccaacctatgccccaaggtccaaaattgttttgatacccttgtcaagtaaaccaataatctccgcatatagatgtccgacatctatcctattttatcatgataaaaagtgacactttgctatgtcaaacccatcacttatgatcacaaccgaaataggtgcaattattgaaagagcataaatttcacttaatttttctgagggaatctatcctaccatgtcatatcaaatatataacagcaataaagtaagatagatataaaaaccccaagcgaaatctaaggggcaacgcacacggcagtcccggggtacatagatctcatctacgattcgctatgtgaaaaccttaacggcgtaatcaaattatgccgaagccgagtcaatctcattggctcgttttttctcattggcgtgcagttccagtggacatcggactatccgatgaacacaatcgcgcttggccttggtgagtactagacatttataacatcccggcctagggcttaataggattaatagaatacttatatcaacaagttgcaacttcttttccggaagccaatctccaaagaactccagggttaagcatgcttggcctggagcaatttaggatgggtgaccgaccgggaaattcttcccgggtgcacacgagtgaggacaaagtgtgcagaaaagatatgtgttagtctgtgagggcagtctatgacctatgaaagctatcagatgtaagcgggcccggcctgggggaaggcgggacgttacaaaatggtatcagagccgaatctcgcggtttcacgggcgcgtgtgtcgcagttgcgcaggcatggtgcgcatggctggtgtagaccgggagtggttacacagcatggcacatgcgctggcactggacacatggacgtggccaagagaggacgttcctggcctagggttgatcgacgggggcgtcgatctctcttaagggggagggtgtaacatcccggcctagggcttaataggattaatagaatacttatatcaacaagttgcaacttcttttccggaagccaatctccaaagaactccagggttaagcgtgcttggcctggagcaatttgggatgggtgaccgatcgggaaattcttcccgggtgcacacgagtgaggacaaagtgtgcagaaaagatatgtgttggtctgtgagggcagtctatgacctatgaaagctatgcggctatcggttcatctcatgttccgatcacctcatatacaacataataaatctcatctactacacccgcacatcaactatatgcactgatctagatcataaactatacaaggcggctctgatactagcctggagcaatttgggatgggtgaccatcggttcatctcatgttccgatcacctcatatacaacataataaatctcatctactacacccgcacatcaactatatgcactgatctagatcataaactatacaaggcggctctgataccagcctggagcaatttgggatgggtgaccgatcgggaaattcttcccgggtgcacacgagtgaggacaaagtgtgcagaaaagatatgtgttggtctgtgagggcagtctatgacctatgaaagctatgcggctatcggttcatctcatgttccgatcacctcatatacaacataataaatctcatctactacacccgcacatcaactatatgcactgatctagatcataaactatacaaggcggctctgataccactgttgggatacgcgtaggctacgatagcataaatcaaaattttttatcgcgtaaaccaggaaccatgcaagtattagatcacagatcattactattcgacgcgctgtgcagcggaagaagacgctgagaagtcgaaggaactctcgcgaagtagcgcgcgtcgatgtagaggaagtagtcgatcgcaccggctcgaccttctcctcctcgtgcgttctcctcgccatactcccacgccgatcaacaccgcaaacaagtggcgcctctaccggtatccacacgtacagggacggaacgccacgcgcagatgtgctagcacccgtgcgcagctagggttttgctcggggagggaagtgacggctagggtttctcacgtgatgttatgcctccgccggtcatgcccctcacgaatatataggatccatcactcgggcctccaaggcccgtaggactcctattcggatccctatccgaattaagctcatattggatctctatccaatccccttattccggcccattaagcgtgcgaccctataggttcatatatactcagctgtaacccgaaaactccttttcggtccacgcgtcaacagcggcccctagcagaacgtattgacccacctggcatacataaagatcatatcggctgaacctctagtgtatacttgtatgaacccctttgcctcacgatatcgattaagctcaaggctagatatgtgtcatcctctaatagctcaatcattcactcgaacctgttgatagattatataacttgtgattgactcctcaatcacctttggcatggccatgcactttcataatctacaacatcgaggggcccagagatatctctccataggaggggcaaatcccatcttgattattcatatcccactatatgtttcatagcatacccgaaaactacttttatagctacccatttacggagtagcgtttagcagtccctaagtaagctactacacatgttgagaaccatgataatctcaggtctaaagattcaacaccaacactaaatgagatcactgatgacacaacacatatggctcttgcagtgtctcatgttgggtctatcgaacaacatgttcaccaacatgtgtccacattattaatttggtatctctataccatgatccatgagacatgatcatcaattaatacatgtgctgatcatataaacatatttgttccacatatgatatttgatcagggatcctttagaaatagtaacaaaacaacataaagagtctcatgaaagaatcacatattcattaaccaataaggagttatctatttcaaggaacaatgtcggataaatatgtaaacatagtatgtgatacaatcatctctatgattgcctctagggcatatcactaacagcggcggccgagggcggcgcggcgcgaggcggcggcgggcgggagcggccgctcgcctggatctgccgcctctacctccctctgtcgtcgccggcgactcccccgtactccttcaacgcggatccggcggcggcgccctcccccgcggcggcgacgacctcgggtggcggcactaccgccatcccctcctcaccgcccctcccccctcctcaccagacgacgacctcggacggcggcgggggcggctctgccgcctcgggcggcgccgccccgcgcggatccggcgccaagggcggccgatctggagcctgtgacgacggcgggcggcgagggcggccgatccggagcccgtgacgacggcggccggcgggggagatggatcctatgctggcgacgatggcgggcggcgggggcgacggatccggtgccggcaactccggcaggcggcgggggcgacgaatccggcaccgtgcggtggcgggctagggtttaggtttttttatttttattttttttttgtttgctgaatttaggtataagcaaccgcatgcgaaaatcccattttcgcatgtggttgggccggccgcatgcgaaaagggtgatttttgcagaccttctcccccatgcggttgccaaccgcatgcaaagataccgcaccagagaaagccgtgtcgtatcttgtcgatggctttcagcacccatttcgcggggggggggggaatggcgatgagcaagtaaaccggatcgcactcagcattgctttgacaagtgctaggcgcccggctggctggagccaatttgatctccacagtggcagccactgcgcaatcttgttaattggaggctggaggtcctcacggcgcagctttttgatggagagaggcaaacccaaatacttgcatgggaactcctcaaccgggcaagtgagggagtcatcgagggctgcgacctcttccttcgagtagttgatcaggattgcggaacatttggtgaagttggtatgaagaccatatgcctctccaaagagagccaggatcccttgtgctgcagctagttccccagcaaccggcctaaggaatgcgaccacaccatcggcgtacaagcggatccggtgagggatacctaggggccataggatcccatcactgatatagtttataagcaaaattggtttcatatcatcgaaagttgatctttgaattttgttacaggccatcgaaagttttcacatttatttattatgatactgagtatcaaaatcagtattaacgatcgtcaacaatgctaaaatatgtaagctccaattcattcgccgggcaagctccttaattttttataagacaaaaagaaatatctaaaaaaaattaacgatcaccaacaacgctaaaatatgtaagctccttaattcattcgctgggcaagctccttaatatgtaaaacatttgcttgactcgtcatccaaaatagagtatggacctccgatagattggcaacctgtgggtagccgaatggctccgtctgcccctttgtcgaaggaaccaggaaacggccctccacctcctggtggagtgtacatacgtgaagagaatctgggcggcactcgcagactggtcggcatatgaacagataagaccaacatcgtagcaacaagcctcgacactactcaagtggtgggaggccaccgcatgtaccaatgaagtgccaaagaaggccttgtggactataatgctattagtcgcttgggagatttggaacgaaaggaaccacagagtcttctagcaccaagagctcacggtggctagtctgatagccaaaattaaggaggaggccaaaacatgggtcttggcgggcgcaaaacatctcggcaggtggcttaccttctaacatgttcgggccaaaggccttgaacctgtaaagttttctttttgcgctttgcgtatgtacagttttactccttctctgttcaataaaattggcggctcgccagttcattaaaaaaataattgatcgttgtcttgcagcaggcatcaagttagtggcggacagatgactgcactaaaattgtagcgaaaagtttaaaagtttaccaattttttgttaaaatattcttttagaaactatgacatacattctagaaaaagtgtccgtgtgttacaacgggaagaaaagacgagaaaattgaggaaagattgagaaagatttacattatctaattaattaaaatacatattttctagaatttttgggtattttctaagtaggtaggtatataattaagttaatttacaagtaaaataagtgtgagaaataaaattatatggttggatttaatttttattaaattctccatattgcttacactttttgaaattttcttagaatttccagatcttaattgctaattttgataatacaaacataatttcaatatttatttaaataaaaatcctcctttttataagagccatttttagcccattttctttttcaacccgcaaccgagccggtccgctttcctcaggccgcgagcaagcgttcagcccaggaagcaactaaagtctaattgatatccccctactcctcctcaaacttgccgtgtgggccgtaaccgaaaatctaaccatgttttgtgttggactgctggcccgcgtgcggcccagcaatgctgcgattcgacaatggaggtcggcccaacgctcgatcaatctgagccgttcattttgataaacgactcagatcggttccaaatcaatcaaaaccccccatgcaaaaaaaaaaaccctaaccctagatcattcccactccctaccggcggcgcttctccccctcccctcccctcccctctcttttccctactggcggcgcctctccctctcccttccgtcttgccaacacggtgcggccgtagagaggtacagcagcagagacgacaatgacggccgtcccttcccctctccctctcctcgacggccgtccctccctctcggcctctttgtttctgtcggcgacagcgccctcccccaccatgagcaacggcagcgatgtcagcgtcggtggcttcctacgggcggatctggtggcggtggcttcccgcggcggatccaacggcgacgtcggcggcggcttcccggtgatgtttttgtttttcttcccgttctttttctctttcgctggattgccttattggatttaatatcgctacttcctatggctggtcgctcaccgacgctgctggacgactgaccgattggagaagcgtgggctgccgaacccaacctattgtcttctgcgaccaactggaagagacaatcgatcacattctgattgggtgccctgaatccctccagctatggtggactgtcctttcgagcctcggcctccctcagtgtttcccctctggcgctgattccttccatgagtggcactactcttgccggctcaaagtttcgagggagcgtcgtcatgggttcgatacgattgtgactcttggtgcttggtctatttggaaggaaaggaacagtcgtgtgttcaacaaccgttctcggttctggcctaaggttgtcacggccatggtgcaagaggccaccctttggcatctcgcctgtcccctatcgccaaagtttcctagttagggtgtttggtcattcagtcgtcacattgtaatagcgagagtaggcttaagttcatatattttcctttttccccttttctttcccgtctctcttctttgcttgctgtttgtataaattttatacctcttaatacaaaagtgcgtaatccttttacatattctaaaaaatagtaaaaagtatagatataaaacgatgaactgtatcggagtattgtattccttatattacaagcagcagaagcaccatagaagcggagaagagcatgagcatctgcagcaggctgtagcgaaggcctaggctgctggcgccggcgccgtagcagtagtctgaagcaggaagcgtactagtcgtagttgggtattcgccctcctcgctgccatagtacccaccgtattgctgctccgtcgtctgctcgtggtggctgtagtggtagtactcgtcgccgcactgcttacgctccctaatctcaaacgtccctgcacgtatatatgggtaataaaaaaaatcaagagccccgttggtggtcttaaaaggataaaaaaataataagtcaaagtaaaatttaagtttgaaacttaacttaatttgaagttaattttaatatgttttcaccacttttttttcagtattagcttttaaatagtaagaatacatataaaaaaattaaaacaaattattttttaatcgccaataagatgttacggtgtttataataaatttttgggtagttggtgacttaacttaatttgaagttaattttaatatgttttcaccactttttttagtattggctattaaatagtaagaatacatataaaaattttataaaaaaatatttttttaatcgccaataagcctttacggtgtttataataaacttttgggtagtcgatgaggccccaactcaagataatatattgtctgatagatatgcaagcatttggcattctagacaggatttataaaacattttaaactccaaaatgtgtaattttatactagaataaatttataaaaatcgtttttttccatatacatttgagaaatttcatgctgcggtctatatattttcttaatttgtgcgcgtcaatagaatttaaacaatttaaacactcatgtttacacagagagatatcctattatagtttttgttgtccaaactttttttttttgcacgtgatcttgagagttttttttaaaaaaaaatattttcaggaaaggagaatatataatttgttggactaaattaatatactataatttacctctgtcaggagtgtagctgcagccggtgtcgagcgcggccttgaccgcgggcagcgaggcgccgctgtagaacctgaagccgtcgtgggcgacctcctccacgcactgcagcgccatcttcgtctccatcaggcacggcccaccgcagtactcgtccacgctctccttccccacatggaacgccccctccacccccagccgaagctcctccttgcactcgctgtacacctgcaaattcaaaattattaattcggttcaatgatcaattgcgacatgcatgcatgaagaaacacacttgattataaacagttaacagttaattaattaacttgattctgtttatagctatatatatgtgcttacgttgtgatcgtcgaagcaatggcaagccttctcgaacatttccacggcagctttgcctgcatatgcgacgatgaaattaataacgatcgtgttaatgttagagaaagctgtggctaacttcagagtttgttgctgacatgcatgctgtatcctaatgtagttatgcaatggcaccaactagctagctagcagcatgaagattatcatgcagaaaaccaagaagaactagaattattgaggcactcactaccaaagcagcatgggagcaaaagacacactgcaattgcaaaggccaagcagacacttcttggagagggatggagcaatactgccatattgctgagttaattcgggagaaggtgatcgttgtagttgagcagagatgtaatttaggctagtgccgctgcatttcggcgatgaggctagctctatatcttgttatatatggttttctctgcttgattgtttttcgtcagagcatgctttctttctttctttctttgacaaaacatgtgcttgttttctatcaagatttaccagctgcattcctagtcctaccaacattcccaaggatgcccaattgtccactctttcattttgcaaaacttcattcaaaagaaatcactgccgtctagctttgagcaatgctatctagcagtaattatggaccgcttcattcaaaagaacattttgtgtctagctggagatttgtcgtaaagtttagtttgggcaattgctactgaattaattaggactagtaaccaactgttaacgaaggaatatgaaagaagtgcagttcaagttatacaagtcgaatccaacaccttgcaaggatcgcaacttttcttgcccaaatctttgtcaattccatcgggctaattaacaatcgatgtcttgcacgaaaggaggaagatctgtctatgcaaattctccagccaaccgctgccaatagattatttcaagaatctaaacatgggccagaactgggccatgcaaagcctgctctcctagctaggttgggccggtctggctgtaaatgataggaataagttcactttgtgaccctcaaaatgatcgaaatttaatccgtgaccccaaaccacagaaccggatatctcaacccctaactctcgaaaccggtgcaatttgactccctgggtggttttggatggcggtttcgctgacgtggcgcctacgtgacggttttaactcggtcttctttccacgtgacgttgacgtggcgcttacgtggtattagaaataaaaaaatatgtgtaggacccatttgtcatacacacggaaaaaaatgtgggagcccctgtcatgtggagcccacataatcctctcctccccatcttcctcctcccttctctcctctccacggacgatggagtctgcgccgacttgccgccggccaccgccttggccgccgccacagacggcatcaccaacacccctctcccgcgggttgtcgtcggcctcccccacccctccccgcggagacgttgccagcgcacccggcggcaggcgggagggcgggcgctggagcagcggcgacgacgaccccttctctcttgctctccttccttcttcaagcggtgtggcgacgaggagcagccgcggagcatgattcctgcggcggagatggcgatggcgcagtggaggccgatcggcctcgaggtagcgcgtcgtggcggcccacggggtgaggcaggcgtggaggacgcggtggaccgggtggaggaagaggtggaacgcatgtgggggcgaggaggaagcgaccggcatcaattatcacgacgagctgctttgggtgttcgtccacgccgatatcggctactgcttttctgactcgcgccaccacagcctgccataactccaatccagcatccaggtacagctcttactatacaattaaactaaatctgccattagttagtaactaagcttgattatatttgataatcagccagatgtacagcggatcttggctatctccgagatatacagcggtgatgcctgcatgacaatcaccggtgagatgaatcaagaactgatatagaatttctccagtctctatgccacggctcagagaaaggcacccgcctgccgccgccggaatcatgctccgcggctgctcctcgtcgccacaccgctcctcctcgtcgtttctgtttcgccggaacatctccgccgctggcccccatcccacggccgccgctcgccaacggaagagaaagagagagggggaggatgaggagagaatgatttacgtgggccccacatgtcagtgggtcccacccatacttttggtgaatgacaaatgagtcccacatatattttttatttctaacatcacctaagcgccacgtggaaagaagaccgagtcaataccgccacgtaggcgccacgtcagcgaaaccgtcctccaaaacaagggagtcaaattgcaccggtttcgagagttagggggtcgagatatccggttttgtaatttagggtcacggattagatttcgatcacttttgagggtcacgaagtgaacttattcctaaatgatattcacattttaaattttgtttttgagaaggaaaaagtacaccgaaggtccctcaacttgtaatcgagttacaaaatcatccctcaaccgaaaaaccagatatatgacatccctcaatttatagaaccgttcactttaggtctctcggtggttttgacactggttttgtccgatgtagcagctgagttagcgtgggacccacgtgggtcccacatgtcagtgaaccctcgactttttcccctcttttctctattctctccctcccgtgcacgcctgaaataggatggagtggcggagcgggcgggcggcaggtagagtggcggcggccggagcagctggcggagcacccccgccataaatcacacctcctccagcatcgggaggacttcctcggtgaggctggcgccaacggcttggccgtgcgccgcgacgtctgcgtcgtctgccggcgtggcgaggttccgctcgcgatgggagttgtggcggaggcaggaaggaggcgcggtggtctggacagccggactacaccaacacgcagccgacggcaaggaaggaggtgcggccgtcgatggggaatccggcggcggagcagcggagtgcgtggacagcgtgtcgatgacagtcatgtcgtcgtggtctgcgtcaggctgggcagcgccgagaggaagaagcggtgcgggtcggcgacgaggtgcgcgtactccaggtcgccctcggcgagcgccgggcatggagaggcgtgaccaccacggcgcgtcgcgcttgtccgcgtgcctgctctgcacggcctcggcgtaccatgactgcagctcgtagtccgcctgcacggccttgtcgctcgggtagtaggccgccacgtacgcctcgctccaccgcgagatcgccgaccagaggcagcccatcggcggcgtacgggtattcctcgatgagcagccggagcccgtgcggctggctcgggtcctccacggccatgcctctgcacgacacaaccaaatgcccatttcactcctcgccggcgcccaacgaccaccgctgttgttttccctaaatccggccaccgccgctgccccaaaccccagatccggagtttcacgccgccgcccaaggctgctcttccgaccgccactcgcttgcacgtgggggccacttctctgagccctgcgccggttgctgcccttcaccgccggagtcgcgactggtgaccaccgttgcctcgccgcgccgagcgttgctcggcgcgagtgagaagagagcaagagagagacagaagaaagaaggagagcatgatgatgtgttcactggtagggtccacgtggatcctacgctgactcagctaccacatcagataaaatcggggtcaaacccaccaaaagacctgtggtgaacggttttataagttaaggaatgtcatatatctgtttttgtggttggggaacaataccttcggtgtactttttccttttgagaatgatttatatttgtattatttttatgtggcacttaataaatatgtttatatccgtggataaatatgttctattttttttgaggaaaaagatgtggtaaatatgattaacaaggtcaactcctttcttttgcattgtactattggagagttgtgtatcatattgcaatacaaaaatacaagatcaattcgacttttcgacctgaatggacgatcaagaaaaccggttctcaaccgtcgatattaaggtgaaggaaacaaacacgcatcaaatttattattcatcaaatcaaaagacgtacaaattacagattgttgttacatgaaatcagcactggtgcgtgggttgtagaaatcaatatcaatatgctacagtactattcactattcaggaaattaaaaagaaaacacaacacatctttgaactcttcagcaacgtttgcctgtgtccagtcaaaagctgctcgaacagcagcaatcaatcaggccatcagccttgttccagcccagacgattagcagagaggaaaacaccctcgtgaggctgacagtgggcccagctgctccgctggtcggataacccggacgctttaccgccacgtgtgagcctacatgggcacatattcatcaaacaccaatgtttagatgaccagtgtaaagcatagtaaaaacaaataacccttccttcagaaatattatttgatatttataacaaatttgattggaattttaaattgccgctacatctccagacgtgacatattgggacggatggagtaatgatagtgattttcaagccgattttactctttttatttcttgtcttaaacaggtcaaaattttaaagatttaatcaaatcttatcaaacatcgaatatatttctaaatggagagttaagagtaactaattagctggtaatctgctagcccaacatttttacctgaattaggagaagcattccccgatccagcgccaccaccagtagcaccgccggcgccgccgccaccaccaccactaccgccggaggctcctgcactgccaccgccaccgccaccggcggcggcgccggcgccgccctggccattgacgttgccgcaggccatctggaagacggcctggactccctgcatgaggcccgggctgtagccggcgaagttgccgaagatgccgttcacgcaccccatcatcatggtcatctgcccgaagcacggcgcgctgcacatggtcgccgccgccgacccgttcgccgccgccggagccgacgtggtggcgccgctgccaccggttgtggtggtgacgttgatgcccatcgattgcaggcacccgttgatcacctgccacaagattaattaatataattaaacgttttttttcttcatttagttgggtgatgagcgaacgtacgacactcaaaagtcactgacactggtaatatacagacagaggagatcaccggccatgcataatttgtaataataatgttaaatataagaaaaaaaatgcagtattactattatgttaattttatcctaagctgaccaaattgtagaacaattgtccacgctgtaattatggaaaaagcgaattgaacatctgataacttattataaaaaaaataaacctttttggctatgagcattgtttgttttcaaaaaaagttaatagtgtgtctatttccataattatattaaaaattggttcaaaaactaagagaagtgctagtttgtttttgaactatatacttccctccattttcttaataattgaaagcaagcactatttatttatggatacgtcactttgtaaatatttgcaaacaataaaaaaagatgatttgttattaaagtgtataacgtcctaagtatatgtatggagcttttgttcactttagtctaaccatctaagaataattcgcagccgaatttcatatagtaaagttaggattgccagttgtttaaaaacgaagaaagtaataattttcaggtatttgactgtcgtgtacaaaatgattgcacatggtgtaccagcctaatttaaacaaaacaatgtaaacatctccatcctttaatatagctacatcgaccttaattttttccaagttgaagtgtacacactaggagttgcttttggggctgaaggtcaatgcttattttgcactagtgacacagtgacaccctaattaaattaatgtttcaaggccattatacatcccaattggttgaactaatataatttcactgaagagtgccttttgcattgatctcacagtatgcatgccacgcactcagtcactttcattctgcatagtttttggtcagtaagaatctctggatccatagaaatgttctatgatgaaattcaaagtgaagagaagagaatggaacttacttgtctattgtcaaagcagagagcagcttgtgccacaatctggattgcatcctgtgtccctggaactactgcaccaccaccacctgctccccctcctccttgccctgcattgttcagataaatacagttacttaattacttagaaccaaacagatggagtgatgatacttccaatgcaaggatcgtaaaattccttcagattatatatgctgaaaaatccctcaatacccctatctggaaacgttaaaactatggcattttcaaatttaaagctgatcatttccaaacaagaccaaagtcctacttttgaacaaaaagacaagaagccatgcatcccatatgttaattaaaagtggatctaagatagattaattacctctacagctggagataccaatggagaagagcaccacagtgaggcacacatgtctgagcttgagacaggccatggcatgcaaggacatgcaactgaatgaactgatcaaaattcagttactactccctcacagcttgagattctgcttctagcacacctagcctgcagtccctctttatatgtgcaggttatgcaactgaattggcaacaaagctgcttataaaatgcagcactggattaaagaagcatggcagccttgcttcttggggaactctggatggctactgaatatgaagcaaaatgtgatcccttgaaccatttggtgagttaatattcaggcagaggcatatggatcactgggagatgattgcaagctagtcccaattgctataaaaaccatgcatgacatgggtaatggccattctgtgcaggtgtttggtacacaagaaccaactacccctcactagtttcctagacttggtcctgtgttggagtgtgcacaaatcacacctaaactggacatcgattaattggttaagttcttaagtttccagcctagttttgttgactatgctggaccttgatgtactttggatgtctcagttgcttccagtgagctttgagctcgcatgagaatgattcgtatcaaattaagtgcttgtttttctaccatggtagacgagttctgtctggttctggtaattgtgacgtatggcttaggttatatgcagaattgaattattgaaatatcgctaaaacggactatactgaaatttttattgatttgatttcttccaaattaccaagcaacgacatagtatatatagctagtgaaaatgaacaagaaattgaaatacaccctccggcaatgaataattgacgtttacagtaagttttggtcaaactttaaaattcacttctatcaatttcatattagaatcagtttaattataagattcaataggtttataatatcacggtagtacttttcgaggtaaatctatatatatacaatttcatttggttttaaactacacatttgagaaactttcgacggtttaaattttaaaactttgatcgaaccctactctaaacgtcaaatatttataaatgtgctttctccatcttaaaatatatagttcaactttgaacttaaaatggcagctatatttttttttagtgatagctatattttaaaacatagaaagttaattaagacgctgatcgggttagcggtggtggcagcggttattaattgacatgatgatgagtcatgggctcatcaagcatgtggagtggaagacatgcgtacacagatcgatgacagtaggcagttccttgtgcttgcggggggaggggactgaaggggatgccaatggccgttgagctcaccttgactcgcctgccgattgttgccaacaaccacaacctgccaagaacgcctctcgcaacctgattcccagctagccgctatctcgcaacctgattgcctgcaccgctagctgcacgtatggaaatacatattctaacttaatatcctttaactttaaaaggtttatatgtgagtcccacagattatggatccacatgccggcgatccatattacagaaccgacgtcggaggagcctctccttgaacgcacttacataggagaaaaatggcttggaaatggactaacaccaactctgccatatctgtttttatatctttttggaatcggaattgaaataaaaaccgtagataaaaaacataatatgatactgatgaatatagatacggagcgaatattgtaactaatatttatcggaatatgaaaatagaggttgttgcttcttctttagcgaagagatgtgcctcactatttttttctaaaacaataaattaaaattcctattttttatcaattaataatatataactagttttacactttacttttcatgaaaattacaataagcaagaactatatattagtcagtacggcatggtctaataaaaaatagttattagacaagagaaaagcatatctaaagcattggtagaaaaaaaaatccattcaactaaccacctcagtactgtgtacaaatctgagcatctaaagtagagaatgatcaagctaatcagctacataaaaataatttgtttatgtttgtgagaaaaaaaatacaaattcgtttttggaaagcttgcaaccgattctggtttccaacgaatattagccttactatattcgttttcgtttttgagaaaaaaaaatctaaatgcatttctgtttccgagaaaaaaaatccagattttggaaagtatctaaccaattccagcttttgacgggcagtagtcttcctgtattcgtttttgttttcaagaaaaaaaagaatttctaaatcgttgttgttttcaaagctttaaaagaaattccaacacttttcgttcgaaaaacactagttgaagccgaaaacttttcgaaccgtttgcaccctacgtgcgtacacgctcgatcgagagcattgcgtcgccaccaaaccatcggacttgggtccgtcagaactcagatcgatcgatcgatgcccgcagctaagctcccaaattaacctacctaggtcgggtacgttcgtgctacctgcctgtacgacgctaccaatcaaattggctactgatcatcaatagaatctactacatgcgtagtgacgcctagcttctctccaaacctcacacgagcctgcatgcaggagctacctacaaacacgaccagagcagagagtgcacacgaatgaatgcgacgcggtaggtaggtccttggatcgatcgatcgggcttagcattctagaagggttttgctctcaattcccggctgatctctcacctaaccatcgatcgatcgagctagctagcgttttacatatactcctatgtgcaagctttaaattgttcactgaggcacgaggcagcacgcgttggtaatatactaggatgcatatatgtggtcactggccataagcgagcagatcgaaaaaacaaccaagaacaagaacgagataaaaccaatctgataaaaccaacacgttacaaatagtaagttggagctctaaataacaacgcgtgctgcaacgtataacaaatgataagttgagacgcacgctgccggtgaatcaaccctattcctacaagcaaatcaaagaaataagcaagaacaagataaaaccaatctaatatagcaaataggaattgaatacaaatgataagttggggttccaaataacaagtagatgggtggtctagccaacacgtgcctgcaagcaaatagcaatggctaaactttaatctaacaaacccaagaaatcctggagaggtacctagctattttataaaggtgggaagaacgatttaggggtccctagggtcgtgcactcgcgctctacctggttaggatgcaccccacatgggccccacttaagccagggtcccaaacaaaattacaatccctctagggcgaggtcggggagcgcgagcagctcggcgggcaacgcgcgcagcgcgtccaccagcggcgtcgccgccacgagcgggagatacaccgacgtgagcttctcgaaggtgtggtccaggtgccgtgctgccacgtgctgcgccgccgtggtcttgccccgtgcgtgagcagcagccgcggtggccggcggcggcgtctctttgcctcaagcgaagtcaggatgcccaggtactagatggccaatggcggcgtctcgtttactctctcttgaggtatcacgcctagtacccaggtactatggtctgatacctaggtaccagctcgataccagggtatcggataccaggtaccaactggtactcaggtactgggtacaaggtaccaggtaccagcctataccaggtatcagaaaggagtcacttaaggccatattgctaaggaaaaagtgcattgaaggtcccttcacttgtcatcgggatacaaaaacgtcctcgaaccgcaaaaccagatatgcggagtcccttaactatacaaaaccggtcacccgaggtccttcagtggtttggacctctgttttggtctacgtggcggatgagttagcgtgggacccacgtgagccccacatgtcagatgtccacgccaccttctctctttcccttcttctctccctttctcatctctctctctctctctcacttctgtgcgagctggccggggtgaggcgggagggcggccccgcgacggccaccggcagaggcggcgtgcgagcgcggcggcttctccgctttctccgcctcctcgccccgctcggccgacgtggggcgcgctcttgtcgtcgcgtgcgccggcgaacgcgtcggccctgtcagcggcgccggcgacgagtacgcgcagtgggacgcggcggtggggtgcagcctcaccggctcgtggtccagcacggcgcgcccatattctcaccgataaattaagcagccaatcgagctagctagacacacacaatgagcaagcaaatgcaagcagccggtggcacatatatatattcccgagcggccggcaaatgacgtcggcagcggcgccgctattagaagtggtagtgcgccttgcagttggcgtcgcagtcgtagaagcaggggccctcgcactgcatctggcacaccagcagcgcccctcggcaccgcctcatcgctgccatgcaccgcgcgtactcccccacccggtacagactcgagttgtagctcggccgccgcccgtgcctcctcccccgccgcgcgctcctcatacccacgccaccgccgacatggccggccttttccctctccgccctgatgcccttgccggcctcgccgccgccaccgccttttttgccacctttgtagcgccgtctaccattgccgcatccccaccagcaccttcttccgccgctactgccgccaccgccacctccgcctccactaccgccaccgccaccgcctccccgtcctccttcgccgcctcccccgacgccactgctcccgccaccgccgccgtcagtgccccagccccacccccatccatagctccaagaactccccccgctgcttccccctcctccaccaccaccaccgtctccatccttccggccggccacagtcgccacaccagccacaccacgctcgcacgccgcctccgccggcggcggtcacggcgccgctctcccgcctcaccccggacagcttgcacagaagtgaagagatagagatgaggaatggagagaagaggggaaagagagagggtgacgtggacacctgacatgtgggaccccatatgggtcccacgctgactcatccgtagaccaaaactggggtcaaaaccaccgaaggacctcgggtgactagttttgtatagtaagggaccctgcgtatctgattttgcggttcgaggatgttttttatcccgactataagttgagggaccttcggtgcactttttcctattgctaattagcccgttaaaacagctcgatcagggcccaaacaatgggccgaatttcggcccatccaaccacgggcttagggaagccatccccctcctggcctcccctatataaactcgccctcgagtccaagccatccccgaaaccctagacgccgccgccgacctcctcccgtgctcgcgacttctctcgacgccggtaagagaaccgtaccatctcgtctcctcgcgcatccgcccaaaatctcctcttcctcctcctgtttctcctctgattcgtttgaccctcatctgctattcctgttctaggtggagtgagagagagagagagagatcggagatggccaagtcgaagaaccacacggcgcacaaccagtcgtacaaggcgcacaagaacggcatcaagaagcccaagcgccaccgccagacctccaccaagggggtgcgtctctttgctccttccctctctctcactctcagatccagattccctgcaatcctgtagccttgccttggtttcttgcaaaaatgatgttttcttcatgtggacatagtaattcactgcaaaaaatttgttcatactgtgttgccttttgtttgaattacagttcgaataatgtgtatatgtggctagaggcttttggaaatgttcgaatgacagttctaggttttccatgttcgaatgacagtgtcggttagactgttattaaaatctccttactattgagttaggcattatatgcagttgtaatgtggttatatgaaaccgtacgagttgcatcgatattagacaggaatttgttaggtgcctatctgagttttcctgcgattaactgtgtcaatttcactgcttaagttctcaaaatggctttctactcctgtgtcacttagccttgtggaattggatattttgcttggttttagccctgccgtttgatgattattagccaaagattaagtccaacgttcattggacccagtgctcaggtagtttgggcaatcgtctgtgtatgtcaatatacttttctggacagtataaacaatttaatcacaagtcgaagcgactttgaatttgtctatatagtcttgtggtgtgtaggaatctattttgttgcttattcttgcatcctattttgttcttaggatttattttgttttcggaaatcaattcaaatgtcctcgctgttatgttgaaattgaatcctgttgccttgtttccgcgttcttacctgggttctttgtaaattgcttttatagatggacccaaagttcctcaggaaccagaggtactcgaggaagcacaacaagaagagtggtgaggctgaatccgaggagtaaggtggaggagccttttggttatgaatgtttcttgtatctctggatctacagttttgaacctatttcactgttctgtaagggcaaaggagattactatggtacttaagttttatcatgcgtagtttggctctgtgcaacccagttccatgctgttggattgcacctgaaatattatcttctataagaattggttatccatttttaaggttgtcttgtttgcattagcacatctcaatattttgttgtgatgcctggatgactggaagtgcttcttgactgcttacagctcgtgattcgtcagaatgtgttatcttttttgtctttctgagtgtatggtattcgtggatttacatgcttatttgaattatcatccccaatccacccgtgtagttaccttggatgtgatttgtcattcactctggttgctgattagcctttaagaacagattcaactagatggatcccaaagcttctgctggtgtataaacttgtagcttgtaggattgtactgtatatcttatgtgaagacgctcgcttgtagcttgtaggattacatttcacattcttggggctaaaataggaatggtgtcatatttgggtctaggaatgtagctgggttccttgtggaatttctttgttcctatgggcattgttaggaaatggagcccaatcttttctttttcaacgtgagcgatttggggaactagaataaccgagtcaatcttagatagtaatgctctgatgttgcacagtaactgaagcaagcctagcatttgcatatatacattagagagtgcaataatgttgttacttgttactacaaggaaaacatgtactactacacatacacaaactctgcaccaaggccactatatacatacacccatattatcacaacattccacagattgcatcctggaccgcggagttggcgcatcaagaggccttggcgttggtgccgggcctcttgacgacgacgacggggcacttgcagtgctggacgcagtggttgctgacgctccccagcagcgtcctctgcaggaaaccgtaaccatggctccccatcaccaccatgtccgcgccggccttctccaccgccccgcagatcacatccctcgggtcccctttctccacccgcgtctccaccttcacctgcacatcagaggagacgagatgatcagtcaatcgtaccaccataagtgtgattcgtgtgtgtacgtcttccatgtaattgactttaggaaaaaaaaatcctccgcttgtaaggcccgttggtttaaggcaattgaatggtaaagtcaaaaaaaatcctccgcttgtaaggcccgttggtttaaggcaattgaatggatattattaacatagacattgagaaaactcgttagcacatggttaattattataaaattaaaagacgaataattagattttctaaaaataacttctagacagaagtttttttttgttagaaacgtataatttaaccgtctaaaaaacgtgctaacggaaaacgagaatgtcaaagtttggagttgagagaaagctaagttacattggggaaggcggtgcagatgtcgcgggccttggcgacgacggagtcggcggcggtggccatgtagcggtccatgctgtccatcacctcctgggtcagcacgtagccgccgccgtcgatcaccgggtagtagagcggccgcgccggccgggcgtggaccaggaccacggccggcggcggcgcggccgcgggggacttggcggcggcggagaccacgttggagaggcaccacgacagcgcgtgcatgctctcctcgctctcgtccaccgccaccaccacccgccgcggcgatcctcctcctcctcctccggtgacgttctccatggctgccggattaattaactctctgatctcttatgtggtttcaattgatggctactatatatggtgacaatctgacactgtgtattgctaatgctgaattgctgatgattgagcaagccggagagctttctatatagaacatggatggatgcttagctgatggcgggctggcggcaggagtaagctagcttcggtgatgctttcgaacattgctgcttgacggttttgcccttcagttgcggaatatctttgggataagtatgagttgaaatttatgattttctagggggcgattttcatgttggtaggaagtttctacagggtaggtagtttggcgctagggacatgtcgacatgaggaccaattttcgcgcaactgacgagttcatttttgttctaaatagatgatgcatgatctaattctaataatattagaaaaaatatccgtgcgttataatagaaaaattattttaatcatcttattattatacggtttagttaatgtgaaattcactataagaatccgcttgaatttgtttcttttataaaatcatgagttgcaattaagagtttgatcgtctcaagtaatcagcatgcaagtttttttttaaagagatttcctatacgactcttttttatttccaaaagcgaatgaacttaaaaccgactcaaacaatgatctatatttctaaaagcgagtgaatttaaaaaccgactcaaacaagatgacataccaaagtaccagtaaaaacatctttaatttttataatagtagagattcgagggtacaaaacgaaaaatagaagatttctctctactattataaaaattgaagatgttttttaccggtactttggtacgtaatttttgtttgggtcggtttttaaatttatctatttttggaaatacaaaataaatcgtataagaaatttctttttaaaaaaactcgcatgctaacttgatacgaaagtcgaactactaattgcagcttataattttctaaaaaatatatatcctagcgaattcatatagcgaattttatcctagttaaatcgtataacaataataagattaaaatagtcttcacccgttggaacacacggctatttttctattaaaagtattataaaaaaactcatacatatagtttttcttaataaatagaagcttaggaagcatgaagtgattacagtagtagaactcacttaggtcccgttcgtttctccaacaagagttggacgaagataaagatttttatggcacgtttttcaaactattaaatggtgtgttttgtgcgaaaactttctatatgaaagttgttttaaaatatcagattaatccgttttctaagtttgtaataattaaaactcaattaatcgcacgttattaccacctcgttttgcgtgaaacacttaatctgatatcttcaggagattcaaacaccatcttagcaatattttgtttaaattctagtaatatgtttcttttaatcccgaataaacggactatatgtattttgacgttgatcgatctttcagtggttgcacattcacatccatctagaaatgaaaataagattgtatagaagaaggttttggttggataaggagaagagggtcacactggtaatttgtttttttttggcaggtcagcaaaactgcgtgctgcggcacaagagtcgccggttttctcttgcacaagcagctgccgatatcctgcaggccgccggactggatagcaattagcaagaatgtacgcacgacaagacagacagacagacagagacctctctcctttgtgctcgcagcgtgacggcgaagtagaaatatctacccacaagggcgaacgtaagattttgaaagtgtgggtattcaagatttatattacaatattttaagatacatatttatgttatatatgaaaaagaggatgtatctattgaaaagtaataatcagaaaaaaaaagacacaggaagaatggggattgaacccaacgcccattaaatgtactaaccaattgagtaattattattattcttttgcatagatggatagctacttttaaaaaacattgggtattcgtatgaatacctatgatcccttttgtgctcgtctctctgtctacccatctacccaattctagtacccagttatccaggtgcagagcagttcaataaattttgagcatctcaaaccgtggctccaaacgtgcatcgcgaactgtttatttgaaatttatcaaaattccattcgaattaattaaaacgataatcgaagccttggacaggatttaaaatgataaaatccgttagccaattgagattgtaagccccggtgtataggatatgcaagtaccagcagaagaaggtggccggccggggtctcatgatcttatccaaactccaaaccaaatggattagatacatccagcgggggagctatcgactcgtcgatcaaaccggccgttttggtcccctgaatagcttggcagcttgcaaagtgaaaatacatgagtgtgatgagtgaaaggggtgagtcatgcaaagctacaaaaatgcatcgatctattcccaactaatggtacacgcacttgcacttggaaagtgagttgggaatgcattatttttactgtaggaatgactgtagaaggggataacgattcttttgtaagacacgcggcacgatcagatttgttatggtaacgagacagatctggtttgttttttttttttaatcttgaatcttgacgagctactaaaagattagcttggcttgcctggctcggcgagccaatgtgagctatattgctagtgttttttttaaagggaaaattacaaaaaccaccccaaatatcactctgagtttaagatgcctccccataagaagatttgttgcaaatccccacctcctaattcatcttgatttgatttaggcacattctctccacatatgcgtgattcccgattcatcggcggcaattcgggatttcaggatgacgaagcgacacggctcggcctcgatctccgcctctccggtctcgcaagtcgcagtcgcgggcagacgaagcgacgcgcaatcgcgcacgcgcctttgccgctgatcggtgattgcatcatcgcacgcgattgaacttctgttgggctgcggctgggctgggagagagagaggggggtggtaagtgatggggccccctctgccctgggccctaggcggtcgcacaaccggcctatgccctgggccggccctgttcccgaagaatcttgtagcgaaatcaactgagtcccactaggcgggagcaagagattatgttgtttgttctgtataagatgatcatttcattgtgttatcatggatattttcactgtgtttttcatggtatactagttatataaattcgaaaccgatatcatgtgtactgaataacaaatccattttttttttcacggacgtaatgagcatacataaacatttgaacacgaagcagtaatcatatagctagattagaactgcatgatttcatctgttgcaattggtcagatgacccaaaatagtaggtttcaatacagtttaataaaaaattaaggccacacaatctaaacaagagacctgttgacaaatcatcacgatgaacgggacttggctaatttcaccacgagatactccaggattcacgcatgtatagagagaagttgcctaaatcaaaccaatgtgaattaggaggtggggatttgcaacaaatcttcttataagagggcatctcaaacttagagtgatatttgggatggttattacaattttccctttttttaatgatgaaaaagagttttcggcctttatttgataggaagctagagccggattattacaagtttgcagcacctcagtttagatcactagaacaaaataaggccaaacaaaaaaatattttgaatatttaaatattcattatatattagcaaaatgggaagtagggagtggtaaagggtatattaagtaagcacaaatcaaataaagtaagtttaaagaaaaagataataggtaaaatagataaagaatggtgttaacatatatatatatatatactgacaagcttaatgcatgatgatgagtacgtagcttacaacttggttcattaagctaaagagtgttgtcttataatataagagattttgtttatttagttatataagttaaatctcttatatatcatagcacgtagttagttatagacagctcaattcggcttgtttagaacccgagtgcattcgtccaaaaaattaaaaaaagacctcgagtttgagcgaatagaaagttttgagtcacccctagatgattgtacttgtttactgtgaacttttaagttgcacttcgaaattttgccacgacttaaaaaagaaagaagaaagaactatgaaaaatggttcaatttcaccgtgaaatagaaaaggtccatggaagaggtctagaaagcaccctcgatcaacttggcccaacctagcaacttccgatccaaagctgatcatatcagagaccgtcggcctggctaggcccagaagcagcaccgatttggagctggtcttcgcagcccatgtccggcccgttcttcttcttctccttgtttttttaaagtaaatttcagaaaagagactatctaataaacgtttgcaagttttttgggtgaaaaactttcaaatgtaaagtagtgtaaaacatgaggttttctggaatttgccctcttttttttttctgttgcggaataaataagggagctcttcattgtctgtcttatccatatgggcatggcttcacaattgtttgatgagattataccactggaaaactggcgaaatccagtgaaatttgaacacatttcaccaaaagttttgaaattttttgaacagaccggtttacctggcgctttctagatttgagccggagtgaatcatctggaaactaacgaatatcaagcggttttcatcggttctgtgaactctgctctggtttaattaaccaactagaccattgtccatcgctctaggcttgctttgcaaataaatgagagccgtctcattacaagaacaggaacgaatgaaagtttacagctatgcaaattcctacccaatctcctcaatttgtcccaggaccacttctattttctgagcgatgacccagatggaccatttacaacaattccactagatttagggaatcgcatttaacaaagaccacctgaaaaatcaattaacccaaattaccttaaaagatatgaacaaaattccagctaatgcattatcatagagtattttgcaactcacttcgcagaattgttgacaaatacatacttttgctgtcataataaatctgtgaagaaataactatattttaagggaaaaaattaacgataaaagtatatttaggactacgggagtatatatattacaccttttgtcggtttatagacactgagggaaagaacacattaggaaaagtcctaaaagaatatttgcaattccatgtaagtgggaaaggaaaaagggaaacaaaagcatttgcaaaaggggaatgcttgtgctcaaaaggatgagtggattatcttatctctgccgtttcatcatgtcatgaggtggcattctagtgattattgcgaccgttactggctctttcattgtcttctttcattgactccttttttattagttaggtattgaggcgtctcaagtaaacaaaaaaagaaattaaagataaaatagttatccaccagctggaaatatatatataaatacaaaatatttatcctgaaagccaaagattacgcgcctaacgagcaaggcgaacgtgcattagttaggctcatgataaatggcagatgagaataccagatgacaaaaggtgacagtagttaggaacaaaatgaaaggttttatctttttctttaacaaatggttggtagtagtaataggccctatttgggggagcttgtcccagttgcagtttttcccaaaagatgcttctgctagaagctgccctaaacagtccacacttctaagaatctgtagttacaaattctgaaaaatgaactaagaagccagaagctggagaagctgggtttcagagtttttttagattctcagaagctgactatcaaacagctgcttctcagaatctaaagctcccccaaacaggccgatagactagtagctggtgggccccatgacacagtcacttggattttcctctttccatgaggtgactgcttgcatttggtgttattctctgccatatataaacaccaccattggtcgccatggagaaaagagggagagggtgagagaaagcagcagcagagcatatcttattgagcagccaagaaagcaaggtattggaaggaattgaggaggagaggaagtgatggaacagcatgagctttcttcttcctcttcctcttctgaaccctcttctccttcgttttcttcttcgtcttcgtcatcgtcctcgtcctcgctgctgaggcagtgcaggatttgccatgaggaggaggatgagtggtgcgctgcaattgagtccccctgtggatgctctggctctctcaaggtaggtacaaagttacaagctgatcaagtgatcatccatccatgatccttccctgcatttcttgtagttgttacatgcatgatatggttcttgtgatgattaatttactagtttgttagtggctaaaatgatgtgtttatggtttgtgtttgttaatttgtgcatgtgcagtatgctcacaggggatgtgtgcagaggtggtgtgatgagaaggggagcacactctgtgagatttgcctccaggtagactcttctttgtgaaagtttgtgtttgatcattagtgtaccatatgacctattcgtgtataatgtgaaacagctagccacttttattggggttagctagaaaggtgaaatttgtgcaggaaaggtgccaaacagctagctccttttttcttgtttatttatgatttgtaattatgtgtagctgtgcaacattatgtttagaggataaagtaacagatttctttggggttaaaagaaagttagctaatgcttctaatcataagcaaagtgcacttttcttgtgcaaaatgtaaacttctgccaacctttcataaactattacactagccgcctaaataagacattctgaaagatttttcatgcataatcctgtttttttaataatacaagatgcttttcttgacagaattttgagtcagattacaccatccctcccaagaaagtgcaggttgttgaaacggcagtcactgtcaggtacctcctccatctcttgcattgtcaatttctgataggaaaagatcattaagataatgctcttaggataaggtgtttctaatctaagcctatctggctagtagtatcatgcaactgtgaactgtcaacaccagtaatgtagcactgtacatgcccttaaacggagtcttaaatcagtaggtaacactctgttttcaaccaaggaaccaaccaatcatgcaatgagagacaggattagcatactaacaaccagtggttgatgagatgatctgtgtagccatttattaatgttaagatggccactcaggtagatcccccaagatgtcctagataagccacaggacccaaccaacaaggcaagtataccttccaaactagggaccacaatgacacggtgacagctcttaagatgttaagatctatcaataatacaagacaagaaatgcagtaatgcatcttggcatattacattggcctgattagtggttctccaatgagattacagagataaagctgcagctcagttttcacacagaaccatcacaacaaaatataaaaagagagaaaaaaaaaagaagcttcagctggcaacatttccacacagaactacactgaccaattgcgttaggctgtgtgaaatgccattatctgaacaaaaatgtacaatagggcatcatgccaaaaatgaccagatagacagccaaatcaaaccgtgaagtatgagctgtggatgcatcggtgaggcgtcctgtcaagagcgtgcgtccaaatcacacggtgtcaatgcacaaatccaccttcccggccatccagcattccagctaacgtggccaccttagtcacactcacatcatcacccggggttgcatcttgctgcaaggtttcagcagttgcaaccaccagatcggattagatgggggacacatgtgccaactcggtacactgcctgatgcagagccttcttttgcagagacgaggagatgctccctgaggaactctctcaggaggatcaggagcagtatgcaggatccgaggcgcagacgggtaatggagactgctcctcatggtgccgatcattgacgataacggtatgagacagctgaagcgaaattgtccattgtctggcaggccgttcagggtgtctcctggattctgatatcatctgtgattcttgtgcagttcaccattatgctgctggtgtggcatctcattgcagtggtgacaattgaagcggcggatcactgtgcattcagccttgtcacagtgagttcactatctcaacagaggagtaaactaatcaattgaaattaactaactggggaatgttgcattgcagatattcttacttcgggctgctggaatcttgttgccgttctatgctatcatgcggatggtccgcatgattcagcagggccaacgacagtttcggttgcagctgcttcaggttagtcttgactgacttctgctcaatggcttataggagcataatagtccgcagtcatgataccttctcttcctctgtttctgcaggatcaacggagaagaaacgcatcaaacttgcacagtatgagtggccaggagcagcaccagcagcttgtaattaatgttcactgaacaaatgaacttaaatgcttctacattggaaggtcacaggaatgtgcaatatgtgttgaggggaatatgttcaacatttgtaaaattttagtatatttgtagatagcatagtaaaaaccatgaatctgcagtctgatacagtttcgacttaccagtgccatggacgcctcaaatatgaatgaaggttcaaataagtgaagattgcaacaaaagaaaaagactatttttttcttttttcttttttcttaatttgtttgtcatgaccaagtattggtgtcaagatggtataaacccagcatttacagaaaactaagctaacacactaacagaactaagataaaattgagaaaataaagtacctaatcttgttcatccaatctaaaagataattttaccactggcagttggagaagcccaagatatgatcagattgaaaaggcacccacacatgacacttgaaagaaacaggttgcatcagtcatgagacaagcaggattcaattcatgcgtctttcgtaaaatctcagctagatttgagaagccagagcaatccgatatcctgaatggatgctgtcccattatcttgatataaattaatatgagaaatccattacactaatccagattatatttcagttaccaggtgtgtttattttctttaaaacaaacgtatatactgtctgtacaagggaccatcaaagaactaaaataatgcccattataccaaataagtcaatttcaacctgatgcagttttccttgaaaaaacgcatacgtaaatttaattcaggaaatattaggacaagagcattcagttttaagctgaataaatctaaaggctagattcatggcattattactattttattttctttctatcctgcataccaaatgtccttgaaagattaatcaaagagtaaaagctaaaaaaaaaatactaacacatgcatcacaaaagttgaaatgtgagcatgttatatctgtcaggtttaaatttaaatcaggacagtaggaatcagaataaattaaattcaccaaacagaaaagtacaatagaatcaaagagcattgctcatgtttggtgtaacagtactaagaggagctagctaactgaatactgtacattaccttgactcttaccaaccaagtgccaagttagaatcaagcaccacatgatagacagaaaggtctcccatgtgctgtgggacagtagaaaagtctgagacatataaagccagataaggaacacaataatacaacggaacagatttataaaacaaatgtggcaaataattacaacgtactgagcttgcagttttcataagcagtgaaatatctacaattagacacgcaaatcatatttgtaatagcatttagtaaaggacggaaccagtgcacatctaatgttgaaaggcacaacaagacaactccatgttaaagaaccacagaaacagagctaaatctttgatcacatgtgaacagatcagcaaactgtaatacacacaacatttttagtaaaattgacaaatctatccccaattgtaaacatatggcaatgttgggtcctttgtttatgcaatggcatagcaacgaagcgaacaaacagccagataattgatctattgaacataaagataccaaacaaggaacttagtcatactacataacactaaaacaagtagccttttgaataagacacagaacatgcctacctctcaaacaagtgagtaatgatgcaaaagtacttagaagttgaagtgtggtatggaacaaacatttattgtttttaagaatctcaagaaaggcatgagctataaacaggaccaaacatgtgacatcttaacaattgacagtgaagactggtgcaatagctctcatctaaccagactaggtttgttgtggggtgattcgctttgtatatagacatatactaaagaatgccattctacagtattttgataggaatttctgacaagtgacagacaatgaagtagacaagatcacaagattcagctcacaggagtaagaggaatgatcatattagtaaactgcaacagagctcaaatcacctttaaactagaatagagatcaacaaacatggaccacatggaataaatctgcataggctcatagctgctgcgagatagcataggcaaaataaaccttagcaactttgctacgaccacatctcaaattgcagtcaagaccaaaactaacaactgcagaacaatgccattcctatttctacaatatagatagctctgctgctagtcaaaaaagagaaaaaaaagcaagatgcctcatacgggtatagtgccattgaccacaaaaaaacctggtcctgcacttgctctactctgcagaattaccaatgaattaggatcccaaagcagggaaattggtcaattttgagaaacaaaataaatcttaatatacagctttctttcagaattaagaacacaaaatatttggacgcaattgagatttgctaactacaaactaaaggcagtataaattgctggatggaaccacagagttgcggctcgtaagttccggctatcttcatccttagaacctactccgtccgtcccaaaataaactaacctaggttgggatggaatataatctagtacaacaaatctagacatgtctctatccagattcgttgtactaggttatgtcccatcccaatctaggttggtttattttaggatagagggagtacacatcagcattgcttaatcataagcacctcaacatacttgaattcaacgatatggctgacagactaagccatggtacgatgcataatccagcataatgagttattgagatatactaacggaacaagagagaaatggaagaggcactcctgaatgaagatttagcgtaacacatgactgaactaaaataaaactaccataggctacatcataattaactgaatcattttgttcacacatgaaaacacactaatatttcatggaccattactatacaacacagaaaacaactagcacctttctcctaaaaagcaggagcaacacctcaaatttcagccaccatcaaagagatccacatttctgctggcaaatggtaatcttagaacgtcctgctctcagtctgattagggacattcctcttgacacgttttttcattctctctgcccactggtggaacacattagacgcatcaaatttacctgtaaacttcaccttctgagccaattcatacaatatgtcaggcttcccagccttggagaaatctgcagcaaacttattgtagtctatctgtggagtcttcatccctttttggatcatctcttcaatgtatttacatgcctcctcaggtctaccatgtcgtatatgcccattaataaacactgtgtaagagttcacatctggacaaatccccttccggtgcatctcctcccacaccgcacaacccatcatgtagttcctcccgccaaggaaatatgacttcatcatcatgttgtatgtatggatcgtaggctcaagtcccttctttatcatctttttatatattcttgccgcatcatctggcatattcctattcgtaagtagcttaatgagagcattgtatgtccgtccatcaggagggcaccccttttgagtcatttcctccaatagggctgtcactctatccatcctctttgcattcccatatcccacaagcaagcatgtataggtggcgacatccggctggcacccaacatcctgcatctcctcgaagcaccgcattgccatgtccatctttcctcgcttacagtggtcccgaatcaacattgtatacgtccacacatttggagcaggcccctttgccttcatgagctcaaacatcttcacagcctcgggccgcctctgcccgcgtagcaacccctcaatcatcgtattgtgcacgacaacatcaggcttcaacccattctccagcatctcattccaaacccgcccagcctccaccagattcctcgcgttgcaccatgccagcatcagcgcggtatacgaccgtaggtctggagcgtagcggtcacgcattctgtcgaacacctgattagcctccctccccagcccctcctgcgccaaagcaactagcaagcaattgaaggactccaccccatcgtcgaagccgtgcgtcctcatcatctcaaacacgccgaccgcattcttgatctcaccggcagcagcaaacgacttgatggcgatcttgaacgcgtccatgcagagggcgccctccttccccatctcttggatcaacgccaccatcgactggaactgcctcgccttgccgaggatgtggaccatcttgcagtacgtgatggtggtgtgcgcgaagccgccggaggcggcggcggcggcggcggcccaccggaagaagcggtgggacggcctgtgcgcgtgcttgaagcggtcgagcaccgccaggacgagcgtctcggagagcggcggcgagagcgcggtgagcgccgcctcgaggctcgcgtcagcgcccgcgcccgcgcccgccgcgacgacgtccgcgatggccgcgcacacccgccccacgtgctccgggtggctcgagtccgcatgcgccggcgagcccccctccccctccccctccacctcgtcgccgtcggatgccgagcaggtggaaacgcacctcgccccacatgccagcggcgagagcagagggagcgaggcggcggcggcggcggaggtcagatgcggtgggggcagcggtgaggggcgaggaggtgggcgatgggggagtggcagtagaggcggaagtagacggtgagggcgatggaggaggcgatgagggcgaggaggaggagcgtcgcgcacgggcacaggagcaccgtcgccggcccgggttgccgcggcggggagaagggcggcggcggcggcgacttggaggtctccatggacggcggcggcggcggaggaggaggaggaggggaggaggaggaggtaggtggtgggtttgggcttaacggccatggacggggatcctgccactgcgtcggtggaattttggtgttccccttcctccctcccgtcttccactgttccgctgtaaaaatgtaaaatcctttttcggtgctttgctgtaaatacctaaggcatccgcaatgttgtgtttagcgggtataagtagcattagatactcttttttcttttaacccgataacaatacagtaagagcaagtataatgagctatatgcctactataagtttatgtggagaagagatgtgacaaaaagttaagggtgttggctttcataccagagctagcttaacacaagcttcaaaacaaatacaattaatgtataagtaagagatatagagaggagaagaaaattatagccaaccttatagctaatctattatatatgttggctttaagattggctaatagtaggaagtgagctctattattatccttgctctaagagtcataagtagttacttccttcgtttcacaatataagttattcagcattttccacattcatagtaatgtcatctagattcattaatatgaatgtggaaaatgttagaatgacttacattgtgaaacggaagaagtagaacctaattacacaggtacaatcaataaagaagagttaaactacagtgtttctgacaaaaaaacaattataaaagggagctggtcattgctttccaaccgctgttctagctgttgcttcttgccaatacttcatgccattttacagctccatactctaaaaaatacttatatgacttgtaacttgttgaatcaaaacatatacattctatcaaatagaagagatggatccctccaacagaagtttataaaagaattgcaggcatgatatttatcatatacttcctccatcctaaaatgtagctacttagtatgggacgtgataccacctagtactacgaatctagtactactaaaatgtaactaaagacaaatattttaaaaatgattcataatcaaagattttaaagtttgacctcacccttatttaaaacgacaagtattatcagcccggagggagtatatgaatctaatcggtggcaagttttttagtcaagatgaattaaaggacaaatattgagccgaacccatacaaccactctcaccgaaaggacaaatattgagccgaacccatacaaccactctcaccgaaagaagagaatagttgaggccttatgcaattagcaatgggttgaagacatatgacacaatatgacgtctgcccttctcgaggaatactttgttacatggcgtgttggcacgcccaacttacagccgtcgaaagaaactaaagacacaataagatggaagtggacaaccatgagaatatagtgcaaagtcagcatatgaaatacaatttagtagaataattgaggtggcatcatgcagtcaaacttagagaacatgaatacctaccaagtgcaagatatttgtttggtttatattcggtattcacgtagatgctagatgccagatgaacaatgacccatggtctaggttggagcaaagtcgacggtgacaaattatcagcaaaggagacgatgaaactacctatggcagtgacaaattatcagcaaaggagacgatgaaactatctatggcagtgagtaccttagagcagaggagaaacgtttggaatgggtcaaaaccctaagccacatgggcgttgagcagggtacaaagtttcatctcgtgccacacaaaaaatgcattggtccatttcctaaaccatagtctaaatgatagttttacagtttacactgatcccaatgttttctaattgtgtggtctagttagtataggaccgtttttgactgactagatggttaaatagtctaattcgcaatttaacttctaaaatggacgagaaccgtttgtctagcatctagacacggtctagactgtctagactatggcttaggtgaacattgttcactagcacgggatcggttatctctaacgggcttcaagcctcatctctttcgggtaaggcccccgccactaagcaaatgtcactggtgtgagaaaatatctcaatcgggcaccaggccatcacggatggatgttatctcaatcgggccaacaacaaagcccgtcacagataagattgaccaagcaatacgagtcaaaccaggttaggtaggagcccgtcatggatgactaatcatctcaatcaggccttaaggaacagcccgtcaccgatagttttgacctacctgttgagtcaaaatagtcccggtttggatgacttatctctatcgggcttacaccaagagcccgtcacagatgactatatctctatcaatctttatttagagcccacagatgactatatctctatcaatctttatttagagcccacagatgactatatctctttcgggcattttaaaactgcccgtcatggatgattatgtcaacatgtactgcgtgtatgttccatacagtcatagcaagccttctttcctttcacggtttatccagaaagattacccagtgcgggataatcattaatggtgcataacaatagaacttgtagcttgaagttctcctgaccatatgcatcccaagtttccacaccttctttctagagaatctcaagatcattgataacaggctccaagaacacatcgatatcattgccgggttgcctcggaccttggattaataagcacaacataatatatttccttttgaagcacaaccatggcgggaggttatagttcgcaataagaactggccaagtattgtgagaactgctcatgtctctaaaaggattcatgccatccgtacacaaacatatcctcatgtttctgaggtcggcagcaaagtctttgtgcttttgatcgatattcctccattgaatcgaatccgcagggtgtcttagcaaaccgttgttccttctctctgtggcatgccaacatactaactttgcttccttggggttggcaaatattctcttgaaacgatcaatgatgagaagatacaacacaaccttcgccggaccacctcgcttcgacttctttccctcccccacacttttctttagcttgtatcaagaagccttgtagacaagacaaacatctaagtccgcatattgtttgtggtacaatatgtagtcgtatggacaagcgtgaattctacggacctctaacctcaggggacacgaacttgctttgcttcatatgtcgtctcgggcaatgtgatctcttcaagaagcatggccttcaatattcccaaaagttctgtaaaactcttgtatgcccatccactacttgccttcagcttcattaggttcaaggtagctgacaatttggtatgtttttggcttgcatctggtgtatagaggtgtctccgagtcactaaccaacctgctgaacttcgtggaatctctctcgttgtaagttgggtcctcgacgtcacgtaacatgtcttgcagcagatcagggtctacattaaccatttcaccgcccaatggagatggtataaacatgccatgctcatcttcatctccttcttcatgattgtctgcaccacttgtctgcaactacaccacttcccgatttttactctccatacttcacccaacatgtgtatcccttcatgaattcccccgttgtatgaagtgagagtgtacgtccattctgctttcaaacatattctcattcttgcaatctctacatggataacacatgcatttgttgtttcttcttttcctatcctcctccgcagcgttcataaaacttaatgcgccatttctatactacttgcaatgacgcttcaaagtagtcgcatacatctaacttcgatccaccgctgcaaaaatgaacaaaatattagttaacatcttataaaataagtactactaaattaataagaaattattagtaactttttacttattttcatgattttcctgcttttctttggaaaaaaaatgataaaaattcgctcccttcaatctcccacaaaaatagtgaactgtgggagtcagacaacagacaggtggagtatttatagtgtgcaaaatatatctcaatcggtccaaagaaacgagatttctaacgggcataaataaaagcctgtcaccgatatgaatcatcggtgacgggcgttaacctcatctcaatcgggccttatttggagcctatcaccaatgttcttcatcgctgacgggcttagtagttgggcccgattgagatataggaggtaatttcaatcggatctaacagtgtgcccgtcacagatgagtgtcatcggtgacaggttataggtatatacacctcgattatgtatgtacgagtacatctataacaatgttaatttaggcccgattgagatgactttgttctgacggcccacgaaacccaagcatgtgaggggccagtggccaaataactattcctattagctgtgcatgaagaatttgaaaatcgctaaacatctgattttggagtgctcggtcactgtgatgtatggaatgaaaccttcacaaagttgcatcatcaaatgaacaacacctaagaccatagcagccttcttgactagttactccctccgtttcagtttataagacgttttgacttttgtcaaagttaaactattttaagtttgactaagtttatagacaaatatagtaatatttataatactaaattagtttcatcaaattaataattgaatatattttcataataaatttgtcttaggttaaaaatattactacttttttctataaacttgtttaaacttaaaagtagtttgactttgacaaaacgtcttgtaactttaaacggagggagtagaatggttgtttcatataacaagtatgcaacatattccgcgcttgctgaaattttgaagcctatttagcgagaatatcttgacatggcagtaagcctatttaccgttataagagtatgtacctatacaaatcatatataccatttggcaacttgtactttgtttcttctgagataaatagaaggcccacttgcccaagctgttttttttttaaaaaaaatctaaccagatagagcaaacatgtgacaaaatttgaaggaaattcactctaaatttctatcaaagaagattagcaattatgtttttttcctacattttaattgcacgggatgggatcaaagctatgggtgtaatcttttttatcgtttgtcaaatgcaggccaactcggtatctatacgtccaactaaaatggaagatttttgctattttttatttttattttttataagattcccgtgtttcaaaggagaccaaataaaggtcgctttactcaaatcaaccttataaaattacattccaattttacataaccaggtggcaagcacaaagtaacagggtaaccaggtatacattgtgctggtaagcatacattaagctttcacccaaagaaatggtactactggcgaagtgagcatagcgtctatatttgtactgtttctaaaaaaaaaaaagtacaactccatttcataaactcatgtaggcttggatgtctactttttatagtggtgttcgggagggagagaaggttatgaacttctatctcacgcatgtaaaataggttggcttattagtgcattaacaattaaatattagctataaaaacttaaaatttagattaatatgatttctaaagcaacttttctattagatttttttttcgaaaaaaagtatttttgagtagtttggtaagcgggcacgtgaaaaaaaaatgagggagtataaattaggaacatgtaattaaaaacactctcaagcattgatggaaaccgtcaattgagagattttagcaagcagtcatctcgttatttgttttaaaattaaagagagcaaaatggacgtggcaggattgagcagataaaaaaaaatggatcacggcagtcagatttcaagaattacatattgaccatacatgattgcttttttgtgcaaattatatctgtattctatcgtaccaatatcaaatgataatgtgcacaattcctgttaccatgaactatacagttaattaggatcctacgttggaaaattaagtacagaaaaacatctaaagtgatccctccaaacattagtctgcaaatcagaaaaaagttgagttattcacaaataccaatttgaataagaaaaaacaacttttgaaactagcaaaggatgcaaccagaaagcatcaaaacgtgctattgcctaatgcaagtagacctcaacagagcatgtcatgtcgcagcaaattagctgattcatttgtgtaagaaaacctcacctggcattcatcacaaataatccagaaaacttcttgtttggaggagaaaaaaaaaaccactttggcatgacaaaatcttcccatcaagctttaaaaactgcctgcttttgagaagcgtcctatccaagacccaattctgtataaataaacatatgaacaagacaaagttgcagccagggatggatctctcatttcatggccaatgatgccgctgacgcctcagctatcaacgagagaggctgacgagcttggaggcaggcgccgatgtcaaaagggtgaatctcagctccatcaaatataagattgactccaggtaagaccacatctttggtgtctgcatcatccggttctggttttgctacaggtgtggtgggttggtcctcagtgacagatcttgtggcagcttcatacacaggggcgagagcgtatgacctattagagttttaaatttagaatggaatgatccagtggcaaaattaacattacaagaatcatattaacctatacatcacaagaacaatgtattgagttgcatactgatacacctgccagttcaacccaaaagtttaaaccgatgaggaaggacggttaattcactttaccgctacactatgcggtgcagttctttttatgtatagaacatacctgaggatgctcccgtcgaagcttagaacttcagtgaagcatttctgccgtcttgcaactttcagtctgtcattctcacggggggatcctccagtggttggcgccactgtgtcatgaaatggactccatctgccactgacaatgttgattagttggcgcggcgagttctttgaactgcccctttgattgaatagccttgctgttggaccagttgcttggtactcagcacaaagttctctcagcctctttctcacattctgcattgcctcgtaatgttcagtgaggtcatctttttgaagcatgtgtgactcgatgaccctttcgcatattttttcacataactttggattgaacagtggaattccaaattccaggctcaaaggtatccactcataattttcatcctttgagaaaatttcattggatttgcttatcctgtgaagcctaactaaactaagataaccaactgtgcccaactcgactctactggacagattatataatagcgaagacaaatttaatattttctcctcaggtaaatccatgctggctactgtggatgcaattgacccatcagcatttttcaggggtaacgggacatcaacggtgacaaggtttccagtttcatcaagatcatttaagctcaatggctgcactataacagcagaatgctttgtcattgagttcaggtaatgcagcagaaggcttccctttactaaattcccttcgaactttcctcctaatccacccaccacagattgatcccaagaccatatcaacgccttttcgcagctggctaatggttcaggcagcatcctcaaacggtgtcctttcataaacacagcagatactgggccacaactcccagatgtatacagtgcaagcttcatccaaggtgtcatggaagagtaagaaggtggaccaaaatgtactaggccggcagtgctgggtagaagtactgatgaatatggaagaggaatcatagacaccataatgtcatagtccctgacaagtaatctttcaagtgttgttgcggacagtgaagccaagctctcgcagcgaagaatattgatccggtaacttcttttagttttcgacaaggaactactgtcagttgatccatctggtagaggggttttgctcgtatcagaatcatttttgtctgtgctttccttactttcagagacaatacttgagggtgatgatgtactcgcatctgcaacatctgagtcaaccattgggtggtctgcttgtgacagttcattatgatgatcagtatctgcagtgtcgacggtttcaagtgaacctccattactcttaacaacattactaatgccctcatcaatgctttccttggataaagttttggagaaattctcctgcaggcagaattcctggctgttcggttcaatagcttcatctggtgatgtccctccagacagcaaacactcaaggaagcatctgaggctaaaagcatgatttgcaaattcctggagcacaccttcaaacctctttccttctaaactagcaaggtccttgcatagatcagcaatgcaagaatcaccaagctttccggcctcgtatagtgtcacagcatgagacttcagacctgtgatacgtatgtgagaaaattattaccaatcaatgacattgaacagttccctgcctagaagtagaaaattagtaacaaatggaatataacctggagataatgaacccatcatcaagtacgaagttacattggcatcaacaatgaaacccacataagaagccccagatattctcctgggtccatcggaatcactggtgagcaatgcatgacctgacctttctgagttgatactcgtaagtgaaccttcgtcatcatcactaagaatattactaggtattgtagatccatttgaatctctaagaatggagtctgcatccataagctttacagcccaacccagtcgacaagcaaatgatgcagctgcctgaagctgatacaggtcagcctgcaacgttttagccaattcagcaactgtagcattttcacttgatacaacaaatacagcatatagtagtctgcaaacaagaaaggcgtaaaatcattttaatagctacagatgattcttgcaatgcactatagtttaatagggaatggagctcagttgtgtggaagaatactcaaggcaagtactcactcttcaattggatcttcgtaagactgatccttatttgacacaaaaccttcaagccttgatactgaaacaacaggacaagtacagaactgaaccaattggcatttagggagaattgagctgtgttgtagtttcgtgtctacagaataataccctcaatatacacacactgttagtgcctctaaggatgttataggtttctaactgatattgtacttatcagcagtttaccgttacaagcttgaagcaactgtgccattgaattataggccaatcctccaacaattttatgctaaaccataataatagaaatcatacataagtatgtaatgacatagatttctccgaaaccatacctctgaaacggtcctcaggataaacagccacatcgaagtataccattcctctcttgtaaagaccatttataaccttcggatcaaatagaacataggaattatcttcgtcctttgatattttatctattgctgatgcctctgcttctgaaagcctctacagtaaagtaatattatcaattaccaaaaaagaacaaggtacttttgaatcttagagagaaataagtttaactaacactgttgtatgccatcatggtaagaagagaaccacaaaaaaaaaaaactcgctatatcattctgttaaaagtacaatatccttgcacaaagaaaacttgtcactgatgaacctaaccttaaactcttccaatgtgaagttgacaaaccgaactccccaccatggttctattgctaggtccgcagggagtgctggcagcagctctttcgcaattgatttgctcagcttccacattatcttctgacataaacgagtggaacaaataaaaatataacagcgagaaactaggctagatatgttcattttctgaacatacgataagcacttgtgctgcattcaaatattacagtccattcctacatcacagtaataatgctaaaatattcccgtggattcactaattaaatcttgtaccctggcaagaatataagaaccaataatatcatagacgacagatcatgatatggaaggtaatgatacctttgatctacacttgttcataatatcgataaattcatttctcccaacacctgtgatcctcagggaatcagcagcactgaagtttggaatactgtcatatggttgctctgccagtattatcaacaatatacaaatataaagaggtgcgcacaaaacataagtctccatgatgaagataaacggattgtaaaattgttgtatagtaaccatatatcaataaatgcaatatataaactcaaaaggtaccacatattacaagctagaatcagaaacgtattgtgaagagaacaaaaggttcctccattttaaatggtataaactgaaaccattttaatcaggaaagctttgtcagatgagttatcctctgaggactggaatcagagatatgagatggaaaatgaactagaacacatttatgagatggaggaactctattggcataagagatgtggtgaacaatggatccttgagggtgatagaaacagagttctttcacagggttgccaatggaagaaagaggagatgtactattacttccttatgggatggagacacagaactaacaactaagtcagaaatcaaagaccacattgtaggatactataaatccttatttagagctgaccctccttctaatattcatctttcccaagaggtttggagagataacttttgcttatcaaatgcagctagtgaacatctgatcagaccctttgagattgaggaattagacaaaataattagagaaaccaagctaaatacagcacctggcccagatggttttagtgtacctttttatagagctttttggccccaagtaagaaatgacctctatgagatgctgattttgcttcacaatgaagaactggaccttaagaggttgaactttggtgttatctctctgatcccaaagagtagcaatcccacatacattaagcagttcagacctatttgtgtgttgaatgattgtttcaaatttctcagcaaggcggtaaccaatagattgacagaggtggcaaatgatgtcatttcccccacccagacagcctttatcccaggaaggtttatccttgaggggtgtgttattatccatgaggtgctgcatgagatgagaaccagaaatttagaggggattgttttgaaaattgactttgaaaaagcatatgacaaagtgaggtgggactttctcatagaggtgatggagaggaaaggcttccctactaaatggattagctggattaaaagctgtgtgatgggaggtagagtctgtgtaaatatcaatggggagaggactgacttttttagaacttttagaggcctcaggcagggagatcctctttctccccttctctttaatttagttagtgatgccctagctgtaatgtttgatagtgccaaaagggctggagttctcaaagggttagttcctagtattttccctggggggatcacccatctccaatatgccgatgatactgttttgttcattgctaatgaggataaacaaattgtggcaacaaaatttattctgtactgctttgaagaaatggctagtcttaagatcaactttcacaagagtgaagtgtttactttgggcatgaatgagattgatactttgagggttgcccaaatgcttaattgtcctgtgggttgttttcctatgaaatacttgggccttcccattagtccagacaagatccttaaccatgacttcaagtttttggggcagaagttagaaaagagactaggtacttggggggctggagacctatctcatgctggtagagctgtccagatcaatgcttgtctttcttccataccctcatatgctatggggttctaccagctaccagagggtgtacatcagagatttgacaagataagaaatagatactactgggctggtaataaacttaaaggaaaataccatatggtcaagtgggaggatatggcttttccaaaggactttggaggtttggggtttactgaaaccagaaagatgaatattgccctcctggcaaaatggattattaatattgaatcagatgatcagagtttgtgtttagaggtgctcagaagaaaatatctgcaagagagaggtgtgtttcaatgtaagtctgattttggctcccaattctggagaggcttactcaatgttagaaagtggttgaacctgggggctgaatggaaaattggtaaggggtctcatgtctacttttggaaagacacctggttttgcaactgtcccttgagtgtgaggtacccagctgtgtttaggatttgtaatcaacaagaggtgatggtgtcccatgtagcccaaaggagactggagtgcttctcttttggaagatcctttggacctgaggaactgactgaatggggggaattaacaaaaaccattgatgatttagaggtgactgatgaggctgacagattgctttggggattagcaacaaccaagagatacacaacccaaatcgatgtatagaactctgacctttaggggcttgagggaggtgaattcagatatgtggaaaagtccatgccctacgaaaatcaaacattttctatggctagctcttagagataggattcagtcggctgaacaattgaaaaagaaaaaacgggagggatctgagtcatgtcaactctgtgggaatttagaatcaactaatcatattctctttaactgtgacatggctaggttaatgtggtgtatttgtagagatgttctgaactggaatgtaattcctcgctgtttcgatgatttcttccttttgtgcagtagtgacactaacccttcctccattagagtttgtatgagtatgcttgctgctgtttgctggaatttgtggctgactagaaataatatggttttcagagatagattgctttactccccactaaccctggctttccaaattgcttctaatcttttgcagtggaggaagctctgtcaacctgaggatgtgccgaagctggaagtaatggtggataggatcaagtcagttgcgtcaagtctgaaaccgcagaggacgggtgttggatagtttcctgatgtcttgagtccctttgataagtgatgttggctggctgctagaacagcagactttgatattcatactgataggctctttagctacggttctttctcccgctttttaatctgctagctgatggtctaagtagagttgtcacgatcttttgctagcccctgttggctcctgcttttctatgtcttgatgctacgatgtatgctggtgtccccagctggaacactgcctatgtggctttctataaaaagccgggtctatgaccttttctaaaaaataaataaataaataaactgaaaccattttaaatagtataaactttttagctgattaaaattcacaatcaagtagaaactgaaactatagccaagcttacgtagttgtcaaggtgaacagaaacatttttagtagtataagttatgagtgagaaatca

SEQ ID NO: 65666 - DNA, 36614 bp, Oryza sativa
ttcctgcagcccggcaacgacgacgacgatgacgatgggccgggccacgacgacgacgacgatgactacggtgaccacggcgaccggtgacgacgaccatggcaaccacgacgatgggccgggccaggggcggcggatgtgcggtggcgggagggggtggaggggccacgaccggagggcctcctcctcctcctcccctcccctcccctccctctccctctcccagatctagccggaggaagggagcggcggacgcagcggcggcaatggcaggcgggcgacgacgattttaatgtccagtttgatgtttatttgtattactgtttcatatatgcatgtattgatgcttgtttgtggaaaatgaagtgagaaattgatgtagtgttcttttgaggttggatctgatgtggatttgaattgttatggatttgagatttggggatgtggatttgggaatgcaggtagcaacatgtgggcatatttatttttgctggcggctgaagggaagctacataggtttttttttctcaaaatagattatctctggtggccggtataacacaacaaccaacaaaaatcgattatcgctgacggccggtataatacaaccgctagcgaaaatcgattatcgctagcggccgataaccgctagcgaagatcaatattttctctcgcctttgctccgccaaggaaaacctaaaatggccgccacgaaagatgatttccgtagtagtgtggagtcctctttcgagcagatctgattttatctcaaacttccttgtgagtcaccaacaattaaaataataaaatgttgcgccacctatcatgggtctttgggcttataacttagtttaggtccccaggccaaatggagcccaagtaggctgcatcctaacttgctgatgtacgaccttaagggttcctttgctgtcctcccacctcttcacctccttaaatagctagggacctcttcaggttcttgggttttctttagattaacgtttagtcattgttacttttctgggtaaagccatgatcagttagatcatacctttctttttatggaaccctaagccgtgatcccaagtagccttcatggcaaattttcttatttctttcacttcctagctagagattaacatgtcagcaaagaacacatcatatcaattttgaacgagtaattttatggttctttagaatgtaccaggtgggtatagcacattttctagcaactacaaattagactagctagaaatttgattactgatcatgaatattctatttctataaattaagaatggtttttttttcaaatgataaattaagaatggttctagtcagaaactaatattagatagtcttttgttcccagtaactcctcgataaccaaaaaaaaaatcaaacaaaattacataaatatgtacatgtgaataatgtacattgtataccttaattacaattctggtcccacaacttcatcatttatcatactacaatacctgagcagtctagctacagcacagccactactcccaatatatacataccaccatgcatgtatttttcctgaaatactggtacagattacaagttcatttttcatttgcccattttatgctataaaatgtgataagaatgagaagtcccaggaaatcgcaaaatcctcgtgccaacgagccaaaccgggtgcttgatgccgccagctgcatcctactacagctgcatttctaatttttagctgcgcgcctgcgccagcttactagcatccagcttactagaatctgtttctttctttggctgtgtttagattggcccaaagtttaaaatttggttgaaattagagacgatgtgactgaaaaattgtatatatacgaaaggtttgatgtgatggaaagttggaagtttaggaaaaaactttagaactaaacacaccctttcatccttttgcttggcttaggtctagtttgcaggagtaggctggctcgtccttgctctgcgcttgtgctaggattgtaaaaccggatgcgccggtgaacttgctctggctgtcaagccgtgtattcagacatctgttatgccttctataaagttgggcagtgagccttttctctaaaaattatgtttgccaagattttagtgaaaacggaatgtgtattaaggtgttgtttggatccgggactaaattttagtccctgtcacatcagatgtttgtacactaattagaagtattaaacgtagactaatgataaaactcatttcataaccctggactaattcgtgagacgaatctattgagcctaattaatcaatgattagcctatgtgatgctatagtaaacatgtgctaattatggattaattaggcttaaaaaatttatctcatgaattagcttttatttatgcaattagttttattattaggctacgtttaatactttcaattagtgttcaaacatccgatatggcagtggcttaaaatttagtactgtatccaaacgccacctaaaccaagcatgcagatcatgtaatcttgggctggatggatgttaactaaaatacattggtttctacatcaaaaagccatactggtttggaacactgttcttaaatcagaggtcataaaggttcattatatgctttaaaaagacactttaagagagaaactgccggttcgaaaaaagtacaaaatgccataaacagatgtgtttatgtgggaaatcttcaaagatcaaaacatggaaaaactaagaaatgatttaatcagaaaaactaaactaaaatattttggcatataatatatacttaaaaaggaaaaaaaattaatgttttacactactaaactttcatcggagtccaggaaaacggtctttgaacattgaaatcatgcacgtgtaggagttactccctccatattgaaatgtatgacgatgttgatttctcaacatagcattcaaccattcgtgaatgtgaggtaattatatattggggtgtttagattcaggggtgtatagttttaaagtgtcacatcagatattatatagggtatcacatggggtgttcggcactaataaaaaaactaattaaataatccgtcagtaaaccgcgagacaaatttattaaacctaattaatccgtcattagcaaatatttactgtagcaccatattgtcaaatcatggagaaattatacttaaagattcgtctcgcaaattagtcgcaatctgtgcaattagttattttttagcctatatttaatattttatgcagatgttcaaacgttcgatgttggcataaagttttgggatggaatctaaacagggcctgtgccagtattcactgcaatgtattaccacaaacgctgtgaagaagtacaaacatatgaagaagtacatccaatcaatttattcaagctttacaaatgtggctggttcgggctgtcttccagcagtttgatatcacacctaccgaacaactggataaatttcacatctattaacaacatgtcctccattcgcaatttttgtagaaatacttttatcatgttcttcacacacttcagtgccctaacttgattcagttcgtttccaaaaaataggctttacacaccacttgcaacagtttctactaatggattaggttgagactgaaatcccacaatcttttggcgaggcccatgtcgagcgcatgagattttaattcagtgacattgcagtcaacaaagtatttgccagtgactccagcaacctgaggatgcaatgccacatagcacactgtggctgcaccctgcaaaaacaaacaatgctaagcagtgattatgtgtttggatagtttgcacaattgtttgttggtaattggatggtttgcacaattaaacatgttatgaattactgaattagtaaaatttcaaggagactttgtcctggtgccagttagttcatggatttaataacattaactctacaaaaaatagtccctggtagagtcatggtaatattgcagctcctgttttttcaggttgcaggaagatgttgaatgatataagcaataaatacattttttccatatttatatatttattaggttaattattccatgatacatccaattatttaggagcagtcaaaaagttttagaatgtacacttaccactagtactaggattaaagttttagaattattttgtgtgtttctgttgaataaaatgtttcagaaaacatatgtaatgaaatagacataaattgcatacacaataaaatacaaattgaatatacaataaaatagtgaatataactgtcacaagaacatatgtaatgaaattgacataaattgcatacgcaataaaatacttaaattgaatatacagtaaaaatagtaaatacaactctgtcactttagtcttgtgaaaggaacagaaaaaaaatgatccaaaacttacttgttcaacacctttaacgaaaaatttaccaagtgtagatagcatacctgaaattaaaaaacaaggaagaacaatcactgtgcattgtttccagttcattattcattcaaataataaagcacaaatgtggggcttttacaatttgcactggacaaccatagtgatcttcgatgaatgaaatatttctttaataaggtaatgctctcaagaattttttgtatatggaatgatcatgcactttaatgaacaaaaaagttctggaaaaactctttatacaactggaagagaagtaaatcagattaataggctagaaagaagatgtatccatgcaattaagataatagtgatggcaactgaagcctaaacttatgtgactacatagaagaaatggatgtctcatagctgtactatagatgaatatgagcacaacgaagcaaaaactcaactagccagaaagataaaagcaaatactgtctgagattcgatgaaccatccatgaagattgatttagctttattttgccaagaactatatgcatttgtcagatatgcccataccatttacgaaataccagtgacgcataatgttggtgacaacagctccaggatgcagagagttgactgttacttttgcatcttgctccttttagcagacaaacattcatcatcaagaaaatatgtgaaactttttgaaatagtaatgcgatcattgatatcatctattcacagaacagctccataacaaaaataacagggctttgacatccatcctctgcatagctttgctattatgagatctattttgtgataacttcatattactgtctcagccaaagatctacatgatttagttaacagcatgtctaacatattacagttagtaatttcaagaaaaatagcctactacaatttcttttccattttacaagattacaaaattgtgtaattttgaggacaaacagtgtgtacaattaaataaacaagagttagtgtgaaccaccagttgttccaaatacgagcttaaaggaaaacaagaagaaaagtggaaccttcagattgctagatagtaaattggaatgcagtatgttggcaagcttggattggccgtaagcgaagattttgttatacctagcgggagagaataaaaataattaatttcgaatatgatgtttttgtgcagatctgttttcttacctttgatcgattgaaaaggtaaacaaatgtaaaaaggagtatacgttgggtcagaaagtaatacccagattcatcattgatcttatcaaaacgaatcccctctcgataagggtgcttgtagctgttagaagcaactatcacaacccttccttctatcccactttctatagctgtaactttcatcttctcaagtaaaagatcggtcagtagaaaatgccctgcattgcatgattaattgcacgatgcagttacacaataataacagaaattttgcacgtttgtaaccaaacatggttacaagatcagtcaagtgaaatatgaccacacacaaatgtgtaaagtacatctgtcttagtaacaaatagaaaataaaacaataatattctatgaattttggcaaaacctacttaaaataaaaaagttttagtatgcagtttaagggactgtaagagggggcctaccaaggtgatttgttgaaaaatgcagctcaatgccctcctctgatagcttaaatggtacaaacgcaatccctgcattattactttaaacagagaagactaaaactattttctcaaacataaaatggatgacgtattcctcgccaaaaaaaggcaatgtaaaaaaagaacacttcaacatagatggaataaaagttttttagtagaggtctgatggactgttttatcttccagaaaatgactgtactaatgacataacccagtaatacataaatactgtctattaagcatgctttgagtgtctgaatcccaatagccagctcaaatgctcattccagtttatttagcacccaaattctctatgttgcagaaggttttgctgctacaataattctgtaaaacagcataatgttttttttttctttttgcgaggaagcataatgttttgttctaccaaatatttccaatatacataaacattagatctgcttacaccaggatgttcagaggaagattcagagcattgaaattctccgcaaatctcctcacagaagacatcaagctgaggtcaagatccagcatctcaatctttgcagccggaagctgtctcactatctcatccctcacacgcgcaccggcagatgagttccttacccccatcacaacatgcagtccccgcatcgcgagaactcggcatgtttcagcaccaatcccactggaggcacctgcaagaaacatctccaatcagcaactattccaccagcatttcaggccttcagtacaaaattcgattaacgaagcaggaattggagcaatatgcaagatttactcctactgcttgcatcagcctgaagagtaaatattggggaaaaattgattaatggttggtaaaactataaatacatttagcatataaatcatctttcataatttccccccagatttatctactgcaatatgcaagatttttatacaccgaacagtaaactttgccaatttcccctcaaatcgaagagaatcactaaattcctcgagcaatttcagttcagaccaacgattcttggattcgagcagggaatgttcagaagaaacaggagtcaaccgagaaccaggggacgctatgaagtatgaaccgaaccaagaaacgaccagctgctggaggagagatgagagtacagttcacttgccggttacgacggcgacgaggccggaaccgtcgacggcggcggtgacctcctccgcggtggacgacggcgagaacccggaggggcttcgccgcctcagtaggccccacattgtcttgtgctgccgtgggaagtgggaacagcttccggccggtggcttaaattaagacactcaacttgcttaaatagaacgtttcagcttccaatcaaacgtataatactcctgttttgtaagacgtttcaattttaaatggttcaactccatagaagttgacgaatggctattggtcaatttgtaaactcatttgctccctccgtttcatataataagtcactttgatttttttaaaaaagttagaagtttaaccaaatttacggaaaaaataacaaaacttataatgtaagttagttttattaaatttatcattaaatatatgttgataggttgtgttgaaaatattgctaaacttttctataaatttagtcaaacctacaatagttcgacgtaaaataaaatcaaaacgacttataagagatggtagcatatcaagacggtccaatagggttccattatgtagcaaattttatagcaatccaacttttgctactaaacacacatactgccccttctgtgcattaacccttttattagtatggtaaattttgccaaaaatattgtgacttcgtgattttaaccttaggacatcatacgatgagttttagagaagacactctataaatacgataatttactcgtgtacaccacgctgattattttagtgtattcttagataccatctattttaatcggtgaggtcattaatccatttcttttctcttcctcctccttcccgaagaaacaatcagcctctcaagctagttctcccctccaatttcaccgagccaccgctaaagtcatttgcccatccgccatcgtcagcccgctccagaagcaccatcttgccaccaaggccagcattggagactgcaaaccctctttctctctcctcaaacgcaaacgtgttctaatcgttatcattctccttgttgttgccatcctccgtaacctgtagatgagtcacgttgtgggatatgtagtcctgccgccatcctcgttgtcgtttcacggtcaacacgttgaggcccgcgctcactgtgctcgtgttgtatcaagctgaggaagaacattgccggatatgccaagggcaattctgcctcatcatgtacaattgtgggccctctcacgcgttgtcagatcgaatacattaaaaaaaatggcatgatatccatgggctaattaccacgtttatagattgtcatgatttcctgtagcaaatattacctattagtatgtgctcccttcgtcccataaaaacctaatgttgagaatgagtttaaacctaattttttcctggaaaccaaagttggtcaggaacttattttcctgtatctgttctcttccagcaattatttcagctttacatttatcatttctgtacagccagtgctccattcacaatttatctttggagatactttattttttctaactagttttggtttatttcccatagtagactttacatagctattgcgacaacaatttctatcaacggatttggctgagactgaaatcccacaatcttttggcgaggtccatgtcgagcgcatgagatttcagttcagtgatattgcagtcagaaaagtatttgccagtgactccagcaacctgaggatgcaatgccacatagcacactgtggctgcaccctgcaaaaacaaacaaggataagcattgaatgtatgagtatgagtggttttgagcaattaacagaaaaaggttatgaattagtaaatttttcaaggagattttgccacttcataagtttaatataacaccaactctacaaaaagtggtgtctgagtctcctcaattctctaagtcctgtctactctcccttctccctcatcccactcctatcctccgagtggcagcgacgagaggcgaaggcaggggcggatccagaaaatagagtcattgggatcattactgaaatatggtggtgtcaatatatatatataagagagtaattcttgtttctagagtgcattagcaaagagattagtaagaagtcattggtgtccgctgacaccaatgcttacactatggatccaccactgggcgaaggcacagctggtttctagcagcggcgatggttgcttcgggctgcggatcgatgatgacaatggttgcttcgggtggtggaggtgtgtcaagcttcaagtgatcgtgacgacggaatcaatggcggtggccgcgtacaggagcggcggatccggcatcaaggatcttggctacggcggatcaggcgctagcgagctcggcgatggtgggtgtggtggtaggtgatgaggacatcactagcttagatatggtcatggctaccttaaatatttatcaagcaaaggtacatgctttctatgtaagatttacatgtcatatatttgaacaaacactattatactatgagtcttgcatgtgctcgtttgtagaggaacttgcttgggtgaaggaaaggggagcggacatacggagtgattgaatgatctatgaagttaattggggactaaccaatatccttcccaaagtttatccccatgttaccacgtcacttttagttcatagaagggaatagatgaaattctacatgttttagattcagattcgggcctcctgacagcatcaacttcaaacggatccaagccaagggggtatgcgccctagagattccgtttgaagttgatgctgtcaagaggcccgacttaggttagagacgtcctagggatagtcctagggcgcacaccccttatgacgtctctaatcatatttacagagattccttctataagttgtgggctaagcccaagggggtgtgtgccctaagactaaccctaggacatcttcagtcatatttgttcaatagttgtcatagtttagagttggattttgcttaaattatttctgccattgaagtttcgccgctagtttggtttgtgaaaccccaactttaaaatcttaatcattcatctacatattaagttgcaatctaccttgttcttgcttatgttcttcgattcgtatgcagggattagccttctcggcgaggtcaatcgggttttcgacaggattgataacaagaggaagtgtggtgctgcgattgcagggttcggatcatgttaattggtttgtcgtttgtaaaatcatttatgtagtgcaataaaaatgttggcaaaaaaatatgtgttacctatcaagtaaacacatggacttagattgcatataaaatacatataatgcatataacataaaacagaactctgttacttttatcttgtgaaaggaacaaagaatgttctaaaacttacttgttcaacacctttaacaaaatatttaccaatagcacggatagcacctgaaataataaaaaagaaggaagaggaagaatataactttctatctgcagtagaaaaaaaatgcatttcattctctcaaactatttcattggagcagttaaccctgaactagtagaaacagtgcaccatacggtatttctcttttttctctctatgtaaatcgtattttgcgccaaaaaaatggtagtgttgatagatgaagtataacctacctctccatttttttctgaaatttttaatcactgctgtttacagagattggaagcagtaagttgacttaaacatcgaagtcttaaattttaagcaaattgtcatattttttaaaaactttgttaatggtgtcatgtatggcttaaaaaattttaacttacaataagacttgcgtaaagaaaaacaaataagggagatgctattgaggattaaagtgaaccaaattagccaaaaaatagttcaggggttagcaatctaatggaagagtttgggagtagtaaaattccagcccttgaaaccaatatgtagaaggaaaatgtcatgaagctataagacctagattagttgctagttaggcacgatacatcaaactaaacattctacgaggtgagattcgaccaatcattcatgagtattgaacttgctttatttttccagtaataacttgcactcgtgagatatattcttaccatataggggacaccagtggtgcaaaatgttggtggcgacagctccaggatgaagagagttcactattacttttgcatcttgttcctttcagcagagaaatatttatcatcaaggaaatctgtgaagcttttagaaatagtaatgcgatcactgatatcatgtacttagaacagctccataaacacaaataacagggcaattgacttccatcctctgttggtgttttaccactaggaggtttatttttatgataacttcgtattattaattcagctaaagagccgcatgattttgttaacaacagaatagtttaacatagtactaccatttttttataagattacagaacaggcaaacgatgtgtggaacaaaaaaaaattaactagagttagtgtgaatcaacaggtgttcccaaagtaaaggaaaataaagagaaaagtgagaaccttcaagtggctagataataaattagaatgcaatatgttggcaagcttggactggccgtaagcaaggaatctgttatacctagcaagagagaataaaaatatatagttgaatgtgatgttcttgtacaaatttgttttctcatgttttatctagaaggtaaataacatgtaaaaaagaggcaaaatgtgttgtgtcgcaaagtaatacccagattcatcattgatcttatcaaaacaaatcccccctggataagagagactgtagctgacagaagcaactatcacaacccttccttctttgccactttctatagctgtaactttcatcttctcgattaaaagatcagtcagtagaaaatgccctgcatggcattattaactcaagaatgcaatcatacaacaaaagcagatgttttccacataagtaaccaaaaatgggtgtaagatgagtagtccagccaaataggcaaatatgatgaggtacaagtgaaattatgtaaagtatgtactgttttggtaaacatgcaagtccatggattgaaataaactgaaactctaatattctacagtataaatttagtttcatgttttagcaaaaccttcttgcgatcaaaagtttcagtttggagtttaaggactgtaaaagtggatcataccgatgtgattcgttgcaaaatgcagctcaatgtcatcctctgaaagcttgaagggcacaaaacaaacccctgcattatttctttaaacagagcagaataaaattgtttagtcaaagatagggcaatatgtaaaaagataaagataaaacatattcagtagagatggaatagagttttttagtggaggtttcaaagtcacttttaccttccagttatactgtcctaatgctcaacctagctaaacatcaatattgacaattaatcttgcttacagagtattttaatattattcaatatctcaaactctcaatagccagatcgattgctcaatccagtttgttcggcaccaaaatccctacattgcagattatgttgttgcaattatagttctgtaaaatgcgcaatgtttctttctaccaaaacatgccaatgtagccaatttagtactattccctccgtttcataatataaaactttctagcattatccacattcatatagttgttaatgaatttaggcacatatatatgtttagattcattaacatctatatgaatgtgggcaatggtagaatgacttatattatgaaacggaggaagtacatccaaacatagatttgcttacatcaaaatgttcaaaggaaggttcaaagctttgaaaatctctgcaaatctcctcacggatgacatcgagctaaggtcaagattaagaatctccatctttgcagacggaacttgtttcaatatctcatccctcacgcgtgcaccggcagataaattcctaacccccataacaacatacacaccccgcatcaccaggactcggcatgtttcagccccaatcccactggaggcacctgcaagaaacatatccatcagcaatgatgccaacagtaattcaggtctgcaatacaatttgattaggattttttttatggcgcattaaattactgtgcatcatccatcacccattgaccaaagggattaatgttgcatttacatcatggatggtaaaatatcatatatttttttactatttaaattctaccaaaggcaattattgtagtccaaattttccttaactaatttgacattcaggtttctaatactataaaaatacaaaaatcatgttccaaattgaataaaaatttccatagcggaaaaattgaacatggaaggttcggtttataacaaaagttaaaataaattacttttaattgtatatagttccggaatagttgtttgatttttatcaaaattcagatgattatgcaaagcgatactcttaaatcttcataatcaatctctagaaaaatttcagtgcccaaattatattttgaacaacaaagctttggtttataacgaaactttgatttaaatattttttttgcttttttttcaaattaggatgattatgtaaagacatatatagctttaaatcttcaaaatagatacttttagaagttcaaaacgaattgtgaaaatcttgaatgagaattttcaaatccgcataattcaaattcgacactagaatattaatgctaagattgactagaaaaaaaatccatttgaatggatatcaaaattctagtatttataatctgaatcatattttaattttatgtctcctatttggaatcaacgatttttaagtcattcatttatctcttttgtaaagtataatatttgttttgcacattcattctgtgcattagaattccttgcaaccactattaaaattctctgatggttaaattttggaaaatattctatgggtactaacgttttccttttgttatgtattttattaaattaggatgtgaaaatatatttgttaatagataaaggaaataaaaagtaacggctaagatttctttatactgtatcagtcccaaaatcagcatgcatgaagagcaaataaaaccaagtgtctctgattaatagaaaataaatattggtgaaacagaagataatatattttctaaaaaaacacggtataaacgaaggcgcttacaacacatacatttacccttgaaaactcacacactatctttatgagcatctctgggagacttggtcatcatatcttgagattgacgaagtcaccacgggaatcccgttatcgatggatacgtcgcttaccactgaagaacagatagccgtaaatctgagcatgcatatcaagtttaggacatgaacccgagtgggctagttccaccacaagtaacctaattaaggtacgatcacctcgcaataggtaacaaatatcgaatgaatggaatttctttaatttatagagcaagagcaggtaagataatagaagtagcaattatcacaagctagaaataaatttattttggaacggaggaagtggctcgattgattagttaaggacgacctggagcaatacacaatatattcactaatagatgaattagttagcatgctccaatagattgattagttaaggaccactttgcatgctctaatagatgaatcacttggagaaatacactaatagattgattagttaaggaccactttgcaagctgatgaattacttagctaccaaaccaaaaaaacagaaattctacgagcaaagccatgtttcagaggagtcaatcaaccaagaatcaggggatgagagtacagttgaggcttaccggtgatgagggcgacgaggcccgagccgtcgatgccggcggtgacctcctcggcggtggacgacgacgagaacccggaggagctgctccgcctcagcaggccccacatggcgtgcggtctttgagtttttcgccggcgtttaatagttttggtgccggaagtcatgaagaagaggcctttcagctaccaatctcaacacaccgctcctgctcatctacgatttttataagccacatattttaatttctaattatatactccctctgtcccaaaaagaatcaacattgttctagcttgattctttttgagaaatgttgattctttttgggacggagaaagtaggtgtaaggttagtagtaatataaatgcatttattataccaaaatacactggtgacttggactgcggtgtcacttaggttcatcaacttataaatcgcaagtcaaggtccacgatcttgttcaatgtaccaactgtggtccaaactacctttaatcaaaggtactgccgtggttgtcaacggagaaaaacattttgcattcagtccacaccataaataaccgtggcaacaaatttgtatttagccccttttgtatgcctaaatcgattccaccaattcggttccccgcctccctgaagtagggagtaatgattagagcagtggtgattattgatagtcgaaggttctcggatcaaaaaagagtaggagagggtgatctcatgagtccagtacggacctcatcttcgtgaagaagataccacaccacaacagttgtgccaccttcctctctctagtacaccctactctcgtcgcactttgtgccaccctagccattgccgctttccccttcctaattcaaaagaggagaagagagaggaaaactttgggttgaggatgaacttgaagcgaatggattaaatgcatatttgtttctacagtaggttttgaacaggggtaaatagaaaaggcttgacctattaaaggtgatttcaacctcgagtcgtatattaaactaaaattacagatctagatatatgatttacaagttgatcgattacattagtgacacagcggtcttaaattggccatgtcttttactctaagttttaatgaacttagcgtttgctaagaaaacaagtaaaagaatctataatattcttcaaaaatcaatttttcaaatttataatcatcttttgtttcgaagtggaagctttactatataggcaccaaataaaaggaacacatgatctctactaagatggagattggtccctccacccaccgctcacatcactccatcgtaaaaccgtataacttttatttaagcatcgataatcatttaagcacaatgtcagcgccagtcccgttggcgctgacacggccaacctcagcgccaatgcgcttggtgctgagctgacggcctaattttggttgaagtttttggcaggggttagtttcgaaataagtttttgaaaagggtcaatttgtccttgtatagctagcatttataatatatgtaaggacatattatgcgtgataggaaaatactttcatgaactcagcgcgtatcaattcctgattggacaagattaggagcttaagcatgtagttggaagataaattaattaatgatggttcgttggaacttggaaggtggagtagtcaagaaaaatgtttacatttgtgtaggaattttaaaccgtttttttgacaaattgacccttttggaaaacttatttcgaaactaaccactgccaaaaacttcaaccaaaaataggccgtcgcctcagcgccaaacacattggcgctgacgttggctgtgtcagcgccaacgggactggcgctgacattgtgccaccgtggcggccgggccgatccccagctgacgtggcagctacctcagcgccaaccggactggcgctgaggtgggacttggccgcaacccccaaggcccagaccagcaagccttctggatggcttgcgggctgggacctcagcgccagccataatggcgctgaccgtgggacactcagcgccagcccacctggcgctgaggtgggacttggccgcaacccccaaggcccagaccagcaagcctgctggttcgcttgcgggctgggacctcagcgccagccataatggcgctgaccgtgggacactcagcgccagcccacctggcgctgaggtgggacttggccgtttcggccatggcccagcccagcaagccttctggatggctgggctgggacctcagcgccaggtgcactggcgctgagtttggacatgtcagcgccatttagcatggcgttgacgtcccagccctgctaaactttagcaaaactttgcacacaacacaggcaaacatcaaatcacagaaatttacaggcagtaatatatccagagaaccatacaaaacatacatccatccatcaatcccaacatcattccatacatccatagaatccatcaatacatccatatatgaagtccatacatataagaaataaaaacatcccatcgatcctcgtctatacatccagtcgagtccatacatccagtccatacatccatcgaaccatgcatcaagtccatccatctatccatccatccattgaaccatgcacttacctcctcctacctctagtgcgaggacgaggcacgtcgagggtgtacctccagtcctgcgaaggagcccgccggcgtcgtggtcgagacgggccgggctgcgagatatccggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccatatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcgccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacggtaggtcctgtggagccacgccaagtacaagtcgaactccgtcccgttgtgctgaccctggtctggtactccattctcctcgaacttctcccattgcgtgatatgatcctgatggtagtaagcccaatcagtcaccttcttattcttccgaaggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggattcagttctagctcaagcacttcctgtgcctgatatggcatccacaccacctgcagcaacaaaaataaaacacattgaagcgaccaggctagggcagccgacccccagctgaaggtacccgcctcgtcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccggtcgtcgaacagtatgtgctaacaacatgtctaatttttccaataaataagtacattactcaaatactacacattattgataaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacctccacacttcatccccacccatattatccatctaataatccatccttagccaactattatcaaaccacgtctacaactaaaacaatgcaaaatatccaataaaactttggggaacttagggtttatagaggggtttaccttctcttccgatcccaaactcaatgccgcacaaatcaccttcgattagagaggtttttgggggagattggacgaggagaacgtggtggcgaccgaaccctaggcgggcggctggggaaaaaacggaggaagaactggctggggcggcctcggccgggctctaagtagccaaggtcagcgccaacttacttggcgctgaggttgggcacctcagcgccgaagcggttggcgctgaggtagctgccacgtcagctaggggatcggcccggccgccacggtggcacaatgtcagcgccagtcccgttggcgctgacacggccaacctcagcgccaatgcgcttggcgctgagccgacggcctaattttggttgaagtttttggcaggggttagtttcgaaataagtttttgaaaagggtcaatttgtccttgtatagctagcatttataatatatgtaaggacatattatgcgtgataggaaaatactttcatgaactcagcgcgtatcaattcctgattggacaagattaggagcttaagcatgtagttggaagataaattaattaatgatggttcgttggaacttggaaggtggagtagtcaagaaaaatgtttacatttgtgtaggaattttaaacgccacgaatacaaataaatgttgatggagggagcattgactttccatttttaagtaagagatgtcatttttatgtttataaggatgtcacataaacaataagatatttaaataataattgaaatagcttgtacgtagttttattttttttcataggtaaacatgcaagcacaaacaatattgaaacagtgtatacatagttttgactaaataaaacatatttcaccccctcactttattaatttctggtcacatcgttaaaaattcacataatgataataccattagaagtgatcgtcttaaatggaaaaaacacgtatttgtgacaggatgaagcagctataaataaatgcaccagatgctcctttctatgtttaatcaaattatgaacagtgtttcaaaaaaaaattatgaacacagtatatgtatatcccacttgtttactccacaatagttgattttttacagggacatggacagttggacacatgtgggacaacaatgctttgaaagttgatagggaagttcgaactaactctggtcatcccaagcagtaaatggtgcaccctatctatctatcgacagactaatagttccatgccatttgctcaataattacatatgctatttttttcgttaagtacttatacgtgcattacttttctgtgattaagtgtaagtttcaatttgaggaattaaataacttttctatgtaagtataaaatttgttttgattacaccaacacaaacacatactactactacgcacgtacaccaccaccaagacgtgatggtaggtgaattgtaggatcttaccatgtagtaaaaaccacacacgcttatagaagcaaaaacaacaaatccatcttccaatatttaagcgtaactgttctaaaaatacaaatatgtaccagtgttcaaacaaatattgtgttaaaccatgaagcaaacaatttttaaaaagtaaaaatatagagcaaactcataaatgatacatgtccatcgctagtttgtttgcttctgcacctatcacacacctaccaatttactcctctgtaagtgtgtgataggctatgtcgatgtgccacagaggtgttctcagccaggggtgggcctaccatgattcatgggtattcagctgaatatccaagattttagattaaaaaatttcatatatgtaatatatatttcatatgtatgtggaaaagtatgcaaaatagacttgttccttcagagaaagcctaacttagcaccatcccacctccctcctctactcggcccattggcccaataacacaaatcaacccaaaatggatgtaacccttacctctccagctctccttcccaatctcctccttggcatggcaccctggccccctccccgaccccgacacgatggcacatcacctcccacccacccccttcctcaacggcggcagcgcccagccagctgcgacgcagcagcggctgctaatctcacgccacgcgtccgtgcccctaggccggccgccacgaaggcgccattgcccacacgccgccgcccctgccctgtggctcccaggtggtgggccagccggtgcccgcactctgccgcccgtacctccaccctccaccagtccacctccagtccctgaaccgccttagacttagacagccagacccacacgacggtggaaggttagaaacattttggtaatttggttggattaggattttagtatttagttcatagttgaatccaagatggttcatttgatttaggatttaggatatctttgaatctaggaatggttcactgttgaacattttttatttaggatttgaatccagtcattcagggatggttcatgattgaacaatcaaactttgaaacttgtgattcactgattttgtgaagctttgtagcagagttagtacttataaattgcatcagtgcacatattcagcagagttagcatagttagtacttaaattggaagaccatattgttgttttataggtttgaaacgtgaataggaaaaatgctcccacggttaatttaaaggcttttttagaaacagctgttgcaaataagagaactcaaaaacaagttaagaagcaagatgggataagaatatttgaatgattgtttgattacattcgttgaaagtgatctattcttccaagttaaggatatagacatcattactcattttcaaaatatcaagaaatggaaagttcttatctaaattgtaagatttcttatcattttttcattttctatgctctataaatttaatatgttttgtcaattaaaactttagtattgtactttaatatgcttaacacattcaatttatgatcaattatatgaatctataactttaaaaaatcatgcttataccgttatatattatacagctattagactttatgttgaaaaaaatttctcttccagtttcaaatacccaagttgaaaatcctaggcccgcccctgttctcagctgttactttacaaagcttgcagagttgaagtcttgtctgtggctttggctaggttattgcaggagatttgaagggctttgtggtggtggtgactaactcgtgtagggttacgatttatttttgttcagtaaattgtatttttttatggttttaagttttaatgcaaatctggcggaaatgtctttttcaactagaaaaaaccatcacattttgctattaaatcttcatatgttcacttaatccgttccaatttactatgttgttctggagaaacctcacccaattgccaatctaaaatccatgctagcaagggtgctgatgtattcatatgtgattcttgactacaattcagtcagaacaattctaaacccgcaatgtatttaaaaattcacgatagtttgtaacacaatgacaattggctcaacaaaaaaaaatcatggcatttggcatatgtttacatgtaaacccatatgcattataccgttggtttatatcagtttacatcagctataataataaacaagtttttattatgttgaggtgaaagagagggtgtgttaagagagagaaacgtaggcgcttgtttggccagcgctagcacaagctctcctatccgtgccatgggatctactaagagcacccacttggtaaagtaagatgctctctataaaacatgtacatctcagcaatagagtaaaccacctcaatagtatgtctaatagtatgtctatatggatatctatagctctctaatgcattgcctcgtttttctctataggttatctctaggttagtagatagctttactcaccctcttcatttaatctcttccaagtagaaaaatatgctgacatggatctcttgtagagagcctatagataatcattacgggtgccctaatgcctaacctatgggtgaccaacaagatgaaggtttgttgagtaatgaagtcgcatatttgattaaaatataattttgatatttgtataaaggtataacaatagccactagccagctattgtacatatctcctttttacgtggctgtgccgatggcgatgcggactttttaagtagcaaccaaccatactattaaactacttgctctaatttgcaaccattaagttgagttctgataagtaaatgcggtctgaaaaggatgaggagaggattagcagttattcagaactgcagagacgtcccttgacattagcactatcccaattgctgacaggaatcgtgatctggagctgaatttcaccgataggttttatgttcttggtcgttttgtgtggccatcgcctgagcatatcattgttgggcattttcggttggtaactttttctctcctttctttctttgatgatatatggagttgtttgtttcaattcagtttagttcattattttgaaataagattataagggatacactaatgtccaaatttagtccctgactggaagtgaggaattatcctatacatgtggggaatgatcatatcctccgtaaaatttctaggaaatttcaatgttataaatggggccttgatgttatctttacactacttttatactatctctctccgttccaaaaacgactttatttcgagctatacacgactttgtaaccagcctgatgccctcaactcaccaagcatattgtttgtcaaacaggtaaaggaaaaatggtcctgaaggtctgcaccggatgacaccccataatccaacctgactagttccatttattccagccaaaattgcatatcacaagcatataatctctacattgcatatcctatccagataatcttagtattgaatatccatatactccctccgtacaaaaatataaggaatttcaataaatgagatacattctactactacaaatctgaacatgatatatctcatctattaaaaacccttatattttgggatatagggagggagtatccatcaacataagttagaaatattttctttttttaaaaaaaaaaaactgttcgttccgcctcattgaatctaaaatgtcaacagatggacagagtgaggcagcatccagcatcatgaaaccacgttatgctttctctccgtatgattattattacctgcctgcactccatgccttcagcgcaggatcaaggagaccaaatccttttaagagctaaaactcaagaagtcaataatgaaaagaaagaaatacattgttgttatgaaaattgcacttattatttgcaacaggtaggagtagccaactataatcagaagtacttgcctcaagcatagctctggttagtctttatctctaattctctattactgtccaagaagtgctgttggtttcctgagcaaccactacatgacatgaatgtcgacaaactaaacaccctacattcaaatgaaaaaaaaaaagacataaccagctccaatcttatgagaacttgattgtaaactcttatggttagatcatgtgtccaaacaattgaagactatatgttcacagacgcttgttaataagatgccaaatcaccccatgactcccgacgcgctggcctgttttccttcactggagaaagcgtccaaattatttgtgatatgatgacaaggtctcagaaattgcccaaagaatgaacccactgtacacattctagcggcgtcgatgtgagcaaaacaagttgagaagttttatgaaggagcatctcctatgcgtattcttacgggtagcggtctagcaatcagaccatccatcacccagccaccatttgaaccatcaagtttgacatggctaaattctctttgagtataatcgagtgatgcttcaagccttccaccaggtctacacgctgaggcaacatcacttggtttgatgcccagatatttctccaaccaatagagatagttaacatggaataaagatttgagcatatcttcaggagaagatccctctttaaggatgacctgtaaatcaaagggtaaaatgtcagtaactttgtatgatagcagaatggcatcttgaaactgcttggttcaagataaactcacacaaaattttcccttgtattctgtaagaaggtattgttcgtttttgtagagatcaaacaatgcgcatgcatcttccttgttctcaattatttcactaagtttagaacccaactgcaaccgccgacaaattatttctgcagcatcttttgcctgtggtgacaaaatcttgctttcctggtacaaaattcaaggaaccacatatagtgggacacataaataagtgcaagaatggcacatattgtgaatttaagatgtattaagttgcagttaactcttgactagttaaagcgtgccttgggaatgggaggctgtaagacctcaacaatatgaaaatatagaggacaaaaagtatcagtgatttgatgttagaaaaatactttacttactttacgtgaagtaccaatagatagattcaggaaaaggggttcctcgtcgttaacctctttgactgaaggaacttgtccactcaatagatactcactgaacaccaaacctgtgagacaggagggcggcagataaattagttaatcttatcgattagtaatgaaaaccaaggaaagacagaataatcccactaaaactggatgattttatgacacaattgctgccttgcgagaggccacttatgcaattaatcctcactaaggctccgtatgccattgaggtgaattctgataatctaagttacaaacggtaatattaatacctactaaaaagttggaagttttgtgggaatgaaagttgcataattgtcttaaccttaaaatgattaataaaataatctacaatgattatatatttacatttctagatgacttagaaaagacacacatttatcacaacacaacaaactgcaaacagaggctaagcctagctgtagtcaatgccatctctcatccacagcaaaccaagacactaaataatctggaaaacacaagtgaccaagatttttcacagattagctccagcaaaatccctctccttgctgtctcatctcacgcggagccacaacatcattaatctgatcgttggatcagtaaagttaaaaccagatatctggcatgactttgctaatgcaaatacccttctttcagtgctgttggattgattcctaattgactgccaatttaatctacagagtagtccattttatattacaatgtatactgtgcaaagctgaccatcaagacctcacgagttttcaatcatccattcaaaaaaattacaattcaaaatatgatttcaaccatcaattctagaaaaacatacacatgttcagtgacaactgccatgcacttacaatggacaattttgcaggctatcattgcaagggagatatcgatatttacccaaaagaatagtgacaaaacgtgatttttttaaaaaaaaaatcgtgtgatgttttgctgagttcaatcagctacagtgcagttttggtatttgtatgtattgttaatatattgatccatccaccagtttatttgtgtttgaacatcaattaaacaacattattcatataaaaattgtgagttgtgatcatatgaaggttataaaggaactactgaacgggataagcagcagtggataaaacattacttgcacgataaggattcagtgtcctcagctgaatcgattgataagacttgaggttgcaatacatgtgaactgcagtaactccagcaaatgaaataagagctaatgatacagaagagccaatgcgattagctaatgctatccctagcattatccccaggaatttgctgaccattccttgtgcctcaccctttgcaatgacctgaaatgtaagatccaattggtatttaactacttgggtcagaatgcaaagtgggatgcgtaggttgaattgactaaatttaagaatttaaaagttcaatttctaaaaaaaaaaaaagaatccctcataagaatacaacacgggcacagagtaaaaaatctagggcatttggacaaagttttgaaaagttttatcacttcgaagttcgaaccaggttttgttaccaaacagttgcactttagatgactggtccatgtgcaagtgtgccttgcatccacatcgtccttagttccttacacattaagcaccttgcagttgatgctaacatgcttgtcctcgtgtgaaaactagattggctccttaacaactcttaggctcttagcacacatgctcaatatctcacattaggcaaccaccaccagcatcactgaagcaaacaggcactccctgatttcaggtgtagcatcctcaactggacctcaacagggtgcaccttggtgtcgtgatgctgcccctgccatcacctgcttcacggcttcctcattgatgccacaccatcaccactaaacgatgccactcccattttttctcgcggacggttgggccactggtccaatgataaaatttgtaaaaccttgtccaaagtgccacttcgatgagaaaaaagggtcaaaattgaaacttaacccaaaaaaaaaaaattgacatggtcacaagggcgatgcaattatacctatgtaccgaaccgctgcctgtggggtttataattgtaatgtatatacccaataggaaagaatgaggattcctggtgcaggcaatatagtgaactgtgaaaaggacatcaaacgaagaaaaaaaatggagagcagcaaacaaaggtggtgcatgcatgcaatccaggagcggaagtcatcaattcagcaacaaagacaaacttgctaccaatgctatagtccacacaatgctgtcatagcaaaaggcagagaacaagaccaggaggtaggagtaatttggtccagtgtgagcaaaataaaaagtacagtggcatcttttcagaacattaaaggttcgcaatggtatatattttcttgcgtaaaaatagtatcagcaatatctgatataactgcagcttacccgtaggattggatatagattgcaaggctcatacatgagaaacaaaaattattctaacaatgacatctacatgctaaacgatttgttttcatgaatgaggatagattgattttacctcagcaaagttcctttgcacagcaaatccagcatagaaacaactcctggtggcagcctacagaattgaatcattgcactaatagtggttcaaagaaaaataatgaattggcaagtacaaaatattgttgggaagcaccataaaaatcaattcataggcagtcaggctcaaatttgcagaatagagtaataatttcaaagcattccacaagagtaagcaacatttcaaatcacccataattcggtcataccatctgccacctatccatgccaatttactgatttatccattgcatccagtagaatttcagtgaagaggtatgcaggacatgattagaagcaggatatcttcagttattatgttctttatgtagtgagcaagattcaggagacaaggcaaaaacaggggaagaatcaagaaagccgaacaagcagtacagatctgtcaggaggagataatatattggaaaatatcccaaaaaaactggactaccagaatgatattgcacgttcaattcagtgtatgattaatgccaaaatatgatacctaactacaaatttggatgacacatgtttccatactaagtgtaatctgaacaatgctgaccaaatctgtaggtggaacataatacgaagaaaatgacatgctgcagcagatttcacatgaaacaatatgaccttgcgcatatggtttgcattttccagcatgaaatgggtaaatatggtctgcacaggtgaaggggtacagcaacaatgacaatccatatcaaaatcaacagttctgacctgtatcaaagcagctgctgatcgaccagctccagcggcagccccaattggaacaaacaggtgaggaaagaccggagttaaaatctccagcccataagccgtgttctccagaagatcggcgaacaatcgccacccctttgggttaacatcgaaatgccggccgaatttcgatagcaatatcttgctcaggtaccccaacccatccttcagcacccaattcaccgctgccgcggtaggtatagcgcctttccccaatccaaccgcatacaacaatgcctagacaggataaatacacaaattcaccaatcgaaaatggcacatttcaactaatagccggtgaattgcacacagatggacgcggctcaggcgccacaaccgtacctgcgtcgagagcacgccactgatctggctggcgatgccctgcacgccgcgccacagcgagtactgcaggtagtcgctgctcacgctgtcagggtacccatccgggagcagcagctgaacggcgaccgtggcgcaccgccgccacgacagctccagctggcgccgcagcgcagccagctcggcacggccggcaccggccttctccgcatcctccccctccgcctgcttccgcctcccgtctcccgcgacgacgtaggaggtcccggtcgggtccggcacgagcagcgtgcgcgcaccgcccctcacctcccagacgctcgctccctccctgccgccgctaccgccgatggcctcggcgagcgcggccgggatggcggcgaaggcgcccgagtggaggagcacgaagaggaggaggagctcggggtggagcgactggagccaccgccaccacccgtcgccggggtcaggagggccactccccccttgcctccaccacccacctcctcctcctcctcctccgccaccaccaccgccatcacagccaggagaggagatcgcgaggggtggcgggcgggagaggttggcggcgaggcgggggaggcggggagcggaggtgggaggagggggaacgaggcggggaagggtgggtggggagagaggggccgcgaggaggaggagagattgcgaggaggacatctcggaggagcggtttggttatggccgccggcggcggcggcggaggaggaggaggggtttgcagcgatggaggcgaccggcggcggcgacggcggcggcggattggaattttcaatgttggggggatatgtgcggcatagacggaccccgtcgtcaaagtttagactgggctggttaggcccggcccattttccgtgaaatgggtatcaatgcggcctgctgaggcagaatcggacggtagtacagtatcatttagcaacttttggactttgagatttacgtggctaggaataagttcattttaggtaccttaactcaacgagttcgattctcaccctcaaaccaaaatagcagatagaacgaatccctcaattattaaaaccggtgtaatatggaattataacggatggttttatccgacgtggcaatttgacatgagtcagcagcactgagtcagcatgaacccacatgtcagaatctcttcacctctctctctccctccctcagtcctatctcacgaagcagagagcagtaagggcctatttggcacagctccaactccagctccacccctcctggagttggagctcagccaaacagtttcaactccaccaaaactgggagtggagctgggtggagctctctcacaaaatgaactagagtagtggagctgggtttaggcagctccacaactccactccagactcaactcctggagctaaatttaggagttggagctgtaccaaacaggccctaagccagtgaagagaagatcggctctagtgtgggcccatgccacctaccggggaacgacggtgacggacctgcggcgcacgtgatgtctagtagaaggaggactcccttggaacgacaaggagaggatccagcgccgactgctctgctctgccgcctacttcggcaacgtagcacgtcagcttggtcgtcttcaccgcagcgccgattgctgcccaaatccccccagtgtcgggatgcctcgcttcagtcatcgtcccacctcatttggggccgatcggcaagcgagtgaactccttcgtcatcacctccgtccaagacaacgactagggcaaaggcgatcgctcgtgataaggatgagggttgggcggccggttctgacaaaggacacctcggtcgctaccgctcccccttttcccagtccaggggcatcctggcctaatcgggtcctcgtgcaaaatattaaaatggggctctagtagcctagtaaattttttatagtaaaactaaaaacgggcgtggcgatcagccgatcatcagcgatgaaatagaagcggatgccggaggagactggggagaggagatgaagaggctgcggcgtcgggatttcgactacacacgacgacgcggacgcctggacgggaatacgatggaaaatggatcggttcaccttctgcagcgttttgggcattgttttactacttcctccgtttcacaatgtaagttattctagcattttctacattcatattgatgataatgaatctagatagatatatatgtctagattcattaccatcaatatgaatatgtgaaatgctagaatgacttacattgtgaaatggagagagtactatttagggcctctttgatttgtaggaaaaatgtaggaattttggaggatttcaatcctatggaaaaaaaaaatcctatgaaggcctttgaaacaaaggattggatcctatccaatcctttgaaattcctaaggaatgggtattcctatgcacattttggaggaaagttagcaagaggtctaacctcttggaacatttcctctgagtctatctctctcatctgattcttgcgtttttcctatggtccaatcaaacggccattcttgtgtttttcctatgttttgcaatcctctgttttacaattgtattcctgtcagaattctgtgtttttcctattcctttgtttttttattcctacgattcaaagactgcaaattaacaaaattaaagcctctaatattattatatatatatgacatacttaatttggggggcctgttcggtcgcacagcccgcacgggcccaaggacacccctgctagtcgcttccacccaggtcaagccctgcagcttgctactgctgcggctagtccggccaccgcctcgagaactgcccgctggagcgttgtttcctctcggcttgttgccctctacaagactacaagtgctgaagtgcaccatggccatcgtgccagaatctctgcgccgcatgcaggtcttcatcgccatgctagctgcaggccgtcacagccggcgcttcggtcgctgaaccaggacccgccgaagcctgcccgtcatactggcccccggagccacatcgcggttcgcacatgtcacgtacgtcgactcgtcgagtccctactccctagagctcgagccttcgaacaagtcgccggcgcagcagtgtggtgctcgtgcgcacatatcgtaccaggtcacaaagccgaagctccgcgacacgtgcgaggaggtcggctccatcttgttgctccggctcgccgtcgacaggccacgggcaaaccaaggggctttttgttttgtcgattacaggtcaacgacgagacatcccgtagtacctgccgcaacggtgcaacctcgatcgccacgccctccgtggtagcgtgctccgcattggccttgccgagctggaagcgggacggtgcccgcgtggcgatggctgtggtggcggtgagctgcacgagccagtgggcatcgaggatgccacacacgccgcgtcacccggggtgttatctagcgccactatcacggattcacggtgtccctttgtggggctgagccaacggcaactgtggcctgtgggtgggagacggtggataccgtggaggcgcagggaaacgtcacgcgcgccaccggccgcatagaggccctgagacgtgggagccaacgctgactcgggtcaacttgccactcggacaaaatcactcgctatgttaccataggacctatattacacaggttttaatagttgaggtacctattgtatatggtatttcggttcgaggatgaaaattgaactccctatgaagttaaggggcctaaaataaacttattctaggactataatgaggctgatcggtagtgctatgtgcgcagccagctagtcagcccaaatctacacagaacaattgatttgtagcagcatcaacaagggtgtgttacttgctgaccgatgcactgttgtagccagcccaaacgattatttaaggttaatactaacaataggcttttggacggtctagatcgatttgagattcatcttgatatgataacacctggttctctatcggagttggggtgttgctgacactagagaagaagagttcttcaaagctggaggaagagttcgagctcaaatcttaacgtgattttggtagtgaaggattttgtagaaaatatatcctaattttctatcaaataccatttagcaaatccattgtattattgtagaatgattttttgtttattagtgttggaggtacactatgagagccttcggccgagcctaccgaaaccaagaacctgggcaacagactcgagccggaggcgagcagcgaagatcgagagggtagccatatgggcaaaaactacatggcgaaagccatggcttaaaaaacacgcgggctccaccaagcatgaacttcgtcggagggccgtacgggcgaaagcctaggcgtgaagacatgggcttcgtcgtatatcgaaccccaccggaagaaggcctagcgggccgttgcgcctttggggagtttcgataaactgttgggccgtgccatcctagcccagtaagggcccgtacatgtaaaggacactttgtacctctagtgtggtccttatcataagagtaaccatgtaaattcccctgtaaaatctaaatcctaaaggggaagtctgtaataggactataaatagcctcctagggccatgtaatgggggatcaaaaaatttttactaagcaatataattgtctttactttcaacactactgttgagagaaccacgtctttcaatatgacgcggttgtccattcgataacaattaggatgttctttgtcatgaaacgattgtgtgtattcaggacgttgtctgcagccgccctttttgttcttatcgaaatttgcatgacacagctcgcaaatataatttctagttgttgctacataacgtcaatttcgactatctcactggtagagaaaggggctttactcccggttgggaaccccctatagtcccggttatataaccgggactacgaatctgggactaaagatggataccgggactaaaaatccatttttagttaccaaccgggactatagatgataggagcagtcctggttaattgtttcactaaccgggactaaagatggtaggagcagtctcggttaattcttttttctcaaatcgatctgctccctaaatattcccgatcatattcccaaatcatccccatatcaatcaaagtagcatcacagatctggaaagaaatacatcacatattggaaagaaatgcatcacagatcacaatacatcacatcacaaaatctcaaacaaaaaatacatcacaaatcctaaaagaaatacatcacaactcccagatcagatccaatatcacatacatcacagatcaaatccaatgaatcacagattaaaaaaaaatcggtagcagagaggagggcgccaccggactcccggccactgtcctcacggcctctgcgtgagcttggctagccagccgctgcacccgcccgcctggccgcctgccgcgccagcccgcccgcccgcctgccgcacccagacggctggccaccgccgctcccgccgggcgccgctgctcccgcccggccgtcgctaccgctcgccgggccgccgctcaaagaggggaaggggaggaacgggaggggaaatgggagagggagggatggaggagtaatgagaggggagaagatcgagaggagtgcgcggataatatgtgagttggtggcgcggtgtactttttactcccggttggtataaacaaccgggactaaagatctatttttagtcccagttgtttatatcaaccgggagtaaaaataattggtataaacaattattttggtggcacgcggataatatctggcatgcggttcggggtactctttactcccggttagtataaacaaccgggactaaagatctatttttagtcccggttgtttataccaaccgggagtaaaaataattggggtctgtcttgaaccccacgacttattgaaccgggactaaaaaagatctttagtcgcagttggtaataccaaccgaaactaaagattaaaaagtacccctcaacttttaaatcgggactagagatgttttttacttccggtttttat

SEQ ID NO: 65667 - DNA, 57082 bp, Oryza sativa
  unsure (1)..(57082): unsure at all n locations
taattttgacttgaatttgcatttaattcggatatttgtgacttagggttcttcccccaaaaattaggcttcctcatttggggattttaggccaattggatccggcttattggggatttcgggaaatttcaatcttgtttattcccttttgcttgataatggggaatttcaatctagtttatcccctttcttgtttgctgagtgctagccgaaaccttagcatcggtctaggaattcttagtgtttgaattgggaatttcaatcttgtttatcccaatcctcttcttctcataaaaatcaacaaaattaaactcttcaataattttgcttcttctactgttggccgagatcagcagttggccgagatcagcagtataacagggcttcgcttatgcaaccaaggcaaagggattaatctaatctaattaactcaaaatcgcatcatgcatgccgaatagaaattagggtttaattggcataatggcttcacttagggatgatgggataaagaagtgttgatgaaaaaatcgaacacaccggcctgggagatctgcttagctcctgtgcaggttcaaagattgatgagatgcgggcgtgccagtcagtttgatcctgcaactgacaagattaacagagacatatgagatttagccgataccggcagaaaccctaaaacgagaagcagccgatagagctaaattgatatgctaagactagattaacatagacatatgataaataggtaggcaagtatatcatccaaaccaaagcaatccaagaggtcgaatgtactgatgcagccttgaactacgccgatgtagacgatacaattgcctgggccggcggaacattggacttatcccttcgccagagatcgaagacgatgcagccctgcatcgggtgccaagttccgccggaacgtaaaaacaaaagtagaagtaaaaagggtggcgatgcgtcaaattgtattgatcgtagcgataaattacacagatcctaggtgtacatatttatacccatgggttgatacaagtcctcatcggacaagaaagaaactttcctaaagataaaaggaaaagataaaatccttataggacactaaacacactttcctaaagataaaaggaaactaacaaactattcctaattaatagataacttgccatgccacattctctttgaactcggtctcttctagataagcttcatctagtagatcaatttccttaaccgaatatagcaagaatccgacaactgatgacttgacaactctcatcggctaatctcaagacttcgaagccgatgctgactctaagtcgatgactactccgggcttaccaaatttcactgttaacaagaaggctaagattaggctctgataccacaatgttggaatttattccaattaaataattgagtcttagcctaaacatggtcaccttctgcttatgcgaaaattaattgatctaactgacctgagatgaagccattgctcttcttctttcttcttcattgtttcttctgttgtgagatacctcatgaaccccttccagtgccttgatcgatcgggtgattaatttagggtttgaggttagagtgagataagtcgtcacctgcctccctccttctctttccttttataggtgacactggtggggctcgggggtctatctcaatctaaaattcgagtctattttgtaccgatcacacaaaacagatttatctcttagtttgtttcttgttaggataaggaaaccggtggtttagcccatctcctaatttttatcgccacaagtccacaaaatcaaccaacaggagtgtgctcgggaatcaatttcttgggcacatctttgatttctacagaagtattcgttctctgatcgtgtgactcccttgccgcatgggtggagtatatttgcgagatttgcacaactattttgtcactatattttatggagtggctatttggttctgctagtttatttgaaaattaattgctgctcaatttatctagtcaatggtctgtattatttgctatcttttggttactgtgaaagattgggacaaatccgggcaccatagccgtgtccttatcactctctcttctagatccacattcactatgacacacgcttgagtttggtggtggcacgccgacataggctggccggcagcacctgtttattatggtggcaggcggttggacggatggtcatctctcccctttgtctcgccattcacctttgctagccgctagtggtgattctttaccttggctccaagtggtgggggcacaacgacgttggaggcgggcgttcggctttggttggcagggtggtgaggctgcgatggaggcggtggttagacggcattggcaggggctatggcaccggttctgactggaggggtggcacgagataattgaaggcggaagacggcatcaactccggttggaggggcggcttcctcaacgtggcagcctgtacatttcaacgttgtggtgtggacgacggtgacgatggtcagcggcgagggccctaggtgtgctggctgccagatcattgctagatctggtaggacaacaaggaggggctttggtaggataacaataagctcagtgacggtgctagcggcaaccgtggagactggattcggtctaatggctagatacagctagcgttcatgtgaggacggcgaggagtggacgaaaggctttttggaggtgttgacaatggttaaggaactatgttagatcggaggcttaagtgccacgggatatgaggtgtttgtgcaggatccattcgtggaacgcaaatggtattggcagggcctcttcttctctgcctctgctagagagcgtcggtgggcgaaggtaatatgtgtcaggacatgtggatccattcggaaaatctatcaagatcacttcagtgttgttttgtgaaagcaggacagaacgaatgtagttttgatgcttagtcaagtagttttggttttgtttttcttctctttgttatgagatctgtagtttaagtattaatgatgtatctttcgattttgtacaagcacttctgtgtatataaacatcagatttgtttccattaccttttctccaaacaaaaaagtagatcacgaaaaatgaaataatcgggaacatagtcctcctgcaaagggtatcgtggcagccctacattttcaattttgaactaaccaatatcaaatattcactactagaaaaaccaattttcagacgataatatatattttttctaggcggataggcatcttggaagtaaatggccacctacgaaattgacaatggggctgagattgtcctccgtctatgaaaatcgtgcctgcagctcaccaaaaataatattgcgtcccatcttatcctttcctccaccatccactactcttttctctccaccatccttatccttatcctctcgacctttcttctctctcacgcacggctcagagggcaggggcggcatcgtcagcggtggctccgaggaggagcggtgtgggtagtcggggtatcggcaacgaggagcggcgtcggtggcagctcgggtggacgggaggggcgtcaacggtgtcgcaggcagaggggaggggcgtttgcagcggcgcgggcggagaggaggggcaatggcggcaacatggccgaaggggaggtgtgggtggtggtattggtgacgaggagcggcgtcagcggcggctcggccgaaggggaggggcgtcggtggtggcgcgaaccgaggggaggggatcagcgtggccggaggggaggggcggtgtagctcccgtccctctcctctcctcagctctactctacctcggcagctggagatggtgacgggcggggtggcagttcctggatggcgacgtgcgggtgcggcggatcaggtgacgggtgtggtcatcttcctcgtcgtcatggtcgtctttttcgtcgtcatggaagtcgacggtggtgcgattcccctaccctccctcccccactccctctttgtctccctcacagatctggcggagggggcgaaagcggtggcatggccagagggggagagggcagcagcgggtgggtggtggctttttttttctccgaaaacattttcgcaagcaggtggctatagtgcctacgaatatggagatgccgcctgctaaaatcatttttgcaggagggacaaatgtccgcctacaaaaatcgtgtattttcgcatgctttgaagttcatgcggagtggatggccacctggaaaaatcgctttggcccgtttgcaaaaatgtttttttatagtagtgatttagaaatagagacagtaataaggaggagcaatataaatcctcaaccaaaggtacacatacttgttatttcagatttaggtagagctgatctcttagatgcaccttggcttgtagataaaaaaacctattactctcgaaaggcttgggttaattctctgagatatcttccaccgctcagaaggctaccgcacatccatccatatgtaactatgtaagtccagaaaaagtcggctgttttttaggacctctacccgctctagtgtgggcatgaataaagcgtacaaaaattgttggggcaatttcgttcttgtctctacttcgattttcaatattgattttgcccctatattttaggttttcgtttttatccctactttttttttaaacgaaacagccgtttacctctattctgttaattcttgctaacggtgttcattgcggggtagaaaggataagtatacccttagatattttccggtacttttgtacaccactttcaaatttgacccaaattttggcaaactttcacaattttttgacaaattaaattactgctatagtatggcatcaatagatttgtattttgattatatcaaaagtacgggaaaatatctaatggtttacttgtctttttaccctccacatttaacaccgttagcaagaattaacggaacaggggcaaacggttgattcatttaaaaaattagggtaaaaacgaaaaccctaaaaaacaggggcaaaatcaatattggcaatcaaagttggggcaagaacaaaattgtcccaaaattcttcccccataatactcgtttaaaatttctatcaaacatttccttaagatcatagttatgtggaaagctagatctaggaggaggttaaaaaaagctacaaagaaccctactcagatgaggagttcaacctctcaaattgaactccctctcaaatagctcgagggctatataaggttgcctctacgttcctcgctaggaatacgagatcgaagaattggagagagagagtagaaacacactccacagaaattaataggagaggcaaaactcatgcggaatttaaattgcatgaagtaaatacaggaatttaaattacataaaataaattcaaatcatatcattacaaaagagtggagctaactgttacgaactctgttgatttctggaaagtttgagaggaagaagatagaacagagtcgaacaggggaagaacacagagagagagagagatattcagacttggggaaggggaagaagtattcagtttaggagatagttcagaatacaattaattcgacctcttttcccttccacctagtgcgcttatatagccgcgcgaatacatcagcccatgatccattctggcccagcgattctgacattggcccgcttgatacgctcaggtcgaactcaatgcttcaccgggttctctgttgtcggattgtccacagtagacgtatgagtagtcgctgccgtgacattcctccctccttcggaactagcctgcccccaaggcggtgcttcaggaaaatgcaggtggagagctgcagcatcctcccaagtagactcagccgacgagtgaccttgcagcgaatcttcacctgttctgtcgcatgatctcctcttttgaccacgcgtcgttcaagaatttccacaggaacaatatcttcaggtggaacagcaggaggaagacgaacatcagtaggttgagcggggtaagatgcttgacgaagctgagagacataacaccggatgaatagcgcaatccaatggaagctgcaaacggtaggccacgactcctactttagctagcacttgaaaaggcccaaagtagcaaaacgccaatttgtgattagaacgaacagccaaagatgattgtgcataaggttgagccttgtgaaaaatccaaccaccgacttgaaaggtacggtcagaacgcttcttgtcagcttgtgacttcattccttgttgagctcgcagcaaatgctgacgaagtaaactagtgatcgttctttagagatactacacactcagaaatatccaaaccaccaaaatgtctgggtggatgtccataaagaacttcaaacggagaggtgtcaagtgctgagtgataagccgtattatacgaaaattctgccagggcaagccattgaaatcatttcttcgggcaagcatgaataaaacatcacaaaaaagtttccagacactgattcaccctttcggtctgcccgtcagcctgcggatgatatgcggaactcattttcaattgtgtatctgccaagcgaaaaagttctgtccacaaggcacttgtaaagatacgttccaaccagaaatgatatgctgaggcaatccatgtaacttgtacatgttgttcaaatatgccaaacccacatcaaaagcagtaaatggatgtgttaacgccacaaaatgagcataatgtcacgcccagaattcactagtaacttccgaacttatttgtgcataaaatcctcgtccaggaatcaaccgaggcaatttaatatacaaatccatcataataatatcgttatattcttacaaaagaaaaaaaaacagcagcggaaaaacgatctagcgatggtttcagctccactcccacaggcagctcaactagggtataagccaaacgtcttctccttctggatcctttttcttcaactgaggttgattgattattgcaaggtgagcatatgacatactcaacaagccacacagcaaatatgcaagtgcacaaggataccaaaggatggcataatatagactcatttgcaaaagcagcatttaacaaatatttaagaatagtaaaacagtagagtaatcatcaattttaatcaacactgaacagcacacttctaaacaaccaaacccggctgcacagatctaactccaaaccaggagctaagcaaattattaccagttatagcatcaataatttttgtgagaggtgtgagagtaatcacgaaaaacattgctcaacccgcccataacagcgggcacggctattcgaatacttttactctggccagaggtgtaccactgtacccacaagacacagcctcaacatcatgtctaccatgcgtcgcgatactagaaagtacccgaatagaggttgtgacaatactctctgcacaacacaactcaccacagtgcaccattcctggatcataatcaccccctctataactataaccagaggcatggactccccagcgacccccacggacttctcgccgcttctcagtctggcaccccgcaatgaatcatgctatacaaaagataaagccgttgcccacgctggcttgtgattggcacggttaatgtttcacaacagtagctcgtgaaccggtccttaattgtcatgagcacgaccatcaaaaccatgtgctcacaacccacctttaatcagactctaattatcaattaattatcataacacgattaaccatcgtgagctaacattaaatataaccataagtaataatgtaaggtgattcagcccattaatgagctaatgtttctaagcatggctaagcaattatatatatagcatttagctaaaccaaaccaatatataaggttcaagctaattaatttattactcataggaaaataaagtcattgttggccataattaaatgggaaaggctcacaactcgatgacattcgaaaataatgcataagttgaaataaaacattagctttaaactggttcaacctgcttaaagggttatttgggatctgtgtgacttgccttgagcttcctcaaacgcttctgaaccttcctcaacgtaaacgctctcctccggaacgtccgaaactaaagcaaataaataaaatcaacaaaacagtaaaaaacaagcataaacagtacatgtggatatttttaacatgtggatatcgattttacatgaatttagcaatttgaaccacttgaatccgagttatgatgatttagttatgaatttctgaagtttaatcagatttcatctaatacagaaaaactaaaaaaaagatttatgatgtcacgatgacatcatcgccggccatggctctgaaccatgaggtcgccggagctagaggactcggctgggtcttccgagtacacccatgcgaagacgacgacgacgcgaactcaccggtgtaaagaacaacgacgaacgaaggccggcgacgaactccaacggcggctcggcttgacttgacggcgacgacggctctccgacggtcttcggcggctgcaaaggggcggccgaggtgctcctcctccgcgtgaacccgacggtgatgacgctaagcggcgacggcgaccacaaccacagcgcggcgcggctggaacgatgacaacgacggcaacggctagggctacgcggtggccgcgctacgggcaacggtagagctcgggacttggggcaaacggaagaggacgactaggggatgctttatatagtcatgggtgagagagatcgaactcaaaacgaaaggatttgagccagaaaaatccgagggttaggtggagagataaactcgaaaacgaattcgattcggtttatccgagcaaaattgatctccgaaactttagggaaagaaatatgataaggaggagataatttcccctcaactaattttaggaaaacacaagagaaaaggtcggatttggaggggaaaaaccgagccaattcggtctcaggtaagctgccagaggttgaagacgatactgtagtgacagggacggaaagtatactttccctcttgggctggctgaaaacaaagcaaagaaagaaagagaagggggagctcggctgggccgacatgggctgcacagccgtgcacacaaaggacggagatgggctggaatcagcccacggcttaggggaagatttaaaactttttctaattaaaataatcactgaaatgatctttgaattgttaaaaatacttccaatgctcaaataatttcaagaaaaatcctgaaaatacttggacactcaaagtacttaacaagattataatcaggcaatttaatgattaatttaatatgtgggtaattactaaaatgttctttgtatgattaaaattaggaattgagctccgaaaaatccgagaaatttcagagagtataattaaccatggagaatttcataaaaattaaatccatccatgctttatatttaagaattttatttcccacatttaacttcacttgtaaattaatgaacatttaatataaattctaataataatttattaaataatttataaatcctaaaacgaaaatcaggatgtgacacataacgactgaatttgtccacaaccacaaaaatacaatcaaagccggctgatataggtaacccctcaataaaatccaaggagatcgtctaccaagcatgatcagggaccggtagcggttgcaacaaaccaggatatttcactctttcagacttagcttgtttgcatacctcacaagtgttaacaaacatccggacaacacgtttgaggccgggccaagcaaacaaacgatgcactcgactgtatgtgacctgaatccctgaatgacctccaatagctgagcagtggaaagctatcaacactctggtctgcaaagtggaattcgaacccaaccaaatacagcctttgaagcgaagaatcccatctgtcagagtataatctagaaactgctctggagataatactatctgagaaatgagttgagaagtagccaggtcagcagcatacccattctctacttcttccaaccaagtcggaatgcaagatgacaaagcactcaactgtaacacttctccatgagagcaacgagataaagcatcagcagctcggttttctaatcccttttaatagaccaagcgatactgaagacccaaaaatttagtgagagcacgttgttgccagggagtaaccaacattgatcatccagatgtgtcaaactgcgctggtcagtacgaatgacaaattcaccaaattgcaaatatgatctccaatgatcaacagcgagtaaaatagcaaggcactctttttcataggtcgacaaacctctgttctggggccccaaagaacgactgaggaaagccaaaggatatcctgactgcattaatactgctcccacccctttatcagaagcatccgtttcaatctcaaattgcttagtgaaatccggcaacgccaatacaggagcagtagtaagcgctaacttcagagcatcgaaagccgcctgatgttctgaactccaaacaaacaccacatttttcttcagtaaatctttgagaggtcgactgataattccaaaatgacgcacaaatttgcggtagtacccagccaaaccaagaaaaccacgaacttccttaacattctgtggaatagaccaagattaaactgcttgaatattctttgtatcagtagccacaccagccaaactgatcacatgtcccaaatacgtaagactagtctgtgcaaatgaatatttggaacgtttaacttttagttgatgttgagccaatagctgaaacacctaccgaagtaaagacacatgctgatccaaagatgtactgtaaactagaatatcatcaatgaagaccaacactcctttccgcagtagaggagatagaattgtgttcatcagctcttgaaaagtggccggcgcagcagtaagcccaaatgacatcacccgaaactcatagtgaccattgtgggttttcagtgcagtcttgtgcacatcttcaagccgcatcctaatctggtgatatccagcttgcaagtccaaacttgtgaataaacaagaagcagccaattcatccaatagttcatcgattattggaagagggtaacgattctttactgtaatggcatttaagtgtctatagtcaatgcaaaaacgccaagtgagatccttcttaagaaccagcaacactggagaagaaaaagggctagaactcggctgtataactccctgctgtaacatatcagacacttgatgctcaatctcattcttctgagcaggattatatcggtaaggtcgaaggttaactggatgagctcctggcagtagaggaatagagtgatcaaatatccagctggtggtaaaccctgaagttcgtcaaagacagcagaaaattcctcaagtaactgagcaatttctgtaggcagagaagaagatgacgattcttccaccaacgaacaaaattccacagcatgcaacaccgcattacgatggactagtcccttaacttgattaccagtgatactagggaaaagagcaatattagctgaaacacctttaagacaaactgcacgctgcttatactgaaactgcaaggttttcgctcgccaattgatttgcattgggctatgttgctctaaccaatccatgcccaaaattacatcatagctgccgagtggtaaaaccttgaagttagattgaaaggatatcccttgtacacaccaaagacaatcctccaactcagtaacacactccaaaatacccccatcagcaactttgaccttgataggtgacaaaacatgtcgctgctgagtccatttatcggccaatccctctgaaataaagctgtgtgaactgccagagttgactaacattagaatttcattgtgttgaatcaacccttgaagtctgagagtaccacttgtctcagtgccttgcatagcttctttggaaatctgacacacttcaccttcatattcagagttaggaataacagcagaatccttctcctcatcacccctctctttagaagaagaatcccggaattccaatagctcttccaccacatgaagttgcacagttggaccatatttatgatctctgctccaacgctcaccgcaagtgtaacagagccccttagccttgagaatagcatgaagagcagctactttgtcctccacccgagacatgcgcttatcagaacgagttccagctgccaaaatggtacgaggttgtcccactggaaacactgtggccgaacaaaaattggtagtccgactgctggaacttgtctcaggacgacgagattccctcctgatcgcctccaacacctcctcctgtaaacgggcaagatccacagcagtacccaaatcttcgggtcgatgcattataacagccgctctaatttcagctctcaatccttccacaaactgggtgacaaagaacattgtattccaggatgggtgattgttcgtatttcttaacgtcattactagaaatataattcccagcaatagcgcagaaatacttctggtatattatggttacagagttcatccgcaagcgcatgaatataccattgtagcatttcacccgagagtattccaagggtatcgtatttattttatcctgtgggaagatcatgtagagagaacttgactaataatttatatattacttgtgataatcatattctaagtaggggttaagataatctaagggtagagtgacacacaagcattagctactcattctcataatatattatctaagctaagtggaaagaaaagagaaagaaaatctattcctgtacttctaatatacatagtatacatacattctagttaaccgatatacagctaataccctctatccgatgccctccttgtacttcgagaagccacccctgactgccgagttccttacaacagcccgtcataaccatacaaccggggctcaatacggaggaataacctccccagggaattaactttgaattatataccggcgcggaggaatacccgtactaagctgtcaccgtcagcggcccacctcttatccgcagtatataaccccaaataatgatatcccgtaatctaggcaccacgtctaaaatatcagatactactctaatatcatcgtcatgacagagagtaattgcatatgcaaacattatacccgcaccaaagcatctcgcagataccctagccgtatattcagtataacatgaacataatgtaaagtacgtacttatatactcggaaagtatttcaataccataaatgtatatagaagagtattctaataaaagtacaaagctttcaaaagaggaaaggaaagctactagagtcatacccgaactcttccgaaggcttctggactcctgatttctactctattcctattccaccaactagatactactaaactaaacttgagagaaatgagagagctcttgcttgaggtgtgtgttgaagtgaagagagtgaactccttaaataggcaggtaatgacggttatggtggttggaaaggtcggtaataccctccaaccgccatagggagtgaatctccactgttccctcaaaaccctgcatccatcggcgctggcattggttcggccgaacccctggtttagccgaaccctgggctggcccaaccagcccacaagttggctggtggcctcctccggtgttcctcttcgtagacttgtgaaatttggcccagtgtgtcgtgtcaatcctgagttcttggcccattcatacataagtctggttctcgactgtcacaccccgaagttctcctcccaagccaaaaatttaatttataagcgaccctacgaaaataccagtgcaaagcaagagtaaacccttttaaatcaatgcgaataataatcggaactggcatgtggaatttttcttgagttctacatgtcgaaattcactaacaggatttttagtggaattttcagagccctagaaataattttaaccagttaaaattgagcaagcaatattttaattccaggaaatccttttctcctttttctttttctttttccctccctttttcgaatgggccgctggcccattctctccttttctctccctcctccctgctgggccggccgcaggccgaggcccagccaagccgcccctccctctctccccgggacgccgacaggtgggccccacctatcagacccgtccccttcctccagccggcgccgccgcgcccgcaaccaccgccgcgtccacgcctccgccttctccgggccacgtcagccacgtccgcgcgtgcaccgcatctcccgcgcccactcccctctctctcccgcccacgcccgcgcccgagatggccgggattcggttttcgaatcccgcctctatctcctcccccactccccacggtggccggcgaaaacccgcctttcccggccacgtccggccctcccctcccctatttaagcttccccatcgctccctctcgctttttccccttctcgccaaactcccttgtgctccccatcgctcccgcgccgtgcaaccacccgccgccgccgttttcgctactccggccgccgctagctgccgctagggtcgccgccgcaccgcgccgtcgccgccgtcgggttcgcgaggctaagctccaccccggccgccgcttccccgtcgagtttcgtcgccggaattcgcatcccctcgcgctccggtgagttcaaccgctaccgccgctttcggccatgaataccggtcgccgtggttcatctccctccctctaatctctctcttctccttctttagggcaccccgaatcccgtccgccagtggccgtcgtcctcccgtggctcgccatcgccgttcgccgtcgtcttcctccgcgccggccaccctcggtgaggcgccctctcccttctattcccctccctctccctcctagccgccgctttagcgccgccgcccgttagccgtcgctttagcaccaccgcccgtcggcgccgcctttgcgccgccgtctccgccgccggttgccgttgcccggaacgcgctcgcgtgtgcgcgtgccgtcgccgtcgccgcagccggtcggtcggccttgagccgagccgggtcgccgccgcccgtccgatcgaccccgagggcgatctggaccgtcggttccgtggaccggcggtggaccacccgcgtggtcccggtcaacggtgaaccgccctcccccttgagtcgctgaccggtgggccccgcgtgccggcgccccttcctccctctcccgagccgctgaccggtgggccccgcatgtcggcgccgtctttccccccctccgtgctgacgtcagccctgggatttattgcgcaataaatgatttaaggtttttcttttatagtaataaacacagtgaatcttctaaaattcataactaattcaaccgagctccgtttaagcccattcaagtctcagtaaattaagaaaaatgtgtagaatccattaaaaatggttttgttctctgtttcagtagtcttatagcctgtttgcaatgtttgccttgtatgtcgctagattccggttcgtccgacgctccgatgtacttcgaaatagtcgccgaggttcctcctgcagcagagcaagacaagtcatgcttgtcacttgaacatgttgatcctatattgcaaatgctctattgttttccttcaaatattgcatcgttttataatgttactatgggatgtttacctattgtcatagccatgctattgttctaccatgtctctttgtcagcttggggttataacatgactagagattggactagggattgcttagccatgcttagttcaactagtgcacaatggggaaaaccttattaatgtttagactgttggttctaatggtattgttggattagtgccaccgctttgtgttggtgtgggtgcatggttttgctggtcgcatccatggcagttaaggaccggttcgcgggatgccctggaagaacttatcgtacttatcacaagccagcgtgggcaacggctgggcttgtagtgtagctttcctctagccgacgcatctaggcaagggtgggcgtggtggagttcggatgggccctgcgacggcctatgcggcttccggattcacctaggcacgagaggggactgcccgctgccttgcgaggagtgggggtgaaacctgaggtgtggtgtgcttggttagaggggggttatgcgaagggtcctgtcacggcctctttctggtatgtcgtggtggcatgtcggcgcacgggaacgtgtcgtggggctgtgtcttgtgggtacagttgtacacctttgatcagagtaaaactattcgaattgccgtgcccgcggttatgggcggtcaaccagattcaccgtgattagtctcaccctagtgtaatcttttgaatttggatagtttaggtggatggttgggcctgtcgcaacgtgggatagcgttggacagtggatagttaatattaattaattattacaaccgtttaaatctttcaacttctgtttataaatgctcattttatgcaaatgaaccactctagctctcctttgataattccctgcatcatacccctattccggtatgacttgctaagtacaatgggtagtactcagtcttgctctatttttcccaaccccagagcacgagtacgtgtcagatgaaggtttctccgaggagtaggcttcgtccgtgccgtcgaggatgcctatggagtggtgttcccgctgcagatctagtcaaggctttgctcctgttgtcttttgtttttctgctgcatttatgtaagtcttttatggtgtttgtaagacgtggatctgaatgtcaatattgtcgtttgtgtaccccggccggtcctggacggagaatttaatgcacattctgcttagaattctattcgggaatttctgggcgcgacatcgacatcgtttgattgatttatcgtttgagttgatgtcgattctcctccactttattgtcattctctgcaataggttagtatacctaatactagtggaatattattattctaacagatatatgcattgcaagcatcactagttctcctctattttggtaatattgacggtcaaaactaattgataacgaccgtcaacagtgatgtgcatggaagctgtgtactaactcactaaatttttcagcatagctaagcacatacccagtttggcgtagcctattaaactgtcgaattagagtttgaaacccctcacgcccgaacttagcacaaactgcctcacagaattcaccccaacttatcaaatctacgtgagcattagtagattgcaaccaagtcaaatctccacctatgaactgcaaggcggctactcccacccacacatctgatctaataccactcacttggaagtaagtctcacatttcaatttccatgctctaggattctctctatcaaattgaggacagtccactcacggattcacaccaccataaggaaatcccccaaaattccgccccactgaatccccaaaatcacgtccatttcgagaagcaaattgaggagtaaatgtacccttgcccgggagagacaatggagaggtattctccccaatcgcctttccccggagtgaaattcccgcgcggtggcctaacggcccgtgacccatgtcaccatgacttggacaagtctcctcctccttcggcagcggacgagatcctggcgatgtgggaagcagcggcggccgctccgctggcttgatagcactggcttgctgttttgagagctgattcacttgatgacgcaagtccccaatatcctctcgcaactccaccaccgccttgtctatggttggcttccaccccgctagctccaccaccatgggcttgatttcctccaacaaccccaccgaagcttgagctacgcacgagaatgatagcgtggtttctccaagtaatccaggatcgattgctctgatacctattgttacgaactctgttgatttctggaaagtttcagaggaagaagatagaacagagtcgaacaggcgaagaacacacacacagagagagagagagagagatattcagacttggggaaggggaagaagtattcagtttaggagatagttcagaatacaattcattcgacctcttttcccttccacctactgcgcttatatagccgcgcgaatacatcagcccatgatccattccggcctagcgattctgacattggcccacttgatacgcttaggtcgaactcgatgcttcaccaggttctcctctattgtcggattgtctacagtagacgtatgagtagtcgctgccgtgagactaacacactaaaaaatacatcttcacattggatttgaatttaaaatcacacacgaaagctatgaaggctctctcacaccaaggtgtataggcgactcaaagggagacctctcaccaagcatccaccccttattattgtccaatgtggctgaaatcccctaactaagacaatgtcacaaatgctcttagggcaaaacactagctcagataaaatctgggccatccgttgttcctccacttcaaaggaaaagcctcatatcactgacatgtagctagccacaacatgtccgccacaacaagtccaccttttccacggatgatccgcgccgctactacccacgcatgccttgggatcaatctcgacatcgcgcgccccaattaccgattgccacggctccgcctttctcctgcatgcgcgtgggccctccagccagtgggagatgccgcgtgcgccagtcggaaggagccacatcgcctgcgctctcccgagacaaaagccgccgggtggccggtacggccccacgcctcacgattggaggccacgtccactccgagtggaccccatgcccgcgccacgttctcttcacgtgccgtcctgggtgggctcacctgccaactagaggaagatcccaactagttggtgccatgcgtcccgtgctcttccgcttgagcctgcgtgcatacggtgttgggccgtgctaggccaatccggtggtgggagaggaggttgtcttgggctccagtgcttggcccgcctccctctttctctgtgttttcccttttcttgttcttcatcaattttcttggcacacttgacattgtgtagtctgttgtgaagtccttccaccacattatttatccagcatgcaccgtcttgtactcaactttgttacccgacatccttggccgttttggacttcgactcctccctgagtttagtctcgatatgccattaattgaccaaggttgaccgccaatgatcgtgacgtccgtacaaccctgtcacatagtatcccaaccacacaagactaatactcctccttgagcatagacctagttatgccattggccaaggttgacttgcattacctatagacatgtaaacgaccgttgtttgtgtatagataacgcaacctgacccacgttagtccacgtacacatttcctgtacttccagcacttgccaattttccatcacaatgaatcaaaaccacacgtggtttcacagtttctcatgtgtggtgataagagctccaatgacttcgttcccatcacctttgtgcttgattgcttgcttgtagactttttcctttccacggcaaggttttccttcggctgcaggcagtcaaaacaatggtgggtcgacgaacggtgtaaaacttgaaaccatatgcatgactaagacctaactatacacgacgcgttggacaaaaaatgaaggatgtaaaactgaacaaaacaatgctaatcctgaaattaaagattattgatagctgtcactatagttttagagctgttttccaattatttttgtctttgataagtcggatttatcaaagcatggatttaaatttgcaaggccttctgaccgaattgctaaaaaaactgtcacaaattttttgggcaaaaaactataatgtataactatagtatctttatagtgtaactacaatgtataagtgcactctaaaggcattgtaatatcaatataagttagatataaagttgtatattttattttaatatatattatatagttatagtataggtataatggaagtataattgtagatttgaaagctttttccataaaatacttgcggcagtttttagatagtcccttaaattgattgtggagggtaaaacacatgctctatatatcgttatcaatagtgacgggtctggttaaccagcgcgtgcaattagttgaccggtattttgcacgtgcatatactctacatattatacgaatatataggaggtcgtgtacgtctttaacaagccacgcagtgttaaaaaagaaaaaacaaagccacgcagtgttgtttcagcagagagagagagagagagagagagatgcgttcttccagaggtgtcattcgccattccgtgtggtgtctggtgtttgtatggtcatggcgggttgcagcagctcaggatcaacaagcaccaaaaactgatccagtcgaaggtaagcaagccagcaatcatgtacggtgtgtattgacgcaccacgtatgtctatcttctttcgttttttgacatttacatatttaagatgtgaaatttaataaattatcatctatagtcgatgacatgtgagcactcatatatcaataacctaaaagtgacgaatagttaaatgtctcttggttttcctccatgcgtatagttagattgcaggagtagtaatttgtggttgtgctcgatatatgatgtccctcgcactactacagaacacctgttagagcacctgttagagcatccccagtagatactctctcccgtcctccttacatgaaatagcgtatggtgggagaaaatccacctctgtagcggatacgccgtttgggcatccaaagatagctcatgcgctatcccgaagagagaaacgccggatatggtctttctctctcctcacgcaattccacaactgctgctcccaccctcatcagatcgagctatggaggggtgaaggaatgaatgtagagaagagagagaggatgcgctagtggccaccttagtcggccggtcttgagcgtcgccccatgatcatatgagccggccactcccgacatcggtcacatgcgcctgccctgcacccaccgtcggccaaagcgccacgcgcccacatatccgactctgccctcccccctccttctatagactcctctaagtaggcagacgcccgtggcatctcccctgccgtcctcactgctcctgcgcttgtgacttctccccccgccacccgtgccgaccctccgcacgcctgctcgcgccgctcctccgcccatgccgccaagccacttctctccccatcgcgcgccctgttactcccacccattgaactacccgtcggtggtcagccctcctcgtatgtccttcccatcctctcaggctctcagcattggatatagaagagagagaaaggtgaggaagtttttttagaggttgaattatcaaatttctcaacagttcttctcatacattgtctatttttgatttttgggagtgttgaaaggtagttgaaagatattagtaaaatataggtttttggtacatggagaatgtaatatgaatgatctattggaatcaaaaggaaaatggagtaggaaacatttttgaatggccatccaaatgggaatatggaggatgaaatttggataagctggggatgctattagggaatgatacatgtataggtgccggtttctattgagaaagagttagaggaatttgatttcattaatgacctagctatcatccatatgattattagtggtgagttaattagtaaacatcatccatgaatgcagcggtggccctgaacacgatcatgaggagatggggcaaggaggcatcatcggagtggaatgttagcggtgatctctgcagcggtttcgccgctgacaaaaacgactgggattactatcccaacatcaacccattcatcaaatgcgattgcactttcagcaacaacacactatgccgcattacaaaactgtacgcacactctctttgggcaacacctaatagctcaagcacatttttttataggtattacttgtctgttgttatgaaggagggtaaataagttggacgtggttggtcaaataccttcagagctacagaatctcacccgtctagagaacttgtatggtatctaagtctttttcttcttaactagtcctgctactaaagttacgttatagatcaagtttttcacagactaaaaattcaatcacacaaattctctttgtgaacagcagggtacatttcagtcagccatgcaacatcctttttatgttggctaattgttctacttttttatgttgttttcagggacttgaactataattacttgactggtttcattccatcattcatcggaaaattcacttcgatgaaatacttgtaggagttacatgttctatatcatgtttcatccattgatcgttattgtttcttaactattcttaattatttaaagggcattgggtttcaatccactatctggaccacttccaaaggaacttggaaacctcaccaatcttatttcattgtaagaaatattttctcatatgcggattaatcttcagctgctccttctgttccaaattactcatcatttttccgttgtcctatgtaaaatatcaagaagttgtttttttaaccaattgagtatgaattatatattgtcacaatatttctcatgatgaatctaaaaatatatatataaatctaactatgttaaactatactcatttgtaaaacttgatagccaagagtacatatatttgacttgcaacaaaacttgaatagtaggtaatacgaaagaaaatggagtatataaactactacataaaacatcataggtgtcagttttccaaccggtaccaggaagacagcactgattacccggggtcaaaggtgccggttcgaaaaccagctccttttaggcgcacacgagcaaaaaatatcagctcgatacattgagccgtcaagccgatcccaactaaaacccatatctaaaaattgcctcaaatccatgaactatagtcaataatccctagaaaaacaacacaactagatcaaataatacacatctagatcacatctacattagcaatagctcacatctatatcaacaaatcacaaagagggagggaggggaagagacggatctactggctgccgacgccatcgcacctcctccacaccggctgtcgttgccgcgccgcacctccagcctgctagatccccacagccgaggggccagcaccaccacaccaccagatccagcacaggccgcctccgtcccactgccatgcccccccccccccccgctcccgtgctgcccccgtgatggatggaggagaggagaaggaagaagtggagaggaagatagaaggaagaagaagagaggaggaagaagagaagaggaagaagagagtggactggtgggtggtggtgtggtgggttcaagcacaccggttcttctcggctcgttttactgaaaaaccatcacctataatatattttaggtgtcggtttttaattaactgacatctatattatacgtgtcggtttttctcaaaaacaagcaactatagtcccttaaaggtgttagttttttatgttttcagcctggggaggtgggaaaaacactatagttaccggttttagctagtctggcacctatagtgttgatcgtcacctataatatattttacgtgtcgttttttaattaactgacacctatattatacgtgtcggtttttctcaagaacaagtacctatagtcccttaaaggtgttagttttttatgtttttagtcctaaggaggtgggaaaaacactatagctaccggttttagctggtatggcacctatagtgttgacctgatgtgcatttttttgtagtaagtgatatttggactccatgaactaatataatagtacaacaaatggcaatcgcataagttcgagcaataaagtaataaaaaaatcataactactactcagtactaaatattatgtaataggcacgtcaatgtaacttccctgttcatgtgttgtttcaactttcaaatgatcaactaaagttgatcgaacagcaaaaacatgaacatattgtcatgatgaatattgcgggtcaaatggcacatcgggaaaaactatgccccttcctgctattagttgatgataataatttcttatcttgaaatattttattttcatttaggggcattagcttaaacaatttcacaggtggccttcctgaagaactaggcaacttgaccaaacttaagcaattgtaagatactccattgatttctaacttcatatttctatttctataagaattaaaatttggaatggccagatctattgttgaacatgacaataacaaactttcaataacaggtacattgatagttctggattcagtggtccgttcccttcaacgttctcaaaacttcagaacctgcagatcctgtatagtcaaaagcatagcctcagctgttatattcgtcatgctttcatgataaatgacattttggtgtgcttgcagtctagcatcagacaatggattcacagggaaaatacctgattatttaggtagcatgactaatttggaagaaatgtaagattattaatattaacttattaacatatctcatatgttctatcctatttttgagagagatgaatttgtgcaagataaattattctgtatatcatgttctttccattcagacttataaacaatagatttgctccgctccaacaaaaagtatctcgagataccggtacctcacagtaccaaatcgtttttgattttttgatctaacaatgctcatcctacctagctaaatctaacgatcataaacgacttattaccatgaggtaccggtacctcgatgtactttttgttagaccgaactaaatttctataaacaattgcattttcacatttcagtcctcgctagatagaaatgaataaagctgcatcacagtaacttgtccaggtggcatatacatacgtagtgattttattaagactggtcacatatagaacttttatatctttttcttattttaaaatgtgcaatgccctttttctaaaattatgagattgtagtgctttccaaggaaattcatttgaaggaccaatcccagaaagtttgtctaatctgaccaaattaacaaccttgtaagtatactctttaggtgacattgtatactcttgaaggttgataatgtcaaggctgataactaatttatgaaaaatataaatgagcaggcggattggagatattgtaaatgggatctctccattggctcttatcagtaatctgacttctctgaacaccctgtatgtgatgatttcagctataaagcttacagtatattgtctagttgcaagttaccacggttggatttcattgttacagaatattgaggaactgcaagatatatagtgatctcggagcagtagatttttctatgtttgaaaagttaagcttgctgtaagttttcaattacaggccatggtgccaattgatgatattattaatcattaactcaagttctgtaccatatgttcaagtaatatggttgtcatgtggtacagggacctaagttttaacaatatcacagggaaagtttctcaatccatcctgaatttgggaaatctacagttcttgtaagaaattctttttacattaatttgttgatagaagctcctattaagcagatgaacatgttcgatcatcttgaattgtgcccaattcaggtttcttgggaacaataaccttgcaggaaggttgcctgatggtataagctcttccttaaaagcgatgtatgtcaaatacaatcgacatggcattatagcacaatttactttcataatggaatatattaactcctgtataatctaattctgtaatgtttacagagatttttcgtacaatcaactcactgggagcattccttcttgggctagccaaaacaatttacagttgtaagtgtaatattatgatatctgtgttgctgagaaaaaaatagatattctaatattctgttttgtgaaaggaatttggtggcaaacaactttttactcggtagcaccagtaacaggtacatactaattgtgacatttagttctaattttgctagtgcactatacgaatttagttctaattcttataattttgctattgcactataagaatgcttgctgacaacttaaattttcaatccaaatttgcacagtagactaccttgggggctaaactgcctccaacaagacactccttgtttccgtggatctccaaaatgtacatttctcaatcttcattgaaccaaagacaataatatgagctaaggaattttaatgattgttacaattttgtgatcgtagattattcttttgcggttgactgtggtagtaatacatcaacgagaggatcagataataccatttatgaagcagatcctgcaaatcttggagctgcaacatattatgttactggtcaaacaagatggggtgtcagcagtgtaggacactacttccgggccacagatgcaaagaacattatatatagttcccaaaattttaacaatgtagttgattcaaagttgtttgaaactggaagggtgtcgccatcatctctgaggtattacggccttggacttgaaaatggaaattacacagttctgcttcgatttgcagaaattgcttttccggactcacagacttggctaagcttagggagaagagtttttgacatatatattcaggtaccaatcaagtgcattttatataatgtttttctacttaatcttatcattctttatctgaaactattattgacatttacatagggtgctttgaaagaaaaggattttgatataaggaagacggcaggtggaaagtcttttagcgttgttaataggagtttcatggtaactgtgtctaaaaattttctcgagatccatctattctgggctggtaagggcgggggaatctatgggccaatgatctcagcattgagtgtcactccaagtaagcgaaacattatatatagtatcaggaagtgctacaccagctgccaagaaataatattattcctttgtagattttactcctactgtgcgaaatggcataccaaaaagcgaaagtaaagtaggtataattgccggaatatctattggtgcaatagttttagtattagcagcattatttggagtgtttacgctgttaaagaagcggagggcattggcatatcaaaaagaaggtattatttgttagtacataattcaaacatcaaaattgtcaaatgaataatcttctcatctgtcctaaaaataacatgcagaactgtactatttggttggacaacctgatgttttcaattatgctgagctcaagctagccaccgacaatttcagttctcaaaatatcctaggggaaggtggattcgggccggtgtataaggttcttgtttcccataattaatcatgtacaattggatataaattaatgtgatttggcttttgagtgttgcattttagcaatattttgtccatgctcaaaatatacatgtaacaaatttggcagggtaagctacatgataaaagagttatagctgtgaagcaactttctcagtcatctcatcagggggcaagcgagtttgtgacagaggttgcaacaatttcggccgtgcaacatcggaatcttgtgagattgcatggatgttgtattgacagtaaaacacccttgttggtttatgaataccttgaaaatggaagcttggatcaagcaatctttggtgagttcacatctgcaaaatagcatgcacacctgcagcactaataaaactatatttgtttaattcacaaataaatatttttgtttcatgaataatagttgaggattttgcctttttctgcattttgttataatttgcattcatgatattaatagagctatttcttcttgtaaaggtgacagtagcttaaacctagactgggtaacacgcttcgaaatcattttaggcatagcaagtggtctaacttatcttcatgaggagtcaagtgtgcgcattgtgcacagggacatcaaagccagcaatgtcttacttgacactgacctcaccccaaagatctctgattttggacttgccaaactctatgatgagaagcaaactcatgtgagcactagaattgcaggcacattgtaagaacattttaccactgatcttcttatgattgtaacatcaatatgaatcctactattaacttgtcttatatttttaaggggctatctagctccagagtatgcaatgagaggccatttgtcagaaaaggctgatgtttttgcatttggagtggttatgctggagactgtcgctgggcgaccgaacacgaacaattccctggaggaaaacaagatctatctccttgaatgggtaagctggtttacaaacaacccatataagaaaacatcaattcattgtgtattttcattcgtttactgaaactatgttcaacaaaaggcatggggcatgtatgacaaggatcaggcgctcgaaattgttgacccaactatcaaggattttgataaggatgaagcttttagagtcatcaatgttgcacttctctgcactcagggctcaccgcaccagcgaccaccaatgtcgagggtcgtggcaatgttgactagagatgtcgatgtgcctaaagtggtcacgaagccaagctacatcactgagtggcagctcaggggtggtggcaacaacggtaacacctccaatagctatgcaggatccagctaccagcccgaagttcagtagggaaaagatatcaccaaagtttgtctccattgaaggtgaatttatagtagaaattatccgggctatcgacattgggttcaaatgacaatattgtagatcccttttttaacataattttgtgtccgcgtgagttagagcaaatattggaattacttatcctgaactctttcatggtaataataatttgcttctaataatttgtaaatagtgaataaccgtggtgtatttactacttaaaagaagctagtggataacccttaatatgtaatggccagtgcaacgcttaggtaaaattttgtcctaatatttatgcgcactgttatggtatagttatacaatgcagtaggtgtattgtccactttttaacgggttaagctttgtattcaaatctatggggacccccggttttaaacaccggtaatcccatgtgtcatatagtactattccctggataagtaagtagtacacacatagcacaatataatatcacaactgacatcgtttacaggtatttctacattaataatacatgggtatcccaaacgggtcccaaaatagaccaagcatgctcacatacattacaaaatgccaagtaaaataaatgaaacagcggaagcaaagcggcggcggtccatcgaactccacaggcaacgtctcgtgaacctatggtccctaatccatcgtcttcgacacgtacttgacagcagcgttggatgaatataaccgactccaactcctttctaaaagatttaattaagcaagggtgagtacatacatacccagcaaaccaccacttcaaaatgaatctaatgcacaccggggttcaaggatggcttggtttatttgcataaagctagtttttacaattcatttcacaaacctatgacctagcagttttaactcgaaaacaacgttaacgttgaagttgtaattatccagggttcatccacctctccaagcctcgctcggttcagtttaccctcacattcattttatagcaactctatcataccaaccttcccacgggttgggcaaggttctcatgtctcacaatttctacactaagcaatattaaaatctatgagtctagtcaagggtagtataggtcccggcactcattaaccgcgattacggctattcgaatagattggtttactcacactgtattagatgtacgctttttatcccgcactccgcggcttgcacaatacatgagcctagtcccaacacatgagacttgtcacggcccgacttttcagtcgctcttgcatttggcactcgctccaaggactatgagcccccatgcacccctacagtccaacctacctactgccggatggtgaggggagtcctggcgctccagggattaggagatatttactacatatatacttatagagtgtattttaggttttacgtgtgcttttacctttccgacaccggactcatccacatcgtactcatacagaacctaccatgactggagtgtcgccccacaagagcttcctagtccgtcgtctgcccatacataagaaatgcaatcgtactcggttcatttcccgtataacttcctgactcggtccttaactgtcgaaggtcagcgactaaccgtttccaaaaccactcatattttactcatgccgccctagtcgaaatagttttgttttattaagttttggttttcgcaaacggtttgtgtgtggtaggtggcgctcatgtctccacccgcaaatcataaatcactcacattgagtgatctcacatccatatccatataatctaagtttggagtgtacaaacgtctacaatagcaatactaagcaatgtcaataattgactgcgtataaataaatagacttaggctacaatggatataaaaaagtgtataacggtaacaatatcaagggtaggcgatattcaagtataggtacgcaatttataaatagcatgcaattttatttgcaagcaacacatttataaatataggctcaatatgttcaaggaagggagcgtagtgacttgccatgctataggtccctaatgccttcgagagatctgtatcagttagatgattagaatacccacaatcgaagaataaccagaatattcacgctcgataaacggcccaagaagccacacataatcctaaggaaataaaataaagcaacattcaatacaaactatgtgtgccattaaatatatctcgattttagagagattgtggaaattgaacggagtcaaatgtagttatggttcacaagataaacggagtatcctttcctctcctccttcgatgcagctgaatatttactaaaagttatatttcgctattgcattccagtagttcttgtccagagcatgctgaaagcctttggttgcaatttcagatccattcggcaatttgccctggaaatacttaaattgtcagtgagttcacaattattatttgctacaaactgttccattctacaataagagagcaaattaaattaatctctaaactgaaaatacaggttacacctttctgctcacaatcaaacttcggactatattagtaccttataaacggcgctaaaatcaccttgtcccgcttatatttacttgtaaagttatctatggcaaaactcctggaaggctggaaggaaagcattaggtgagtttttccagttccaaatggaaaagatctagaaattgaatagatatttgaagataatatgtatatctcttatgtttttccacctctttttataattgcaatgcacaggtaatgacttcttctcatgcacaggtaatgcctatattgaaccatattgtagaaaagagcttcttatcagtattcatatctcactgaaacctcactatacaaaatgaactctaggctagttttttactctgtcaggttaattttgtaagaaagattgcggagcattagtgctttgagatccttgatattttttacagtagtatcagtgatattttttttacacaaaaaagtattgtcacaacaaagttttgtcaggtttgaaagtgaaacctggagcctctcatttctggcaaggaattatggatgtgaaagaagtgttttataaattctgtactaatgtagtaggcaatggaaggaatactttgttttgggaagataattggataggaggtaaacctttggctgaacagttccgtgatttgtacaatattactttgacaaaaaagattactgtggcagatgtgaaacaggtggggattgactctattaaattcagaagagatgtcctggggaataaactgctgaaaattaagcaatcctggagtgatttggttctggaagatggaaccagagatacacttcggtggaatttgaccaaagatgggaaattcactgttaaatcctttcacacagctctgaagatgcaacaggtgattttcccgcataaaaagatatggggcttgaaagtgcctttgaaaatcaaaatttttatttggatgtttacaaaaaacaagattctcacaaaggacaatcttttcaagaggggctggagaaaagggaaggctaattgtcaattctgtgaccaaacagaaactttacaacctcttttttattgccctttagctagactgttatggaatattgtgaaatgtgcccttaatataaattctgtgttgaatagacaagatctgtttggatcttggatgaacaagattgataaatttacgaaaaaacttgtggtagtgggtcttgcggcaataatatggacaatctggaaatttcgtaataaagcttgttttgagaaaaaactcccagctgatcctactgatctggtgtttatggcttgctctttggtggactcgtgggcaactttgcagaagcaggagggaagtcgaagaaatcttcaactgggggccaggttgctaaaacaagtggtaaatgaagtctacaactcgaagctcggctggagaggaggtgttcgaaggattaggtcataactcaggagaggaaatgtttactgagtattttgtgtggatggaatgagcaaagatagctctgtaatagacaatctagctatggtctttgtttttttcttttgcataagggtcggatgtcctccctcagatgttttagtttttatttttctgttttctgtttagtactctggtagtctgacttgatctcatttctagtaaaagaaatgggggcttcatgccctagctcaaaaaaaaaaatcagtaattaactcttcagggatcaaaataataaagatttttgaaaactgcgaaatacaaaattgcaagtttgatctgaaactgcggtgaataatccattttgcattaacattagtgcagtacatgttatcatagctatgtagtggaatttggtacttctagaagatcttaaactggatgacaattacaacatcaacaatgtatagtctggataaaaaaatggattcaattatgcagttcagcatattcaactctacaactaaaattcactgaaagtatccccttacctttctatatgaacagaaatcaactgcaagggtgagaatagaatgcaggcttgcgctggagcatggcaatgaagataatttgtcgctcagcattgctgtgcgagtgcacagaggaagatatagtggtagacatggggaggggaagtggagcggcggtgggcgcaggggagctgcaagccagcggcatggctggagagggagaggaggatgtgccgatggatggtatcaatttcatagggctcgcagcatcgctgaacatttggtgattgggagcgcactgatgttcgcgggggagaccagacgctgtcagcctggccagatttttttttaatcccccgtggggtgtctttgtattaaagaagaagagaattgacccagtttataaggaaaaccggacccgaaaaccatacagctgcacggttaattatgggaaaccggctgaaacccactgcacagagaagagaaagggacctagctacacaactaacaaaaacggcggagcctaaccacaggatgttgctgccaatctaacacaaaagcaacacaacagcttcgacttcacagaagaggtgttatcattgccgagctaaccacccaagcgatccagcagcgccggcttcacaactgcagcgataatgaagcgaaagttgccaaagcgaaaagcatctccgacatcttacaatggacatcagccaagccaccaaagagccacttcattcacacggctagcaccaactccctggaagagactgcaacatgtcatcgttgccaagcgtcgctgcatccatcagcgagcagctccgacttcataagcagaaacagccgaagagcgtgttgcccaccgcaagaacaaagcgacccaagaaggcgaagggcctcgccaaaccccaagatatgaaagcttttaaacccaaaagaccatcaacagtcgtcgattcataggaacttctctgaagcgacgcccccaaggaggacatgacgtgtaacactgctgccgctcgtccgaaagccggaacaaggttttcacctagagatttgtgggggatataaaagaaacgcccagacaatgcctccaagaaggaaaacggcacccacgggcgtcgtcgttgttaaactggccaaaggcacgacaaggctttcgtcagcgtcttcacatcacccacacaaaacacccccaaatcgacggccataggacagtctataacgtctcgcaagcagtcataccttaattgtagttaacggcaaagatgggctcatggccaccctcgaagcgccatcaagacaagccccattcctgcttcacgccagcacaaaccgtcgtcctgccaactccacatcctcacatcaccgcccacgaaccatgaaatccgccaccggcccctgtcgagcagggggctcgctgccagagtgcaaccccaccggagcccgcctagcgacgccgtgcagccgccgaactcgccgcaacgtgcccgagccgcgggcagccagatctgcctgcggcagtcgcccccctccggcctcatccctccggtcgcatccctcgcgccaccgccgtccggtgggcgagcatcaatgatgcaagaggggaggataggcgccactgccgccgatgagttggtcagccaccaccggtcgtgccgcgcccccgccggtgctaaggccacgatgaccttcgtcctcgcgctgccgacacctctttcgcgtgaccgacgcctccttcttcctcgcgcacagtagcgcaacgccgccactgtggcagcctccaccgttgtcggcctcacctcctcgctcgtgacgcaccgtgctccgtcgttgctggctgcaccgcctagccgtagccgcgccagccagtgccgccgtcgccgcacaagttctaagcatgcctccgtcatccgctgaggccgcgggcttccaccgcgctcctccggcgtcggccaccttcgcctgccggccacagccgttgcatcgcccgcctcaaccagctgtcgtcgcagtggacagtcgctggctagatccgcgctccggagggccagatccaccaccggtgtgctcggatccgttgcggctgacgccccgttgactgtcaccctgtcgcccgccacggccgctgacttccgaccggcacgcaccactctgcctcccacgaggctggccggatttggtgccattgagtttgttgcggctggatctgatgagggatgcagcgtggcctggacagggaggcagcgatgacggagacatggacagtggaggagccaaggaggcaggtgtggtggtgaggggatgcgacgcgacggcggcggcggtgcggcgatgggagaggacggcgaagtaggccatgcgagaggagtcatggaggaaccatggatgggagaggaagggtggaggaaccaaaaaggttcagttctagacatattgtggtgtggaagaatctaggttttattgaagtttcatgaaggatcttcatggtcttttgccatttgagccatccgacggttcatattggctggtgataacatcggacggttcaagttttcttgatgacgtggatacataattttgcgagaagacacccctttcacttatttagattatattgttggattcgttacaactacataacaacatttaagaaggctctattccgacaatttttttttactttttaaatgttgcacatatctttagtgaaatatgcaatgttccaacaagtatctattgatgtttcactatttcatttgcaatgttgcacgttatctttttatatgtctcagcaattacaattcgatgtttcaaaatcaaatatttgcaaatgtattgtattgtatgaattttttagtgtttcactagttgggacataatatttcatgtaataacaattattgttgcagtcaaaactttttatatgttgcatctctataaaacatctgcacaagtgatgaagcaatttttttttgtaaatgctgcaacaaaagtttgatttttctagaacacacatatatacttttataaaaatatatttatgtgagatcttgttataaagatttaagtatgacaaataaaatggtataattaaattatagattggatatatattttagaagaaaactttgtttagagtttgattaaaaatggagagagaaagtaatgatgaatcagtgcaccttggtaaccagccttgctcctctatgcgtgtgacacatagtaaaaaaacaagaccggtggttgacccgttctgatcgtcggttcaccggtcgaaccgccgggtcagacacaactagccttgctcctcactacatgcatgctacagacgtggccctgcatgcgacaaatgcgtagcagcatacaatttgtagctttctccccacatccatgctgggtgccgacccgttactgatgtacatagttgtaacggttgaactcttttgaacaatcagtgatgtggaaaagaaaatcccagccgtttatcgacctagacgtggccgtccttccactctcggtcctcactcattgtcagtgcctccaccaggccaccgcttgatgtgtcatgcccacaggcaacattgtggaagaggcgctgtgaagaggacatggccagatctgttgctgtcatcatgccggccttgtgtcccgtcatcaaagctaagtggaggatcgatctataccaactatagagaggtgaatggttaaaatacccaaaaaccaaaacttttagcagaattaaaagttaccatcaaatcgatgtaaatcggcctgaccgtagatcttgcaccgctccactactgtagaactgatatggattaaagatcatttgtagtcccggttataaagtgcaaccggaccatataatatttacttccgattggtaacacctattgaaattaaagatgatatttagtcctagatcactttatgttaaggggctgtcaggggccatggcatctttagtcaaccggggctaaaaatcatgactttagatctttagttctttagttcggttggtagcaccaaccggggctaaagataaaaacatttataacattcttcttcctcttccaacccgagcaattgctgcaaagatttgtaggaggaagggaggtgctgccaaaattttttgtgtaagtgttttggtgataatatacaaatcagagggatctagaaggttagcaactctcgaatgatgtatgcttagcatattacatttatggaaaaattcgctactatacattaaaaaacgtgtatttagctggtggacatcgcaaaaacacgaatttggtgtcgggcatcacaaaaaatggtaattagctgatggacactcgcagccatatcttattatttccgggggaattggaaagagaaaatgatgtgagagtacgattttgcccctgcgcggcttcaatccatcaccgccatcgccgaaactggtcgtcgactacgccgccgctactacttcctcatgcctgtagtaccccaaggcgctcctattccagtcgccgcggttgccgagaccgagaacgcgatgtagtcgaatcgtctccacctccccttcaaggacagcgcccgcaccgccgtgccagtgccgcatctgggcctccacgtcgctcgtcggcgacgcctacctcctctccaacgacgacaaagacgatggcgaacggcgcccgcaccgccatgctgtccccatgctggcgccacagccgcatctgggcctccacgccactcgtcctcgacgatatagatggccaaaacgcccgaggcccgacggcccagcccacggcacagcgttttggcccggcccaagcacggcacggcccgtcaagggtcgggcccgtgccggcccggcccgactaccgggccgtgcctgggcctctctgccggcacgttgggccggcacggcacggccgggccggcatggcacgatgggccgcatgccaagcccaacacataaacaatagggagtaaaaatagacatattttatgccacagtcgaaagaatagggacgtaaaatagacttattttacctatatatatgtcagcccaaagaggagggacgaaaaatagacttattttcactatatatatgtcacagcccaaagtggagggacgaaaactagacttatttaaaaaaggaacgatgggccacccgcgccttcaggccggcccggcacggcccgacagctggtgggccgtgcctgggcgggaggcgcagcccatgggccggcacggccctgcacgaagtgccaatcgggccgtgcaggcccgatggctggtgggccgtgcctggccgtgtctgggccgggccttttggccatctatactccccgacgacgatgacgacgacgacggtggacggcgcccgcaccgccgtgttgtccccgtgctagcgccgctgccgcatcaggcctctacgctgctcatcctcgatgacaccgacctcctccccaacgatgacgatgacggcgaggaccggacggcacccacatcgtcgtgctgtcccgtgctgtcgccgcatctgggcgctgctaagggcacccatcgtcgtgctggcacccgcatcgtcgtgctgtcgccatgctcagtgttctcgctgccaagggcgtccaggagctcatgctgctcagcgtgctggcgtcgctcctttccttaccagagagcaagttaccaagggcaaatttatctttaaagagtgtttctctctccaattcctccaaaaataataaaataacgcaacgagtgtccatcagctaatttccagttttttttttgcccaacaacaaattcgcgttcttgcgatgtctaccagctaattacatgctatttggatgtcctatagcaaattttgcctacatttatagctatgttttttatatattattgtgtctaaaaaggttgatggaaaatgatgagagagaaaatttgtttagggaaaattaggctacttttaaaatataaacatgtggataaaatgttgtaaaagagataacaaaggaaaaatgtagaaaattaagataaaagaatagaaaactaagttaatttaataaaatagttagaaaaagtacaatgtattaaagatatgcttagaactttaaaaatagttaaaacatgaataatatgtgggagtattgtataattattgtacgattatttatatataattattgtatgattatttaattagtttgactttcgtggattttatttttacgatttttgtgcatttcaggtaagtggatcggcaatgtgtgtacactgtggaccgatggtcgaaagagtttatagaaggcgtgtattattttttgagtgtggccaatattaacaagcataagggttttatgtgttgtccacgcaaaaagtgaaaaaaccagaaggagtattctacatcaagaacatttcatgcccacttgtttcagtcggggttcatgcctagctataattgttggacctcacatggaaagctaggggttgcaatggaataaggtgaactagaagaagagaacatttcggactgtgcgcctcaataaggtggatttcaaaaaaatacaaagggcgaggcgaacggggcttttgaagataacgatagtgtggatgatcttggtcatatgttgcacaatgtaaaggaggactgtgaaagtgaaaaggtggtccagaaattggagcgtatgttagcagaccacaaaacgtcattatgtcctggttatgaacaggggcacaaaacgttgggcaccacgctagaattcttgcaatgaaaagtcaaaaatggtgtgagttacaaggcatttggcgagttattgaaactcgtaaagaacattattccggagggaaacagattgccctaaataacattcgaagctaagaggtagtctgccctctaggactggaagtacagaagatacacgcatgtccaaatgattgtatcctctatctccgtgaggaatacgagaacctagaagaatgcctggtttgtaaagcactacgatacaagattagaggagatgatccagccttcgaagaagagagttcctcctaaggtgatgtggtatttccctataataccacggctcaggcgcttgttcaagaacaaagcgcatgccagaatgatgcgcgggcacgcagaagaacgtcaacaagacgggatgctgagagacaccccgttgatgggttgcagtgatgaaacatcgaatgaacatttcaatacttcggagaggatgaacgaaacgtaaggttaggtttaagtaccaatggcatgtatctatttggagagatgagcagcggccatagcgcttggcctgttaccatgtgtatctacaacctcccccttggctatgcatgaagcagaagtacatcatgatgccgattattatttaatgccaagagcaacctggtaacgacattgatgtgtacctaagaccattggatgaacatctgaaactgccggggaagaaagaaggtgtttgttagcattaacgattggcctgcacctagcaacttatccgaacagtcaaacaaggggtataaggcttgcacccactgtatggataaaactgaaaatacgtatatgaaacattgtaggcaggttgtgtacatgggccatcatcgattccttatttcaagccacccattccggaagaaaggcaagcatttcgaacagaatgaagaccgccgtactaagcctaaacatcgcaacggaaaagtcttgtttactctggtgaaagatctagaagccatgtatgaaatgtctatatatggctcttatgaagagatgtaacaatgaatagaattaatcaaatatgttgatttctagcttggaggattcctccaaagttagatgactgcaaccatctgttataatacttacatgtatggctaatgttgggtttttctatgttttctataaattttatattattcttttttttattttagatactaaccccaggcatatctactgaggctaatgttttgatatctctgatcttgtttattttcttccacttcttgtgttgctccatccaaaatactcatcccaggcgtatctattgtggcatgtaattttagacattgcaaatatgcatatttctctaccgaatatggctttagatgactccagttagagcatgcccaacagctaccgaatactgctaccaatctcagattttttaattcctatggaaaaaagtagttccagcatttcccctatatgccaaaaaattggaaaccccatctccatatatctcgctctccacaagttgggtgtcctcctcattccctatccctggatctgagggcaagtgcgagggaacgtcggtaggattgaaaaaatagatttattcgttacatggcccatttttaagttttaggcatctgttggaaagacaaatattttcacccctcaaattccatttagggttctccaaaataaaatttggggatagatttttgaacatctcttggtgatgctcttggtttacgctgatttcaagtaatacatgcaaattaacattgatgtccatttgtcagacacagtaatctccatcatttctgtatgatctgatattggagcaaatccgcaggtttgataattttcagtaatctcaaccatacatcttttctaatctaataaatcatgtttatctatactaattactatctcaactactggtagaagaatagttttctgtgctagcaatagaactcataaatgaatgtttgagatcacttctacttatgataatactggcagtacaaggagagaccaacataaagttactctttctcgtaattgtgcgagaaaaaaggctgatcatttggtttaacaaaattctttcaagggcaattctagttgggatgtattctgtacaatcctgtgaaaggtagctgacattacaaccgcagccttttcattcacaacaaaattgaaatttgtaaaatcaaaggtgtttttgattattattctgtgataaacaattggcatcagagattattggttttgatatttggaatttatttgtgatcgaagtggttttggagatgattagatttcacaggtgattgacagggacttgttgtttgtcgggaccggtcagaccgggccgatgctgccggtcagaccagagctatgtgagcggttagaccggccagcccacggtctgacctgccgacgctgtgtcagtttcggtttcgggttgtttatttggatatccgtgattgtttcatatttatggcttctagatggatattatgcgtatgtaatacagttgtttgctactaatgagttaagttagggatagcttggtctcggaatatggtttctttgtttgtttcatgtgtaggtgacttgatgcctcgggagagtatttgcggtgatggaccgggagttgacttggtggtaaggcgatgtccatgatggtcagatatcacacgggatacttaggctagagttcaatacatgtggttggtgaagattccatatggcatacgatggaggtattgtttgcgtatgggatgtggagtctaatttggaaggagtccaaatttgatatgattggttatgtaaagtttgtttcttgtacgagaaggtttcctagctaaggggattaggatttctagtatgagtttggttcgtggctttaggctgcctacctcatgtataaatagagacgtagcgtgagggttctcggtatcgcttttgacagcaattgagttgctagtttagtgagggtttcgagtttagtcgagatttttgtaagtagtgctgttgatgtactttgtaaacacagaaagaagcaataaagttgtcatccactttaagagttttttgatttgtgttttatcgggttcggcggtctaaccggccacacaccggcggtcagatcggcggcagacctgcggtcagacaggcaacggcgaatggagttggtgattggtctcggcggttcgaccggtgttacaacctcggtcagaccgacgtgtttcaggcggtcaaaccggcgcatctacttcggtcagaccgcgatccgtcgaatttgagggtaacattttattccgcaaaaatattgggtttttgggcataccaaccattcaccctcccctctggttggcttagttcttgtgatacgatcctacaaaatttaaacccaaaacaattctatttaagcccatcaattattcatatgtagtttgggctgtgcaggtgcaaattacaaatgtaccaacaacttgaatttcacttatatgaaacaaataaataactcatctcgagatgtccggtgtgaagccttcacaagaattatagttaataatcattgctttgcacggaattttgcaagatgcaacaacaaaatttgtattttagttcactggtgtgttgctgacaacagagggtgccaactagcacagaccagtggcggatctaaaaaatcgattagttgatgtcataacgtgtctattggtattatagtatgttaattatgcttagctcaaattcttataacatataggtaaacagtttcgttataagttttgccgaaaatcatcggtgtcgcctaacaccggcccttctactgtagatctgcccatggcacaggcaaaatcttcaattccattgaatgtagagcgatcgacatgaggccattaagggcagatgaagttggtaagttaatttgagaggttgcacaaccaaattcgtgaaagctaaactggtcaggaaatcaaatatatagcggtgaatgtgcttggacttgaacaggcttgtccaaatgatggcaagcatggtaaaaaaacaatttggaactgagggaattatggtagatgaagaaccaagaattgcaataccttatttcccaactactctcattcgtatcactttcaaagaaaatggaaaacacaaaacagaaaatagcatgagttatggaggtctactaccaacaagatgttgtagcatgtacaattggaaactaatcttgtatgaggaatatatagcaacgtgcagtaggagggtgaatcaagacagtaatgattaaaccatagaggccggagaataaatcaagacagtataggactgtacagggacacagaaatattgtgaagattcaatcaatgttttcatattttgtttgagttattatcaccaatagtctgtggataatctgtggatatcaacaagtggtcggtgggatcacttattaatgtgaccttagagcgtcatacttaaaattgcatataatgactgacgaagcaattcaatagaggctatggagcaagatatttaaataaaagttgggctttggcccatattgtcgagccaagctgaagctccaattatgtgacttataattagatcactttcaattgccgcacttgtgagtatggacagaattttgagcgttgatgaattcctggaagtgatgaccacttgtttcctaccaagactggatccacaattttgaggcaaaattcacttcactacaaacatgaacttattcttcatttgttttctccaccataccggaaacaatggacaagtagcttaataagcacaaacataacaaaatttatagcataacatattcctccatttcaagcagcaggcaccttgtttacatggtcgcttgaactttgcctgatgtggctatacgattgagctgttgaagatggcaatggtgtactcgccctcaggcagaggctctgagcgtccttaattatattgatgaatagattacttgattacaaacggctctgaccatctcttaaatagacaagccataaagtaactgtcagcaaaaacccctagctcagctctcgatcagtggctaacctacaatctccgaatattttccagacgtgaacagtaactgaagaactgaaacgaaaaacagagtttttggtggtgcgaactgactgcagcttttctgggtttttttctttccttttattcacctccatgagggagtctgttacatgcgcaaccttgccggatcaacgactgaccgtgccaactgaccgtgccatcccacgatccgatcccagctcgatctcatctactctgaaaaaacagagaaactgaataacaaactctgactgaaaaactacattcagccagcgcatgcaactaggaatccaaagctaatatgctattacaaaaaatagtgcaaagactaatttaaacatgcagttaacttgtcacgaccaagattactctgacattttcccccctaatcttggtgtgctggttccaaacccatcttcttgcgaacctccaaaaatcgaactcttccaacaggctttctcaaaatatctgcaagttgatcttcggaccgaacatactccacagcaatttgcttcttttccacacactccctaataaaatgatatcgggtgtcaatgtgtttacttcgttcatggagcaccggattcttgcatagattaattgctgacttattatcaaccttcattacagtttggctaggttcttctccaatcagttcagccaacaatctagtaagccaaatgccttgacaagcagccgtagtagctgcaatatactcagcttcacacgatgacagagccactaccttttgtttttgagattgccagctgatcaagcttttccccaacatgtataacactccagtagtgctctttctatcatccaaatccccagccatatcactgtcactgaacccaatcaaactgagtccttcagttccttttcttgcaaaccaacaaccagtatcctgaaatgtacctcagtacatgcttaactgctgcccagtgttcaatggtaggtttttccatgaacctactcacataaccaacagaataagcaagatcaggcctagtattcaccaaatacctaaggcttcccacagtgcttttgtacatagtaggatcaacagcctttccatcactctccttcctgagctttaacctagcatccatgggactttgagtcgagttgcagccttccattcctgtcttttcaaggatttttgctgcataagcagtctgtgacagaaacactccagtttccttttggacaacttccatccccagatagtaactcagcagtcctagatcactcatgcaaaatttctttttcatctccagtttgaatacttcaatctcacttggttgagccccactgataatcagatcatccacgtacactcctacaatcaacttggagcacccatttcccctcacatacactgcactttcagtttcagattttaggaaattcagagagattaaagtgttgtgcaatttagcatttcaggctcgtggagcctgctttagcccatacaatgattttttgagcttcagtacctggccttcttttcccttctgaacaaaaccaagtggctgcacaacataaacttcttcctcttaactcaccatttaggaaagctgatttgacatccatgtgatgaatctgctagccttcacttgccgccaatgcaatcaagagcctcacagtttccattctagccacaggagcgaaaacttcctcaaaatcaattccttgctgctgcacatatcctttggcaactaacctcgccttgtgcttcactactgcaccagttggatctttcttcaacttgtagacccatttaagcccaatggctttgtgtcctgctggcaaatcagctagagaccatgtctggttttcttcaattgatcttaattcctcctccattgcctttctccagcattcatgctgctctgcttcaacaaaacttgctggttcttcggtggcaagcaaacactgatcactgtagtcgaaatccaaaacaggctcagttgtggatagaatatcttgcacacggcgatacctgacaggaccttcttctgttcctggcgtaactgagcttggcggcgtgcaaaattccaccctaactgctgctccagatggcgagggcgaaacaatagtcgacgccggcgatgcgcctccttgaacagtcgttccagcttgtccaccttgattagcaacaacgggttccatgggacacaaagaaatccaccgtgaattcctcctctccaattccctccgcctcaggatcatgccatgcccaggtggccgcctcatcgaacacaacatcacgcgacacacaaacacgtcgcgccaccggatcatacatccggtatgcttttgaaccctgttcataaccaataaaaaccattctcgtacctcggtcgtcgagcttcctcaagtttggcctcactgatttgacatgaccaacacaaccaaacaccctcaggtgttcgaccgatggacaccgtccatgccaggcttcatagggggtcactccgtctagcgcctttgttggtgaccggttcaagacatataccgccgccgtaacagcctcccccccaaaaacgcgccggcatccggctgatttgagcatgcagcgcgccgccgccatgaccgtctggttccgtcgttccacgactccattctgctgtggggaatagggagcagtgagctctcgcctcattccacgatcagcacagtagtctgtaaactcaacggaggtaaattcctccccgcggtccgtccttagagcctgcagctttcgcccagactcaagctcaacgccggcttgaaactgtttgatcgccgccaccgcctcgtgcttgccggagagaagtcggacccacatgtaccgactcatgtcgtccactaggagcaaaaaatactttctcccgcccggtgtcgccggcgagattgtcccgcacagatctccatgtaccagttcgagcgcctcctgcgccctgaacgtggcctcctcaggaaatggaggatgacgttgcttgccggctagacagccatcacacagctgatccatgtgatcaatgtgtggtaaccggcaaaccatgttcgcctgtgccagcctctgtagcgcctggaaattcaagtgcccaaaacgagcatgccaccgccaagccgtctcgccgccactcgccgccaaacaaacagggcttgcaatgttcagttttagcacatacagatagctattatcacggtataccttggtgagcagcaagccttcgggatcacggagcgtgaacacaccgccccatatgagtgcatcgtagccgcgcgcgtcgagtcgcccgacgctcacgatgttcttgcgcagcttcggaatgaagtacaccgcgtcaagtgaccggtgatatccgttcttgcacttaagcaccatgcttctgcgcccctggatgtctatcaccgagccatcgccgaatttgacagtgccgacgactccagtgtcgagctcggcgaaggctgagcgcgcccccgtcatgtgatttgtggccccggtatctaggaaccattatcctgtgttctcttgttcatgcccatcatcatcatccaggaccacctttctttcggtgaggtgcacttcttgcaccctaggtgttcgaccaaacgctgcttcgccggcgagcgatagcccggtcacatgtgccatgagcagagttggctcctcctctgtctgcatcaagtttgcctcgccgcggcgttgacgtcgcggttttcgacattgcctagcaaaatggccatattcttcacagttaaagcacttcacctttgagatgtcacggccgccgctctccccggaagctgcctcttttccctttggtgtaccagcaggtttgccttggcgattcggtgcgccagagctgctgcgaccctttccaccaccaccagatgcatcctactccttctgcttgctccgtgcctgccattgttcctccgtgagatacaacttgcttcttgcttctttttcttcgtcatcgctgtagctgtcgatcgtcgacagccgcccgacgagttcctcaagagccatcgttttcacgtcaagaagctgctcgagggagatcgctactggcttatacttcttggggacaacacacagcagcttcttgttgatgtgttcgtcctccatgactccacccatgtcacgaatgtccgcgacgatggcagtgagccgaatcgcaaattcctcaggcgtctccccatccttgaagcgcatcgcctcgaactgacggcggaatccctgctcattcgcctcacgcacgcggtcgacaccgatcctcatggttttaatggcatcacacgccgccttcgccgtgtcgtgcttcgccagcccgcgcaacatctcgcgcggcacggcctgaagtatcgccgagagagctgcccgatcttcacgaaactccacgtagccgggatcaatcgccttccacagcccctgctcctgcaggttgacgcgcatcaggagcgcccaatccggatagttcgtccttgacagcactgggaggcgggtggtgtgccctgcatctctcccctgaggcacaagnnnnnnnnnnnnnnnnnnnnnnnnnnnccccccactgctgccacttgcgccgccgcggccgctgccacttccaccgctgccaccgccaccacggcgtccaggcggtgtgtatgacatcgtcgccggatcgtgacggtaccgctctgataccaaatgtcagcaaaaacccctagctcagctctcgatcaatggctaacctacaatctctgaatattttccagacgtgaacagtaactgaagaactgaaacgaaaaacagagtttttggtggtgcgaactgactgcagcttttctgggtttttttccttgtattcacctccacgatggagtctgttacatgtgcgaccttgccggatcaacgactgaccgtgccatcccacgatccgatcccagctcgatctcatctactccgaaaaaacagagaaactgaataacaaactctgactgaaaaactacattcagccagcgcatgcaactaggaatccaaagctaatatgctattacaaaaaatagtgcaaagactaatttaaacatgcagttaacttgtcacgaccaagattactctgacaataacttacctctaacaaactccaaattatctcaagcctgatttatctttagccaaacaaactcttacacaactttatcttcaccacttgtagacgcctgattcatcttctggcgcctatgatacatcccgccgattagcgtgtctgcaacactgccatactcttgacagcataacaaaggggatgtgcaacgctccacaaagctactagtaatgtgaatacttttgtgtctcattactgtagttagaagaattgtgccccatttctgtaatgctgtacttttgattctgatgcctcccatctcctggtgaactttcttagctggtctatttccaatactggaaatttgtctgatcgagtagaagaggaagcgagaaattaaggttatgttgttcttctagccagatctttcggattaacgtgggagctcatagaaagtgttcgattagtataagtatagatataaatatcgaagctttaggtctaactacagcactgccatttcctatatatacatgccaccatgcatgtattttcccttgatatacataccacaataccagagattatacgttattttttcattcgtccattttatgctagagaaaatgtgataataatgagaggtctcaggaaatagcaaaaccctcatacctatgagcctaaccggctggttgagcccccctgctgcactgatgatggaagaagccatccagctgactagtcgagatctttcgttccaagaacaagcggtcaaagttgtttgattcctgtaaggtactgctatacaacaagtacaaggatatgtaaatgaaaagctacaaccatatgtaagccaaaagagttcaattagcttaataattatcattgtggactattacggttgaagtgatctaaagtcaaattttgctacaggatatcggtgacttcgtgtttttagttataggatattgtggaagtgacttttggtgggagacactatcaaaagttagatgttttctggtggacacgtgtacccattaaaattataattttcagttaaagaggagaaaaaaaggtcatgtgaaagttctgaaaagctcttgggcccacatgttagatctgtaatctctcaatctctatccctttctcaagcacatggggcccacatgtaagcctctatcattgttttccccttctttctctgctcgcagcaggaacaggtgaggtgaggcgtggcaagcttgatggcggccggccgtggacggcggcaacaggggaaggagatgcagaggccagccgtgggtgaacgggaagcggtgagcacggagcagtgttcttggccagcagggagcagtgggtcggtgagcccgggcccaccagtgaggcgacacaggagacaggccggtgaggtcgacggaggcagaggggtcaccaggtagtggggttcatggggaagagccggctggcggcgcagtcgcaggaaaagccaccggtagcgaagccggtgtcaacgaggtccgcggggaaggcggtggatccaagaggagaaggtgggggaagaggtgagcgatgccacacggaggtggtggccgccgctgatgcagctagcggagattggacgaggttattataaaagttagtcgatatagtggaacgacgactaaccttcccgatcgctttagacatttatcacctaagacacgccagaagacgacataggaacacatgatatttgttaacgagattcagccgaagcctacatccctagggctctgattatgaacgctcctccccaaccaacatagcacctagcagctacaagtccatggccacaccgccatcatctccctgcatgtctacgctatattgtagtcgccatggttacattgtggtgcccccctctctacataagagagatgccgggttacagagtccgactataactctaccccctaacacctatcacaactccgagtccaactgtaaccaaataagactggtatgttcgacacctattctgacagaggttgaggacaatggggccagcagcgcgacaacagagtggagggcgtccgacattccagtcagagaagccgatgggaatgaagggcgctggccatggcagtgtggaaggaggggatagagagataagagagtgcagatctgacatgtgggtccaatggcatttcagaactttcacgtgatttctctcgtcttatttaaacaaaattattattttaataggtgcggtgtccaccagcaaaaatccaactttgagagtgtattccctcataagtcgcttcgcgcggtatcctacaactaaaatcatgatgtcacgatgttatgtagcaaaatttgccaattttaaattactgtcagttagttcttagagaaacagtctacactgactttattattccctttattattccctttttgcagtgaaacagtctacgctagctagcttgttcaaggttatcaacagcgtcttctctttcatctcctgtacggatattttatacaagactgcttccatctccttcttccctttctgaactgtggttgcggcacttgtgattgctacattgagtcttcaagggatcgtggtaggctgctgtttattgttgatctcttcgattcaataaaaacaaacaaagaaactcctccttcatggacattatattcacaaccataggtgtgtcctcttattaggcttgtattgttttccacctctatatcactgaaataaggcatagtttcatggatatttagaattcctttgtagccgttccggtagttttttttatcaaaaaatttaatacttgcaatggccaatgggcttgggagacattggcaaatagtgtatcatattctgttgtagttctagcactagttgcaaacacgtctcgcaatgccaattgtagtttcagcactaattgcaaataggagaatgctctcatggtacacaagtacacaacgtgtatgttctatgcggtgcaagtcaattgttttgtccaatggatgtttagatcaggagaagaatggatctcccagcagcaccaagagaacaggttggctgttaacatgaacgtcagctgccggtgatcagcttgccaaaatttcagtgaaaatatctggtattttaaaccatgcatccagatcgatcacatgacctacatgttgggatacgggtaggctacgatagcataaatcaaaattttctatcgcgtaaaccaagaaccatgcaagtattagatcatagatcgttaccactcgatgcgctgcgcagcggaagaaaacgctgagaagtcgaaggaactctcgcgaagtagcgcgcgtcgatgcagaggaagtagtcgatcgcaccggctcgaccttctcctcctcgtgcgttcacctcgccgtactcccacgccgatcagcaccacaaaccagcggcgcctctaccggtatccacacgtaaaaggacggaacaccacgtgcagatgtactagcacccgcgcgcggctaggattttgctcggggagggaagtgacggctagggtttctcacgtgatgcaatgcctccgccggtcacacccctcatgaatatatagaattcatcactcgggcctccaaggcccgtaggacttctattccgatccctatccgaattaagctcatattggatctctatccaatccccttattccgacccattaagcgtgcgaccctgtaggttcatatatactcggctttaacccgaaaactccttttcggtccacgcgtcaacagcggcccctagcaaaacgtattgacccaccgggcatacataaagatcatatcggctgaacctctagtatatacttatatggacctatttgcctcacgatatcgattaagctcaaggctagatatgtgccatcctctaattgctcaatcattcactcgaacctgttgatagattatataacttgcgattgactcctcaatcacctttggcatggccaagcacttccataatctacaacatcgaggggcccagggatatctctccataggaggggcaaatcccatcttgattattcatatcccactacatgtttcatagcatactcgaaaactacttttataactacccaattacggagtagcgtttagcagtccctaagtaagctactacacatgttgggaaccatcacaatctcaggtctaaggattcaacaccaacactaaataagatcactgatgacacaatacatatggctattgcagtgtcttatgttgggtctatccaacaacatgttcactaacatgtgtccacatcattaatttgttatctctataccatgatccatgagacatgatcatcaattaatacatgtgctgatcatctaaacatatttgttccacatatgatatttgatcagggatcctttagaaatagcaacacataatataaagagtctcatgaaagaatcacatattcattaaccaataatgagtttatctatttcaaggaacaaagtcggataaatatgtaaacatagtgtgtaatacaatcatctctatgattgcctctagggcatatcactaacagtctcccacttgcactagagccaatcatgaacgtatcttatacccattgccctagtgtgtgcctcatgcttaggctgagggagtggctttgtcaacggatctgcaacattcaaatccgtatgaatttttcatatcttcacatctcctctacccactatctcgcgaatgaggtgataccgccgtaaaatgtgtttggacttttgatgcgatctaggctccttggcttgcgcaatggcaccactattatcgcaatagaggtccataggtctagaagcacttgtcatcacacctagttgagaaacaaatttctttatccaaacagcctcctttgctgcttcagaagcggcaatgtattcggcttctgttgtagaattagccactgtatcttgcttggaactcttccaactcacaacgcctccattcaggtagaacacaaatctagactgcaatctaaaatcatctttgttggtttggaagcttgcgtcagtgtaactatttacaacgagctcttcctgtcctccatagactagagacatatccttagttcttctcaagtatttaaggatattctttacagctatccagtgactcacctggatctaattggtatcggcttgttgcactaagtgcatatgaaacatctggacgtgtacatagcatagcatacataatggatccgattgccgaggcatatggaatcacactcttcttgttttgctcatcaatcgtttgaggacactgattcttgccaagattaatgccatgtgacatcgataagaaacctttcttagaatcttgcatgttgaacctcttcaacatcttgttaatgtatgtactctggcttaatccaattagcctctttgatctatctctatagatccttatgcccagaatatatgttgcttcccctaagtccttcattgaaaaactatttttcaacgatgtcttaacggatttaagcataggaatatcattcccaatcaataatatgtcatctacatataggattagaaacaccagtgcgctcctattaatcttcttgtatacacaaggctcttcttcgtttttgacaaagcccaacgccttgactacttcgtcaaaacgaatattccaactccgagatgcttgcttcaacccataaatggatttctgcaatttgcatatctttttagctgattgtggatcaacaaatcccttaggttgtgtcatgtacacatcctcatcgagatttccgttgaggaaagctgttttgacatccatttgccatatctcataatcgaaataggcagcaatcgctaaaacaatccgaatagattttagcatagtgactggcgagaaagtttcatcataatcaacaccttgaatttgtctgaaacctttcgccaccaatcgtgccttgtagatgtgaacatttccatctacatctgtctttttcttaaagactcatttgtactcaatggcttttacaccatcaggtggatcaaccaagttccaaacttgattgacatgcatggattctatttcggatttcatggctccaagccatttctcagagtctggtcccaccattgtttcctcatacgtagtaggttcatcgttgtctaacaacaatatatcatgttgtcctgtagttaacaacgcatacctcgcaggtgtacgccgtatcctttcgaacctttgtgaagccaatgcttccacaactggttcaacaacaacttgttcaacctgttgagcaacatcttgctcagcttgttgtggttgtgtggaccttgaaacattttccggtgtttcctgaatttcttcaagtcccaccatgctcccactatcctttcttgaaataaactcttttcccaagaaaacaccgtgtcgggcgataaacactttgccctcttcccgattataaaaataatatccttttttttccttaggataccccacaaagaagcatttatctgatttaggtgtgagtttgtccgattgcaaacgttttacatagacctcatagccccaaatctttaggaaagacaaaccgggacgcttccctgtccatatctcatatggtgtcttatgcactgattttgatggaaccctgtttagtatgagggctgcaggaat

SEQ ID NO: 65668 - DNA, 3001 bp, Oryza sativa
acaggtgttgcagtcgtcggcgcagtcgcagagggcggtggtccacgcccctccagccgccggcgccatgcggcacgacaccacacgctccatcggcggagcagggtagaacatgccgacggggatcccggtcaccggctccggcgccgccgccgacgactcgccggacttggacggatcagggggatacatggccgtgtagaagttaatttgactagctagctaatggatggctacctgctgtccctgagatgtgatttaagtactggacgttctattcgttgatggatatatagatggggaatattagtcatgttagttaattaagtaattaattaattgactagttagcgattaagcagagggacatagtagttgctaggaaaatactgggtttgaaactttgacgcacgcatgcagcgggattggcctggcaaactatgtcctgcagtctgcaactggagtagtagttttcttacatgcaaatgtcaccattgacttgcagcaggagtattactggccaggtgcatctatctgcttacctatctctacagaaccgtaccatattataatgttttgttctctctatctcttgactattgtctagcttaattcactaacatctatataaatttaaatacatatatagatagcatatatacttgagataaagtctattttccttcatcgaactagttcactagatcatacaacccctaaactattttttccctcattatataacctatacaaacggtacacgttactctataatggtatttcttttttttctctccacattgtcatggttatggattgcacatacctaatagtagttgactaaatctcggaaggacccaccacatatcatgtcctatacggaaacaacctgcggatatggagggagttccggataaggaaagacaaccagagttctacatggaaacgacaaggactactcagattgtatccatattggtttcccacgttctacttgtacaaggggacacctatgggtataaatacaagaccccctaggaggagaggggagaaccaccatggaagacacccatgacaatcaacacacgcccaccagaagccacaacatacaagcctacatacgccaagacacgccgccggatatcgacttcagggataggcatggctattcccctacggtgtctccggataccgtcaggagatacgaaagcgctatctctgatctcgccgggcacggattcgagaaggaagactaccctgttgtcgactacgagtcagaccttcagatcaacatgtggacaacagttagatatgctgcccacatattgtactggtgtgattatggtgaataaaagcaactccggctccggccaacatgatgtaaggttattacctgacagctcaggggcccgaacctgtataaaaatccccgtctccgtttcttttacctcagtctcgcgtatatcctagcaccgacgatccccatactgtccaaataccgtagtcgaaacatcaaacgtcgacacacataaatcatatttttgcattgaaattcaaaacgatcgatagatgcatattacaacttacctcttagtaatatttttttaaatttggccactttttgcataagtcgaaaacacctaagactgattcaaacaaattttaaatttcaatgaaataatcatgaaagaaaagtgaagtactttggaactttgatacgtatgtcatttatgtgtcataaatggcttaataattttcagttcaaaatacaacccatataaaatataaaccataaagagaaatgctaagaataaagtgaaacatttttaatagtttaggagtaaaatgagctgaataatagtttgaaggagtaaaatggacgaatttccttaatccgtttgttctttggttaattaacgatgagtgtatttgtagttgagtgtaggcatcataggtgatggaaatattatttagtgcacgctcgctacttctgattctaaagcaccacttcttttaattcaggtgactcttaacatatcacacgactcgcacagaggactcccaatgtgcgaatgagcattcaatgagtacttctttaagtaatttgatttttgaagtgattttgaaaagatttaacatttggatagaaattttttagttgcacaaggtccagttgaaaaactatactcaaaatttgaaatctttgacttcaattaacacttcaaaactcaaaatttaacactttcaactataaattttaaaacttcctcccaaattcggaactctcaactcaaaattaaaacttttaccaaaatattttaaacctacccaatccaactcaaaatttcaaatattcacagaaaatttttaaaacactatccaaattttgaactttcaacacaaacttttaacctttcaactcaaattttgaattttttaacttagtaatttatttataattattatacaatttcatcaaggggaagaaaaaaaagtgtgttagcgcattgtcccctcactactcgcgactcgtgtgtgactctgattcaattcgccagacataggacaagctcaatttgcgtcaactagccgcccccaaccaaaagcttttgttggcagtgattatttccaaattactcattgttgcaaatacaacgtgtgtgccttagttagttagttagttattcagttatttctgcatttgtttgattcagctttgcatgagcttgccgaaacttgtggcagtcgtgctccagttgagggtcgcgagattagctcatagagcccgcatcgtgcaccgagagcgtgacgcacgttgagcagctgtggggatggacgcagcgaattgccagcgtgagaagcggtcctagtggttttgatttcattgtaatcccattttgttatataaggaagtaaaccagaaaagcagctagctgttgcgctacgccaaaattcttctgcttcctttctttcttgtgttgccggatcggctacagtacgc

SEQ ID NO: 65669 - DNA, 2372 bp, Oryza sativa
cggcggggtcgggggcttcggcaaggccaaggcgggaggcaacggcgcgcgcttcccggaggcggccgcggcggaccaggcgggtgaggaggtcggcgcagtgcgaggcgtgggaggtggaggccgccgccacgcgggagcacatggagaattaatgggagcaggagacggagtcgtcgccggcatcgagcgcggcgggcgggggcagccgagggtggcgccgccgccgccgccgccggggaattcggggaggagaggaaggatttgacgagcgagcgatatccaccgttgattaccatccaacggtcacttgattattactctcctcttctcttatttggaatgaaatcattttttatgacgctattgtagtcttgtagatagtagagcagagtagaatactataattacttaaaatgggatactaacatatggttttttattatttattaattatagagaatgtgtatgtcttcattttattataaagattagccatgatgatgctctcctagctatgataataatatggacatagttcgaagggattagtgtgcacgtttcgtgagcgtccacatttgtgctgtgtttctaaacaaacaatatagatacaatgcatgatactatttgcagtttctttgatagcatgacgataaattgtgaatggtgcattttcgtatatgttaactggtgggaacattaaaagaacattgtagtgtacattaacacaaccttttgaaaaacgaacgttgttgtgttgtgtacacattgttcaagtgagacccacttgatgactataggcctgtttagtagagctacaaatttccgatcgtatatgtttatatgttaaattatagcggtctaaaattttattgttttatctaaaacatgaataaaatgatttattcaaatgttgatcgtaaatctaaatttatggatttgtagagccaggaatacccagcaaaaaatatcttaaatatgtagtctaagaagctgtgccaaatagggatgaaaacagatcgaatacggtcggaaactagctttatcatattcgttttcataatttttttcggaatagaaatcggaatcggaatcggaaacccggatatgaaaacggaatcgaatattatcgaatacaaatacggagcgaaacgaatactgtgacgaatattaatcggaatataaaaactcctcactactcacaaacgatttttgatattgtgtttctaaaatcatgctctatcatgttattgtgtttctattgctattattttggcctttttgtgactgttgttttatcaattaaaaatttgaatatcaaaacttcaaatgatattttgaagcagtaaataaatttagctgaaaaaatcatgaacataaaagttgtagaactcatcaagacatataacttttattttggtaatttcttcatccgataaagtgacagtaacattgttcataaaatttacatctatctttcaaagtttataaaaacaaatgagagatgtaaattttgtgaacaatgttactatcactttgtcggatgtagaaatgaccaaaataaaagttatagattttcatgagttatacaactttgttgttgatgactttttcagttgaaatcatttagtatttgaaaatgttgtttgaagttgttatattttcaaattcaaattcaaactattcaaacaaagtcatatagaaaaatgaccaaaataaaagttatagatcttgataagttatacaactttttttttgacaatttttccatttgaaatcatttactacccaaaaaaattatttgaatttcttatattttaaaattcaaattttatatagttcaatcaaactcagatggagaaatgaccaaaataaaattggtagatctcaatgagttcttcaactttgttattaataactttttcatataagttcatttagtatcataaaatttaatttgaagttcttttttttaagaagtctgatttgcctcctctttggcttgggctggcttatgggccttatgtgttgtcggatatccgatggaaaataccggataatatccgacggatatcacctatatcatattcattttcatatccaaaaaattatccgaatttgaaaatttccggatatatccgaccgaaactatccgaaccgaaaaaaggtccggtcggacggaaattatccgaatcactttcaaccctagtgccaaagaagacctatgaatatagctttttgtagtctgtagggatacttgcatctcgaattttttttatttttaattttttttattaaaagttttacaaaaataattttccattttgaaaattgacggaagtagtcgcctaccgccctctgggagggcgatt

SEQ ID NO: 65670 - DNA, 9185 bp, Oryza sativa
ctgtgtgtgtgccctccacataattttggcatgcaataagtgtgggtaatatgggcatacacatctagcctgactcttccagtctccactcttcaccatgtaggaacaacatatttgttgctctatttaattagagaaaggggcaactattaatcagttgcctgatatttctctatccctccgtcgattttttaatgaacaagatctcatcaagattagcggaaatcaggtaaccctacctcttcttctcctgatccattctggcgctgccaatcacacccaatccatcgcaagcgcctccatccatgtcaccagcatcgccgccagcgaggtaagactcaccgaccacacactctcaacctctctcccttctcatactcctcgtctacgttggtgacgtcgccctcctaaacaactccgccaagcttcccttgctccacctctcctccccgtgtttggcgggggaagagaggtgggggcaactaggattcctatttggatgaagcacatgcttcaacaaccacgtatacttacaataaaaatcgaaaataattcaatagcaacacaatgaaaatatatagattagaaaataacatccaatctgaggaagacacaggtgaccttggctcaatgtcctactccatctcgtgcatctttgcaatgataatcagagaaacaattttggggtacattggaataactgaattaataaaaattggtgtcatttataacaaatttgaccagctggatggaaaataggtgactcatcaatgttgtcgcaaacagtgaaagaaactgtcagtatttttcagtatgatctactttgatttatatagtgtcttagagtttttgttttgcacatattcaacactaatattattataaatgaaatataaatatattgcaaaatttaacatttgaaaacataaatttcacttttaatattaaaatttccaaaaataataaaaatatcacgaagattaacattttgattggtgcctatgggggacgtacttacggtattttttagataatggaagctttgattgaactcagtcaattacattaaggtgatacaattatcttgagaacactttcggcctctgcataactaagatgcacacaaccgaacatacaaaaccacactcaaaaggaaaaaaagaatgacatggaatatggagaaccaccaatcccaagactaaattgccacccatgaataactccttaaccatctcctccaaaagcacatagaattaagagccaccaatcctaagactagattgccacccatatccctgggtaaaaaactccttgaccaccttctccaaatattgacatgccgcaactactatatcccgcgaaccatacttctgtaggatagcccatgtacaaagccaatggataagagaatatataacctgcaaaggtgaagatatgactatttttttaatcaaaaaccacattattcctgtatagccaaagcaaccaaatagtagcaaccgctcctaacagaacatgtgctttcaaattattatgaattccatcgagccaactcccaaacatatgcgctacacaatgtggtggaggaagtccagatgccacttggatgatggaccaaacagaatgggcaaaacgacgttcgaagaaaagatgtctaattatctcatcattgcaacaaaaacaacggttcttattgctttgccatttccctttggatgaatagttaatttagtccctcaagtttcaccgaaggctcaatttagtccttcaggtttcattttgtccacataggtcctctaagtatttgttttggcttaaaatcatccttgggcccacttaatgtgccatatggctatttctagtcaacaattctattagaaaatatccattttgcccttaatttgtataccactatacactagaaaaaagaaaaccaaaatgaataagcaacattgtaagtatacttcccattatttcaacatgtgcacataaacttgggcctaatggctatcgaatacacttgcaagtacataatttgtttttgttttacataaattgctatgcagtatctataaaaagaattcatagcatgcatttttttctcttatatatgtgaatgagggggtataagtgtcatttatcaagagagttgttggttatgtgggttcaaggataagtttgaattaaaataaaatcttgaaggactaatatggacagattgaaacattaaggactaaattgatccttgcatgaaacttggaggaccactttggctattcacccttttccttttgtcaaattgtcctttgttaataccactccacgacgcaagtaccaaagaaaaatcttaactcttaggggtatatttaattttcaaagacgcttattaatgttaggaacatgctgtgaattagagctagataatgagacttcaccgagaactccccatttgaggttaagtcccaatgaaactcatcttgttcctgagttaattgaaaaccagtgttacacgtggtaataaattattccacgccactagttttgatcctataaggtctcttctccatgaaaaagatggaggattgtttttgaagacttgtgcaactgtagcctgcttacgcctaactatgttgtaaaggcaaggatattgtgctttcaaggttgaattgcccaaccatttgtcttcccaaaacctgatttgggagccatctttaattataaaggatccaaaacggagaaagtcacatttcaccttcatgagactagaccaaaagtgtgagtccctggccttctactgagcttgagaaagaggtttatcacctagatacttattacgtatgaattgttgccaaaccccttccgtggagagcaatttgaacaaccacttactaattagagccatattcttaatttctaaatcatgaattcccaatccccttgttccttggggcggcacaatatgttccatttagcaagacgatactttttttttcgaccatcactttgccggtaaaacagtatatgctgtagaatggtgtgttgcttagctgtttttattgtagtcaactttttgagtagttttcacgaaggaactagaacctatgttgtttgggcccactttcgtattctgaaattgtaggggttcataataaacaattatatataaataaaaattctaccatgtgaacaatatcatacccccttcctgggaaaccatctctagtgtggtggtggagtcgttggtgcctaactccatccacaaaggttcaaagactggaacatatggatattatgtacatacaaataggttttcaataagaatttagtgagattagatatgtccaactcattttcgtctctttgagcgtgcgataagaggcgcatttgcggatgtaagtgtggtgttgcgtgtataggtgtgtgtgtggaggtctgccatgtaaaaaaggattatcacctccttctcccaccatcgaggcgcttgcatcccaacaattgtgtgcgttcatatacctcatgtgagatcttaatatcatttatcaatttttaggtagagaaattattttgaagagaaagttacgatcttcaaaagatgcactttatttagtacatcaaagtttttcagtttcatgtcgaaatttcttacattctagtgaaagtttatatccataattcgtgcagagagtttgttttatagaaaatatatttttagaaagtttattctaataaagaaagagtgggctcatatttttctataaaaattattttaactcgttgttgcaggtattatcacgcacaagattcaaataattataaaaaattcagataaaaagataatatagttacgtctctcttatgtcttcacaaccatataaggtcaaatttaacttaacacaagaataaaaaaatatagattacgataaagaaacaaatatagattacgataattgcaattatatatcacgtcagcggttggagttttgttgtatttgttttcatgcgcatgtgcatagaacaaatttaattaacttcgtctctagatagagatatgcgatacaataattcatgtgcataacttttttcgcaaatcatagaccgcatatgacgaacgagacaagtttcccgagcaagtcaatataagacagtgacttccacgtgtcatttggcatgtggtgtgtgactttttgctgcacaacacaacttcataatatgattccttgtcagcaacgcgtggagacagggtacagagattccttgagtttgtgcacaaatcggcctgctcgctccgccacctatgtgcacacgggactgtgagagcacgagtcggtgtcttgcttgtttctacgatgtttttggcaacaataatgtgatagccgtggagtcgaaattgttgtgtcgctaggcgacaagctcggcaatgataacactcgcctcgcgaagtcgaagcctttgtgtcgcttacaacaagctttttatcgatggctattttgagctccgccatttttacggtcttgttagcttaggttagttagagtgttgtggttgtggttttcgtgcagtttcccctaattaactgtgcattgtaaggttttggtcccgttttctccttaaaatgggacacctttttctttatataaaaagtcggcaacagcctgaccgtttgaaaaaaaagagcacgagagtgagaatgagaggtaggagattaggttaacaaagagatgggctgcctgatgtaaaattggtcaaattgagtggttgtatagcctgagaaatgtgcggactatccgcgccaaactctatactggataattcgtttaaactatcagataatcagcatccgttggataccaccgataccacatttgactccatatctacatcctgcatccatatcacacggatatctaaaaacctttaccatgtcttcaatttggatggattcggagtggaatggatcggataatattcaatccgtgttcacccctagcccataattagtcatactgatattatatggcccaattgagacatattaatcaccgtattattactatagattatctacttaattatcttgattcattaaatattttgagaaataaattataattggtccaaactattacatataagaaagtgtgttgagaaaacatattcttatagacgtggagcagataatcggcgataataatttggtgaagtagggctctgtaatgtgtcgaagaaaatgagtagatgatgagcaccgaagaattgctccaagctcagatcgagctctaccaccactgttttgcctatatcaagtacgtggtactttgtactcggcgaagctttcccacatcgatccgacggctcatgcgtgtgctcactgtgtctatgtaccattgaatgtgatttatccaatttatatggacactatcttttttttctgaaggatataattgaggatctagcaccttcactctcaagttctataaaacattggaggaaaaaaaaaggacatgccccattgatcctagtgggtccaaatgaaaataatgtagaatgattgctacaagaccctttatatttgtaattgcatatttataaaaaaatacaagaatgagatttatagtaaatataattattctttggaatacattttatgtaccctttgtgcatgaaattcagttagttatgttcaatgtagggttgcacataagactgattaacttagacgcatacaaattattactataatatcatcgttggacgaaattcaaccatgtgtagacggttcagtttttccattttctgtgagtacaagtgagaaggcacgcacgcaccacactagcatcagttgcatcctagcatttgccaagattgtttagttaaataaacaatgttggctttatcttttatgaataatagaaagagctagtttttacaccttaagggaatgctcgctctatatactccttgcctctcaattctacatctatctattatatactaaaagtccatgaaactttctataaatactcctaagacgccacgtgtcactcctacaaacactcctagaccgccacatggcactatctaatctcacagtcgattttcagttaaattggtggacctggtattttggaccattagattagatctactatttaataaaaataccttcctatgctgtgggccaaaaaaaaaaaagaacgtacgtagatacatataactttgtataactgtggtatacacttaataaacaatgaagtttacctacttttcacatagaaaaaagaaactcgcgtacgaacttaattacgataaaagcggtaaaatagaaaaaaatacgtacatggtgccattgaaagaaaacgatggtattaaaaataggattttatattatactatttaaaatatcactctatatttttgcgcaaacatacacaattaaaatatattttctacaaaataaatacaaaatattctttcaacgctctttaaacgttctatctttaaaatttaaaaattatataccaaaagttcatcgagctacaattgctaacaaggtatttgtgcatcatatcgaatatcaaagatatgatgaacatgtgtactattagacacataatacagataaaggacaatttataagggacatttgctcatttaacccttttctaaagcttaactatcaatttgatccttttttaaaaaaagtttgctcatttgtccatgtttttcaaaatagaagttgtcgtctgaccatactttcactacatcgtgagtttttcatttagaaaaaaaaagaaaaacatgtatttacaagcccaaatgactaaaatgacaccgaatacatcaaccttatcctcaaccactcatttgctcattctttatcccgctctctctcctctctctgtccaaagcgcgatgggcaggaggagtggtggcggccgcatggcaacagctgcggagggccctcggctgcttcgcggagggtaggagcgatggcagagaggcaacattgtgtcgccgacgaggaggaccgctggcggtggtggaagaggcggcgacaacttggcagaggggaagcagcagctccatgaagggtaggagggtggcgtcggctcagcgacgaggaggaccgtcggcggtggcgaatggaggcggcggctgcggaggggtggcggtaaccacggatatggtaggaggagaggaggcagagggatggcgtcggctcgatgacgaggaggataggcggtgacggtggaggggcggcggcacggtgacaaggaggaccaccggcgcccacgcacatctctgccattagcttgctacctgcagtttcttccgcacaaaattggacctaactttggaaaaataaggtcaaataagtatgggtagaagtggtatttggggcttttgttaacactgattaatgctcttaagagaagagggttagagtgtagcttcggttttgaaaagaagggtcaaatgagcaaagtgaccaaaacagggtcaaatcggtagctagacattcaaatagggtcaaatgtgcaattgctccattttataatatagattatatcattttgtttcattttataaacatacatagccaaagacacgtgtgatttactttgatctatctaaaaaaacatgtctacggtaataagaatcatagaaatttaaaagacagaaaaactcaagagcatataccctaataataccctaaaagtaaataaaaattatcaatggctaatccctacgacatataaaattataaagtattattttatcggtttattaaacgccctaaagaaccctcctagagcatctattaaagcctttaacaaataagaggaaactttaaatttcttctgtaacagataaagcatctaaaacttaatcctcattaatttaatgctcccattaattttagccattgggtcatttcaatgggtatgtgtatacatacattatttaataaaaaaacattgatgtcaggtgaggttgtattgcatggtttagagggttgttgtcaggatgactagcgttgagttttactaggttgctagccatccaatgcatcacaaaaagagcccataggagatattgtgttttgttgatcgagcgaccatcaagagaaggcaacgaaccccagtacaaatattttttatgagtaaatcttctcttaactgaagtatctatgtaatattatttaagtcgcattagcttgaagcatgcataatatgataacatggtatatctagaaggctacatgttagaacattcaattaacccatcttagaaataataatacttagcaataactcaagcaggtaacaaatttctatctttaattttgttatcaaattttaatcgttggaaagggggggatagagtgaatggttcaaacagttatgtgaatattgtccaatttgcaagctaaatgttttttttaaaaaaagagatatagcgggttactgattttgaagtattatcatactattcaagagcagagcaagtagtaatcgtatccaaaatacatacaaagaaccatgatacataattttaatattcggaaagatagaaatgcccgcgcaacgtgcgggctaccttcctagttattagtgaaaagaggatcccaagatcccactagtataagccacgtcatcaaataaacacacgatttaaaaaaagtaactgttggatcaaatgagccaaacatcagtcacataaagcaaataatacattatgggatgttttcgacccttcatgcacatatcataaaatgtgtggaaacaaagatatggtaatgaaaacaataccttcaaaattatccttataaaaaaataccaatgagtattcaatagtaattctactatatcaacgataacaagtatccgtgaaaatattcatagttacataacctaatacaaccgtcgattacttcactacatcttaaaattaaaaaaaatcatgtgacatggatgacataataaagtttgtaaagttgatttaaatcatatgattataagatttactataaaaaaacatacatatacttctcaactggtgatagcagaactacaacgcgtaacaaatatggctatttacattattaccagaaaggaaaaagtaagaattacccccctccccccggaactatcgcggtcatccgaattactcccctgaaccat

SEQ ID NO: 65671 - DNA, 34552 bp, Oryza sativa
atggcgtagtagatgtgctcacagacgatcaattgcagaaatcatcatgtttgtgtgcttgatcgggtgatcaggccgaagttgcacacagcggaatgacgaaatcgaagccggatgccgatgtcggagacgcatagatgtcgacgaggcggtgggcgacgcagttttcacgttacgcagtatttctctcctcctattctattcaacaaacagattagcttggttctcggctcaacccctcacggcccgtttggttggagggagtttttaggagggattgggagtttagagggatgaggctattaagtgttttgtttggttgggaaacataggaattttggtgggatggggatggggaattgaggaaggaactccctccttttcaatacctgggtaggggcaggtaattgggagggaattcctcctttactttttctaagcaaatctcagccatccgtttttattaatgacctaatctccaactaaactccctatcaatttccatcacctctaccaaacaagatattagaattaaaaatcaaattctcatcttaatttcatcatcaattccctcgtgtaaactcccaatccccttccctcgagttaccaaacaagccgtcaggtatgattaatttgacttcatttagcttatcctagtactaatgactaatctctaaatcatatctttgcacctattcctgttcctgaaatatgctattcccttctcagatgtacggctgaaaatttgtagatctgaaggttccaggttctttgatctctaatttctacctattgtcttctttgcctagaaagtatttatcaggaagtgagaaaaggaaaaataaagaaaacgtgccgatgatttcatagaaacacaaagaggatccattgacaagttttttagaagtagtacaagtttttgtgtggaacaacctaatgatcatgattagatgaaatcgcttccggtaactaatgtagccatgagcccatatgatgtgaccatggctactatagatataaccgctgctcacaccaagataaagttgactaagttctggaatccaattcagccacctgctaccgtgctgaatttaaatggccgccaaatctgtatacgagctatgttttcggtccgtgagtacttgatggaaagctcttgtaatcctctttccagcggatccggcctcatcactaaatttcattcccgtcatccacaatcatagaaaaaaagtgttgcgtcgcttatattggaccaatgggcttgtaacttcgtttgaggtccatgtggggtgcgccccaactaggtggagcacgaccttagggacccctaggtcgtcctctcacttttataaatagctaggtaccccttcaaggtttcttgggttttgttgagattaaagtttagcttcgctactttgccgtgtaatcccgtgatcggttagatcgtcggtttgcctgttacgaaaccccggcttatcatttgtattcaattcctttttgcaattcaaattgctttcatcttgttattgtttgttttttcgatttgcttgcaggaataaggttgagtcacaccaacatcaacacatattctcaaaccaatttcattgaataaatcatttgcaaagctaattattcatcacaaattattaatcatgataatgattttacaagggtgacaacttcttgtaacgtgacgagcaaagcctccatttgctctattgcaattgttgagaggcgaggtatgaagcagtcttttaggcaattttggtcgactgaatgtgtgtatagtgcttcgaagcgtaccaacagggtattgtttcggagccaattgtccctgcagaaagaaccatgtgttccaacccctacttgtaccctcgactgttgttgggggataggcagtagcttcattctgaagagattgccagtgcggtccatatccaattggcccaggacgattcagtctgctacagatgaaaaatcctcttgattagtaattcattttgcattttgagatttttttttattccccaaaccccctgtccttcggccgacatacctgttcccaagccaccatgcattgcgagcccaaacatgtgtcttctcctggccagaggaacactcttgtctttttatccactgctaatcacactggccggaagactgaaagcaaacatgtcaaaatttttgttctcatttaacacccgagcccacatgtcagcctctttccccattcgtacaaatgagatatggggctgggtgacggaggaggcagacaagtgagcccggatggcaaatgagaatgaaaatttgaaagtgacatttgagcatgtgtattttgggaggatggtaaatagtaaattctcccgcaatcataggttgcagatcatgttagaattaaatgggctaggcccaaattaattctagcaaccccaaagatccataattaatgttaagagattaataccatcttggaaaccaacgagaaagacctcaacttaaatagattgctaattgagaacatctgttgattggttcagatggtggttggactgccacacgtgcatgcgccgagctgagccaaggcgagtcgaggcaaaagcataaccgttgggcatcaatggtgaagttactccggtaacggacgagaccataatgcgccatcaatcccataacgttatctcacatctccggggtagacagagggtacacttcctctattccatttcattggttgttcttctgttcttctcggttttgagtacctgcgtgcatgggtaatcgaaatgagtagggcctccggaactccgactacctgagtattttctacggtttgcatcttttccatttgaatcccaactccatagctttttttgagtattttctcccatctctgcgaggcatacctgagagtgccacccttcttagatctctttaggtatttctatgaaccgaggagacggatgccctttcctttgcaccttgcatgttcaggtacactcatgtcaacttcttggccacacagaagacagattctctatcatttccggtgctcttctttgccgagtttgacaacgagaagaccgagggtgaaccacctgtcttttgttgcaaggtggatatgcaactaccttgtgcaggtaattaagctttccatccatacatgttaattatgtatgcagataatttggaaagcatgtgtgttaaaaacattggtaatgttgagtacaataccaccaaacatctaatgactttcaaatttactcccaacaaagtagtatttacaagctaatggcatgcaaatgtataagataattatgattaaaaagttatttattatctacatggaagtgataagagagacaaaagacagaataatcacagagaaaatgattaactgaaaaatgcggtgccatatttttttagcaaacctgataatgataatagatatttcttttaggaaagataattagttatgctccctccctcgaactgagatatttcctgtgtattcaatcgtatacacgagggttgtcttctcctctgctctatctcctagacaggtatgaaagttgaattcgaaaacctggaatgagcgtagggatatagatccttcaacccaagagggtatgtatcccgtagcgagtggaatggaaaggttttggtttatcagttaggtttgtacacttttcctgtccgttaagggaaaggtaagtagtataaactaggatgaacccccaagaagttttggttcatggtgtgggatgaatatggtttcaagggcttaagctatataattaactagatgatgccccgcgctttcctgcgggatatatgttagataatggagaaataatgaaatgatttggaaatgataatttagcatgtgcatgtttaattttaaaatgaaataaattttagatataattagtatatacttttggttgcgtgcctatgggcagaggccggagatgtaatccatttccattatctaaaaaaaattactatatgcttgcatgtcgagttttgtgtgcttaatgggttgatatggcatgcatgcatgtagcttttagtagtgataataaatactatacttgtgtgttgagctttaagtatttagtgagcattaagtttataaaaagaagagattataccccttattcatactcattagtttttcgattcctttcatatacacattagataagtcaaagtcacaattatattttcgttgctcaacaattatttttagaaagtcaatacaacgattgaattttccgataatccgagtattttattttgaacagaacatgtccggcgcctgtattgtgaactgcaaggagcaaaggttgtgcatccagcttttcaaaaatttcaaggtggagacaaagaattcgaggaggctatgtgtgaaaaacattctcatcttgcaaatgatcaggttttgtgccgtaacgattatcatgtcctgagcctagctaggtgggcatgacgaggatttcatgtatgtggatactgtagcctctgaatgccctccttttgcagatgattactgagatggagtttactaattgcactttgcaaatattaattgatgcaacatttccttgagtatataacagccaagctagcatgaactccttgagtgtataacgtcaatgttaattagcatgtattatagttcaaaggttttttctactgaagatatcctatcttagtataaagttatcccccactaactccttaagcttaacatgcaaagatgctacaccatcatccactaacaagatgccacatcatcatacactaattaacaagatgccacatcatcatccactaacaatcatcacatttaaatatcatgcaaacatgctatatctttatagtttttataatttaagagcttttcaaatacaaacatgttaaattatcatccagcataattcatataatgtttcaatgcatatatttattatgttttatgatattctatggtccaaattatatttctcattttttcctctaattcagttggttttagcctttagatgattaatctacggtccaaactatctccctacttttcttcttccataaagtcataccaccttactttttacgtttgaatcatcattttacatactatttaaatttatattatcataaaccacattaatttacttaatctgatgttatctaactatcttacacttttttttattgttatcgtactaaattcctgcagcaatacgcggggtttcacatagtaacacaaacacttgtgtcttttctgccttttcctaattacgagatcagcaatttcaccattttggctgtgtttgtgctcaagatgccaaatttcaccatacaaatcaggcatttaccatattaccatccatggtacctccaaagcatgcatctttttttttaacaaaaatataaacaatgtacatgtacattaggaaaaaaaaacttgtgattgcaggttggcaaatctatcacataagttaaatgccctggtcttcaaaatctcccccatacagatcatggcatctgtaatttcaaaaattctgaacatattgattactattattgcagtccaaaatgaaatcatatgaagaaatcagatgatcataggcaagacgaaacggtggctcgtcagtcgtcaagctgtacgattaaactaatagagtgatgtgtatttcactttcatccctttagcatatacctaatgaagattctctaaaagccagcagatagatagcctggtaaccacagtatctgcccatgttgcttctcttttatatatatattgtccatcataggaagtgatgaatacaccgcatctgcataaaaaccacgtcaggattcactataaacccatatatgttgtgccaataaagtgcaaaacaactgacaaggcacgcagtaatcctgcaaaactgtgtgtgtctgattagtggagacactaacaataatacttgtatcttcttcagaaaccattcaatctcaagcacacctggatggcatattctctcttcaattttttttttcagtcttaaagaactctacttaagcagctgaacagatttcaagaaatacagactagcttgagttatcacagtgcagtgtagtagtgatcagccatggctgttgcactcgcgctcttggctgccatgtcggcgctctcgtcgtgcacaagtccggccaccgcagagctcacacggcacgagcacccggtggccgccggcgcgccgctgcgcctcctcgtcgtcggcgactggggccggaagggcggctacaaccagacaagagttgcagaacaggtgattttgctttctttgcatcaaacattcattcaacaattcaatcagagaatgttaatttgttggcaccgatcaaaagaagaaaagagaacaactgtatatcgatcagagaattttgtttgtttgtttgtgaggagttagatggggaaggttgcggaggagacggagatcgacttcgtcgtgtcaaccggcgacaacttcttggagaacggcctcgccggcgtcgacgacatggcgttccatgactccttcatggatgtctacacggctcagagcttgcacaagccatggtaccttggtaatcaccatctaaacctaattaatttccatttaatactatactattagatcatatggatttataaacttactatgtgtttagaactttttttttctttgacatggtgtgtttctacaactttagatggataaaacaagtcagaacaaaataaatgatatttacattctccttaataaaggagaatggtcgaatgtcccgttgaaaagtcaatatcattatgtatttaaaaagggatggagtactaactaaaggttatcaattgttttcagttcttggaaaccatgactacaggggaaatgtgctagcacagattgacccagctctgaggaagatcgacagcaggttcatctgcatgagatccttcattgtcagtgcaggttggttaacacatcaaaacccacaacaaaccttgtttcttttctcaacatgcagcaattaaaatctgtgttcatagctagaatctttgcaaatttacaatggaaatcttttctgattaatactagaatccactgaacaaatttataatgtccttttttctgtaaggaattgtcgatttcttctttgtcgacacgaccccgtttcagctccagtactggactgatcctggagaagatcactatgactggaggggagtcgcgcctcgggatgcgtacatcgccaatctcctcgaggtcagttcctctgatcaatatccactgcaaaaacaatccgctcgttgcatcagcaaaactctgtaatgagatgactgtctatatgattgtatcacctaggatgttgatgctgcaatgaagaaatcaactgcaacatggaagatagctgtaggacatcataccatgaggagtgtgagtgcccatggagacacccaggagctccttgagcttctccttcctgtcctcaaggtaacactgataaaaagtagtactttaatcttctaccaattggtttcgcatatgagcattcgatgaaatttacgatgatttcacaggaaaacggtgtcgatttctacatcaatgggcatgatcactgcctggagcacatcagcagcagaaacaggtgagcacactaataccttgtgacacaatagaggaaagaagggttcaagaatcttatgttcttcctcctctcttttcagtccaattcagtacttcactagtggaggcggatcaaaggcatggagaggcatttttcaacaaaacgaagacaagctccagttcttctatgatggacaagggttcctgtcacttgagctcagtgagaaccgagctcgattcgccttctacgacgttttcggtgaagctttgtaccactggagcttcagcaaagctaatctgcagaaggttcagtcctctgctagtgtaactgaagaatgagagaagctggagccttcagaatacattcccacacagctgagtagatgtctacctgcataattctacttgtacaattatgtcacattgtgctcatcaatactggatttgctatgaattagcaagtgtttgattctactagagaaagatcacagaatgaagcaggtgtttttgcacgaagccaaagacaatcactattaaatagggttcacatctgacttgaaggagcttcaggcatcagttgacacagaaatgaattatgcagactagtgatcttgtcttcatacctaataaagctttaatgtcacagcttaccatggcatgtgcacacggtaactttagtgcaaacactataccagtaatactgaattcacttcaattattgtcggacgacataactgacaaacacatctcccacggtaggatgcaaatttcagattcgttatgcaacaaagatgacatatatagcatcatatacaaaattttctttcgaatttctcctcaaattgcactccatgagcaaatgggaggctcataacatacaaaaattgatgcttaagctctgaccaaaaaaaaaaagcatcataattggtcccgctgctctaatgacgccgtagagaagatgaagttgtgtggtgagtgcagttttgctttcagatagctacaatgttcaaaactatttgatcttgagcatcacgctgtcgtgcaacatttccaagagcatagcacttactcaagaatatagcctgtgtttggaaactcctgtaaccacttggacaaaaagaaatttcaatatcttcagctatctacttttaagataacagagatcttgtagccagcctactttgcgacaacattctgctcctctaaacctccagttgccttggcatgggcaacagagctaccaccatctgaactcccattgcactttggcttagcttcagccatatcatctttccttgttggtttggaagaaacactaccattagccttatgtgcacgagcacttacaccagatgaagaggcagatgattcttgtggaaaaaatggtttagcatcagcatgttttacgcccaacttctgagctgggggtggattgcctgatccaggaggaaggaatacccctgtaccctgaagaggtaaacgaggtgaagcgggcctgggagcagcttctgcgatccatgcggctgtactgtttggcaatgtgacagctgatgcaaatggaacagcttttggagtgataggaagtggtgcaacgaaaactgtctggatgccattggatggaatatggtgaagtccaggggttgaaactgcaggtactctattgctagggttgtagacaagctgtttaggacttgagggatgaattgctatgttccctggcctcaatggtgcagcccaaggcatcggaggaggtgtcaatgggggagtgataagcaagctgctttccgactgaacgtgcttccttgacacagacttcccaaaacttagtaagatacgctgcttacttgtagcagggagtgcccgttttgctatatcagcgctctttccctcaaaaactagaacagacctggaatcaacataaaacgatcattaatttagaatggtcagcttgcccatcagatatgtcctgtccccgagccatggaggtaatacacatttactcatattggtggatggcaataaacaaactagatatacttttcatgataaatgcgaactagaaaacaagaacagagcaagcagcacatttgcattaatgaagtttgactggcgtacttttgtttactacttttagaatttttaccctaattaggatatccacttcagttaagaatgagttgatttgttcagtctaaaatatggccattgaagtggaacagatgatgcaaaaacatgataggtagacaggtaaaaggtgtgacaagtaatccatgatgaaatattcctttaattaaagaaagatggctgatttagcatccttaccctgtagagagtgagagtttcagtggacctgcatgatcgcctcggctatctgctgcaataacatggccaaataccatgtcgcagtcagtcaggcagagtgtacaaatgggtctaccataccaaggaggatgatgatgagggtgagaataatctccctgaaaatagtaacttaatcagcatcactataaacttcagaaagaatcaactcctagcccacttcaatgagaatttacctcattgaagatatcgataacacagtaatctggactggaagggacaactttctgatgaaccaagctatcaaacagattttgaagcacaccaggaataggatccacctttacctctgcattccaatcccaagacagatgacaggtcataaaatcttagagctatcatgaatttacaatagagtaaatattgacaacctggcttgatgtacctcttaaatgttcatcttcaggagggccttctgtgatgggaagaccaagctgaataatttctcttccatgacccttcattggccttttggcaactacaactgtttgccctgctttttatcatagaattatataacacagcacattttacaaagatgcactgtgaaggtcagacaggacactatctgctgacactaaaacgaaatgctggaggcagtcactatgatgcagcaaacaacatattgtctaacttttcagaccagcgcaaccccatacagaaaacaaaagggggaatgcttcttccatagggtcaatagaccataaaggaactcctaaggctaagatgaaaatagacaaagttgcgacgatccctatggttgcataataagtacatacatacatatccaaaatcattttacataaataggggatctagtgtaaataatttgataaaacccgacaatacaaaagaaaaatggtgaccgtgcatctccaactcaataaccatatagagcaaaggaaccaacaatgccgtaccttccagtcctggtttacgccgcatagtcttagcttcattcacaaaagaaagaacctttcctatctcagttagatctacataccctttatacaacttaagcccctctagaacattcacctaaaaagaagcaaatgttacatacaagataataaggtaaacttgatgtactgaaataattacttcaaagtggaaattgggaatctgtccagagaagtgacataccatcctgccatcaattacttcattaaccacaaagcaagttgggactggaaccacattactgattacatgaagtcctatatggaggccaaacaagacatgaacatacaaaatgtattagatgtgattcaatcatccaggcattttgttgtattacacacagaataccagtatagctttaagaaaaatagagcacctttacaacctagttaactttacaaacagcaatttttgaaaactatagctgacatttcaaaagcaccaaatgcgcctcatagtcactgaaagaatgatggcagagcttgttgaggtataggcagtaatggaagagggacataggctgttgatgtgaccattgtgtcttaaagattatatagaatttagaacaagaagaaagcagtagtgccataaaattattgaatggacacaacacaactatgcgcccagcacttattgatcagctgatattgttgttggcatggctcactcaggtatattcaaatatgagaaaggaagccaagtcagatcaaaatagatacattgaatacaaggatcttgtgagctcacagacggttttaacacaagccatgaacgccatatacctttctgaggttgggcttctgtagcatgtgaaatatgagaaaccaactgagaattctgagttgcttcagccgatgtctccacttccttcacacctcctgtaggcaagaatacatgagtacgagattgatgagacccaagcgcatcaacagtaaagtgtaaagatcgagcatccataaatgcctaacataaagagcattaggtgcagactacattattaattttcattcccatagcacctaatgtgagttggtttggttcttctaagaatcatcatagataaagaagccgtttctgcggcatcaatcgtgcccttaaaaagtgtatcctcactaagataaaaaaaaagttactactccaattaattgcaattggatagattagacgcattcccttcccccaaaagtagttcgtatacaatgtattcataataaaggagagggggcataaatcacaaaaaggtgaataccactggcaatcgcagcatcatctccctcggcaccggcgctaccgctcggggggcgcggcggcggaggaggaggcggcggcccctggcgcgcggcggcgtggtgaagcgcgagggcgacctcggtgacggggaagtaatgctggaggtggaggacgggggcccagtggtgccgcctgcgctggacggcggcggcaacggcgtcgaacccggcgggatcggcggcgtcgcgggcgtgggcgaggaggaggtcgatgatggcgttggccgccgcgaactcgccgcgcagccacgcgacgaggccgtcccggccgtccaccaccaccgcctgctgctgctgctgcggctgcggctgcggcggcggcggcaccacccaccccggccccggcgcggccatcgtcggcgggctcagagcatggcggggcaatctgctgctagggtttcgccaattctgatggaatgccggatgcgatggatctcaccttgcttctcgtcactagtcagggggaggggagaagaagtgatgagaggtggttgggttcctggtgagccactgacttgtgggcccatggtgtatgacgtgtcatccccgtgttggggtgttggagagagaatagattaacttcgatcgaccgaacatcgatttcgtggaaggggtatagtttcttattgacgtggcgtccctatatgatcgtttctgatttttttaggattattgaaaactgtatagtcatgttggattactgaaaactgtatactcatgttagtgactatcaaaatggtcacaaagatggagatcattaccatctatgcaagcattaaatgtttaaatgctctaattgaagacagcctatagccatcacgtcgtatgagttatctacaacattagctcctgatgacatggaaatatattatagatagaagctatctatactattaaacatgtcttatatgttttccatgtgttttagtgattgctccatatctaggaaggggactttcttcagatttcccctatttacagtggtcattttatcttttctacaaactagtgcaaagaaggcttatatgaaaatttattcatttcaagggcaccacagctgatgagagacacggacaaaatacatatcatgtggtctttgtggagcatcatcaaattcgtgccatctgctgttcgttgtacctcagcaagagaggggaaaccttcgaagttgagtttacctgatgagatcaaactagcaaccaatttgactttttttaattaattagtaagataagactaagagtcgctctattaatagtcaccatacgtaagtgtgataattcagtcatcgtggatcttgccatgtgaaatttggtagccttagatggttgggaggtgggtcctccagccagtctttttttttttaaaaaaaaaaagtcgcctcatctatctgctcgtgtgtgagagcccatgcctgttacaaagcgtgggccagtacacgtccgcagaaatcccattctggcccatgaaaactctcatagtcacgtggaccagccacaatcccatcttgcccattaaatatgaggtcgcaggactagtcaaaattgaaccgactcatatatgaaaatactatagattaataatttctgtgtacaaaagaaagccctcatttgtcaatcgtcgtcgctcttcggtatatgatatccatttaccgtaacaacaacctaatgtagttagatttacctaaacttatcaagacatatagtaaccagttgaaacaagtgaattatcgctcttactgctcatccctcaactttagtttttattcattgggttaaactggtcagtacatgttaagtcacatggtatctaagcgacatagtatgtattagatgcctcgattatccgttctgatatcatgctgaattaaaaatgtatcaagccaattcaacctaaaagtttaaaccaatgagaaaaaggacacccaatttaattgtactcaagcaaccgtcgatacataaaatgatatccatataccgtaacaattatccaatgtagttagatcttttttcttttttgatgataatgtagttagattttacccaaacaaacttttcaaagttccctgggtgcgccactgctgctgctctgctggtcccttcaattcccttggatctctcatatcatatttgtactgtacatgcatgctgcccctgcatcctgcataccggggcacgggcacaggtgagaccacacatccacagcagatgcagagcagagcaggtaactatgtatgtaacccgttttctagttcatttctcacatgatacacgtgatagtatatgaagaaaaaataaactagaaataggataaacgagcttaaaaaaattcgcttgccagtcccacttgcatctctaccggtaacggctatgctacctattctattcgacatttcgattggagggatgctcgggcccagcgacagtgactaaagcaacagtgctaccactaacaggtggggacacaaaaccagtgcaccacgcctagtgcctgtctctgtctgtggccctccgatgctcacgagatgcacagaaatttttcagaaacacaggcaaaaaaaaaaaaaaaccgtccccacactgtcacaaagtcgcctaaccgcgtggttaccgcggttatcgggcttatcgcggggtacggtaatgtaaataccgcggtaacctacttaaattcaaataaatttaaaaataatttgaaattttgatgaattttgcacagttttgtacggtttttcacggttaccgcacgataaccgtgcttaccgccagggcacagtaaacccggtcccagcggtttgggaaaccctgcctccaatcgcctactcccttcgtaccccaaaatacagtaacattaggcgtatcctatcaatgtgtctaatctgattctaggtgttattgtattttagaattgagacagcactgcatagtactccctccgtcccatgatataagggattttaagtttttgcttgtactgtttaaccactcgtcttattcaaaaaaaattgtgcaaatataaaaaacgaaaaattgtgtttaaagtattttggataataaagtaagtcacaaaaaaataaataataatttcaaaattttttgaataagacgagtggtcaaacaatgtaagcaaaaacttaaaatcccttatattatgggatggagggagtataacttttacgatgtgtgattttgtttgaaaaaataatagatatgtacattatgtgtcatatatctacttccacttcgttccagaatgtaatgtaatgtgtttttagtttgattctatattgaacttttctgccatcgaccaaatgtacttagtaaagtacaccaacattttacagcatcaaattagtttagtttcattacagttcactatgagatatgtcttgatatatagtacttatttgccacggtatatgttaattatttcctataaatctggttaaagttagatagcatttgagttaggataaaactttaacaccttaatttggatggatgaagtaccgtttaattgtcagtgataatgtggtgcaaattcaggcatatcttggattcagaatttcaaatcctttcccacaagtttagatcgcctgctacttcagatgattatcagatccctaaaaagggagagtttcccattacaactgcaacatcaacatgctctattgcagtagaaacttaacatcaacatttgcttaatcaaataaaaagttactcatattggtagagaatgaactttagtaaaaaaatcatgatattagctctaactgcagcatagcctagctgcacgcgtttagtggatgctagaaatgaataatccaatcagtgttccaaggacacagttactgctactacatatatatgcatttcatatcatgggcaccatgcattattgtcatacaaacgttctacaaaatcagcagactacaatcaacaagcctaaatgaaatgctaatcttaatcaatataattaataacctaactctattcaattctaccatcaccaaaatgcaaatcaatctaagttgcctaccaattcatgcacaacactacccacataaattcagcaaaatcatcacataagccacacaaaattaagggaggtgagcacacactgagccaattgtgatgatcagaatgctagctgccacatcaacacaatgtagctaagatcagaatgctgaatcagctggaccacgacggtggcgcctagctcgtccatggcggtcgatggacctcgcctcgcccgtggggaggaatagctcggcctcagggccgacattgcactctgatggaggtgtaggataccgaagacgatcatagcagtagccgtaagtcatgtacttcgtcctgaacctctccatcgccgatcgctgcctaccagacatggccacggcattgtggatgttggcaatgtccggtgtgcacatcggtgcacgggtcaaggtgtccatagcgcagccatggagcatgagttccgaaaactctgcgacgaaaggggcgtacttgtagttcaccttgtaccggccaccggaggtagcccagctggagccatcccagattgtggcgtacagcgacatcggtttggaagggaactgaactcccatggatttggtcctctgaacctcccggattggagtctcatcaatgtagaatctgcagagagacatacagtgagataatcatatgataagaaccagcaagaatgagaatggggagggaaactaacagtgctgagaggaaaggaaaaataggaatagattggaacattctaaatatgcctgaaaatctcagtatttttttttgtgaaacaatgattcatccacagtagcatacatgcgtatatcgtaagttagaacagtagagtacaaaacataacatccaatataattgttggtccatgtatgtttcttggcattgaatggtttgttattagtcaaatacatagtcacctactttgttgtcttcaaaagatctgtactgcatacggttatgccattatgaccatgggaaatttcaaacaagtacttcaagagacagctttcctgacctgtactgttgatatcataagtactactaaccaacaatgtcctgaagttaggtgctcaactatacaaacttccctagcatgaccacaagtaattgtgccaagttgtacattttgattttgaaaccccagcatattaaatttctgggtgcaaattcccctaagctgtgctgcattttgagtctgtggtttcaagaaagggaagggatggaagatgtcattttggatgcatgaacatgaacatgtgaaagcacatgatgaaagtggttgtgtggtggtagaatggtagtggtgacaactttttcagtttctcttctctagtacatgactccaaaagttttgcctgtgactgatcataatagctttctatcattgtcgacaaagcaggtttgcaatgaatggtagaacaagaatcttggcggaaggatcaggtggaggatgatagatcatgcaaaagacaaaggatggaatgcttaattaaatgcggaaagtaattttatgcagaatgaaatgtggtgctgacagagatgcatttggatgttttagatggttgaatcatactatattcaaacaaaagaagcattgaaccccttttactttgaaatgcataattactcgacgatcttttgtgggaataccatttaactcaacttgggtcatgagtagagtacattattaaagtggcaataatccaagggaacatacaagctgtaaagaatgggaaaatcactcctctcaatcatggaggaggataaagtagaggggacaaggaaaaaggtacttgaaggtaataatggtaattattgattgtttcagtacattacatgagtaaaaggacaaccagatcaaacacaacagatataatagtgccatcttcatgagtacagataccatctaaacatcagtatgcttatagctacaaactcatattaattctatgattatggtaatggattacacattacaagcaaaagtgtttatttgaaaattttcgttgcaaaagcaacaactgtatcatgaaaaatttcactacaagagcatgttatttctgtgtgcccgcgctatttgctaccaaggtttacctttttgatttcgaagtaaaaaccgctcctcactggtttaccgaaatccaaccgaaaaccaataaaaaccgatgattttcagtcaacactgtattaaaataggctaatactgaccggtttccacaaatcgagacctagcagtttcacgaaaaccgaccggttttcgcaaaattccatcggttttgtgaaccctgtttgctacatctttaacaaattacccttcttgaaatagttctcagttttattactcaatacatgttgttactcaatactatttattcaaagcatatcgcatatatctttgatttataacagttaatttttaccttctttctgttgttcagattcttaaagatttacacctcgtcacaaagtcacaaaacgaagatagtaatgtgtttcagtgcaagcgattaatactactcagattcatgatggaaaaatcacattatctttaacaaaacaagtcataaataaaggatagatgaaaggagaatatactaaaaagcttgatcatagtattaaccaatcatgcatgaatgtgattaaaagtagggggggggggagtttccttacacgatccagtcatggctccaaagaatggcgtaacgatggaaatcctccgtcggatcaaaccacaggccatacctctcctccctgccgaccgatgtactgccattgccatacacgttggtctgcactctccactccctccccttaatgttccctaggaactcaaagtccagctcatcatgcgtcttctcatacacatcgccattcgacatctaagtaaaaccacagtaaaattaacattgtgactgatgatgacattttcagatacaatgttgcagaatgtgtttgtagaactgaaacacataatgtattatgcacatcttaatcaaacagtatgcaaagccattttgtgagatgttcagaagtatgcaggtataatgcacaattgagttgtgcatttgatgaaatatgcaaataataattaccaacggtaacatattttttttaccaaacagattaatggagtacaaatttggttctggaaatcagaaatcagaaagaaatgcactgtctctgataggggtatatatcagcaacattgcaagaggaaagaaagaggagatatgttacatagaaggcgacgacgacaccggcggcgtaatcgggcggcagcttgatgctggcgctgaagaagccatgcagatacgcatcctgcgacgcgaatccggcgcctgagacaacaaagcacacagattagattatccatccaatccaagaactcaatccacaaagagaatccgaaccaccaagaggcagagagaggaggagcaacctgtgcgctcatcgagggagatgcggacccgcttgccgtcgccatggagcgcgaggttggagtcgccgaacagctgcgtgtacccctcccggaacgacgccgccgccggcctccgcagcctggccgccatggccagcacggcctcctcctcctcctccccagcggacgccagtaagggagatagcagcagcagcaggagaagcaagaagcaccgagaggcggccatggctttgcttgcttcttgatgtgctctgcttcttgctttccaatgctctggtttgccctgtgcttgcttgccttccttcttggtgtgtgtgtgtgtgtgggtttaatagagagagaaaggagattatcttttctgcatttggtggtgtgaatgcaggtgcagcagcaagctcactccattgccattggtgacctcttttatgggcacctgcaagtcttgctgcaccctctttctctcctcttctctcttctttctctctctataagacaggttgcatttgcattgcatgagagagagagagagagagagagattttgcagtggattgtgtgcagtggtggcagagtatgtctaataaagaaatgagatactacactattattatttggtatagtatcaaatggattattatacatttattatttatttaaaacatcattggagtatctcacacattagacattacctgtccttttgtctctagcaatgcatccatgggctctcatgtgagaaactgagaactcacaagggggaaagtttttactactagttactgtgctgattgaccaatcactgtagaagaatctttttttgttatatggcctaatcttttgtgattttcttgggaacttctttggttgtattattatatttagtgctatctatcctgatgagtttcatctgtgggtgggatatataatcagttgggatgcaatgcatgcctggcattttgataagcaattaatgtacagggattctgtcatgaaagtctaccaattttggcaaggagaggaccctttgcaacacggtacaccaataatacctcaaagttgcttgagttaaatctagtggggaaaatcctcaatgtagtatttggatttagaaaaaaaaagggtccattttactcccctcgaactattttatcagcgcacttaatctcctaaactatttgttgacacattttagtccccaaaatattttaaatgtttcacttcactccacgaagtatttctcttttttttctctacataagtcatattttaccctgaaatttggtaagagtacttctcaatattttttagaatactttttatcattgttacataggatggcatctcttattgatttaaacttcaagattaaagagttcaagcaaacaatcacgaaaatatttgaaaacctgtactcctttagaaggcactagttatggtggcagtgaatttgccactgccacccaccattcttttgtaacttttataaattagtccataatattttatgatattctggaatagtctagtatttgtttcaaataagtgaataccatatatttaaataaccaaacaagtgatactaacatatttgataaaaacgtattttatctataacatattataatatattttcttttacccatagcaaaacatggtcattttgctagtattttagaactttgactatgtgtcatctatggctctaaaaatcatcttgaattacaacttatataaatataaagaaaaaggagaaatattgttaggtagtactccctccattccaaatttatctacatatttcataggtacaccaagaccaagaaaagctaataactctctcatactatatttactctagcaacaaactcaatgcatgcaccatccccaatattttctagccaatagcaaatcaagatattgcatgtgggttataaatacttgtgtgcatagatgcatgcatcaatgtccatttactccaatgcacaaataacgaatagactcaataaatgaatacaaatatgtagatcatttaggaataacctcagaaaaactatatgtagatcaatttggaatggagggagtaaagtggattatttttaatagtttaggtgtgaaatgacctaaaacaatagggggaactgatccaatgaaatagttcgaatgagtaaaatgatttttttcattggatttatcatagtaattattcgtagtgtgttcatggaataaacggatttaaataggaaatttcggtcccatggtagtacatttttagataatgcaataatattttacactttttccccaaaattggatctagcatacttatataattgcacatcactaagtgtagttattaggaattcaatctcttctatcatgaagttacattacctctatgactttttaaaatgttttgatctatgctgcatgttagataatactaagagagaatctattctataccactgataagagagaatctattctataccactgagtttgatcgagttcaacgatttgccatcgacattgtctccttctataatataccgacgactttatcaattgttctacaatatgccattgggctgggcattcttttcaaaaatacccaaaatacccttagaggacatacaagattaacaattgatttatctcattagaagtttcaaaaaaatataaaattttttatgtggcctcgttacacaacatggaagtttatatacatgtttcaagtttttttggtatatttagattttagaaaataatatttttatgtggtatatgagagaaaatttgtttatacgagagataatagcacaaaaatatcttatgtagtgtatgaaagatgatttatattaaaaacatcaataaaatgtattttatatagcatataacaaatgagttatatatttttttacaaaaaatataaatgtaaaaaacttgaaacttctatacaaacttctatgttgtgtaagtaggccatatatttttttttattttttttgaaacttctaataggataaattaattggtaaccttgtatgtacataagggtatttcgggtatttttgaaaatagtgtccagcccaatggcgtattgtagaacaattgataaagtcactggtatattatagaaggagacaatgtcgatggcaaatcgttaaactcgaacaaactcagtggtatagaatagattctctctaatactaaccatctttgagtaaacccacatttatttccaatcatttataggctttgcatagttattctaaggtgcagattgtctaattaaagcaaaaaaaaaaatcttcttgcactctaatgtttagcatttcatcatgcaatttttccgtagtaaaatgcaggagtcccatctatatttatctccgctcttggcaccccttcagggcccctttgaatcgcaggattcagaaaatagaggaataggaaaaacttaggaattgaatgccatacttattggattcctatggaattttgaaacacaggaaagtcttcaaactgtcgtttgattagcacatagaaaaaacgcaggaaccttagacacatgaagaggaaaacatgaggtgagacctcatgcttattttcctctaaaattgctctagtaaggttcattccataggaatttcaaaggaattgataggaaataatcctttgattcaaagggctctataggattatttcccatagaataaaatcctctaaaattcctatggtttttcctttgaataaaggggacctcacagtgggaatttacctcactgtaaatacaacttcacatgatttacctacctggtggctaataaattatgcatgacacccaacgtgtagccttgaatgtgggtatttattgccaagagacccttgttcttggtcattccaactttccaaggatcagagcatagcattggataggattgcgctccagtaatgatccaactaccttccttcaaacatgagacgatcatggggacggcggtttagttgctgaaatatcagatggatactcatcaattcctcatcatctcatgtgctctggtacaaattaatcgaagtgacaataccatatagtactatgccatatagtaggggtatatgtctgcattcatgtggcagtactgcaggttttggaacgtaatagttattcaagggtgaatgccaacatatgtctgacctgatcaccaccaagaatccaagattcatgaagaaaggattcatacacagcatgcatgttggatcgtatgaatccctaagttctaaaatagttatattgcaaattctttgccagaatagttgtcactgtaaagtactaatcgtcccctcaatcacatcttattcaaatttctttctattgtatcctcaaccacccttccgcttctaatcaataagggttactttagtcttttcttatgaaaccttaatttatcctaaacaacctagaatgacaagtgttgtattatatactttcgggtctgtttgatagagctcaaactcctagatttagctctaggagttggatctgtagtggatcggagttgtggaacagcctaaaaaaacccagctccacctctagtttattctgtgagagcgctccacccatccccgttcccattttagatggagctggaattgtttagctggactctagctctagagctgtgccaaacaggccattcatttgtcctcaaaagacacttcaactttgactatgaatctagacgaacattttctttccgatattcatatagtgaaaaatgaggtccacagtgagaaatgaggtcttttggggatgatgtagtacatgcagaggattgagatcaaatgcagttgctattgtaactgcacaatagcaactgcacacaatcgtggccattcgttttcagatccagcggctctagatgactgctacagtaaaggcataatatagtgcatccctgctacagtatttttgctacagtaccacttcatatcctgaccttccattctagatcatttgatacacatataactgcttaagttacacttataataacaactgcacaggatcttgatccacatgcagaggtctttcacagaggttttatagttttcgtgttgattaatttgtagcttcagggaaaaaagatttcagggatctaattaattttcataatttttcaatcagctaaaattgtacattttgtacaacgaattctgtttttcttattcattctgatcagccattttttttcttttgtgcaagttacctctcttgcatgacacaagcaaggcctgtactgtactcacatgcatgatgatgacaaactagggttcaaactttggcaactcaatgtcttaggttaattataaattaagaacacatggcatatattatgtatctaagtgtatcaaatggtgctaccttgtgccctattctaaacaacttaattatgtagataatatagattattactaccactttcaaaagtatgatttctcaaaaacctttttacataagtattgcttggacaacattttctaaagatatttttttactttacaatatatcattattcttatgaatatttttatttatttataacctactatatctctatgtcatagtaaatgcatttctagctttattgaggaacaccaaagttgtttcttcttaaccttaacatctgcttaacaacctagaaatacttatattttggaatagagaaagtacattaaataagggtgtgattcgaagtgagagagagaggttaattagaggtaaatgaaaagaaatatgacaggaggtgatacacacttgtggtaacgtgagatgtgacaaacttagtcatcaatcaaataaccccttaatacacttattttgatagggaggtagtagggcacatcctctaagcctaagggtagtcccaactctccatgtcacgtagtgtttagtataacattatatacatcactactacacaaaagattttcctagatatggagtcatttagattgcagacggaccataactggtcgcgtctgggaaaatagggcccattttcgcgtgcggacctattaagagaactgcatgcaaaaatacccaccctttctttccctcctacccactttaaattttcccctctttctctcctcttccctcctctcctctttctctcctctcctcttttactcctctcctcattttccatgtcgtcctctcctctccctgagtcctgacggtgcttggcggccgtccccacacggatccggctaccggccgccctctcctcgtagtatcccgctccactcccctccccttccttcctccccagatctggcggaggggagcggcgccggcggcggtgtggccggaggggagcctggaggccgacgggagcacggatccagcggccggccgccctcccctcccctccccccctcgggatccagctcccctcccctccccttccttccctggccagatccggcggaggggaggggcctcagcggcggtgcggctggaggggaccgcggatgccggcgacgggtggcgcggaggccggcggcgacgacgacgagggcgcgggcggcatccccggccgacaatgacgaggaggcggcgggcggcgcggaagccggtggtgacaacgacgagggcgcgggcagcgtcttcggacgacgacgacgacaaggaggcggtggcgttgccggtggatttttttttgaatttttttccggatttttattttcccatgcgggcgacataggcacccacacgtgaaaatcgcgattttcgtagacccttgggtgcatacgggccgcccatctgcatgcgaaaatcagtttcaaccgcacggaaaaacccttctcctagtagtgtatgtttgtcacataaaaaaacaaagtggcaaaagagttaacaaggagagagaaggaagatgaaatcatctctcatcaagaaaataactttaggcatgaagcaagaacaaagacaaagggataggtgaatgaaagaagagataattaggagaggtgattagataaaaatttattttgaataaaccatccactgagttttatacaaactccatatttatacaataatttatgagttaggatcgacctactccatctcttccagtataataaatttgaacatacatacatttttctgttctagatcacattttatactaggttggttttttttgacgaagggagggactaccctaaggttgaggtcttgacttttgttgaaattaattgctgaacaatttttctcatcttgtctcccacgaaggggaaaaggctgacgtggctgtgacctgtgactggcattcatgtcagtaagcagagtgcgtagccggtagccgtttgatgggccgatatatgacccatggagccgatgagtgacgtcctaccaggacttgtacagcgagaagaaaataccgttaggttcagcgagtaaaatcaaatcgtttccatcgcttagcgtaaaatctccatctgtcctaaaagtaacttagcttgatattctggtttatataaaaaaataagttattttagatgaaaggagtaaaaatatatgcagtagtagtttaaagagttaaaagtgctattgtgctctgcgttcaaaaaaacagtgctattgtgcttgtctcctctcttgaaaatacttttaaattttgtaggaagtttgaaggttcaacaaattgcattaataattatgccctagtctttataagttccttcctctaccactgtttttaagtactcctttcgtccctaaaaagatgtatctagaatcagatgtaatcttatgtatatttagattcgtagtactagaatgtgtcacattcggtactaggttagtttttttataggacggatggagtatatccctagctactaattactgatggttacatatacagtatgcatctatacatgcatgcatgtcacaaagctagagcgggtgtgccctaccattttcacaatcacggtcacagcctgcgaaatattccaagcagaagcagccttgtggcatgagacaacagtaccttgcaacttgctaatagtgtagctctagctagcagccacttttctcaaattcatatatgtcaattcacaagcaataatgtatagtacatccactctgcagctcaggcgccgtttaggtcccatcccaaaattttacacccagtcgtatcgaacgtttaaacacctatatgaattattaaatataggctaaaaaataactaattgcacagattgcgactaatgtgcgagacgaatcttttaagcctaatccatgatttgacagtgcggtgttacagtaaacatttgctaatgacagattaattattcttaataaattcgtctcgcggtttactgacggattctgtaatcaattttttattagtgcccgaacaccctatgtaacaccctatataatattcaatgtgacacgccaaaaactttataccctggatctaaacacccattagcgagctctcgttgccagcttcgttcttctgaaacaatccacaatttttatgtctagctaggtttgatctgattcaatctcaaaacagctgatctgaatgtgttcaacctaattaggagtacgtcatatattttcctgattaagatgcataatctatcttggtcttcatcatcacatttttcaaactactaaacgatgtttcgtgtaaaaaaattttatatagaaattactctaaaatatcggatagatctatttttcaagtttgtaaaaacttagaactcaattaattaattaattatatgctaacgattttcttgtttttcgttccctaactttgttctcaccttcattagaaacgaacaccatcactgggtataccgaaccgattccttggttgtttttagctgagtttagctatatatgtatatccacaagtcggtcatggaagcagctcctctgatgtaatgtcgcaggacgtgagtccctaataaatggggttcatccttataaatccacacatcatagatatatgtggctctgatttatgttagaggagcctcatcgatccgccatgcatggaggaaacaaaaccatactgtttaggtgtagacgtacgtagtacgttgcctgggcgatggaggccaacatcgacatggatcaatagagccaataatcgatcgatcgatcgccaataatcgcatggcagtcgacagcggcatacgtatgtatatgtcgttatttaattaggtatatatagtcatgcataatcaacatcatatatgtccctgacctacctaaacttgcatccatgcaaatatgcttacccatatgtgtgtatctgtgtgccgtagatcccgtgaagctagctagatactccatccgtttcgaaatatttgactctgttgactttttattacatgtttgaccgttcgtcttatttaaaaaatttaagtaattattaattcttttcctatcatttgattcattgttaaatatatttttatgtaggcatataattttacatatctaacaaaagtttttgaataatacgaacagtcaaacatgtgctaaaaagtcaacggtgtcaaatatttcgaaacggagggagtatatatattgggtaccattagccacactggctagctagcagccgcatgcatgatccatataactccactatttaattacttaatcgatcaaatagacataatatgatatgattaagctagtagtactatgatctctcgtgatcgagtttgcatgtatagctagctagggaccttccttgtcaagttgtctcagattatataaccttcgttacaatcttaactaaggtttggttcatgcatctcacggtgttctccctccggttcttttttttaattgatgttttggatacgattttaaataccaataaataattaattaggattcttattcttttttctcatattaaatatattgggggtgacacaattaaccaacagtcccttgcatctcaccttgttacagtcttggtataactccagtttttataggatcatgcatattgaagccatgaagagtagatatttaatttcacgggattttcgttcgcgagactttgcagtgcttattttttttcctcgcgtgttgaactttcgtgagcctattttttgtttgtttgtgtttggtaatgatttttttttgtgtgtgttttgccactggttttgagtattttggcatatgttgctatgcccttttggcgattaaacatccttcctaatacttctctatttaaacccatgtaacctaggagtaagaacacaacaacatgcacttgaacccaaccagagaaactaagtagcatggacttgagccgccagggggaatttggggctgaaccaaaagaagaaatgatcgctgagatcgatctaaacatggacgtatattattgatgacggcattggtaagtgttatatacttcttgttcttggcaatacaaccatgtgcttgtttgtgcaaccacaaattttacgcaatcctttttgagctaacaattgcttcttcttcttttttttttgtttgtggggggggggggggggatgacgatatgtcaatgctcttgtaggtggttttgatctgaactttgaaccaccccatgttggacttaacttgaacttggagctggtagattatgagaattttgtctaaggttggatcgtaataatgagcatgcaatccatccaagctatcgccaacaacaatgttatccaaggtaaaagatgacatgaatcttgtttttctattttgttgtgccttgttgccccatgttaatggtttcgtacaactttttatgtgggaaagatactccaaacaatttaagaaatcgcatatatcaagttttgttagtaaaaaacacaaatggaaaactaaagaggtatgttaccaaagaagtttttttataccagaacaattcgaagtccatctttgcactgtttggcgtttatggcagtaggtacgagcatcctcgatcaaagtattttggttgatgtttctagtagaaaggtgtagcaaagtgggcctaagcgagttccattggatttagaaccattatgcaatgttccttttaagaatagaacaacattagaagatatatgtatgttaacaatgctagatattagtcaatccaagctattgagatatatacaagaaggtcaacttgtgcgtcactcaaatagtataaagccacatttaacagatgcaacaagaaggctaggctacaatggtgtgtggatatatacttgaacatatatggaagcatgaatgataatccaaggtctaaggggatgcttgatgttattttcactaatgagaaatggttctaccttactataaaattaaatcagagaggtattacatgcttccagatgagggatgagcccttatgtacatgcaaaagtaagaacaacatccctaattaagcttatgttcttgattgtaattgctcatagaggaagtttgcattttttatagaaaattgggtgtttttctttggttgcatagggaagtagtgttaaccggctaactaggacaatggaagtgaagcccatcacttcaattactagggatctccttaaacgtgctaacagtaatcgatctccttgatcctatcgctccagcaataccatccttaatttggccaccattatctgaaccttttaattagtcttcctctaaatccgccccctaattccatgccactaaagagaatgtcgtcactttaaccatgagcatgggtcgccatatagtggaaggtgactcattatcgcggtattagattgagtgagaacaacagagggaggggggtatgagcaggagatggaacatatatataatactccctccgtcccagaatatagcaacctaggaccggatgggacatatcctagtactacgaatttggagcggttaaacatttggtgggtattgaggccttgacgctcgcgtcgcctcccgctcgggcgactcgggcggcggacccaagccaccgccgccgccgttcttcccccctcccctctgcctcgccgccgcctgagcaaacggccggcaaagccggcagcttgctaggatggcggcggcggccaccctagatctggcgcgggcggatctgagggtggaggccggccggagttgcgccgtcgtcgaggccggaggcgtgcagggtgcgcgggcaacgccggcaggtggacatggtggcgacaggcggcgcaagggcgcggggttggcggcggcaggcggagacgggaggcgacgcggcggggtgtgggccgcggtggtgaaggcggcggcgacagagcctgcgacctcgggcatcaccggatctgcctcggccatcgccggatctggagccaggtacgggagaggaggcgggtggcggcggggatgcagtggcggcggcaggtggcggggatgctggcgagggcggcggggatgcaggcgcggctctggtggtggtggcgcgtggaggatcgtggaggcgaggccggcggtgtggaggccggtgcagcccgtggagatgcggccggcggcatggcgtggaggccggtgcggcctgtggagcatggaggccggctcagtggcgtggaattaggtgcggcacgtggagcgtggaggccggctcgacagcgtggagatgctgccgacagcgggaggccggtgcggcacgtagaggcgcggccggcagcgtggaggctggcgacggcgcgtggatgtgcggctggcggtgctggtgctgcgacggaggcggttgcgagaggcccttgttggcgcggtggcagcctccagctgcgcccaccggcgtcttggcggcggtgcagcggggctgcgggcgcttgtggcgacggttgctagccgagcttcgatgaccggtcccttggctgccttggccggttctggtcgatgcagcagaggagtgtgggtgatggcaggttgcgtcgagggttgactgcttgtgagacgtcgtggactattgtgtggccatcgatgtgggggtacttatgtgggtaatgtgcagacgctggcgaaagccttgccgtgcctttggccggttcgatgacgatgacgccgttggcgccgtttcccttcttgaaggcgttatcatggcgctctcccatttgccccacaaatctccaggtgaaaaccttgctccggttcggacgagcggcggcggcgttacgcatcatgtcctccttgggggcgtcgcttcggggaagttcctttacatcgatgactattgatggtctctttggttcaaaagctttctttccttggtgttcagcgaggcctaagcctcttaggtccacttcgttctgtggtgggcgacacactctttggttgtttctacgaattaagtcggagctgctcgctgttggggtgcggcgacgcttggcaacgatgacgtgttgtagtctcttccaaagagttggtgctggccatgtgaaggaagtggctctttggtagcttggctaatgtccattgtggaagtcggagttgctctcgctttggcgacttttgtggcttcagtgtcgctgcggtagtgaagtcggcgctgctgggtcgcttgggcggctagctcggcaacgataacacctcttctgtgatgtcggggctgttatgccgcttttgtgtttagcttggcaacaatgtcctgcatttgggctccgctgttgttgttagttgtgtagttaggtcccatgctctcttctgtctgttgggtttcagccggttccccataattaaccgtgcagctgtatagttttcgggcccagtttcccttataaactgggtcattgtctcttgtctgtacagtttctccttctcttaatataaaaccagcattgctggcttaggtttcaaaaaaaactacgaatctgaacagactaggatatgtcccatccggtcctaggttgctatattctgggacggagggagtacatatgtattttgttttgaggtactaaggagtataagtaagaagcaggtggtgagaagttaacggttgagaataaaaggcttaaaaatattgtcaaattttagattggataggatgccagttaatataggtgataattgaaaatgatcatttatactgagaaaagtatcacgagacatgcgagtattgcctggccagctagctagattggggcttagggctctagattctcacgtactgcacagtacaacactgcatgtctgagactctgagtcatactagcgtgtaaagcccaatgaaatcaaatcactgagtttgtcgcatttctagccttctttattttcctttgagtaaagtatacggccggcccttaaaattggagcggggtgtcaattagatccataatctagaaaaattgttattagggtccacaatcttgtataagtgaatcatttaggtccaaagcgcctctggccgggctgactgccttacgtggccgtccacggtggcagcatttttgcattctagccccccccccgtgcatcttggctcccccattcccgatccaaccattctcccccaactactccgaggaagggcgacgattagggcggagtcggcgatcggggtcagggtggctggagacgcgttctggacggtgcgttgggccgccaaccgatcgggcgccatcatcagaggcgtcggaggcgcgagttggacctcaccttgtgagatgaaggtgcacctgcgcctgtttatagtgagtgtcgtcgtcatcttttaatccctttcatttggcaagtttaatctgt

SEQ ID NO: 65672 - DNA, 32841 bp, Oryza sativa
  unsure (1)..(32841): unsure at all n locations
acctccactcccccttccccatcccctcctccccacgagccgccgtgcatgtcgaccaccgccatgtgcgccgctgcccatcgcccgtcctcgcgctatgccatgcgtgccgccatgtgcgccgcggcccactgaccgaccaagagagagaaatagaggaagatgggtatgacatgtaggtcccaccattttaaaaaataaaattatgactggattgccacgcgtacgccacgtaggacaaaaccgctctggattagatcgagggggtaattcgtctgggattggaagtttaaagtgagcaatgtctggttttcgggttcaatggagtaattcattcgaccatgatagttcagtgggggtaattcgtactttttccaacgtccagtgaaccccaccctacaatacagtattcgcgtgacaaattcttaagctaaaaatcagtattttagtcttttatagatgaatggagtagctagggtcaatttttcgacatgggtgcgaagtgatagtagctcaattggttaggttctttttggtgaaacttgtccatccgggtttaagttatagacttcaatggtgcttgtatttacagctaggtgacgtacccattgacacttaacagcgagacacttgtgatgacttcgtctattcaaaaaatccagtatttggggtacgctcatagggatacgtgttcattgggttgagtcttgagtgtgagcgcttacgtttgtaaaaggcaaattttgctacaggacactttgacttcgtggttttagccgtgggacaccatccgaactcacttttgttccaatcgggtgggcccctgccgtgtgcgctgcgtccccctcgaggaggggactgacttcgccgccgccgtcgcacgcgagggctccggctgctacgtcctctccgtcctccgccgctcccgcggcggccactcccgcggcggccgctcccgccgtcctcaccatctcctccgccgcgatgagctcgaaccccgtgccgcttcgccaccataaccaccccggcttcgccaccgcttgcccagcgcttcctcgtcgcagcctcctccgtcgacacacctgccaccgccttccacctccctgccccctccactcccgccgagagagggctggacaatgatgaagacgacgggcagcatagcggcgttatggaatgaagatagagagagaagagaagagagataggagagttgacgtgtgggcctaaaggcatttttgacatttcacacgatttttctctcctcttaaaccggaaattatcattctaatcggcgcgatgtccatcggtaaattaccacgtttatggagtgttttcctccaaaattgagttcgggtggtgttgtacagctaaaaccacgaagtcgaagtgttccgtagcaaaatttgccttcgtaaaaatatcaacatgtctggcaatcgttgattttactccagccagatttgtatattaagttacaatcaatgtacaattatgataaaatctcccagataattccgttcacaatctatctaattaatgcgtgggcgtttcgatatgatccaaagatatctcacatctatttcgtctataaatgcaaaattaattgtaatatactatatatattcgtcggccaccaacaaagttatctccaagaataatctgctgttgtgcgagaaggagtaatggatccagcatcacgctccctctccattattttcttcttagtcgcagtgacatttgtggtaatgtatttttttcctttacaaaataatttattttatttgtcttctaacaaccgctgttaccaaaccattaaacttcagacaatattgtttagtttgtttatttggtgttccaaaacaatatggtttctgtttattttcatcacaaaggatgccctcgttttgttcttcaggttgaggtgtctgggcagaagaatgaagcagtataccatttggtaaatttcatatcacactagtattattcttttgttcgaacactaggaaatagcggtacaaacagaatccttcatttgtttgcattcaatttttctcctcctttccacttgattgattatgaactttgtgttgcagtttggtggtgaaggctcgctcaccaaaaatggtaatgattatatccgctaccctccaaactaaatctggtcttttcttattaaaaacacaacaattagttaaaagtaggggcgcacgatgaaacatggtcaaatcacctataatatctatgagtagcatatgtataggctcgaattataaatctaacacgagtcaagtgaatacttcctccttgcatccaaaagtcttatgcgtttcttttgtaaccaagaccaaaaaaaaaaattatctcaaatgtaaaaaaaactaagaaaccaatgtatacatgtagctaatgagtacttatttagatggttgttcgggctccgattaataatttaatctagcacagtaaaacaaaaggacaccatctttcttttggtcttggatgtacaaatattataatctcatttggaaaattagaaaataaaatatgtacaagactttgaaatatgttagctaaaaaatgtttctgtcgttttgaaatgccttaacacgtgtaattttcttgtgtgttcaagaaatctttcttttttaacaaaatgtcaagaagtaactacccctaattagatttacattgtgtttctctttgtgctatgtgtagagtgcccagggaaatgcagctaccgttgctcggccacatctcacacgacggtgtgcatgacatactgcaactactgctgcgagaggtgcctgtgtgttccatccggtacatacgggaacaaggaagaatgcccttgctacaacaacatgaaaacccaggaaggcaaaccaaagtgcccctgaaatcaactatgaacaatcgatccatccatgaaagcttggaatgtaccatctgaaatacaatgcttcctgaagcttagattcatatatactacttgtgttgtcatttgtattgttggagaagagtagttcaacttaataaaagttatccatattttggcattataaggcaatatattggttgacatggattttccatgccattttgaatgtgaagtgtctgtgaactggggatagaagagaaaagaaatgatacaggggaataggggatggcacgttagagcatctccagtgatgaaccgattcatgcagccacattggttgctctaataaaccaaaacaaaagtcaaaattttaaattttaaacttaattttgaagttgatttaaaaatatttttaacgtgttttttttctgcattgacttttaagtcgttaaaacacatatataaaagttttatctataaattaattttttatttcctaataagctattttggcttattagggaatataagcaatcgatgaagacctaagatgacttctaattcctgaaagaacaatagcatgggcccaacttaaaaatagaaaaaatcccacatatctcaccaactcatttaactgtgtgttttaaacttgtatggcccattttgaaataaaaactccatttagagagatgagaacgatggccgactttgtgactcaaaattgagagtcgttgtctctagctcctcgtatgcatcagtacgtcaatccatgtatcgatcactagagatgctcttacatcgatctatctttatttttcctatatctttaaacaatcatttactacagaccgtttattttatcaaatacaaatttatagcccatcctgcagctcatattttgcaacctctgctgcgaagaaaagcttgtgtgttccattccatcagtcaacaaggaggagagcccatgctacaacaacatgaatcatgaagaacaaacaaaggcacatccaagtgcccctgaacccgaagataatgaaacagacaagtagataacgttaattaggagtagatcacgattgctctttagaactctagagtagataaataagttttgatttatctgtcatcatgaattcatgatgtttttttttaataatgaaatagaatcccggcctttgctcaaagagttacaaccaaatgaattcatgatgtatccattttgttgcgttatatctgtactttactttttatatatagttagtacctattattttctaaagctcaacatgtaaaaaatatcacatcgtcacacactaacaattattatctacaatattttaaatcacatataaatatatcacatcatcactcactgacaattattatctaattattttaaatctcatacaaacatgatatatcatttatgattttgttgtatttttagatcttaatatataagcgatgtcaaatcatcatctccacattatttaaacatatacatatatgatttatatgatgtaacatatattcattcacatatcaatatctccacattatttaaatatatacatatatgatttctatgatgcgctccctccgttccaaaatataacaacctacatacatcaacctaggaggggtcacatcttctaggttacccctcctaggttgctatatttagtgaaggagggagtaacatatattcattcacatttcaatttctatgatgtaacatatattcaatcacatatcaactaatattagtacatacctatttttcatgtaccatctagcatcattttgaaaataccacggattcttgaagccacttatctttttctttaaaaaaaaacctcccaaaatgtaacaacttttggcagtgtccagattcatatctaaatatgcttatattttaggatgaagggagtaactatcttaatagcaagtgacgcatttgttttgttccataaatcatgcatcatcatcatctacaggcaacatcagaaggttgaattattttctaaaaccaatatctcaacacgaattgccaaaatgttgatgatccagaaatctctatttcctacggcggatattcttccacattcagccatggtaaagcgggattacattatgttgcatcccaatgcaacagacatgtcaagaggaacctaaaactagttaacaaaagatacttcaatattggaattccatacgaaataactgtagttcatgtgctcgaattacaaaacctttctgaacagagtactgaagcaaaagatgaatccaaaacaagttctagcgtctcatacaatacaaaagcagggaagtgcaaaaacatcttaactcccaaaccacaaaaggaacaacagacagtaacaccggtattacatatccagccttgcaaagcggcagagctcaagcgccaggcaacaagtaaacatgcttctgcctcttttggcaacaatgacgagcacctagaacaaccgttcaagcagctgaaatggtgcaaggatttgacagagatcatcattaacattattaggggaataattacagtactagtaaagaaaactgtgatgccaacaaaaacttactgcagcaatcaaatttcagttattgtgctcatcagcagcttggtgatactggtagtcaccttcatcatatgcctcgccctcttcagggccttcaggttctgtgttgttaggttgcatctgatagtactcatgctcatgtcgctttgagcgctccgtctcataagcatcatggcttttgtgttgctcatagttatagccatattcctgatcatgttttggctcaccgttggcaaattcagcatctctctcatgcatgtgaccacggtcccgttcatgacttgcacgctcgtaatctctctcacggtccctgcctctctcacgatggcgatcatgaccacggtcacggtctctctcataatcccgaccacgatccctgtccctatctctatcacgacgatcacgctcacggtcacggtcacgaccatgatctctctcccggtcccttcctcgttccctgtcccgagtcctgtcccgatccctatggtggtgtctatcttcttttgaatcacgctcgcgagtacggtcatgggatcgttcacgagttctctcatcacgatctctttcccgtggcctttcacgagacttctcgcggtccctgcatcaaatcatgagtaataagcaccacaattagatgttaatgcaggaattccatttatttgataagatatacctatctgcacgacgctcatctctcctaggctcctccgatcttgggcgtccagcgtgctgctgatccctgaacataaaaaaaaacatgcatgtgttcagcatcaattacatggatacttaaatatatgaggaacaatagctatacccaaataagcacccaaaatcttcactgcactaaaaaaatatgcacctattggagtcaatgtccttacataacaatatcaaacttcaatataccgaaaaggtataaaatcacctctgataatattagtaatgaagctcaacatacagtaaggggcaaaaagagaaaaatggtatcaaaggaacatatccaagagcgcataaagcatttatgatcagttaatttttagtgctcacatcacttcttgttgccttagatcatacaaaagtatttgcttccttcatacaataaaatggaaaaataataaatatacctagtggagagcttctgttcagcattttcaccaccaattctgcttgatccaagtccaccacccaatctcctgggacgccaatttggaacagttctaccacgctccacatcaactagcaccctcctattgtccacttttctcccatctgcttgcttgtaagcatctgcgagaacacatattagcagagaaaatgtaagacagcacttcatcagtgatgacgccaaattggactgtatagaggagatatgctaaaccagaagctttacttttcatgtcccgggtgtgcatatactcgatgaatgcatatcctctaggtttatttgtttccttgtcggtcacaagccgtacctgcaaaaagctcaaatgtacccattaaggtctttccaaaaagaaatatgcactgaacttaagaatgttgccggttgtcattacaattgtttgtttgttttagcatatattctatgctgcacgacagacaggcataaagcctaaaacagccgtgctaaccttgcatatgtagatccttcattacgaggagtgaaatccagcacagatcaacacagttggaggcaaaaagcagtctggctgattggcgtttgtgggaaatacagtgatacccccttaccagggaatttactagattaagaaaagaagatggtggtggactaaatacaatacccatttaccctctccattgcatatagttcgttcagccttcgtcggtaagaccatcaaaatagacaacggttacataaatggaggtgacaaatagcaagtcagtgatgtctattccttacgctgttacgcatcagaaaatggagccatcttcaactctaaaagttgagatgtcatttgcattatattttgctgttgtttcctccaagagaagcagcacttgaaagcagaactagctttaacagctcagggaaagtaacataaacactgtactcaccagcaacctaataaatcccagaatgtagaaaccccatgcctgcagataagctgcttttaaaagcataaagtgatctaagcttacttgtgccatcgccaacattcttcaagcttgtttgctccagttaatacacacgagaagcaagttcatagaatgggaaaacaaatgatacattgtgcctactgcagaagcaaatggtttgatcttttccgagagtaaaagggaaaagatgttctaagaaaaaaaaacatcaaggctgcatgcagtaaaaatacctgcttgtgtgtatttgtatttcccaggattttttagtcttctaatggttgtaccaaccattcgcacattaaattgctcaacagtaactcagataatatgtctaacaaaaattaccagaagacataatttctgctggagctctatattacttatccactaagtacatcaacagagcccacatgtttagaaatggataacaaagaaaagactgtccgaaccacccaaaccaatacatgtcaatacaagataaaagtgttatttaaataatttgagaagattatttggttattttctccttggtttagcaaaatgcaaccaacatcattattgagaagcaaacagcaaatgcatgcttacacacaaaacagtgaatgtattgcccaacttgaaaatgagagtgctatgaatactgtttgacaaaaacaagaagttatttttgtttgctgcaaaaaaaaagacttgacagaataacttatttttgttctttacaaaaaagaagacttcacagcattttgtttgatttagaaacaaatactacagacaattctgcccattgaaaatcggagagagatagaagatatccctttcatcctttagcaccttgttgtgaaattccaagtaagcaatatataatggcagtgaaccagctttttcttaaaacatgtttttgtagatgaattagaacaaccaaacaccttaccaaagaggaataagtccacctgcactggaatttaccacatgtacttacccttttaataggcccataagcttcaaactcccgcttgaccctatgctcagacgtctcatagttctgtaaacgtttgctggagtcaataggaagtaacatacaaaaataataccaactatgtagttcaaaataatttgtgaatgatgcaacaaaaaaacttacaagtcttgcaacaaagagtgttttgtatggatctccagtggcattggggtcactctgtgggtcatctacattaagaaaccacaccaatgatgttatcagtatctatcatatgatacaaagggaagagcagctaagaaagaacttacatttctgaagctcttcagccaccttagccgcaccttggtcaagcttacttttgcggatcctatccttcttttcagcctgcgtaaataaaacataatcaccaagtcatgacctggaatgatgaaatgacaataggcacgaataatacagtagatctagaaacaataacagacatggaaaaaaaaagagtaaagccagtagtgccaacaaaaagctgcgtatttgacatagtcacatacaattaccagaagaagaattttggcaaacaaatgtttggacagctacacatgtcttattttgagagagttttcatgtggtgaaagtggaaatattcatctcagaggtgggaacatttgactccaactcttacctcgcaatttcaggtagaacttattggacctaattttcctgtgctgactatagtggaacaatgctcaaacagtcaaattgtgagtgactttccagcaggtgtagtcatagaagctcacatactaatactaacagtcttaagaaatcctgattgttcagagaccagcaagcgttctgacaccattacaaataattgattttgtcgattgaaaaaagcaactatatggttgtggaaactatgcaatatggttatggccacacgaaaagtataccattggcataaatacgacatggtcacgacaacataagaagtaggaacatcttgcactacggagacataaaacaaaatgcaacactaacgattgcgcttcaaacgagttaaaattgatacagaaaacaaatttgcagcagtatcagtataccttggtctcgcatgtggggacgggtggcgcgtactcagggtcaccgggctccgcaaactgcgacacgaactgcgccatccctgcaaccaaccaatcaacaacaagagtgagtccatccatcaggaagcaactcatccacaaaataaatctaacagacaaaattaaaagaaaaaaatatattcataatccccctagaaccgaacagatagaatagaagatgaggcgggtgagggaatataccagtgtaggccggcaacttgcgcttctcgacgggcggcttgaagtcgagcggcgggcggggctcgaagagcttgagcaggttgggggtgaggcccgtcgggtgtccctgccccatctgtggtcgcgagccatggagagagatctcagatcgaggcggatccggagaggagctagggttatagcagctagggtttagggggggggtgggggcttaccagcttgagctgctgcacgttgacgcgctggcccttggtgcgggactgcatcccgccgccgtccgggttcccccgcatcatcccgctgccgtagtcgcccatggccgcggcgccggcggtggcggcggcggcgcgaggagagagagagagagagaagcgagagggatttgcgattcgcgaagcgttgggggatctctctttctctctctcgggatattaggggaggagagagagaagtaaaaagagggggaagccgagacggaagaattttatgtggggcccacacgtcagcgccctctcgcacgggcccatgcgtcggtgacttagtgtatgcttttgctgcctgagcgttgcagggatctttgctgccgctattgaatcacgggggctataatcgtgtgtcacattttttataaatagtaaaatgcccgtgctaacgctacggcgatatttgatgatgcaaatcccttctctactattataaaaattgaagatgttttcgttagaattttggtacatcatctgtattggaataggttttaattttatgtttctattaaatcatacgcgtacgaagtaattaggcatgcacctttttacgtgccccttgccgcttgcagacctgcgcctgagttcattttccacatacgcctctgtgctcctctgcgattgggcccgcaacaccctcacgcgtgatttttcgcatgcctgattgggcccgtgacgtcctcttaaatctaccctattagcatataagcactttaagggaaaaaaaacgagattcccacttgatttaatctttggtaaaaaaaatacaaattcctacttgatttgatcttatcaggcctttatttacctgcatgatatcatcaggcttccatttacctatatcttcttcaagtttattggacaacctgattgcaattaaacggcatatattttagttgtggtaattaagaattaacatttagttaccaaacgtccatcattgatattatttggatgcaaatcgacgcacatacctcatgagcacatgggaatgaggatatgaagaggagcgctgctatagacctagggatgaaatgctccaataacaaatggtataagcacagcagagccataatatatagaactggccatcgttccattttactgcctaacgataggttgaaggctagcaagccaaggaaggctatatacctctcagttctgacaactaccttttcatgaactcgtgggcttttttaagctaaacctcagaagacaatagggaaagcctgtttttcatctaagaataaaagacttggcctattattttagaaaaattggaccaaaaaactcacaaacacttgcccatgaacctgtcggctaaatattgtagtgtaaacttatctgctgcaagcagctttggagtaaatctaccctatcctaaacctttcttacatgcatattgttagtttgtaccaagcacaagaaaataaatcactcactttaaaaccatctcaaaattacatatatgcccactttcatccattaaaggcatagctgcaacttataaatctgaactgtacatatatgtgtcaaccatgagtttacaatcgaaaggggaaagaatggaaaaacagttagaagagattatgccccagccttgcttccattggctctgcactgatcgaataatcgcatcctaccttgccattctgcactgatttctcttgacaactgcacttcatttagcaaaaccatgaaatggagcatgttcctgtcagcctgctaaatagaaacaaccagcttcttttgttaatgagtggcttccaagcttaacttgttttgctaaacttttgaagcaaatcatgctagcttatggtacaccacaaattgatataccagatcagtgatgatcaataatgctatttgctttttaaacagataaatatgaccataagtaacagagaaatgcagttgttttatatttcttttttccccacaaatttgttgcttggtaatcactattaattggaagcaccgtataactcaaaagcagaggtcatctctcttgaagcagctcctcttaatggcgaaaaactatgtcaagagaaatgagtacagatcagtggtgctgcatttgaattcctctgcaatggcaatagtccagaaaaaacatcaatttcaaagatatttaaagaaatcgagggcaacattagtctgcattgggttggtaagatccgtccgctagattggttctggaagcaagcaatgatgctctgttagcaactgtactttggaacgttgggtcatgcatttatggaaaatgggagatagaaaagagggaatgacaagcaaaatgcaaaaataaccatatgtttgaaataccagctattcttgtacaggaataaatttatatgctagtaaggaaacaataatctcagctctcacatcaccaaacaacattgaagcgatgaactctgacagtctgccattcatgtgatcgtgtaaatcagttagcgtaccgcttaaattaattatattaaagatagggtaattcaaaagcacattcctgtaaaatcactggatattttaatcaagtagctaaaatgcataacacaataatatgtacccatcggcaaatgaaaatacatgcctgtttgaatggtcaggagcagtggaggacaattgtcatcatctccaacaatggtgttttcttgagcagaagattagcctgttccaatctattgtgataccatgaaaaacaagggaatacaaatcattcaggattaaacaaagattgctaattacttcagaaataaattcagcaagcagaccatcagtggattaatgctgggttagctgtttatgaacaaccaagtatcacatgtcctattttgacccctaaagctctaataaacttttccttttgtccccagactatcatgaatgcatcgaacaatatgttagcatttcaggcagcaaaccaaaaattagttgtctctaacacattggcgtaatacattccaaccatcgataacaaaattgcttgatgacaaaacttgatttgattagcctggataatgctagcttcctgcaatataacaaaacttgatttgattagcttgcagtatcattttcaagtgacattggaaaccaagtcctgagccatctacttaagaggatagaaattgttctctccatcaataaacaataaacatgaattaaaaccttttagaacttccattaaaaagctttcaaagaatggttttttgttaaaatgcatataatggtatttatatcatcatccattagccacaatgtctgttaaatactatatattatgcacttatgtacattcctgatcaatggaagagcgtgcgggtctgtccagttcatactaagccaagatcaatggtgaaaaaattgacgtgatcctgaaatgatattttgaaagatcaatattacgaagagaagaggtatctgatgacttcataccatgtgactgagcctcatatggctgttggatgcaaagcaccaaacacttctttcccaatagtaaataaccaatccgtatgtgaggacagacatttttatgggataaatcaaatttcacaaaagaacaatatattccatttcataatttagaaagcacaagaatatatatacttaaaaagcacatgtgaatccttcgtcatggctctgcaattgcagtatttagacacgataaaatttcttacagttcaaaaagctcaagtttgccaagttcagctggaactcaaactttgcacaggcacaactcttttcatgattgttacagggaggagggttgtcacttgtcagttgatgacaggaggtcaggattagttggtttggaggtgacaagctaatggtcgcatttgttttagcacatctacatctttgagtttctattgaaaattagatttgtgatggtgatgacaaattcaatttccttttgagattccttcagtgcttccactattcattcataaaaaaacattaaagattggcatgtggtaatccatggcaaatgattacaaagctacagaacacatcaaccatgaaactcaaaagtacctgcagacctagtcaataacctccatgcagacctagtcaataacctccatcaatttcttgttcgaagaaaagtagctgtagagaaatatttagcgaatgagagaattataaataatatcccaaaattcaaaagagatgcagaagataaaagcttcaattccagagcaaccgaaggaagaattaacctcataccttaaatttactttgtgcggctgaggttactctgattacaatgcctgaccgagcttgttcttcgcttatagttacaccataaaaaagagcacattgcttgtcaacctataaatagaaaaatatatgtggtagccatcccattataaacaagataataaaactggtagtggcagaacctttcctcttgctgatgatccaacagggagcggtctcgctgtaactgttccactcatagcttcttcaagaacattcaagacaaaaggagaactggaaggataaaaactgacctttcttgtttaactcgagcgaaatatttttgttaacctgaaccattgctgaaagaatagaacagaaaggagagaactgaatcctttctaattcttcattataccaagctgtcacagaacggctaccggggcgtatcggccaccacggaggtggaccggtcggcagctaccgacggtggccgccgcttcggaggggtgggggtgtcgtcaagcacgatggttgacgccgcgagctgccaccgcttcgggtctggagggggaggcgtgggagggaggtgcggtttccgcgtcctcggtggcggcggggctaggcggtgcggatgcggcggtgcagaccaatgtgatgggaggaggggcggcgaaaggcgaggcggatggccaggagcgatagaaagaggagggagggcgcggtgattttgccggagggaggggaggcgatccgatctggatcggatcgggagggaggtggagagccgttggatcaacgtcgtcagatgatttccgatcattggatatgtcacatgatgaatgagtaaaaactatttgttgaacaatagggtagactagtaaacgtattataatcgtgcattgcacgtctttaactaaaaaaattaaggctaacatactacaagtgcaatcatatactccttttgaaaacctaattcattgcgtaatatcaataaaagctagagcacatttttttgtttaaaaagatcatatttccgagtcacctacataatacgcagcaattaataaaatgctcctttcttttaacatatatgctggaattacatgtaatgacatgttcggaaagtaatttgggagatgtattttggaacaaaacatatgcatattgttttctatttggatgtgtacagaaaactcatcatatagtgcaactgaggtgaattgaatttcagtttggatcatattgttcctaaacttcctaaaatgggattgacatactgtcaaaaaatcgcaataattgattcacgttcagtttcagcaaaacaatacacataaaaaggtaatattcaggtattgctcattcaatttcagcataaggaacaaccaggaaatattcaatctcgaccatgtactggtcaaaggtaatttacccattaccagaagattaatagcagtgtactatactaaactttggaaggcttaccagtatagattaaactaaagaaaaatggtatcttttatcaggaccaacatctacagttcaacacacatcgaatatgatctaaatatggccatttgcacaaataccagaaaatatgatatgcaacatcgatctataaattgtatatttgattcaactgcgcatcttctgtacaatggcaaatagctatatagatgacctaaaattggttaaaagttattttacttgcgtctattcatctattgagatagtgaatgactgagaaacataacatggtcattgatgttagctctgaatctatatgtgtagctaatatttatccttcccaactgatgattaattctgaattaatcagtacgtatttgtcttcctaacaaatgacataccatttattgctgtcacgaaaatagataattgcagtcaccttaggaatgtaaaatataaatgtttctactctgcctagagcagcttatattagcccacaaacatgcttgatgcccatatgactatatatataagtacgtgatgccagctaattaccaaaaaataccagatgcaggcagtagagaaaaaccataaatgtttctactctgactgaaatgctttataaaaaataattattggactacttaactcaatgaagagtctgttaccatgcttacggactgaaagctcagttaaccccaagcacattcagtacaggagacaagctcaactaaccatttcctctaacataaactgaaaaagcatataaacaaatcagtttttcctagagaaaaagatggcaactattgctacttttttttatccaactacaaaatacaaatgtacatgtcgatagattgccgtgagatcggtggagataaaagccacaagaaagcatgattgctgctctgatttgtcacttgaggcctgaaagataagagaaaacaagtcctcgtcatgagggaaataaaaaacctccaagtacctgacatgcacatcaagagcaaccagactgtggcctgaatgcattaagcccgtgctcgcatcgagttcgattaaaagatggaaaataagagttcaaagttgaagcctgagaccaacctcatgtgtagagaccactgtgctggtggagacgaaaactcgacgcggattgaggctgccggcgccagcgatggtgtttggcggtggggatggccaattcggcttggaccactgctgctttggaggagacagcggcagccgcgtcggtcaacatggacacggaggtgattactcaggtgtggagggatgcagattgtagcacacgcagaccattgccgcgagagagactggggcaagccagcagattatattagtatttttatattagtatagataatatatagtaaactgttgaaataaccataactgtctgttaataatattcaaagcttaacagtagttaaatgaaaatgtatacaaagaaatatcatcaaacggctcatattattcacatcatttgctgagatgaaatgcagtaaaaaaatctcacaaaattggaaagaggatacatgactaacacaaaaatctggttacagtttcacgttcgcttaccttatgaactcctccgtaaatgatgaaacaatggaggacttaaccacttacttttgttgttactatcatccatcttgagcatctaattttaatgctatcaataggggagaacatcttctggagcgggccttgtctactccaagtctatttctccgatatgcattccctcttctgtaagtgctagacttgaacgtgttaataaatcactatacctatatgcgtagctcatttgatcatccattgttggcaggatgaattacatggaagccgaagcgatgagaaagcctgtcggctacctaaactcgtgcaggataagtcagccgaaccacacatacacgctagatgagaggaagctaccggaacacatcaaggcgatgactcccgaagagaggacaacttacatagggcaaaggcatcaggaaaaactgctcgatgtcactacttacgtagctatagcgcttcaatctacgcaggacaaggagtgcgtttatgccccatatgcctttgagtaagttttaatatccactaagagtatatgcatataatcacggctcgactaacaattttgtttgcagcgaccattggatactctttcttctctatctaaagtacaatgaagtcatcgtcttggattctttgacgaagacagcaagacatatcaggaatttctaagaactatcgacctgcaagttatatattatcatgacgtgttttaatctttgaggaatgtaaattaattatatctgcaaacagtgcatttaaaaggtattaccagcaaggcggacaacgcaaaaaatcaagagaacgcatattcgtccgcaataagtggccggtaagtacatatgaatgccaaacagtactactaaaatttcataaatgcatgtgtctatccatttaataacctaatataccttacaatcaattgatgttgaaagtgtcacaagcaaccggtgggaaccgtactatgcggatattacaccagcgagttcctaaggggtaatgggaaatattgcgcgaattacaacgaggtaagtaatacacacttgttaaattaatcgctaacttgtattattgcgaataatttccttaatttttcgtgatttgatgcagcttccaaaattccccaagtctgaaagaggtaatcttagagcagtacctatcctaatttttaattcggtttgtctaggttaatctccgatgttaaccaagaaggtatggagcatgcgactaagtctcctgtcttgccgtaattgagaatttagattaaagtcaagaaattttgtctcgacgggtacaccatcgcttcattccataatccttgtctaactccaccaaccgttctcggataatcgataaggtgcaaagtctgcgacaaagccctgaaatctgacttgactgttctgatgtctgactttcctgaaatcagtagtcagaacatttgtcgtactcgcttagtcgttcccggtgtagaatcgtagagacatggagtcctcgataacgctgaatggaactttcctgaaatcaatactcataacagaatattaaatagaaatagcccctgagcaaacgctcaagggtaacatgctataatatgtatggaaaaattaaaaataagttgaatttgcgtgtgacaataaaagagtatactctctagagtcccttagcaaacggagttcggtactcctcctagcccctagctgtttttatggaaaaagccattttccacaaaggcagtttaaatcttataacaaaccagcccccagccgtgaagttgagaaaaccaattcccgattacacggcttagttaatatgcatccagtgagcactctaacatgaccagatctgacatggtcgtttggctttgcagtatctaacaaagccttatcagctctgggcgttcctagccgaaatccccttaggtttttcggaggctttgttagaatagtgtaaagggacgataggacagacttcaagacgaggcaatacaagaaaaggagatcaacggacaaatattgcacatataaacacttacagaaattggcgtagatgatgagatgaccaccacattgggcaaagaccaggtgtatagttgtactcaacaaatcgctgagttagtaggagaatcgctacaccactagtcgaagaccaattatagtcataactcgaccactggagtttaaggtgcgagagatcgctacggcctaatggttgacaaccaggagtaggcgtctctcaaccatttgaagtcgaggtacgagaagatcgctactacctattggttgagaaccaagattaggtatctctcaaccttttgaagtcaaggtacgagagatcgctacgacctactggttgagaactaggagtaggtatctcttgatcgtttgaagtcgaggcacgagagatcgctacgacctattggttgagaaccaggagtaggtatctctcgaccatttgaagtcaaggtacgagagatcgctacgacctactggtttgacaaccaggagtaggcatctcttgatcacctgaaggcaactgataggcggcgagatgtcgctacaactgtctagtcgataaccaggagtaggcatctctcaatcacctatagggatgctagagttggttattacatgtgcatctcatgtggccagcatgactcacatacccaacttatagcatatctgaatgtctgttcgtaatcatgccgggtgatcaagccgacaacatttacgaggaattatccgttaacaacctattcccaaatagtccagccatagccggtgctatatatgagataaatcgtcggtcttcgttggtaggtttggtgcaacaactcagcctttaccgagaacgttctcgataatggggtgtactcaaccacaacctactcgagtgctcaattgttcctgaaaaatattgtctagaaggcaagatatgtagcatagaatattgaatatgtactcaaaaaaaactgcatgaatcttcttgtattatcaggatatgacgagcagattaaatatcaggcattatgtaaaccgtaaacaagcatgatttatataacaggaacagagcgagcccccaatattagaccgtagtcggcctaacatcagaaacactcgtacaatagatattgtataaaaacatgctctaggtaaacataataaatcatggatttgactatattgtattgatctgaagaataggtacaataaatcacatatggaatattgcgtacctttatagatacatatcggatatatctacgaaatgagtagcttaattttaaaaaaccaatctagcaattaccttgttgcgtactcgtttgacatcatataatccgacatctgttggtacaccgcgtatcttgtggcttggatgatctcaatggatcaaaatgttgacgacgatggttccgatcttgtcagggcatgtactctggttgggtcaaatctcccaggtccaaagtagtagaagtatccttcatcgaaaaatccgcagcgacattgcctcgatgaagcttgagatgacgagggtcctgatccgccggaaaacgcacttcgttcgggtctatcaccccacagccgaagtcgtcaagtagtttgttgttggggaatatatctcttgaacccatcccatcgaaaaccttgaagcaccaaaatcccctacctggcacgccactgtcgatgtttgaggtcacgactagattatttgcatggtatggggatcattggtaccagggtatatacgagattgagttaaaagagatggagaaggattttatacaggttcggacccctttttataggtaatagcattacttctgttgggcgaagccggtgttcctctatactcatcaaaatcacacaagtacaatatttgggataacgtatctagtcgtcgttgacttggtggcatagataaccaacacgtagtcgacgacaggatagtctgcctcctcgaatataaactcgtcgacatcaaagatagcgctagatccctcttatcagcctctgcaggcaccatattgggtttgtctaggctaatctctgatatcgatgtctggcggcgtgtgttgatcttggtcttggtttatcttgtatgttgtgtgtcttccctctcctagggggtcttgtatttatacccatagatgtccccttgtccaagtagaactagggagaccaatattgatgcaatccgagtagtccttgtaatttccatatagaactctactcgtccttccttatccggaactccttctatatatgaggtatgattccgtataagacttggtacatggtgggccccaccgagcttagtcgattactattgggtatatggtatccataaccctgacatgcatcaaccaagaaaccatatcagagcacaagttcttaccaacttgactcattgttagcaaaaaacagtattacatacgcatgtcatgtactcatcattgtgaccgccattcaattaagcaaccactttaccactttatagtcctcctgttgattccgtacaagacttggtacattgtgggccccactgagcttagtcgattactattgggtatgtagtatctataaccctgacatgcatcaaccaagaaaccatatccgagcacaagttatcaccaacttgactcattgttagcaaacaacagtattacatactcatgtcatgtactatcactgtgaccgccattcaattaagcaactactttaccacttttacagtcctcctgcccaaaagtttttggcccctggcctgaaacttctggtcatcccctaagaccgattagaggagctctcacggaagttcctagcgaaaatcatgaaacctccgggcccctggtctaacttggacaaaacctcttctttcgcatgtgtagcagtcccttccttgccgaacgtcaagcattgtttgccattcacaacggcacttgcatggtcgactttcatggggacaaaagccaagaccatgtccaaacttcttgttgcgagtggtgatagtcttgtagagtgcctatttggattcataagttttcatgcacccatacttaccaaggttcctaacctttcattctctttcttaaaggtcaccatagcttcaagattagtaccatagaaatccaaatcataattatagcatctagcacaaccattgctaatggaggcattggatgagtaggtttgtttctagagtagttgaacttgggtgagtaggttccaaaatcaggaagctaactagctgatgggatggtgacaatggttccgctgaactccacaagccattttatctcctaaatgcattgagtgatctcctaatgatccctaaggatgtgctgatggaaaccggcactagaagagaggtatgcactctcatcttgttgaaacaaatgcataattatttcaatgcctaaaatatccatatgaaactatgaagttctcttttctgtgaggaacaatctaataatctaaagcggtctcttttgctagctttcgattggtccatgtggcgcctcttactttgaagaaaaattataaatttatactagggaaaaaaatacctaacaatcatttttgaggaaaaatctagagaaaaatatgattccagaggcttccaaaactattttctctttccaatcacacggacttctactcatttgtcttctataaatataccacacctacttggtactactcctgtaactctagaatatatatagtaaacccaaaattattaagcaaaaaataaatctaaaacaacgaatttacactcattttccttctttaaatatactatgcatactcggtactattagctggctcttttgctagctttcgattggttcacgtggcgcctcttacttattataaatttatactagagaaaaaaacacctaacaatcatatgtgaggaaaaatctacagaaaaatatcacacgaacttctactcttttgcctgctataaatataccacgcctactcggtaccactggtgatgggataaatataccacgccaaacatcgttgatatcactagtgatgggataagctaatttttaacagttacatcatttttcttctgaaaacacaatgtagcggtacttttagaaatgaattctagatgttagaaaatggctcaaaatggctcctaggagagggaaaccacatttggttttggcatgatttttggtgtggtacctgcccattgaaaatcactttcttaatagtttttgaaatctgtaattaaagttattttaatttcagaactggtactgggaagaataggctgcctaacttttagaagatcttttggggaagatgaatttgatgaatggaccactttaggagatgtaattgatgacttaatagcaaataacaatcctgatgctctaaagtggtgtctcaaagctagcaaaaattatagtacacaatctgtttatagagctatcttgttttgtttagagggtaaaggatagaaaaattcaggagatctggcactgccctgccatatgaaaataaaacattttgtctggttggctatgagggactgaatccagtccactaagcagttaaagagaaaaggcaaggctgggaagggactgatatttgtcgcttatttggtgtatttgcagggatactttctgctggggcagagtcccaatatagttttgtgatttctttttaattattagtcagtataataatgagaaaagtagagtttttgctgctcctttagctgctatcggttgggtgctgtggattactataaataacacgattgttagatctaaattgatctattcttctctaatccttcccttcaaaatcatttcccatttgcaacgttggaaaatgctaggtgttaaggatgctgatgccattaacaaaatgaccgaggagctcacaaagacaacggcaaccctgggtgctcagagagctagaattgattgaatagtttctatttagccgcggtagtttttagtatgatagagttgtgnnnnnnnnnnnnnnnnnnnnnnnnnnnnttctgaacttcacccattgcaggtaattttgagccagttccttggtgttctacatggaacgagcataaatgttaatattcacgcggctttgtgaatgggccatccgagttgggacatccaaggctgaggttgagggtgttgctgctgctgtgatctgttgggcagtcgtggatcaaggggcgctgggtggcggcgactgaagattgtttttggaggccgccgtattgtcctcactgcgcgccctgctctaggtctggcaagggtcacctcgcgtgccttttgtcacagctgcactgtcagtggtgtcttcggcttctctttcacccaggttcatcttcgccatctcatttgtacctcggtatatcaggcatcgctacaggagatcaattaggttcagaaatcatcctcatcagttcatatgaataatcgatgctttatcaagcatctctgaattgcatctttagataattgaacaggactaggaatatttttgttattctggttagaaatatccattaggttcatagttcttactcctggatttttgttagatagcaatgcaggaggaatgtgtggaaattaggttctaacatgatcaacactgaatattcgttgcacacaagatgttgaaacgatatttcttcacagttttgacacatccatctcctcctcatcagtcaaagtaacacttgcagtgctagctatctcctattgttggtgacagtagaaagatagttagcccccccagcttccccttgacccggagcaaacttttcacttttttagacgtgactcatgcattgctataacacttttggaagccgagctcggccttatctcctgacagtgtaggtgtgggccctaccgggaggaaaaatatctcccctggctggctcggctcgattttttcggtgtccgttttttaaaaacccggcacctacaatatacaatatatggttggtgtcggatttttttatcggttttttaaaaaaaccgacacctataatgtaagtgccgatttttctctaaaaccgacacctatcttcgtttaaaggtgtcggttctaattttttttcatcttatgaaggtgggaaaagcactatatattggtgtccgttttaccactttcggtacctacagtgttgacatctatccgatgttttgtagtagtggtctgggtcattaggatcttagataattacgttgtgtactgcatggatggcctagtcgtgagcgtggcatgcggctgctagtggcgtacgtcttggcctctaatctgtctatttaagcatgtacttagcatctttgttaattgagagtaaaaaagagaaaaacgctgcgtttgtgcagctccaaactccagtgttcttcgccagttcgcctctggtgtgtgtgttcatcaggagtgtgtgcgactagtgtatctagttagggagtgattcccaacattaatcaagtcacaaaccaaaaaaggattttaaccttcaagtaatgccattctatctttctcacagctgcagctttgtagtcatatacaggatagtataagtagagtcaaagttgtagcatatctattgtgccatccctgaataagtaatattattatccttcaagcttaaaatgagaaaagcgcacaagtaacctaataactaataaatttccaaaggctcgtccatcttttactggtaaaaaaaatagtggtggtgatggtagcatattatatgcaatatgatgaatagtattgcagtatctttttggtaaatgagtgaatcattccattatctattatctgtatatgtatgtggccatttcatttaatgtgaattatgccaattttctagatttggggatactattattttctagtttagaacttttggtatatttataatttacatccatacaataaaccggcaccaggttggttccagtataaaaaaatgctagtgactaaaatatatctacctatggtcttacagaactctataattgtagtcatgatacctacagtacacgtatgtagtatttaggatatctcgtgaaatatatatacttatggtcttacatgagattataactaaatataacggctgctgttggacttggagccctagccaagagaagccgctaagccaaccaggcggcataaccagtaggtttgcactgcatccaatggaaagatgatgaggagcagaacaatagcattactattacgcttcacagtgagtggacaaattgtacgacccaaaaaatagatgtagaattacataatgaaaattttctttccaaattgtaaactatgcgcaataagtttttttacgaaacatatggtattatcgatggcaagccaatataaacaacaagagagaattacaaatatgccactgctttcatctcctaatttggaatagccattataaatacacaaattgcatatttgccaccaaagttggtgtgtgtggcttccgtttgccattgcagtctgaactggtataattaaaaggtcaaaagtttttttcacaaaactaatgtagaaaacaaggaacatggtatgaccgttttgctcttggctaaaacagatccctcactggcttctctctccaagagccctaaatcctcaaatccccttatctcttcctccaaatcgagaacaaaactattcaaaattggttccaataggagatcgagggcaagggaggaatggaggaatggtgacttgggcggtaacagcaagcgcagcggcggggagctgcttcggcggcaacagcttgatgtagctgttgctagtgaaccatgtacatgtctctccaaccttaaactagtgaaccatgtacatgtctctcaaaggcaaagtgaattcccttgttatttttatcttttcaggataataaattacaaaatacttcgtaccatagtctagcccatcagaaaaacacaaccatcatcgtctcattgttataatggcttgcactggttttcctctctaaattaaaatacaaaataattgatttataataaatagtctatgcagttgtatagatatgttatatcactgctagagaaagcatttgtagtcccagtttgtaaacccctttagtcccggatagcaaaccagggctacaagaacaggactaaagatcgtcccggttcagatacccgggactaaaagttttttttctacttaaatattgattttaaactgtcctcaaaatcatcctcattcacaaaataatccacaaattcaataacaaaatcatccacattcacaaatgcaacaacaaaatcatccacatttacaaaaacatcagaaaatcttccacaaatttacaccacaaaatcagtcaaaaaaaacatctaaaaataatcccctattcttctattttttttctactccacgacggccgttccgggcgccgcccttcgctccagcgctgggcgccgccgccctccgcaacggccgcgccgccaatgtctttggctgccgcccgctgacgtgagggtaaagggagaagggaagccagcaaggggaggaggggaggaaaagatagaggatgtgagggagagaaagagataaggatgagaggaggagggaatctctgaaatttttctctccctcacatgcgcgcctttttgctttctctatctcacgagcgatttttttagtctaaacaacagggactaaagatattagggggcctaccacgtcctgacaataaatgaaccggtctttagtcctggttgttaacaccaaccgggattaaagatcaagaaaaatacctccgaacttataactcgggattaaaaatagtttttagttctggttttttatcaaccgggactattgtggtttttcccaacccacaaaaaatggtttctccaaaaatgtatgtctatcaggtttatccaggctcacaaaaattcctaggtccgccacagttcgcgtcccgtccgagcgaacattcgcaccaccccgagttcgtacccttgctaagacaaccatatatttttacccattctttttaaacgtgtatgtttatgtaaactagtgagaaaaaaagtatttttttttaaaaaaatgttcattctattattggtagtctgtcggtgcagttggtagaacattcataaaattataaaattatggcgaatgaaaaacgtcacaccattcgtgacgaacgcctcttcccactacgcacttactgcaaccaatgcattttatctcaaggtgctcacagtcatgtttgtgacaattttcacatcctttttacgaaagtagaacgtcacagaaggtaatgtgaaaaaacaactgaacactacataacaagtcatgaagagataggtcttgacatttttttcccctatatggattctccaacttgaacgttcacattttgaggtcgtatgaattagttatgaattttacaagatttaatagggttaaaaacattagaaatgataaatgaaatagtactttataccactatgctcagtttgaaacaaattattgagcggattgttgccatggattatctacttgattatataaggataacatttacatttttcccacattgtatgcgtttttccttgacgggggaccttacgtttttcccacatttataaatgcattgcagaccaatgaattgctgatagctgaggcccatcgaaagtacgatgcagatgatcagcaaaatttggagtgaaacaatcaggcataacaggtggctgcttttcatacttggggaagtgatcaagacatgactgtacaatagcattttgcatctgacggaaagattttcattaaaacaactggaaaagaatatgaaccaagaaatcaaaatatataaaatgaattacctgaacattgcgacagcagaaggcatgcaaggcaacatattccctttgtgttgttgcaagggaaccaacactaatcagactaccaagtaatctgaggatggagtttcttcaaaatattggtccaacagctgcacatacaacacaaacataatttataagacaaatggaagtaaattattaagttagcaaatgttgtatacaatggaaaaggcattgtaatattattcgtatatcaagcaaagttagcaaagatatacaaggaaattatatacaatcatgagtatatgactcataacaggtctttcaagatgagtctgcctgtttttactttggatttagctaaattcacgcaacaggctaattgggtcatgtgaatccgagcatgttttacacgtgtccaactgttcaatgcaactctaagtgtggggctcacaaatgaagagcaaaactcaagttttgcaacttatccttacatttggaatttaggaagaaatgcaaccagagaacatttcaacataaaagtttgtgatgcaagttgtggtaaagggcagggctcatgcttgacactgcagttggtagaaaactgggacaaatgctgctggctgcacaacaaatatctgaacattaactcgtttttttttaattcatattccaactagaagtcttttctgtgctcctaggtttcagtttagtggttgtctataactcagaacatgttgctttaaatcctgttttaagaaaaatagcaatgccatctgctcttcctgaaaaacaaactgtgactgtgcttgctaagactttagccaagcaacgcttattgggtagtgcaagctctaataataccatgcctaccagaattgaacaagcctgtcctaatcagaagacatcagatatatgaacatccaaacaatataattctaaagaataataacaaatgcatttgcaatgaatggaaagattagcaaaaagtgtagtacactgtaccaacaagccatccacaatgactcagcttctttgtttgaaccaacattctgcctattagatatacttgattgagaagttgaaaacaaagaatagataaataagcacagttatcaaaataatttcattttagacaaaaggatcttcaggctttaacaaatgagaagaacccagcatagctacctgaaccaggtcaaggaaatgatattcatgcttcacagtaccacaatgactcaacttcaccttttctgaaagtacatttatattcatgctttagtagaacaacaacatcataacatcctgaaatcattggcaaaatattattaggtgatttcattgcaaagacatgtttgtatagttgctccacagaaaatgccatcaacaaaacaaggtggaaaccataacgtacctatttcatgcatccactgctttcacgatggatatgagaggatgggctctcatattgaaatttattaagaggggtgaggctcgaacccaggtcaactagcccaaaccttgtggtgctagccggaagacccccgggcctttctcatccactgttttcaccgacagcgtgacatgcacatcccttgatacagattcatgactattctcataggaattatataggtgagctcagcattcctcaaaatagcaagggctcaaacgttctaatgtactcaacagattcaaagcttccagaaacaaattgaagttctgcctctgttcaggtaaaaaactgcagagtatgaaatttgcagttaagaatatatacagttgttttggcgcttcagaatgaaaacagaaacaacaaagatttatcaatcatgtataaggcatgcatgagcccaagaaaaaatataagtgaaaattacaattgccacaatatctgacataaaagaagaaacacagagttcgactttgagcaaacttgaacagccttaagaacaaagcacaagtggtgaactatccctaaagtttagaatatttaaaaggtttgtatacagaaatagcattttacatccaacagaaagatttttattcaaacagctggaaaagatatttaccaagaaagaaaaatataaacatgcattacctgaacaatgagatggcagaacgcatgcagtgccacatattccctttgtcctgtagcaagtgaaccaaaagaccagttagataccaagtactgtgaggttggagtttcctaaaaaaaaaacattactcactgctgcatgtacaacttaacagaatgatatgataaatggaagaaaagattcagttaacaaatgtatagacaataaatataaaaggaaattagaatattactcataaatcaaacatcgtaagcaaataatgcaaggaaatcctacactcatgaacgcatgattcacgacacagagtttttggatgagaactctgtcttcacttcagttttaacaagaaactcaagcttgcattgcaatgtgccccaaggtgctggatgtacagaaaacaactatgagaaatacagcatcacacgcatacttaggacatgtcttacagactttttgttttttgcttagtgattaactgctaaatatacagaatgatatagtccataaactaatacttaagtacatagaacagggcaggctggagcagtggagagttaatgctgactctatataatggatcagagcagatgtgctcgaccctaaataaatgttacctgaagcatcctgagttctgtctttgtgatctcccaccaatttataaacatcctgcatggctgcatagtgccattttgttagcatctgctcacagctttcctccaatacctagctcaggcttctcgccttcctgaaaccttgaagaactccaagtagctttggtaatcactttggcatttgatgccttctgtagcatacatccattatcctactgcatatagaggcacgctaccctccatttcaaaagccaaatcaagttccccctgtttatagcatagctcctctaaacatttctttgtttttttatcaagatacttccttttcttcagcatcattgtaaaaatcctgtcagcctcactccatcgtccatcttttgcaagtaccaatagcaaagaagtgtagttggcatatcgtggagtataaccctggaaaagcatatcttcaaataactgtaggacaatatcaattgcattttcagcaagaagaagctccattagtttgtcataggaagccttactaggaacaaagcctcttttgtgcatcatcaataaaaacgaaagtgcttctttcattcgtccagcaagagaaagccccttaataaaagtgttgtatgttatcttatcaaagacacatccgtcactgttcaatgagttaaatagttggatagcatggttgatgtctcctaatcttatttgattattcatgagtatagtatacgtcacatgattgggaagaataccagtttggtccatcacagataagaggctgtaagcatcatccatcttattggctctacaaaggccattaatcatcccattgtaaatatgta

SEQ ID NO: 65673 - DNA, 28264 bp, Oryza sativa
  unsure (1)..(28264): unsure at all n locations
tcctccgatctcccttccattctccttcattcccgcctccatctcctcccatcccccttccccccctttgtcgttgttgcatggatgacacttgctgttgtggcgttggtggccgctgcgggcgaggaggtagccacatgaacgggaccatgctggtgctcggtcggcctccgcctccgccaccggccgcccgggcgagctcttcctcggccgctcagcgagctccgcctctgcctccaccgccgtctgcgcgcgcgtgcgagagagaggtatgacgggtgggtctagggaggtttttctttttgccgactggaatgacacgttggcgccacgtgtgcaacctcaaatcaaaaccgctcaaaacagtgttgacgagggtaattcgtccgacattaaaagtttagggtaagcaatgtctgatatttaggttcagggggtaattcggttgaccgcgatagttcaggggtaatttgtaatttttcctttttattaatactactttatcgttttttttctcgttttaggcatcaacatggtagtgcgtacataagtgggccagacaggcgtaagctaggccgtgctcatgcttaggcccatgtggtggcttggctaagctgggttgggcccgacccacctatacatccctcctagcttttattatatatcaagaaaaagtaaataaaaggaggaaaaaatcgttgcggatatttccccgtctcatcgtcccctatgcgaggcttcctcccacttctcctccgccccccgcccgatctacatccattcctccctccgccaatcgcacatcaccggcgggcggcggctttgctcctccccgccgcaactcggtgagcacgcattctcactttctctcttttttttcttaatttcttttcccttctcgaatgaaccctaggtaagcttcttctcttctagatctggatcatccggatctggaaccttaattttcctcaacccttgatactaataacatctttttgtttgtttgattctttgttccaaaaaataaaaaagttttggggggatgttcggcgttagatccgcacttgtgcattgcggcccttgttcgaattcggctggtgatttgtaggattcggcggcggcgagatgaacgacgacgccagcatgagcagcatgggcctgaggggttggggggccttctatgagccgccggcgaggaacctcggcctgcagctcatgtcgtcggtgcccgccgaccgtgacaccaagcatctgctctctgctacccccttcctgcatcatcaccagcatcagcagtatgtcccgcaccaccaccatcagccccatcacccgcgtgactgcggcaccaatgccaatgccaatggcaatggcaatggtggtgctatgcctcctcctcctgctgccacggaggctcccccttcaaatgccgatgaacttcgtgcacaatgacatgtggatgcacatgcaacaacaacatcatcatcatccccgcgagccctaggttcttcacactctgtccgttggccatggtggacacattgcgcatcatgaccacccagttggctatgggatgatgcctgctacgcatactctgcggatgttgcagcaccaaccagagcctcaaccgcaactgcaacacccaccatcacctccacacccaaaagaggaatgcatttccccgccattgatggaggaaaatgtgccagttaagccaccacctcccaagaagaggcagcagggcaggcaacccaaggtactaaggcctaagaagcccaagaagcctgctgctccatgtgaggatggtgcaccacccagtgcgccagcaccgcggagaaggggtcccaggaagaatatagggatggtgattaatggtattgatttggacctctcaaggataccgacgcgcatttgttcctgcacgggcgcaccgcaacagcgctatcggtggggtgctggtggttggcaatctgcgtgttgcacaaccaccgtctcaacatacccactgccaatgagtatgaagccccgtggtgcacgaatcgcaggtaggaagatgagccatggtgcgttcaagaaagtccttgagaagcttgctagcgaaggctacaatcttaataatccgattgacctgaagaccttctgggcgaagcatggaacaaacaagtttgttaccataagataaggtaagagactaaaataaattctaaatttgttggctttgtaggttcctctgctgctgtttggtctcagtaattgtctgtatgtactctagatgacaaactgcagaatcattttaggtgtaggttttagccatgtcctgtcccttttgcagtagtttacatgcctcatctgtgacctgggtgctgacctgtatggtggctatctgcatgtatctttatcattgtcttcacaagtagcaatgtaatgcgacagtctctaatttaggtggcaaagttaatcatttgagtgtttctcattgtgcttaaatcatatgttatacaatgtttcactgcaatgtttggatgttttacagagcacaatatagttggtatctaatgaagtagagatgttatatgtttcatgttgtgttctgtacgcatgtgaaatttatatagcctatatgtacaatttgtccattcttttattgtactgatctttgcatgcatgatgcatgtgggcataaattcagtacacaatctgtattgcttaaccaagtgtcgttaatgttgtgaatggtagcaagttttttccaatttcatttaatgtgctcaaatctcccagtctcttttccaaagtcccttggaatcaagaatttttagaatgaatgctggggactttcttctgccactagtctaatgtaacatgcctttggtgcccccttatacatagatggaacttctctgtcttaatgaataatacgcagatctcttgcgtgttctaaaaaatacattgatggaactctgaccattgaagacaaatccttgatgttcattgatgaatccttttgtatagtactccatgtgttattttctgcacttcttttgtaagcattccttgtcaagtaatcgaagtcctacttcaatcagtaaacaacagtcaaaatatttcaattatatactagtgatttttgatttgttatttttttttggggataaggaaatttacctgtctacagttttatcatattgtgcttcctcattatgctgcaagattttaagctgtctgcataaatcttgtaatcctgaactgttgcaaaagaaaaaaaaactgaaatgtcacatgttatgcattcaaattgttgatcctatctactagggggatttaactccagtccatagctttgtagttgtcaaggctaattacattagtatgcatatttatttatttttagtttctagattacagggaaagtggtgccatttgaataaacgatgttactcctattcaacaattttcttttctgaactataataagtactgtaattttagagtgggtttcactagttctctttagccatcgaatcagtaatactccctcctcgttttctatccacattaatgaattagtcttttaacctcgtgtttaatctgacgttgactatataattttccacatcatatctaaataaaatattagacaaacccatacaacggattgtctagttagccatttcaaatagattacatcaattaatgctttgatcctagagatgacttctatctgtatagtagatggtattaagctgtatatcggaaaacattgagcagcgcggtaggggcggccgctgggtgatgccacgtcggagtgctacagtgcgcgcacggtagaattttgccaaaaagtcctccgatttgtgcgtaattcgatctagctccttcccaaacagtacctctgaggtgttattttacgtggattcccttaggaaatatggatattgcatgtgaagaagagaaaaatcacggattagggctacgctctaaaatgcggaagccgagtggctttttcgcaaaaggacacccactaaccctaaccacccccaaaccctagccgccatggcctgctcccactcccactccctctcccccactgctgcctctgcctcccctcacgctgtccccgtcaccagcgccgccgcctccacctccccctcgcgccgccgtcgcgtcaccgccgagtgccccctctgcctcccaatcatgctaccacctccgcctcccgccatccccatcgccgaacgcctctgcctcgctccgccgcttccgccgtcgccgagcactgccgcagcaccgtcctccactgccgctgccatcgccgagcgctgccactgcgtccttcggcgccatcgctgacggctgctgctccgccctccgttgccgctgccatcgaagaaacggcagtggtgacagaaccgacatcaaggaaggcggtggctgcagcgagaagaggagagccgtacgttgccaggctctcgagcttgcccctcatcaccgatctgtccttcgctcaacctcgctgtcgttgcaggctccaaacctagatggcggtacaaatccagtggagcttttggccgcttgctgcgcgtcacctcttaggtcggtccctctttccctcaggttgttgtcttcgtttatacccatctattttttgctgtccatcgcctctgcagggaagaagaacatgaggtgagagtgagggcgttccaaatggaggagtgcggtgtcccctagtgatagcctgtacccacggatccgccatccccacacgtcgactcatccacggtatatcttgattcacatgtatattgtctgctttttgtggagtgaaactgaaatttgatagccctgtatctgtcccttcttggaatgacttcagtgattgctgtgttgtggctctattggcaatggttagaagacagtgctggctgtgacaacaaaaggtgaaactaaagagattgaaaagataaaacggtgtcagtgctctgctctattccttccttttttttttctttcttttttttggctaaaattggttggttggttttctccttggcaggttttttttcgaaggagaccatcatggaggaaagaagagagggtggagttgcaaacatgaaccatatatataccttttgtcatgcttgattaatttgctcccagatgaaagtaactcattgctgcacaactccttgaattgagggttccgattctagaacacaacatcctctgcagattttttactggaaggtgttccttttgtgcttcttaaactgaaggtgagttcactgtgtgatttactggaagggtttcgattttgtttaatgttcactgtgtgaggaaagtatcttcaagtactcctagctctcgatacatcaaaatcttacttattgttgtaactgagattattttcttactttggttgtttcttggtttcaattatatgtacaaacagtaccttggtgaatatgcacttgaatgacttcaacccttcctttagcccactgtagagatttgtgttttatactctctttgaaagactattcttgtggcccttgatattttttgggaacttaatttttcctccagtttattggcgtggtctaggtatcctatagttgcatcattttgctatggactttactgtttaaggggcacacttgtcagaattagcctttcgatctttcatgttatctccgagttaatttaagatcagaacaataaaatcgataaaataatgggagctgactagattttatgattgggtgatacggaaagttgattgtattttgtggacaatttggtttgtatggatggatggtcgtgccttttctttctgtgcctttgccctcttgcgagatgccagagtgatgaataaataaaaactgaactgttgattttgttaggtatgtttatatcatttttggtatttttacatgattgtgtgccaatgtttggaataggacaatgctttgttttctcaagactaacgagctgttttctcagattgattgcaacagagcatgctgcaacggctaccatatacagtactccatggttggtgccataaaagggcaaaaaaaaaagccatatcagtagatgactcgtactataaatgagttgatctagctagactgcatgcacaatcgaagagccagatacatggaccaagattttttaattatatctagatgggttgattaatcatatgctcgtccgatctatttaactagatacgtgctgaaattatggttataaaagaaactgcgcagtgcagtttatgatagtacttatcttccatagctatttaaaatgagtaaagcatgtttattatcttagcttttcagttctgattttggcgctatcttttcttcttcatgtattctaattcccatttctcctttggttgggaactccgtgatgtgatacaggctttggtattacatttttattatgttgctttaactatagattgataattgaactttgagattcatccgcattgcaaatatcactttggtattactgttcttactctgattaagtttgcaaaatgatgattctcattgtatgctgtgcaggagctatccaaggaaaaagaataaataagatcctatcgtcttcaacgtgatgctatcatccttggtcatcaggaaaaactcagaagaccatggaccgctcctgccactcatagtaagaaacatgatcataaatctagtctaatatttgttctgtaaacctaaatttttgttttactctataatatcaacaaatttagtcgacaaaaaaacaatacgaagagatcatgcttaattttataaatggctgacctcgggaaaaaaatgttgtgaggattggagaaaaattgttgcacattaatcttccttcatgagaaaaattatagtattaatgaatttgcccacccatcttgcttacaagatgatatattttacgattggtgtagggtcatatgcgttatcactttttctcaattttatgctaaatgtttttttcatatgatcagagataaattgtggcactgtcattataggatatatacatttcaatgttaattctacacagcaatatttattgtttcaaagatagtctatcaaattagcgctacactttgctatgattccactgttttgttcaccacgttgaatacaaaacagtgcaggtcaggggtcttctttgtgaaaagagtttattcaaacagcctaattgggttacagttcttcgatggaattcatgaaggcacatatgaatggggtacaaaatttatctaaatgctccaaaacattgtaggatcgaacacaagtaaccaagcctccaaaacttttttcaaaacgttttttgtcaaaatcaacgcatcaagaacacgatcatgcaaagcaaatccaagagcaaaagaagactccaactttttagatttttcaatctcagattccaatttcttgcaattaacagaatagacatcttgcaaagcattaatttcagaaaataaaactttacaagatttgcagtcatcatcattaggaatcaaatattttaatctatcaattcagcatttagaatctcaatagtgtgatccttctcatcaagcatattagaacatgtttgaagttttttagcaaatttgaaagcagcatattctaattgatcataactaagcttttcttcactattactatcagattcatcaacatcagaacttgcattacgagcaataaaagctagatcaacaacttgcttacctttgctctcatcttcatcctccgattcatcaaaagttcttattaattcttggattagccactgcatgcaattcttcttcttctccttcgtgatcttcttcttgtcaacttcattctccaaaactctaccatcatcttccttcttgcctctcccaagcttaggacatcgtgaacgaaagtgatccgtagaaccacattcaaaacaacgatttggtccacctcttttcctgtacctaacattagccacagctcgagaaagtttgttagtaaccaaaaccaagtcctcctcgaactgttcgagttactcatcggacatggcattaatcaaagcaagaacagtagaatttgatgaagaagcaccaacatccaaagaagtcgaggaagaaaccaaagcactagaattagaatcaattttacgagaaagaatattcatctcatgtgttttcagttttgtgtaaagtgaatccaaaatcaaagtagacatatcgacagactcctgaattgatgtaaatttcatctcccaaatagacatgtcaagaccattcaaaaagtgacgagaaacttcagattgagagtaatttttgtcataagcagaatcaaccgatctaagatcactcaaaattttgttgaatctagaaagatagtcatccaaagcttctccaggtttcatctcaaacttaatgtactcctttttaaaaagatcacgacgaagttctttaatatttgaagtttcttgatgaaaatttttcaaagcgttccaaatctcatgagcagtttgaaaatgtgaagcacgcgcaaaaatccgaacgagaaatcccactcaatanaatattgcgagctttgcaattttgttcaaattcagtttttaaagcagcagtactgatttgatccggaatcacataaggattagaaactttcctccaaatatcaagatcctcagcctgaatataagattgcatcttactacaccaataaggaaaatccgttccatcgaaaacatggggcttagttgtaaacttattagctatggcaaaactttagatcggttaaaatccaaaaaagaaaacgaggctctgataccacttgcaggatcgaacacaagtaaccaagcctaccagatgggggtgaatggtaaggaaaaccaaaaacccaaaaacttttagcggaaataaaagttaccctcaaatcgatggaaatctcgacgtagtcctgtcgccgccggtcggaccgctcgcacgccgccggttagatcgcctccctgccgcctgaacccgaagaaacacaaatcgaagaactctcaaagtagatgacaactttattgcttctctctgtgtttacaaagtgcaccaacagcactccttacaaaaatctcgactaaactcgaaaccctaactaaactagaaactcaattgctatgaaaagctatacaggaagcctcacgcttcctctctatttataccgtaaaaatcccctactcaaagtaggtgtcaaattaggtgtagagcttctatttccaacaggattcaattcctcaatttccttttctccaaaaccacagccgtaccagccatggaaaatcctgctccggatcggacgcctccgtaccgatccttcgccagctcgcactcggtctcctggccgcctgggccgactcggcctgccatccaaccgagccactgctgctcctcccagtccaagccacggacctgcatacatgcatgctacctgcacacatgtacatcacgttcatgcaaactacacgctacagtacatcgagtactgtagcaaccatgccctccaccgtacatgtacatctccatcttttctcattcctcctcgcgaacaccgacgcttgcacgcacacctcataaaacccgttgcgaagatctctcacacacggtgtccatccaccgtgtgccatcttgtattcaacttcgtcacccggtatccttgaccatttggacctcaacttctccctgagtttagtcccggtccccaccgttgaccgaagttgacctccaagaatcctgactctagtcaccttttcacatggtatcctgaccgcactagacctatgttcctccctgaacatagtcccgatcctcaccattgaccaaggctgacctcaaatcacctgcacacaatcagacatcaccattgaccaaggctgacctcaagtcacctgtacacaatcagacaaaacaactgttcctgggcatagatatcacaacctgacccacattagtcacacgcactcacaccaacatccacacatctttccaaaccaattcactaattaaatcatttgcatagccaattattcatcacaaacattaatcatgacaacgatttcacaaacattactttgtgcaatatttttagtacaacaccatttctcctttatgtttgtcgttcttttagttgagaaaacatttttagaggtgccaattgccagcttcgaagctaatttttgatgcaagctttagctcagatcaatattcatgagggaaaaaaggtttgttcgcattgatttaggcaaatggcattctcatttttaccattctactgcctccagaccccagttgcaagaacaaaattcaaatggtaaaaatgaaatattgagattaagagcactgcaaacaatattctttctaaaaatagatgcaattcttctgagtccatgtgatgcaccttttcgagtgattaggatctgatcatgagaattatcagttatacacctatttaaataatctcttaaaatgtatatgattaatgcaacgatttcaataatttagcatgatgcctaatctaatcctttactcaattatcttgcaggcaatcttgatcaattaattgcttcagtttagagagtttttttcctacaggcaggtgagatgaccaccaggcaccagcacaatagctcattacaagagcacaaaccagactgaagattgtttggcagctgaaactgcactgtgtaggcagtagcccttcttgagaagtgatggccatgacttttgagcctttgatcatctggaacagcaacacttgggacctgtacaaatttgctgatggttccttctacaaaaattgaatgtgcaatatctgaatgttgcctacttctgaattgtcgaaacaagaatttggcaataataacaagaattcggcaataataaaaggggatagcgcacgagacctaaaagtggatggatgcggagacaaaggatttagacaggttcaggtcctctcgatgagaggtaataccctactcctgtttggggatttgaatccaccgggtgtagtatagatctgacgatctagttgtctcatgccccctagagggccttctgcccatcttatataggatggggggcaggattacaagatataaaccttaaccaatacattattggtttcataaatctactttacaatcttatcaaaccaggattttaagccgttccataatatacaaggaaacgtaatacccaagtcatgatccgttacatatttcatagatataagttatcccctgtatcagtcggataaccacgccgtgtgggtatggggtacccataatctccacagtagcccctgagaccttcacagtcgaaaagataatcttctctcgaaccagattactccaaagccgagtgcttcaatcatctttgccatggtctcctaagtacttttaccaaatctgaagactgtggagggctgaaaaataactgaatgtaaacttaggtgcatcgactagatgcacctaataggtgtagctcccgactatggggttaattgaataaactaagcatatagtcagggaataaataatccaaccaactgagtggtttttgataattatagtcaaccaagtgacttgataccaatatatagtatatgcggtgtgaaatcccgaataatatgatccaagtgatataccgactgctttgtagaatatgatgcgtgcaacctaaagttgacaacatctttgaaaattcacatagcaaaacagctataaagaagcttgtatgttgtgaataaagaaatttccaaagtattgggcatacgccatgcgcacattgctttaacagatgtgcttaagtccctaaaagacacatggcttcaccacacccggaaatatacgatatatgtggtgtaaaatccgagtaaataaactcataaaggatttaccaaccgcttgaaaaatgaccaagatatataatcagcctaagccttaatattagtcaataaaaatgcacacttacatggcaaaaagcaatgatattatatccaatcaattgcttaaaaacccaaatagcaccttgacctatataaaaaagtcagcgggtcagctatataaagttttactgtttgacaccttttaagatgcattgtaccaactcctaaaaagttgagtaactgcggtataaaaggattttaaggtattaggcacttgatcacgcgcactttggcctaagcaaaaagtgcctaagtccctaaaagaacgtgaaaatatgggctgcagatatattaggcctaggccaaaaaatatgccttcgacacccttcaaaggatgacgcatgtaacatgctcctgagtaataaatcttccgggtgatatagaccaagtgtagctcatatgaatagcttatgatctgagtgattatcccttataggatactccaaaatatatataataattgaatcccgattggcgcgagtattcggttgatgaaccttacggggaataataaatagtccagtctttgagcatagaaaatagacccatgatcatgaattcatgttgcatgtatccagaacgagttcaaattgaaggtatgatacttgtgtttgagttagtaagcccctgatcatatagcttgtccttctgtcgtagtcagaatggtccattgatggtagccgacgcagttggcatagagacaagacgaccaatatagagataatattgcccacctgaggtggcaaaaatattggtggtagtgaagatagtgataccaatcaaaagtgatgaagtcggtgatagacaaggcagctgatgaagaagatgaagatgcccattagtggtgacataataagccatccgtgaaggcgaggataccggtcggtggtgacgaaagcaagccgacggtgaagatgtagacacgcattaaaggcgatgacgaaatccaccaatcatgaagatgaagaaaatagttggcaacggcaaatgcaaccgacagtaatgatgataagcagcaatcatagatgagcgactatgatgacgaagatgcccatcaaacagcagtagaataggctatgttgaagaggcttgacaggatattgatgaagatgacgatgtcggtgatccagtcaatagcggtgtagcagccgatgataacgatgagatcctctatcggcagttgcgtagtaggccaaccgtgaagacgaaataacaagtcggcgatgaaagtcggtgatgacaaaagcaaccgacggcgaggacgtagtcaccgcttagcaacggcggagacatcagggccgatgaagtagatttgctggtgatgatgtcaataacaacaatccatcaaactgttgagaagatatcaaagctcgagtagtttcattgatgcgagcgtgtgcataaagaagactgatgcaacgcttcttgatctataaagatggcagtagaacttggaattgtagctgttgtagatgcttcacttgaaggaaagtaaatgttgttgtccaactcatcgaaactgagctgattggttgataactctaaactcccgaacatgtagatagaatctcaaacttgatacttgaaaaatttggagtagattatggcagcttccagaaaccaaaattgctggtgaaataattggagttgctgaagtagaatgtctgctccgaagcaaagataaagataatgactcctggagttgactcgttgactgattaattgatttcttcagcttgtcgaattttgagagtcttgtatctgtgtagcccccgactctttggttagttggaaagcaactgaacatagagtcgagaactgtagtttattgtcgtcgagtagccatcacttgagtgaagatatgtattgaggatgtccgggtagaaatctttactagaacaccacttgttataataacatggcatcatatttggcgacgcataccgagatgtcaaagctcttgtagaagtcatggctggtgaagtagcaaaacttgcgaagtagcggcaatagagtttgccggtgctgaagacaatgaagatgaagtagctccaccatggtgacaaagttgcacagccatgatgaagtgaacatgagtcgatgacagaagcaaaccggtagcaaagacgcgcagttgtgaagataataacaagtcggcggcggaagaagtagaataatgatgaaaaggaagacgtccttgagtggcggcaaaataggccagccgtgaaagttaagacaccatgagctgcggcgaaggcaaaccaacgatgacgatgacgccagtcaatgatgacgaacaagccagtcggcgtcagacaaggcggccagcaatgaagatgatgacatccatcagtagtggtagtggtataaactagccgtagaggcgatggctctggtcagcagcagacgagacaaccgacggtgaagatgataaggccaatcaacactggcataatcatgcagccgtggaagtgaagaaaccagtcggcagcagacgtagacagcttgcgttgaagatgatgatgacgcccatcaacggaggcggagtccaccgtccttataggcgagaacaccagtcggcggcggcgaaacgggccaacggtgaagtcatagatgcccaacaacggcggcataataggccagccatgtaggcagagacaccagtcggcggcggcgaaggcgagccgacggtgaagacgtagacgcccaacaacggcggtgtgaccaaccaaccgtataggcgaagacaccagtcggtggcggatgaggcggtcggtcggtgaagacatagacgcccaacaacggcggcataataggccagccgtgcaggcggagacaccagtcagcaacggcgaaggcaagccggtcggtgaagacataggcgcccaacaaacaatggcataataggccagccgtgcaggcggagacaccagtcggctgcggtgaaggcaagtctgtcggtgaagacgtagacgcccaacaaacggcggcataataggccagctgtgcaggcggagacaccagttggcggcggcgaaggcaagccgatcggtgaagacgtagacgcccaacaacggtggtgtgaccaaccaaccgtataggcgaagacaccagttggcggcggacgaggcggccgatcggtgaagacaacaacgcccaacaacggtagtgtgaccacccaaccatataggcgaggacaccagttggcgacgacgacggcaagccggtggtgatgttctgactgatccattcctggagcgtagtagataagcttaaagccatgaatcccttttatgcatatctggatctggatcgtacagaacgaacatatagatgtaaatataatactcgatgaaaattcaagtattttaaaatgtttataaatatgtatttctcctctcgtcaattttgatttccccgagcagatgactcgttacgtttaaacactctgcccgactagtcatagccaccaagcaccgggagtcggcctaggcacttcccaaacatgcatatgagtgacatgagttcgttattaatggaacaaagtttcatggatcagaatttactacttgggtacttttacaattattaagagcagaaaataaatttatctcatctctatgcttatgatttattccgagtaatacttagcaccttgcattactcggtccatccaacgagcccccgggtgctaggaatcggcccaaaggcaactatccatcgacaaaccaaacgaaaagcataggaagatagaactccataactcgatgggaactttattgttactcggattattttgcaagcaatcaagataaatattatgaaaaattgttaaaaaatatgatatagtatctgtagcccctgactcactagtcaacggcgaaccagttgatgtagtgaggcagaggaaaaggaaaatatcatataaagaaaagtaatgatgacttagcttttttgtatctccctcggtgacgatagaggtgaccgatgtggaaacaaagtcatccatcaatagcaatgaagacaccgggcagcagtggcgaaggcaagtcggtgtagatgacgaggcccatcaacggcggcggagtccgccaaccgtataggcgaaaacaccagtcggcggcggaagcaagccggtcggtgaaagcgaagacgcccatcaacgatggtgtgaccaaccaaccgtataggcgaggacaccagtcggcggcggcgaaggcaagctgacggtgaagacgtgtacgcccatgaacggtggtgtgaccaaccaaccgtataggcgaggacaccagtcggcggcgacgaagacaggccggcggtgaagtcgtagacgcccaacaatggcagcataataggccggccgtgttggcagaaacaccagtcggcggcggtgaaggcaagccggtcggtgaagatgtggacgcccatgaacggtggtgtgaccaaccaactgtataggcaaagacaccagtcagcggtggcgaaggcaggccagcggtgaagtcgtagatgcccaacaacagtggcataataggccggccgtattggcggagacactagtcggcggcggcgaaggcaagccggtcggtgaagacgtggacgcccatgaacagtggtgtgaccaaccaactgtataggcgaagacaccagtcggcggcggcaaaggcaagccggtggtgaagacgtagacgcccatcaacggcagcataataggccaaccgtgcagacggagacagcagtcggcggcagatgaggcggccgatcggtaaagatgtagacgcccatcaacggtggtgtgaccaaccaatcatgaaggcgagaacaccggtcgataacgacggaggcgatttgataaacaaccgccattatgtactccagatgcagatccatgtgttcgtatgccagcccaagcatatatatatttgtacatatatacatgtacagcttgtaacgacttgatgacgtggccgttgagcctccatagccgaggtggagtacgcacgagtactgccaaaaaataagctatcgcttggcatcgacggtactgtcaaaaaagtaatgctggaacagatcaatctgcaattagaaatataatatatatggataagaaacgaaaaactcggatcgggcaatgaggctgaatcatgagtgacagccgacgacgcgcgatgcagcgtatataagcccctgtagccgacgacagcttgatgttcagcactgctccgcgtgcagggacggctgttggacaacatgacggtgttcggattggcggcccgacgtgcgaggtcgccgaccgcttcgccttgatctcatagttgcatatatagaaccagaaagtatcaagagatcaaatagagtaatgaaaaattaatctgataaaagtttgatcggaacagcaaacctgagtagaaaattgaaaccgtcgaactcatcgagatcgatctcatcacatctccagaaaaattggttccatcgcacttctcgacggaatactcgacgcaacacgtacctggggcgccaactgtcgaaacaagaattcggcaataataaaagagggtagcgcacgagacctaaaagtggatgaatgcggagacaaaggatttagacagattcaggccctctcgatgagaggtaataccctactcctgtttggggatttgaatccaccgggtgtagtatagatctgacgatctagttgtctcatgccccctagagggccttctacccaccttatataggatggggggcaggattacaagatagaaaccttaaccaatacggtatcggtttcataaatctactttacaatcttatcaaaccaggattttaggccgttccataatatacaaggaaacgtaatacccaagtcatgatccgttacatatttcatagatataagttatcccctatatcagtcggataaccacgccgtgtgggtatggggtacccataatctccacagttttgttgaaactgagtgtgaattgattcttgtgaattttcttacagtatgtcaattccatttcagaaagcttagaaacaatgtgatccaaactgaaattcagttttcctaagttgcactatgtgattagttttatatgtatacatccaaatgaaaaatagtatgcatctaatcttgttgacattgagggatatctctgaggtaattactgccttgctatttcggtatggtatacatatattgatatatactggtccctgcttaatttatattgggctttacatcttcagaatagtctagaatgctttacatttcagcttttatgagctaaattaacatttgttcttaaataagttcactggccttgcaatatacaagcatttgccagaatacattctgaacatctctcttttgtcaaaatgagcgtttttgtgtgtcgaaatgaaccggtaagaaccagtttggtatgctccgatctttttgtttgtttatgtataataacttaaatgatagtattattatttgtagaaactatgatgatgaaatctagaacactttaaaacatgatgaattcagaccacttttatgaaattgataatgatcaattgttggtggaagaggaaaacaaggaagattcttatgcataatgtatgcctggatcttattcaattcttatgtgtccaacaataggtgtgtcagcatggaattgaatttgcattggtatggtgtaaacctttgatcccatatttgtatttttctttggacatttgagctgaatgtcagttgaattagacttattgtaaagcaaactttatatgtaaagatggcatatctgttaaaagatatttggttaattcaattgacatgaaaagttattttttaaaaaggaaaatgtgtgctcctacttctgatgatattctgcaatgagtatattcttgaagttgtagtatattagagttaatttatattgcctaattgtcgacgggggatacccgtaaaccggatatagagggtattagggtacgcttgtacttagatctacgtagtacgacatcaagcaaacagaaaacagggattatactggttcagacccctcgataggtaatagctctaatccagttggtatgggattatatgatgaaaccacagattacaaagggaatagcagaactcgatgataccgacgagaccgtagtcgagttggttcgactagatcacccggcgacttggctgtggtggttgagttggcgacaagattcgatgccttatgtcctcctagggagtcccttttataccgtaggtcagttggtctccaagtagaactcggagacatcggaccctacacgatacagtgacgacccagttctatctgagtaggattccttccatctgtggactccgtgatgaatttccttaacgtgtacaaagaacgtccgtatacgcgcagatataccatatcgatatatgacgtatatccaagggtagagggtataccttatccgtaaccctgacactaatgacgtgcattgcatgtacacgcttactagtgtgtagcagggtttaccaaaccatttgggttaacactacggtttgacggttactacggtaaccgcgaggtatcccgtggtttaaaaactgaaaaggttatcgcatgtgataacctggataaatgcgcgataatcgtacggttcgtacagttttgtaaaccctggtgtgcagtagtatggatagtattatgctgtatattattagaatgtcttgttaacaaacatcaatcttctctcaattttctttccccttcatatcatacaaaatcctaaaaggtcattttccattttctctcagaccattgtactttggactgtttcttttggaactttgaacacggctttggtgtgtttgagtacaaccacctaaccctccagatcaaaaataaggatacatattcatagtattatcttaggatgggggtgtactataatatggactattatatattaagaaggtagtatattaggatggtgaaaaacgacgtaaaccttgaattactgtttttttatttatttactgtattcaatttaatctaaattaatctgtccctaacaaagtgatgctattaggcccatagcccgataccataagccgtcccgtttcccatggttgatatcatacaatgggtgtgtttagttttttttaaagtttttgaagcatacagacatacatttgaagtattaaacgtatactaataacaaaacaaattacagattccgcctgtaaattgcgagacgaatttattaagcctaattaatccgtcattagcaaatgtttactgtagcatcacattatcaaatcatggcgtaattagtctcaagagattcgtctcgcaatttacatgcaaactgtgcaattggtttttttttcattcacatttaatgctctatgtatgtgtccaaacatttgatgtgatgttttttgtcaaaaatttttggaatctaaacaaagccaatgtattttctcaaagggacggatctaacaagttttttcaccctatcacatcgaatgtttggccacatgcatgaattattaaatatagacaaaaaaattgcgtgtaaattgcgagacgaatcttttaagcctaattgctccatgatttgacaatgcggtgctacagtaaacatttgctaaattaggcttaataaattcatctcacagtttacaggtggtaagttgttttgttattagactatatttaatacttcaaatgtgtgtttgtatatctgatgtgacacggtaaaaattttcacccttggatctaaacacagccaaagtcatcatggcacgttttccttacaaacgcctacgtttgaatcgatcaaagaatcgatggattatatgtattatgatgtaattggttattggtttaatttaatacataagtaaaaaaagaaaaagtataagggaaatattagggatagtctatgtgtcaaacaacttaaaaaaataaattttataaaaccctacctattatggtccaagttttgcaaaattgcgtaaagtttggcacgtggcacataattctaggtattaggtattatggttataaagtttcgcaaaaccacattactaatcattttgaatttgatttaccacacttttgagatctacaatcatatctcaaatttatgagtattatctatcatatagatgttacagagaaatttcattatttaccatccaatacgctgacctttaagaatttaccactcaattcgtaagcctttaagattttgccaccggaaccacgaatttcttcatttcataccactcccgtcaaatttacaactcatccgtctccttctgttcacactgacgtagggcgccgccgccaccatcgctgggccctccctcgctgccatggcgcacgtatttcatcttcatttgtcatccccccaatcgacagcggcgtggtcggggatggcttcacgctgcggctgcggctgagaggatggcggcggcaaccatatgcaagctcgggcatggccgcacctcagcagcagacgaggtcgggaacagcgacgatggtggcagcgaagcttggggacggtcaccgatgagctcggaactgcggcagcgaggtgggcatcggagagcggggaggggagcagcgccgtgagtggctatgcctaggtggggttcgtggagcgggtggtgtggacatcggcgagcgaggcggcgatggctgggagaccagaggattcgggctgtggctgcggcggaggcggcagcgtgggagaggggtgatgcagggaaggagcctaaatatgaaacgcagacgacgcgacagcgacggcgacggcggcggtaggagaaggaaaagcggaggcgagcgggaacatcgacgatggtggttgcgaagcttggggaaggtcgccgacgagctcgggtgtggcaacggcggcgacctagttccgagacggcttcgtgtagacggacgatgcgaacgggagggcggagtggtatgaaatgaagaaattcatggttctggtggcaaaatcttaaagacctacgaattgaatggtaaattcttgaaagtcagcatattggatggtaaataatgaaatttctcgatgttacacccacgttttctattttgatacaggagtatgtcaaaatggttaatggtgtagttctgtggaattttcgaaccataatatctatggttctctgatacgcactaaaatatatatggttccgtgtaatttggaccataatacctgtagttttgtacaattgatataatccaattagttaatgtttggaacaataaacaccttgtattattagttatcacagaacaaaatgtattatataattttttttatcacaaaatttcagataacatagagtgagtggaggaggagggcaggataaaacagactcggaacaaaaacgggtcaaaaacccaaacctaacggcaagtcttggtacgatccgacggtcacaaatttgtaaagaaatacaaaggaataaatcttttcatctccctcaactcttgctcctaattaaatctgtctccctcaagagtataacacctccccaaccttcgaaaccagagcaaatcgagtccctcgattgtttggatagcagtttcatctttcatgacgctcaagagacccacgtgtcagtgagaaaaattaaaataataataacctcacatgttagccattcatttcttacctttaccctattaggaaacgataggcaaataaataataaagaatagtagatcaatcacagaagacacgagatttgacgtgaaaaaccctcccaaagtaggagaggaaaaaccacggatgccagccagcgaatatcttcaccatatcgggtgaggttacaacaccgaacgacggtttacaggaatatatatgaaggtgaaaccctaaaaaaataacgatccataccgtttcgctccgtttgaagtgggcctgtttagttcactaggtaatgccacatctagtactaggtagctacattttgaaacggaggaagtactgagtataacacctccccaactttcgaaaccagagcaaatcgagtctctttggatagaggtttcatccttcatgacgctcatgagactgtcggtgagaaaaattaaaataataacagcccccacctctccctaggccctagagcaaatcgagtctctttggatagagatttcatccttcatgacgctcatgagacctacatgttaatgagaaaaattaaaataataacagcccccgcctctcccaggccaggcccacttacatttggcaactttcatatgttgtagactgtcctcacagaccaacacaagtcttttctgcacactaggccaagcacgcttaacctcagagttctttagatatcggtttctggaaaataagttgcaacttgttgatgtaagtattctattaattctattaagccttgggccaagatgtcacaatccatgagccctgcgctgcatccgctggccttcgacccggttgccgaggtcgctagggtggtagacggcggccgacatcggcgagctcgcagggagtgcgggtaggaatagcgaggagctactatcctgaaattgttgtcgccgtccgacaaggcatcgttgccttgctcctctcctgacattcgatgggagtttcccggactaggatgccacatcagtcaaatcagctatccatattgtcttactacttcagggcctgtttagttcactaacgaaaatttttagcgtgtcacatcggcgatacggacacacatttaaagtattaaatatagactaataacaaaacaaattacagattccgcctaaaaattgcgagacgaatttattaagcctaattaatccatcattagtaaatgtttactgtagcaccacgttgtcaaatcatggcgtaattaggcttaaaagattcgtctcgcaatttacacgtaacctgtgtaattattatttttatttatatttaatactccatgcatatgccgaaacattcaatgtgacagggtgaaaaatttttgtttgggaactacacagggccttatttaacccggttttgaaagatggatgtttaataatttctgaagataaaggacctacagtgaacttattccatcccaaaacagtgtggtggtgtggcttggatgggccgggctgggcctcctacagtccggctcggtccaactatatatctctcccacctttatctattctattaacaaaaaagtgaaaaataaagaaaaattcattcttcttctccttctccttcttctcttcttggaggatatttcttccccctccgtctccggcgccgatctgcatccacccgccgagcagagaccagcgccgccgccgccgccgtccgttcctcctgtatcgcgtcctggtgagcatccgcccctcgttacgcacatttttttattcgaatttttttttcaagaatgaatttctgtgcgttaaccctagatagtacgtagcttccgttgtagatctggatctggaaagcttttctcttgatttgttcgtaatgtgatactaatagcagtttctttgcttgtttgtttgtttccctaaagaaatttcttttttctgggatgtccgacgttggagacgcccctgtgcagcgccgctcttgttcgaatccggccggtggtctgtaggattgggcggctgcggcggcggcgagatggacgacgacgccagcatgagcataagatgggggggattcttcgagtcgccggcgaggaacctcggcctgcagctcatgtcgtcggtgcctgctgagcgtgacaccaagcagctgctctctggtagccccttcctgcatcatcagcatcagcagcatgtcccgcaccaccaccatcagccccatcacccgcgtgactgcggcgccaatggcaatgccaatggtggtgctatgcctcctcctcctgccacggaggctcccccttcaatgccgatgaacttcgcgcgcagtgacatgtggatgcacccgcaacagcagcagcaacatcatcatccccgcgagcacaaggctcttcacaatctcactgttggccatggttcttcgcacattgcgcatcatgacccagtgggctatgggatgatccccggtacgcataccctgcagatgatgcagcagcaaacagagcctcaactgcaacccccaccaccgcctcagcagccaaaagaggaatgcatttcctcgccattgatcgaggaaaatgtacctgttattgatgagccaccacctcccaagaagcggcagcagggccgccaacccaaggtaccaagggctaagaagcccaagaagtctgctgctcctcgtgaggatggcgcaccacccaatgcaccagcaccacggagaaggggtcccaggaagaatatagggatggtaattaatggtattgatttggacctctcaaggataccaacgcccatttgttcttgcacgggcgcaccacagcagtgctatcggtggggtgcaggtggttggcaatctgcgtgctgcacaaccaccatctcaacgtacccactgccaatgagtacgaagcgccgtggtgcacgaatcgcaggcaggaagatgagccatggtgcgttcaagaaagtacttgagaagcttgctggtgaaggttataatcttaataatccgattgacctgaagaccttctgggcgaagcatggaacaaacaagtttgttaccataaggtaaaagacaatgaaattctaaaatttgttggctttgtaggttgctctgcagctgtttggtctgagtaattgtctgtatgtactctagattacaaactgcagaatccttttaggtgtaggttttaggcatgtcctgtccctttgcagtagtttacatgcctcatctgtgacctgggtgctgacctgtatggtggctatctgcatgtatctttgtcattatctttacaagtagcagtgtaatgcgacaatctctaatttaggtggcatgaaagttaatctgttcaacgtttctcattatgcttaagtcttctgttatacaatgctccattgcaatgcctggatgttttacagaatacaatatagttgctatctcatgaagtagaaacgttatctttttcatgctgtgttctgtatgcatgcaaagtttatatagcctatatatacatgtcttttcttttattgaactgatgtttgcatgcatgatgaatgtgggcaaaggttctgtacctaatctggattacttaaccagttctaataatatctttactgtgagcaaggttcttgccaatttcatttgatgtgctcaaatctctgtcagactctattccgaagtcccttggtatcaagaatttttagagtaaatgctgaggaatgtcttttgccacttgtctaatgtaacatgcctttagttctgccttatacgtagatggaactctgggaccattgatgtcatctttgctatttagtgattaccctttaagtccatgtgttattatttgcacttctttaggaggcaattattggctagtaatctaagtcctatgtttcaaactcagcactttgtttaatcaactttgtgcaaacagtaaacagcagtcaaaatattgcaattacattctattattttttgatttgatgatcttttttgggataaagaaaattacctgtatagtttgaacatattctgctctattatgctgcaagatatcaagctatctgcataaatcttgtcatcctgaaccttcaaaaaatacagtaatatttcacatgttatgcattcaaaatgttgatcctgtctactagggcaatttaactctgtcaaggctaattgcattataaggtatgcatgttctctattttttctatttgtagattacagagaaagtggtgccatttgtaataaatgatgttatgattcagcaattttcttttttataataaagtactataataattagaatgctgatatgagaatgaacgatgatgattaatgagcatcagaattatatgaaatgttagataattaattatcacaaaagctattttctttccaacttcatatatgctgaaatgtgggttgctgctagtttcgtgttgcctaaactgcagtgttacatgagaatattgaatgtttgcacatatgttttagaggccttgagtgccacaaacgatggacagcacctttttgtaaaatgtaaatacccagtaaaattattgtgcaaaatatttggtagtctatgaagccattaggaaaataatgtaattctgagcaaatagaagctaatagtgccaataccagagctattgtgatagatattgttcactgatatgatatgtgtgaaacgttataacttgagctattgcgaattgcggtagcagagtgtgcgatttatcagcatcatcatcgtacatctgggaatgttgtcttgggtgatctgtacatgtactctagttccatagatcttacatgctagcccctgctgttttttcttgatctgttctgttcttggtgtgcattcgccagaccgatgtatgaagatatattatctgcatttgttgatcgttgtacattttttttattttttgaaagaaaagtatgctatgtttagtttgctgagatgcaaatgcaatgcatcatcaggctagagttgatgatcaggctgagatgtggctgcaaatagtttttactgtgatgtttctcattgcttccatgttctcagttaccatggaagcagcagtattcccatcatcaatgccatggaattttgtgtatatgatgtgatatggttttccctactgttcatacttgatgtgttctaaatgagagtgtgacactacgtatcttgaagctacaaaatgaataattacccttttattctgtctatacatgattgttcctccatttggtcatttcattgtctcgtgtggtcttcacatggcttcattgttacttgctgagatatatcgaaaccaatctcgccatcattcatccattctgatgcattttgcagtagtgcttattgttttgttgtacaaaagattattatttattagtattgtatagaagaaataaacaaaagcagctctaataaggtgaactacagctgcggctaaaactgggcaagtttttgcattttaacttatggaaaatattgtttgtgcaactctccaaggaccaaagggatctgtattggccatgtttcagcacacggcaatgaggttcagacttcagaagtccaaactgatttgtgtcttcccttcccaccatgcactactgataat

SEQ ID NO: 65674 - DNA, 23344 bp, Oryza sativa
  unsure (1)..(23344): unsure at all n locations
gtgtggccattgttgtcaaatgactaactatcggccgaattcgtgctctgtaccctacctcccctcttccctctccactgcgccgccgctctcgtgccaccgcaccgccgttcccgtgctgccgcgtcgccgttcccgtgccgctgcgccgccattcccgtgccaccgtgctgccgctcccgcgccgccgtgcgccaccgtcgccgccgccgtcgtcgctgccgccgtcgtcgccgctgctgccgccggtgagccgccctccttcccccctcgcgtccaccactgccgccgctcgggtgggagagagccgagagagagagggagaggaaaagagaggccggcagagagaaaaagagagaaagagagaaaagaaagaaaaagagaaagagagaaaagaaagaaaaagaaagaaaaagagaagagagaatggaggaaaagaaaaggaacaataaatagaaaattaggaagaaattaaggaggttaatagttcaagaaaatctaaaataattagaatttaattatagattaattatggtcatagaattgcaaaatttaatataaattataggttattcttggtaatttctaaaaaaatcaattcgcggtagtagtttagatgtaattaacgactaaacaattagatgaatttttttagactattacagattagttttggataatctctataagtaatcgattcactgtagaagttcggatttaatcactaggaattttagacgtatatttggatctttatttgaattttaaccgaattcaaatcgtttcttcgcacgtaattttagagcccgagggagttgcggatccaagcgaggaccaagaaccgcaagactttgagcaaggcaagtcatcactatcccttgaacacgttgatcccaattgcgaaattatttcgtttataaataaaattgcatgcaatgatgaacattctacttgtgtttataccatgccttgattattgtttaccccttattccttcgtaaccatatttacgtatgagtccctagtcaattatgacaattgcttagaaatgctattctagaatcatgcatactcatatttatcaaatgctaaatgcttgggcaatcacctttgggaaggtaattgagatgcggcatgtggagacatgagcaccacattgccatgaaattgatgacatgatttgggaaaggaaaataaaatgaaaacaaccgttttcgactggggcagacggaggatttgggtggtatctggaaaaggctagtaccgtccccggtcaattaaggaccgagccatgaagttaaacatgaaacgacccccgtacaaccgtacttctcgaatgggtatagacctagcggattagatagccgagcggaggcagtatccctgcatagatggttcacccctgagtgaggcaggcgcgctacggtggggcagccgttgaggtagggccgagaggcatgctctacatcggtgtcgccattggtaggactgccatgagtgtgtgagagagaacttaacttgaaccataatttaatatgtgtgtgagacttctcttttccgggagcgctagaactcctctcactgctagaaacatggacgcctagagtgcatgaggatttaagttcatggagcgggtactgccaatgcgaggttatcaaaaggctttgccatggcgcgtctcatgtgttgggacgaggctcatgtgttgggcagtcgcagagtgcgggtaaagtgtacatccactacagtgtgagtaaaccaaatctattcgaatagccgtgctcacggttattgagtaccgggacatgtattacacttggctagactataaattctttaacttgtgtgggatgggatattacatgatgatttttatgctgatggagccacttcctgagaggtgggaatgtggacgtcctcagaaaaccatgacgactcaatggcggaaagctatccttgggatcacaatggatggtggacagaaccgtcgttgtttaatgtgaacactggtattaaaacttgatcagtctatgctaggttttaggcttatgaaaagaattacaaaacttgctttgcgcaaaagaaccatagccatcctttgaattcttctgtcatgtgcattattgctgtggtggcttgctgagtacggttggtactcacccttgcaatattcaaacttaatcagaggccggagatgaagcttcggaggatccctatgcctattaccaggagggtgatgaggacgatggcgctcaataggtcttagttacggtcgttgcctgtggcaatagcgtgccgctgccttaactccgctgccttacctacttctgtttttgaaatgtattccggaccgctcggtccgatgatttaagactgtgcctgcgggcttatgatgtaataattcgtactagactctcatgtatgtgcacttgatatttcagctataagttcgtgtgtaccagactacttgatccagggaaatggtactgtttacacgattaattcctgttataaaaacgggggtctaaggaagctcaatttgagaagttttatatcccgggagatattcattaccgtattcatttcactctatattcgatccatatctttattgataatattttattacgtttttatacaagttttcaattctgattatgtttctgaaaaaaatgaaaataaacatggtagatcaaattttcatccgtttctgttccattttcataactagctaatactgaacagaataattgaatgcggcaggtaaaatcgttgcagcaatactcatacatcaacctgaaacgaccatcctaggctgtgaccaagatgatatctattgatgactttttaagaaatgctagataaaaaagtattcatgttcggtatcaatatctcgaaatttcaatattattttggaaaataccatatttatcgattacgaatagaagaaagataacaattgagcacatctggcgctccatttcacacaattattttgcgagaagacagaagattaaaattgaattacaaattattttgctagatccccagcaagcatgatccatccagattattggtgcatagggccagcctgcgacatgttaagcaccatcccacaaatcttcgacgcacttgtaaggcccattgtcacagacgaactgcattccagtcagacccctctgctgggggagtttgctgattttgtctctctcttcctcagtgagctcccagtcgaaaatatcaagattctccttcatcctattttcattgtatgtcttcactaacaaaacatcaccctgctcgtacatccacctcaaacaaatctgcaccgcaaattaaatattgaagtctcaattaacatggtatgcccatttaatctcttaccttaaattctgtgaacaactgttttctaaattatttatctgattgaagatctgattgcaccgttaatattaaatcctcttaacaaaatttcataatataatattctaataaaacatatatgtgtttgacgttttgaaatagtgtttcatacgtgagaagaaaaaagtgaatgtttcaagtggaaccaacctgagcaagcgtcttgcccttggtttgggcgatgtcgtgcaggacgccggagtccatcaccgcggcgctgccccacggcgtgcccttcgcccccagcggcgagtacccgcacagctgcaccccctctcgccggcacacctcccgcagcgtcctctgctgccacatcgggttcatctccacctggttcgccgccggccgaaccacggcgaacgacagcagctgctccagcttcttggcggagaagttactgacgccgatggcgcgcgcgaggcccagccggtggcactcctccatgccgcgccacacgccctccatgtcgaacgccggcgccatctcctccttggggaacgggaagtcgtagctgcccggcgccacggtcgccggccagtggacgaggagcaggtcgacgtagtccattccgaggttgcggagcgtctccctcgccgccggcacgacgcggccggcgtgcaggtcgctgcaccagagcttggaggtgacgaacacgtcggcgcgggaggcgacgaggccgcgccggacggcctccgcgacggcctcgctgacgcagccctccgtcgcgtacagcctcgccgtgtcgaagtggcggtagccgagctcgatggcgcggagcagcgccgccgtggtttcctcggaggaggtgaaggggaacgccgccgtgcccatgccgatgcgcggcatggtcgggagcagcgcgctcgcaggcacctccgggatggtcgccattgccattgccgtattgcagtgtagtgtagtggactagacaaggacgtgtgtggctatatataaagaaaaaatggattctgttcaacgcatgccgcaatgcagacaacacatgggacgataatgaaggagaaataatgaaagagaaattcgatcggcttgatttttcgtagctgagtagttgatcacgttgaattatcaacaataattcagtttttctgatttacattgtactattattattagtttactagtcatgcaaatcttgcaaaatgattaattacaaactgtacatgtaatgcccaaagctatgtcacgtgcaaagtgatttgtacacaaggctgtgaccaagacgagatctgttattgtcttatcaagaaatatatataaatcttttagtatcttatcaagaaatatataaataatgattcgatttccctctgacaacctagaaatttcgacaatcgcaccaaccgggatggcaacgatcaggatgctgttcgtccacgatatgcgatcctcgccatcggctagtgagatggggtctggggactccactcatacctaagatgtggatggttctaacagtcatggctatttgttttttcgaacgcgcaagctccctgtatacgaatcaattgttattctgctccaacagttgtaccgaaataatgaataccttgagtaggtagaaatagaaaaaaacaagaattttcctaaatgagaaatgttttctttctaaaggaaattaaataatattaattttgattaatatcagaatatcgaatgagtttatgcttcactaattgaatgataaataactgcaagtaaaggagataggtggtttaaaaataaacccaaaattttaaacatgtatctaaaatcacaacaaaaatagtgaaatgaaattagctcgtcgggaatgcatccaaaatcattatagacccagggaattaattaatagttcccaaccacgggtggagtgaaatccaacaaaaatagatcaagagtcgtatacatttaaactaaatctaccatcttaaatttagcatcctaaataaatttctaggtagctaattaaatttgcaatgcatcatctatggacctatatatgtataccaggggagtaaccatttttcgtgaacgtgtcgacgtgttttaaataagtggataggtatacagcaattaatatacatgtatggtccatacattaattgatcgcagaacgtgtacgggaatggtgccgtgcccatgcctgccgcacataattaagatagatccacatcatgatccatcatgattatttagatatatactccactgtatctaagtagcttgctagacgtcaccatcccacaaatcttcaactgatttgtaaggcccatggtcagagatgaattccaatccaggcaggcccctcagttggggcagctgactgatcctctccctctcttcatctgtgagctcccagttgaaaatgtccagattttccttcattctcttctcattatatgtcttcaccaataaaacatcaccttgctcgtacaaccacctcaaacaaatctgcacgacagagtaattatatagtgaaactttatttgacctgattttttgtttggtttaattaaatattttatattcatttaatttctaaactttcgtgttttgatcacttttgatatacatcctttgattccataatttttgacgttttaaacatggttgggtcaaacttttataattttaactatcgataatttttaaatatttattttaaaagcactacaacaacatatttagatttgtcttacaaaatcctataataaaaataaaaaattatttatttattttatcatagtgattttttatgtaatttgtatataagttggttgagtttgatcacgagatataaacattagacatatatattgaaatattcacttaaagttttctttttaccggttactagctttcacttacaaacaagtaaaaacataataatagtatggtatcacagtataaggataaattgatggcttacaactgatgatatgtaaatatgttatattagttatttagagttgttcttttaaacatccaaaatatgcaaaaccactctccaaaactatcttagggagtaatatagatggtattgcaaagtttagggggttagatgttcggttttaaagtttagggtgctaggtggatttgcatccaaagtttagaggggtatttggacttttttccttgttaaaaattttaagaataatggaattggagggagtagtatatatggtatgaatttttctcctacaaaatttagaaaataagtatatcaaccaacctgagcaagcgtcttgcccttggctccggcgatctcctgcaggacgccggagtccatcacggcggcgctgccccacggcgtgcccttcgcccccagcggcgagtacccgcacagctgcaccccctcccgccggcacacctcccgcagcgtcctctgctgccacatcgggttcacctccacctggttcaccgccggccgcacggcggcgagcgacagcagctgctccagcttcttggcggagaagttgctgacgccgatggcgcgcgcgaggcccaggcggtggcactcctccatgccgcgccacacgccctccatgtcgaacgacggcaggatcacctccttggggaacgggaagtcgtagttgcccggcgtgaggctcaccggccagtggacaaggagcaggtcgacgtagtccatcccgaggttgcggagcgtctccctcgccgccggcacgacgcggccggcgtgcaggtcgctgcaccagatcttggaggtgacgaacacgtcggcgcgggaggcgatgaggccacgccggacggcctccgcgactgcctcgccgacgcagccctcggtggcgtaaatcctggccgtgtcgaagtggcggtagccgagctcgatggcgcggagcatggcggcggtggtgtcctccgaggaggtgaaggggaacgccgccgtgcccatgccgacgcgcggcatggtctggataagctcgctcgccggcacctccgggatggtggccattgcaacctgcagaagtgcacagtgtagtgtagtggagaggaggacaatgaggtttttctctgtgggtagctatatataggaaaagaatggatctcctccttgaggtttcgtgctgcaagacttaaacaacacaagtgacgatgaaggtaacatttttctaggtgaagcatgggcagggatagagctagagcgaaacagaatgtggtgttactctcttaatttactttactttagattaaagtttaacctaatacaaatgtctaagtttgtattaagggggtacatatacggtgaaaatagataaggtatagtttaaaaaattttctttatcgggttcctgagcaccccctaatatatactagctccgcccctgcatgggtaagttagtaagagatcaatatgcggtacaaagttcatttgcaatataaacctgaaatatcatgggataaacaaatgagcatctgagatttgttcttgttatcatgagtaattttttttgccacaagattaaccataagtaacttttttttttggaataaactatttagtggcatggataaatcttaaacaattatttatatatgctacggtagcttacaggtttgcaaatgctgtgttagttagtaccaacacaagactaattcatttttaccttttctattttactagtccatgaaaacttgcaaaatgtatgattagttgcacctacctgtacatgtccatgacccaaagccgcctaggctgatgtgccccgttgaaagcgatcgagatagaagtctgacgaagactatgacgatctattagttaccttattcagaaatgataaaaacgcatcgaggtttaggccctgtttaggctgtgtttgcttggggaggttgggaacaaatcttcttcgcacggaaaacggagcggtccattaacgcgtgattaattagaaattagctttttttttcaaaaatgaatcaatatgattttttaaagcaatttttgtatagaaactttttacaaaaaacacaccgtttagcagtttgaaaagcgtgcacgcggaaaacgatggagaggtgttgggaacccttgggtccgaacacacccttagtcacaaaacaaaattgttcacgctgtcacatcgaatgtttggacatatatatgaagtattaaatgtaggaaaaaaacaagagttaattgcactctggtccaccttttattgccaaagtttcactttaggctatcctctagctcatatttttactttagactaggtaagattatctttggtgcactttggaccgcccaagtcattttctttagctgcatctactctataatattgtaaacaattgcctgtgtaagttggaaaatattaccgggttacgggctgctgatgtgtttaaagttggaaaagtcatttatgtattcctaaaaagtttatggggtggtccaaagtaaaataaaggtaaagtaacctagcccaaagtgaaaaaatgtgttaaatggtggtataaagtgaagctttggtaataaacggtggccctaaacgcaatttactaaaaaaaacaattacacagattgtgtgtaaattgcaagacaaatcttttaagcctaattagccatgatttaacaatgtgatgctacagtaaatatttgctaatgatggattaattagacttaataaattcacctcgcagtttcctgacggaatctgtaatttgttttgttattagactatgtttaatacttcaaatgtgtgttcatatatccaatataaaaaccaaacccaaaaaatttttccaactaaataaggccataatctgaaaacgtgtaaaatgttgtgatattaactagagaacgaaatagagtgaaatctataaccgtagttctagagtgagtactacatgttattaacaatgtaaatatattaaacgacagagtattgtaaaagtaaaatttataaatagctgaaatttgaattgtggaacgaagaatagatgtaaacacagtatgagattaattgaaattagaaatggaagataaagtaaaattagcaattgaaattcaatacgagttaccaaacttgagtccctacaatactaaattaaactttggattaaaatgaaataataaaataattccgagtcaatataaaacaatacacaatattattttaaaattcaaaacaaaaattaaaacaaaactactcctccaaaacatggaaaatggttaattcaaccagtacaatgtacggaattggacttggtgattcttcactctctagtatgtcttgttatcattgtccatgtaatctctataatgattgattatagccttttaaagaaaagatgggaataaattctatgattaaaaaatatgtctctccctaattgttttctttatccgaccctgcatccatgtatgctcttgcttttgtcaggatgtatgtcagctatatactccataactcttggtcaagtatgctatagctagagctagcttatggcggccactttggttgaccagaaacagaaaggcaagtggctgatggctgatgacattgttccgcttgaagatatatgcttttttaaaataattataaagtacaacacagacactcacaacatacgtacactcacccctataaacgcacgcacgtaaaccctactcctacgagcatctttgaagactgagctgataaatcctaaagactgacgaagttactacagacgtctcgttgtggacgggtgcatcacatgccactaaaagcacaaaaccgttaaaatctaaaaaattctctcccataaaaatcaaacccaggatttaaggtgctactaaagtttaatgaggcgcgaagatatgtgctgatgcagtaatattgttgcttctttccatgcaaattctttgcccgtcgtgtgtcaaaaagatggggccactagccaccaatttttggaattatcggagaaaacagccttcccctcacacacagcctaactgttggctgcttacctggttcgttgcatcccatggcgactagcgtaaaacacaactacgaaaagcatttttccgtgggttcaaaaagtgttttttctacagagatcttacccgtctgcatcaggtgtctgggaaaataaatatttttccatgcgggcgatcaaccacatgaaaaaatacatctttccgtgtggtcaggttaagtggaccgcacggaaaaatctgatttccacgtgcgggtgcttatatcacctgcacgtaaaataaaaatcccaaaaaaaataaaatcaaaaaatccgaacccaaaccctagaagccgttgtcgccgtcaccatcgccatcgccgaatctgccgccacccacatcccctaccaccaaatccgcggccgccgcacgtggggagggcggcgccactccctaccgcctccttgttgtcatcggtggcggcggaggcggcggatccagccatcgtggcggcggcggttgcggaggaccgtcgtggtaccgcaccgctaaaatgcgggtcccgcgtgcaccgtgctgcctagcgatttttgagactgtgcaggcactgttttcacactgtttgacacggcttcatactgtttggcactgtttgagcgacgatcccgcgttgtggttacgcagaaccgtcgtatgaacagtacaaaacagtgtacaaacagtgattgaacagtgccgacgcggtaaaaaattcgatgtcatcgtggttccgcagtttcaagctgtgggactatcgcggtcccacgctttcgtcccgcgggaccatcggttttgtgttttggatctgcgggactgtcgcgattccgcgttttcgttccgtgggacggatatatttttatatgtatgtatataaatgtaaattattaagaataagtatatttgcaatttttttcccaatccctctcacctttcaagtgccagccacgccgtgctgaacgcgatgagcagcagctggggcaatcgcggtccgacgtgtcattgagggtgggaggcgaagcgaactaccccatgccgatgaggacaaattgtgggcttaaagaagacttttaaggctctgaaatgatagtcactttttatttttaataaacctggtttcaagagaatttttaggggaaactagttttacattccttattcagttagcatgcgttttgagaatttgtagtgtattggcaaatatttgggcggcatgttttgcacagctcgctgagctgcttccaaacgatatttttacagaggagtgattgttgggctctaggctgattcggtgaagtgattttcggagctagtaaaaagaagtggcttctgctgattaacctagtgaatcactttcagtcgcagaaacgctcctttcagaaaatcagaagcaggaggaggagctttacgtaccaaactcaaactgacccaaagtgtgtactggcagcagtggcggaggcagctgcccgggctccatgccatcgcaacacacattgctccacagcataaacatcatttactcattaattgcttacataattaccttgcttcctggttccaaggaaggttaattagatgactagcgagttgtaccacatcctaatcttgctttcctgatgtatagtagccccgtactctaactccttgacaataaacaaccaacatttcattgataaattgtaacttggcaacaatcaactttaagtctagataaacggtacaattttccatatatatatatagggcatgttcactttgatgcaaaaaaaaaccttaccaaattttggcattggcacagtgtcggatcccaaaactaaatattcggaaaccgacatgtttaactgtatcaagccctggatcagtagattgatacagcttcaacaatctggattttcattgcgtacatttgaacaaggctccaaaggagatgttattacataaattaataggggaatttacaagattgtggctaactattacagcagaagctatagagtgtctcaactctaatattttgctatagacttaaaccatctaactaatctagatttgaaaactaggttgaaataatgctaacttatatgattgaactcctggcttcggcaagaacttcaatttaactctggaaaaaggggtttgaagcaagggtgagtacaacgtactcaccaagctattatattcaataatgaatgtataaaaaggtaatatttgagtaggattacgattacttgcagaaggcagagaatatagaaatagaaagcctgatgttttaaatgtagcagcatttagtaaaatcttgaattaggtttctaaccaaagtaccatatgagtcccgatactcaattccgtgagcacggctattcgaatagattcaggtttactttactgcagtaaatgtacgctttacccgcaatccatgacatgccaatattcattagcttagtcatggcaaagcttttcggttactaacatcagtggcacctgttccatgaactctcatcctcatgcgctctgaacgtaacgttatcagcagcgagaggagttctggcgttcccgaggtttttagagagagaactggttgagagacccccgtcatctcaaccaggttttcacaatacacacacacttgagctcaacaaatcatttacctgcgcctcggtaaatgttatatttgcccttcgcggcataggtttgcctcctgcgcgaggacttaaataagaaccactgtacagaggtaccacctttgctagataacctactttgcaaggtctgtccccattctagaattgcggtcgtactcgttcgtttgacataagtagttggtaataactatatcgactgagacagtactagccacccggaaatcaaccaattcgtacgtactgtcccaatctaagttcattatatttttatgcaaactaactaggcagggctaagcaaagctagcatatctggtttgctatgttcaggttatgtattcaaaatcatgtatgactaatgcatagaatataagagatatagaatatagggcatttatgctcaaaggggaggaataataacttgccttgctccaacgcgaataaatccaaggtaggcaacctgattatctgatccttgaaataccacaagttgccatccaaaataaaataaactctactgaagaagaggaagagccaaattcaataaaatccataaaataacaagaaaacgataaacgactaaaagggctagggtttagggtataacctatctcctttataaggtataaggattactgggctaatatgtgtaggttctaaaagattggagactaaagtggataggagattaagcaacatttgtcgcttatatttcatctgtgggttttagttgcttggagagtaagggatataactggttaagtgagtatgtggctagtaatggtcgaagttgggctttggtagaagaatggctaggatttacttgttctcgagtcgatgctgaaataggatagcatatcggctcgtatttcatgtataggttatgagtagttggagggtaaatggttgggatgatattgtagctggcgtggagtctagatagcaagctgattgaggtaggataaatatcagttagggtttaggtgtttgctagtcgttgctagagttgggcagcatggcgactagacttagcatcttctctagccgatgtcaacagacagtataacggctagagggataggaggtttgtgtgggtttagtggggcggaagtgttactccgacaaccgtgagtggcggcggagcggctaggatcacacagagcccaagagctaactgtgcggcgtgctgtggaggtcgagggaatagtgaagctccgaccgctgtacgcatcaaggcgtggggtgccaggagcagcatttcgatcttgggtttgggttttgccaggctttacaaccaacggtccaacgtcggggtcgatagaccgcacgaacgtccccatgaaaggcgtaaagttccaaccggcggctttttagtggctaaaaggtattttgaaaataaacggaaatattcgaaaagcaaatataagtttaaattgtaaattcaattataagatcaaatatttatccaaatggtatttgaataaattaaggaaatttaaataaaatattaaaatagcaaatttggtaccaaaatgtagattttgaatttagatgaatttaggtccaagtttcactggaatcggatctacggtttaggagatatgggcttctaaagattgggttttgaattaaatctagaaaagacaaaaatacactgttcatgggcccacctgtcagcctttctttttctttttcttttccttcttcttcctcccgtcatctccttctctcttctcttctggccgagtaacagggaggaggggtgctggggctccggtggccggggatcgacgaagtcggcggccacgcgtgttcccgcgcaacgcgcatccgaggatggtggtggccagtagagggagttagggaggaggccggaacggcgacaacaagagctctcttcggccggcaaaggaagtggttgtggtggttgctatggggtgggggagaaggggaaaatgggaaaaatgggttcgccggaggtagggggagtcagtggtgcaaggatttggctaggggaactatagaggaggagatcgaccgatggcggcgtcggccggacttgacaggagagagagaggaagagcttcaattcaagctctgataatgtgaggaggggaggacgatctcgccggctatttaaaggcggtggatgtcggttgcttatggcggtttcagaggagaaggcgagaggagacacggctgcggcggcacagaaacaggagcacggcgtcgactctatccgctgattggccatcgaaggcggttcggctcggcggttgatgtcagcggcgtgaggtggcggctgacgtcggcggcagttgcttagcggcgaaggaaagacggcggagttggagggtaaggcacggcgacggtggcggcgcgacttggcggcgacggcaaggaagcggcgacggcgtgtgcgtgtgcgcgtctgcagaaggaggaagggcggctcggctgtggtggctgggccggcttgggctggaggagggaaagggtttcggcccagtctagaaagaaagaaagtctaattttcctagagattcaaataattgatttagaggaatttggatggctagattttaaaaaggatttgaattcggagagggattttaaaataaggatgttctaatttatttgagtgcaatcttttgagagatagaatataacggaatttatttgatgcactcgattgagagggaagggaaataaataggatgttagcctcaaattatttggcaagaatttggagaagtatttgaggctaatgggaaacttggatatttggcgataaataagaataggtctgaaatcaaaggatgggtcgacaattaattccaatgaaattggaattgctttggtttaggttcaaaggtattgttggaggatttcttggaccacaattcataaaagtaaaaaggatttttagactaaatttgaataaaggaaattttggtcaaaagaaggtttaagatgcaaaatcaaatcaaagagaatacctcgatttaacaagatcaatttttagaataaaaaccacgaaaaattttaaatactagacagggattttatgcatgttagttttaggaggtccctctaattataatttcttaagtttaggaagttattaagaatagaagaatcggcatgatacatatttagaaaatagcaaatttttagtatgttacacatagttgccaaaaatttggcaacttactaaaattttgacaggatttcttaaatagttaccaaaatttggcagcaaactaaatgtagccacttttttgacaactttaccaaaatttggtaaggttgaaaatgacaacaaagtgaacaggcccatagtttttatctcttgctaggcttgcccagcctcaagaaaatcgattttgctaaacatcacacgggtgattttttcgttgatatttgacagatttttgcccctacaattatgcgtcgagatcagtacacgattctgcgtcgatgttgtcgtgaggtggagaggagacctcgtgggttacacgtttgccgctgatcacgattcacaagaaatttacatcctagctacgtgtaaatatcctatataactaaaataaaatataaaattacagtcctatttaactaaaattacatatgtaaattcagttgatattaattacaatcctatttaactaaatctacatttgtaaattcagttgatttgacatgtaagtgcactgtaattttgataaaaataatgtgtaagtaaatatgtacttattattttctttaaaatataaaattacaatcctatataactaaaattacatttgtaaatttagttgatttgacatgtaagtgcactttaattttgataaaaataatgtgtaagtaaatatgtacttattattttctttaaaatataaaattacagtcttatataactaaaattacatatgtaaatttagttgatatgacatgtaagtgcactgtaattttgataaaaatattattaaaaatattgtgtaagtaaatttgcattagttattttatttcaaatataaaattacagtcctatataactaaaattacatatgaaaatttagttgatatgacatataagtgcactgtaattttgataaaaatgttgtgtaagtaaatttttattagttattttattttgtaatccgttggatgcaaatccaagggaagaaaaaatctgggtgattttttctcaaaaatcacccgagcgatgcataggcggtcccaaaaaaatttatggctccgccaataactggcagcaaagcggcatgaatttctcacaacgggccacaatattgttgcgggccggaccacaacccatcgtaacaaatgccttcctaactaacaagcttggcccaacctttctcgcttttcctttgtcgtcggtactaggaataagttcaccggagatccctcaacttaagagcgagattattttagtgccttaaccacaaaaccagaaatatatacccctaaacttacacaaaccgtacactcaaggtcctataacagcatacgtgggtggttttgctgacgtggcatcctagtcagaaaaaaaataaaaaaagtacgtggagcccacatgtaagattcacatatattttcttctcttttctcctcctcctcttcccttttcttcttatcctcttcacttttctcttcaccagcggagcggcggtgggcagagcatcgatgggcaagcacgacagcggagcggcgggtgtgcacggagccacggcccataggtcacgagaggttcggctgtcggcggtgccggcccgcgacacaagagaaggggagggcgtcggcgtcggtaggagagctaggcgcggggggagggggagagggggtgggttggggagtcagcaagccgcgggcggcggaggcggaggcgccattgccacggaggtagcatcgtcagcgactggcgtctgatgatgagttgatggcgtacatgaagtattaaatataggctaaaaaataactaattgcacagattgtgactaatttgtgagacgaatcttttaaacctaattgctcaatgatttgacaatatggcgctatattaaatatttggtaatgacggattaattagacttaataaatttgtttcgttgtttactaacggaatctgtaattagttgttttattagtgttcgaagaccccatacaataccttatataatatgctatgtaaaacgctgaaactttacccggctgtatgtaatcaccccctgaacgagaactcatgttctaatatcgagacgcggtcttgaccgtgtctccgtctacagtgtggtgcaggtgaacagttgaacagtgcctgtagtgtgtatgcacaatgatttgtcgttagcagcgcattcaattcattaaatttattactcctaccaatccgtcctacactccacagcggcggctcttttctctcgccatctaagaaacttcctcatccagagttgactgagtccacggtaagacaaggcttcattcggtacagcttattattgcccagtgtttctcgaagcacgcaaaagaacgtatatatattactacctccgtcccaaaataagtgcagctatagatattcgagtccagcgttttgatcgtctatcatatttaaaaattttatgaaaaaaattaaaaatattagtcacacataaaatactattcatctattatcatctaataacaataaaattactaatcataattatttttcaaataagacgaacggacaaacgttgagcatgaacagtgttaaaactacacttattttgagattgagggagtagcatattactccatccttccaaaaatctgagacctatttattttttatcaaaatcaagaagcaataaactcactcactatgtgacaaaaccaataagcatgcaaccaataagtattagaatgatttcttgtttttcgatcaacaatttaatttagcacatggtgactatcaataagactcagatttttggagaaacaaggaatgaaataggtctcaaatttttggaaggagagagtattaattaagtattactctctccattccaaattgatctacatatttcatagatacacaaagaccaagaaaagctaataactctctcatattatatttactctagcaacaaactcaatgcatgcaccatccccactatttcctagccaatagcaaatcaagatattgcatgtgggttataaatacatgtgtacatggatacatgcatcaatgtccatttactccaatatacaaataacgaatagatataataaatgaacacaaatatggagatcatttaggaacaacctcaaaaaaactatatgtagatcaatttggaatggatggagtaactaatactccctccacctacttttgataggcatatttccaaatctgaaaaaattatttttgataggcatatttcaatctaataacctatcatcttaatgaccttctcgcatttaatgtgtgactctccattcttccatacaagattggctacataggtatcgagaaatgcaaatattaatgaatcgcttgtttacgaggaatgactagtagcatgtttaaataactgataagtagaattacttatccttagtctatgtgtcaagatgaaatatgactattaaaagtagatggagagagtattataaattttaaaatagatttattttagctttataaagaaactcctataaaaaaagtgcttttaataaaaaaaggagatagtaggagtaccatttaacaggtagataaggttgtgttcgctggagcatgttcccaactgaaacagtgcacacggtaaacggaacggcctattagcacgtgattaattaagtattagctattattttttgaaaaatgaatcaatatgatttttaagcaacttttgtgtagaaactttttgcaaaaaaacatcgtttagcagtttgaaaagcatgtgcgcggaaaacgagaaagataagttgggaaacttgggataagaacgcagcctaaggtggtgtttagatccagggactaaattttagtccctgtcacatcgaatgtttggacattaattagaactattaaacatagactaataataaaactaattggataaatgagagctaattcgcaaaacaaatcttttaagcatgattaatctataattagcacatgtttattgtagcatcacataggctaatcatggattaattaggctcaatatattcgtctcacgaattagtccagggctatagaatgggttttgtcattagtcaacgtttaatacttctaattagtgtcaaacatccgatgtgatagggactaaaatttagtcgctggatccaaacaggcctaaggctgtgttcgcgggaggatgttcccaaccagccattagcacacggaaaacggaacggtccattagcgcgtgattaattaagtattagctatttttttcaaaaatagattaatatgatttttttaagcaactttcgtatagaaactttttaaaaaaacacaccgtttagcagtttgaaaagcgtgcgcacggaaaacgagggagatgagttgggaaacttcgggcaagagcacaccctaagagcaggtacaacagcaggctataggccagctataaacatattttaaagagataaaggaagagagagaagagcagcgggttacagatttgtagccagctgcagcacagactccaagacgtaatgtatgtatgataggtgggaccatgtattaataatatagtaagcaactattatatgaattgactattacattggctatagatgatttggagctagtagtgggttatactattaaacttgctctaaggttgtgttctttccttcaagttcccaacccttctcctcgtttttcgcgcgcacgtttctcaaactgcttaacggtgatttttttgcaaaaagtttctatacgaaagttgcttaaaaaaatcaaattaatccattttttttaaaaaaaatagctaatatttaattaatcatgcaataatgcgtgctccgttttacatgccggaggaggggttcagcttaagtatagttacggaaaacgagtatcgaccactagctgctttcgtttacattctgaaagagagtgaagactggttacgccccacgtggatgattccattccagtcgcgctcgcgccagacggtcgatgcgcgcaaagtcagggtcagctcttcaatttgagtaccaactatagataattaaatactccttatatctgaagtattattgtatcctcaaatctgaaggttcctttgctacactacagatatcgatcgaagaaaactagtccataggtagataaatattgtatcgttgaatctctcaaggtcgtttcctttgctttgctagctagctgcagaagaaaggaaaagctatagctattagagagagaggagggatcagaagaagctgctagctgctagctcgctgccggccggccggccggagaagtacctctaatatatataagtccgtcgatcgtgtcagccatcgccggcgccggcgttgatcaggaccatcaccatgcatccaccatactgaaatctctgtggaataatcctatatatcgcccaaggtatgttactactcccttaattcccttcgtgttcttttgtttcgaactaagtagcatcatatatttagaggaggagtggtatgctttagctatatggacttcaaaattaaccatagctgatgtacttgttcttctgcacaaaattaattaacctaacctcgtgaaattgcctagtaagcacaaaccaagatgatttagcaatctccattccatatgagcacacgcatgacatgagagagcaaattaagtcagcgcaaacgccgtagtgcgctgctatgctgaatagcaattaaggttccagcttgcactggttctggatcaaggccaattcttcattaggctactaactaaggggatttaatttctgggtccgaatttagcaagatttgttatattggattatccgagcagcaattgatcgagcttctttctgcgagtttgttaatactagattaatctgatgttttctttgattaccttcggggaattaatttgtgagtctatatcatggtaattaatttatttaactttttttttgaaacttaaacaactttattaacaaagacagagttaaggggatacaccctagtacatccacagatggatacaaaggtagcagaaacaccatctttaacgagatagagactaaccaatctaaggaaacaaacttccagatgcgactaaacagcagaagaggaccagatcgacggagctttgcggcactgccgcgacgactgaatccttgggcctccattggtgtgcacaccgtttgacagaccgaaaggctcctacgcctgccaccgcggtaacggcacaaatcggaggtttgatactgagccgtagattttggtgtatgcatcaccggactcagcaaagtggttccacggagtccactgttaaatctgaggagcaaaaattgctcaacccgaacggtagacccagcatggatactgctattttcgaacaaaaggaaatttgattctaaagaacagctagccaatatcacaaagttaaacagatggttgtgatggagcttctgtctttctaggtggccaaagattgctgagatagagagccactgagtcagatccgacaaaagcaaaagtaatgaacctttaatgttcaccgccggcgtcggcaacaaggcatccgccatctggaggtgttcaaggccatcggctgagagtagcaaggagggcaacagcttcgttcttgacttaattaggtcatttttttgcaaacacgcaaaagacttatgcattgatataatattagaaggaagcaaatagttacacgcgcaaaaggctttgcttcaactggtacaggtgttttcatcaaccttatctcttttttcttcatgacgtgtatgcttaacgactttaatatgtatagctctgatgctgcatttacatagaatcggttacatcaattagctcacacttctgcaacacaatattagccctccattgctaccaagtactgtgcttgcatgcttgaaatggagagtgctaaaaatatgaggttttctcatatgttttgtgcacaggaatacaaacatgtgtgcttttatatcacaaatttgctctatatacctgtgaaatttgctatattgtttctattaaaacaagtttagaagaannnnnnnnnnnnnnnnnnnnnnnnnnnnnnnnnnngataatagacnctcaagggccg

SEQ ID NO: 65675 - DNA, 592 bp, Oryza sativa
ggatcgcataacactcgcagccaactcgaagcagcaaggagaagcagcagtagcaccacgagagatcgagggggggaagaacagcgtgggggaaacctgcttggacgtctcagggaggaggatgccgccggcgctcttcttgggctgcaccagcttctccaccagcacgcggttcagcgacgggatcagccgcctcgccatcgccgccgccctcttcttcttcttcttgcgaagcaagcaaaaaagaccgagcaaaagttctacactcttcgatcgcctccgccgcgctcgtggggtttagggttttaaggtggaggcgacgcggcggcgaatttacgggcttgcccctctccagggccctctagaacgttccactcctactggaccggcccacctccacggcccatttcatttaagggaccagctaatacattttgtcataaaacctttttagaaaaaaattgatatatgtaaatataatacaatgtaattatttgtaaattgtatgtatataattataatacaaattgtatgtaacttttcaaagatcctgtgataagtgatacgtagtagcatactatttccatgaagc

SEQ ID NO: 65676 - DNA, 564 bp, Oryza sativa
tcttagatgggcgatagcggcgtccttgatgtcgtgacctccatgggggcatcgtttttggagtcttgcctttgtggtgttgttgtaggccgggcggcgatcagccatgcttaggggggtcattttggtgctcagttccattttcagtggtttgtgcttgtgtggttagcgtgtggttcttggaggtgccttgtgcacgtccgtacttgacaacttctgtcgtgtttttctttgtaactttactcctccttaatatactcggatggcctccttcggcctttcccggtgaaaaaaagataagtcaggtgagatcttgttcatcctttttatcaattcattacccctgaggccctgaattaacaatcagtgttgtccatttgtcattgtaatttggtttcttgaaacctttgaagtctgaactcccttttgcatttgcaggagttccttgctggtatccgcatgactttggacttatttcaaactgtgggaactgaaaacaaatatagactccaggcctctcggaagtgatgatgagagctgctctcctacacaccatgaaaatta

SEQ ID NO: 65677 - DNA, 518 bp, Oryza sativa
ttcatgctgctcatcatctgttcaagctcgtgcctatgttcagccgacaatttgtctagtgtgactagaataatatttccttcgtgaacttcagacccagctggatttggagcttgttttgacgatctgttgacttcaaagcttgcttgtcccctgacaagtttatcggatcccgctgggcgtgccaaaagcgtgttgatgcaaaaacacgaagcctggaagatctgcttaacttcagtgcaggtccaaaaatcttgccttttaagttcgtgagcgtgccacttgatttgatcctgcaatcaataagaaataaagacaaataaaccgcggctaaatccataaatgatagctgatcggctaattgccgatgacatatcatttatctctgagccaatgtcatatttgaatcgattggcagaggtaaataagtaagaaaggactaaatctattcgatcggctgtagatattaacaatatataatccttatgtcgatacatacttaaatcaagtgattggga

SEQ ID NO: 65678 - DNA, 1501 bp, Oryza sativa
tcaaataaggcttggaggatttttgtatatttcctaaaagcctaaaatgcgtaaataaattttagtggaattttcagagcacaaataataattgagaagaaataaacaaagttgaaaaggttttataaaaagaaaaatccctaaaagaagtcttcttttcccccccttcccttcttgggccggctcggcccaattccctccctctctctcctctcccccgcggcccatcggcctcccccgcgcgagcgccgctgacaggcgggcccgcccgccaccctcgctgacgggtgggacccacctgtcatcgcctacctcgcgccgcgcccgccgcccgctcgtgccctagcgccgccgccgccgcgaatctcgccgtttcccgccgtccccgcgcgcaataaagagggggaaatcacccccgtgattccctctcccgtttccccctcttttccctctctccctccctcggattcgtccgatttgaaacccgcaatcgtcgccggcgtcttcaatggagccgagatctccgcggccgattcctctctctccggccgcgctttccccctcccggtgctatataatcgtcccccgcgcttcgctcttccgtttccgccgctcgccgctcgctctcgccgtcggattcgtgctcgcgccgtcctcctctctctccgacgtcgccgccgagctccggttcaccgccgtcgccgctccggacttcctcccgactcggcgtcacctccatcggcttcgccggcgtcgttcgtcgaccctcgcccgctccttcgtttcgcccgccgaccgccggagcaccgtcgccctcgtcatcccgaaccgcgccgccgcgttcctccgctccgttcgtcgtctccgccgtcctcgtgtctcggggtgagctgtggaccgtccctttagcttccctctcctctcggctctttcgggcgccgctccgccgcgccggtggtcgccggcggtgaccatcggggcgcggtcgtgccgcctcccgtcggccgtgccggcgaggccgccttcgggcgcgtcctcgcggctgccaagtgggcccggccgttagccgcccgcgcccgcgggtgcggctgacgcgtgggacccacggcgccgaccgccgccagctgcgtgctcccggtccaccgtggaccgagaggctgacgcgtgggccccactcccgtggacccggtccgcgcgccctctccctcggctgacgcaataaatgggtttttaattaaaatttaaatgaagaaattcgtaaatatccatttaaagagcatataaacttcaaatggccataacttggccatttgaactcggaattggcccgttcaagtctctaatttttccttaagaagtcaagaacccatttttgtgctttgttcctgcttgttgtatggagtttattagagtaaaagccttttcttttccgttggtcgtgtagacgctgcagcttcggaagatccgctctttgtggaagttgaagccgacgtttgggaaa

SEQ ID NO: 65679 - DNA, 2743 bp, Oryza sativa
atcgattaacacatatatgatgtagcttttgcttcttcctccctccgttccaaaatatttgacaccgttgactttttaagtacgtgtttgaccattcgtcttatccaaaaaatttaagtaattatttattttttcatatcatttaatttattgttaaatatactttcatgtacacgtatagttttacatatttcataaatttttttaataagacgaatgatcaaacatgtgctaaaatatcaacggtgtcaaatattttgaaacggagggattaattaatttcctagtcttgccacaggcacaaattacctgcacgtgctgatgtcgttaattcgtacgtccatctatatatcgatcgagaagcaagcatcatcgccagcgagatgatcgagctagctagctcatggctggccttgcccaatgctcatattgctggaattaatgcgccaccatcagccgaaattatgatccagatcgattgatcaatcaacggacaactacaagatagctagggtgttacgctgtttcgatctcttcatgtactatgttgtccatctgcctatttatatactctctccgtcccaaaatatttgacaccgttgacttttttaaaaatatttgaccgttcgtcttattcaaaaaatttaagtaattatttattcttttttatcatttgatttattgttaaatatactttcatgtatacatatagttttgcacatttcataaaagtttttgaataagacgaacgtgtcaaacatatttaaaaaagtcaacggtgtcaaacatttagagaaggagggagtatatcaacctgattgaccatcgatcgatccatatcgaaattaaggatgaacaggtcagatagatctagattgtactattcatttccataatgtacgatgctattgactttttacacaacatttaatcatttgtcttatttatttttttagaattatacagtacaacgtagatactcacagcacgcgcactcacccctatgaacgcatgcatataaacagtataagttaagtttatattttatagcatgataaaacaaatcacaataaaattaatgatatttatatatttttaaaatttatatttatatattttaaaattgagggggtatatagctagctagcgacataacccatcgatccattcgctgcctctaattaactaacgaccggtggtcatgcgttctggcgacttatgtacgcagttacgcacggcccggccgtcgttctggaagatagctatatgatcgtacaacattatggaacaggtcaattcttccattttgacaaggcctatcccggctcagtccacggtaatacacccacttgattaatcacccagtaattaactaatcattaacaaagccacaactacacgaatcaaagatcaacttaatttgacctaaattagaactaataatcatttagatcgaggattaagaccctcatatgaactctctttgctataagaacctatacatgtcacagtgactttaaattaatcacctaatctcaatcctcagatcgatggacgagttcagtactgtgctgttggccgttggttccgttgcggcgtacgtacgaccgacggtcagagttcagtacggtgtcatggccgttgttggttggtttgcagaaaaaaatcagaatatatatatatacgtgcaaaatacggagtgagtacgagcgcccgtagatgcagcagagaggtacagcatctagggtcgaatcgaatcaacccgtcaaccacccggaccccgaccaaccacctaaccgaccgaccgactcacttgacttggctctactactcaccatttctctcgttagattctctcactgacaggtgggccccaccgtctggctgtacagagaggctcttgccacctgtacacatagcgccgcgcctacagctcacggaccccaaatacaccattaacaccatggccaccggtgcttcgttggattggaggaatgaatggatccggtggccaaagtgccaaactaccaagtcaccaactgtgcataagcttgtgttttgtgttcatgctctaacctggcaagatctcatgcccaaaccatcaaattttatcaaaaaaaaagggcaaataatagttgtagtaatagtgatggtaatagtactgacctgacggcgacgacttgagcagaatcagcctgaggagataccccgtataagtggccgtatccccaagatcacacgcgggagagggagaggttttaatcatgccgtgcatgcgccatgtgattcgcgcgccaaaaaatacacacgcaataatgacgtgagaaacaaatcaaattatatttactccatttctttaaacgcggggacgaaaaagaaaagaaagaaagaaaaacagaaaaaaaaaacgtgcatgtgcgattggttcccgccgcgtttgggtttggtgatgtggcgcgtggccaccgtcggtgacttgccactgggccccacccgcgcgggcgcccaccgtgtgggtcactgacgagtgggccccaccccccgcggtatattcgggatcccgtgtggccgagctatattagaggcgcgcgcgtccgcaaggagaggcggaggccgcggcgaagccagcccgagtcgtcgtcgtcgtcgttcgtccacgcgacaccgcgtcgtcggcggcggcgagaggagaaagctcaacgaaggtgatcgatcgatcgattgtttgcgaggtggaggaggg

SEQ ID NO: 65680 - DNA, 681 bp, Oryza sativa
actttgatgtactgccttgcaaagttaaaattctgaattccgtcaactccatttttctcttgcattgcaaagatttgttggactgactagggatggatgaaagtttaagtggttggaaagcgtttgcactgaggagcttggctctcgcactcgcatattaggctttctgcaaattgataaggtaaatgaatataaagtttctatagaagtggtgcagtgggaacacaatgtgaacattcagaattgcatatgcactgaaccttcatggctcgcactgatccaggagccatgtgcaatttgcattgggtgccgtgcaccttcatggttgtctgtgggtttcatcaaaccggttgtgtgtgtgtgtgtatgtcctttttgctgtgctgagcagtctgttgtcatggtccacacgcagagacatgaatggcctgttgtcgttggtgcctctttgcaagtgtgttagacaaagccttcgtagatagatatctgctctgagaccatggtactaaatattggtggtagtgtcacactattgtggccacaattgcaggtggggaatgacgtggacgatgtgaggtctaaacccgcaaacgctaaccacgcccttgtcgttatcaaccgtggcacacccgactgacctattcacgaataatgtttcctgcaatgcaaacggagaacaca

SEQ ID NO: 65681 - DNA, 980 bp, Oryza sativa
gatcagtcaagacaacttctttgcaaaaacggctgcacaatatgccagtaaagcctgaagcaagtcaccagctcacaatactgtcagattttccaagatcacagagtgaagtaaacatgagaggagaatgccctcaccaaccccagatcctagctcaattattgaatgatccttcacagtctcaggatgttcagacaagtaggtgttcatcagaactgcacctggccatactaactgtccagtaagatcataatcagctgccacaaatcattagaatgtttgtaagtgttggccccatgataaggaaacagcaaaaatctggcgttatgaagtgcaatgcagcattgtgcccagagcaaaaatacacccaaacaagttaatgtactgatgagaggttctagtttgtaaataagattgttcatatttgtccactgcacaaatagaaataaacttgagtatatcatgctcagatctaacttttgtgttccacggaagagctatctccagataaatgatagattgatagttactatgttacacaaagcagcatagcctcctggttatagaagcagacatgaaggacagaatgaaatggggcataagagttacatgacgacatatatgcacaaaatgaaaaccccgccattttgtttgatcctgtgaaacatggaccattcattgtactgacgtactagaatgacaatgtctgagttgcaagtggttcccaaaagggacaaggtaaaagtggtcctaaaactacatgattagtgtaatgaaaacccagtttggtactgcccaagcaacagttatatatgcacagaacgtatcacatttttcagttgaactcatatgtaacaccaaattcagagatgatggagtaatctatagatggtagatgctatgctatgacctttaattcatgatcatcatgttaaaaaggagtggagacagtcatttagtatctagtcacagctgatttt

SEQ ID NO: 65682 - DNA, 1792 bp, Oryza sativa
tgaccaaaacggcggcggaagatcaacggacggcgacggcgtcgaggtcgaaggggcggagaagatcgggtcgacggcggcgacggtcctccggcagtcttcagcgacggcgaaggagcggacgaggatggcgacgacttggcgaccacgatggcgaccttcccgagcgacggcgacgactggaacggcggcggcgcacggctggagcggcggcgacgacggcggcgctaggttacacggcgctggggcgctaccggcgacgagaggcgaagacgagggtggcggcgggcgggtagaggagacaccggggatccttttaaaggggcaggaggcggcggcaaaggcccacggcaaccggcggcgagatggaaagctcgggctcggagagagagagaccgatccgaatcgacctcgaatcaaacactttccaagcgattttagccgatgattccaaaagagaaaaggtagaggagatccccaagatcattttcccttaattggtttcacccgaaaccggaaaggatcggccgattttgaaaggaaacggcggcccggttcggcttagggtttcgggcggcggcggctggaggttgacgacgaccccgacaggcgggccccacctgtcagcgacggaaacgcacgcgcgcgggcgggcgctgctggactgggcggacttgggccgagggagagagagagagggttttgggccgactttcggcccaaagccaaaagaagacttttaaaacctttttcaatttaaattattcatgaaatgcatttcctttattaaaaatactttcctaacctaaaataattcccaaaaaattctaggattattgaattaaaccaaagatttaatggaattttattttgcccccatttaatatggaatttaataattaaaaataaaatcttctttcctaaacttttaaaatcaattctaataattccaattaaacaacaatttatatatttgggatttttagggtgtgacagtaacatccaacgaaatactcagaattacaacgggggtcacttgaattatcattatcagcctccttcacctcagggtccaccaaggggggtcaccccagcctcagtttgctcccagtttaatcagtttgagccgatacagcagcagacgcaaggggcacctcagcagagacaatgggctgatatgatcgcagatgtaatgagggagcaatttgggcttaagccgaaggatactggaaacttatatcggcatccatatcctgagtggtttgagagggttccattgcctgctcgatacaaggttccaaacttctcaaaattttcagggcaagataatgtttcgacttatgagcatgcgagccgattcttagctcaatgtggtgaagcatcggctgttgacgccctgagagttaggttgtttcctttgtcctcatccggatcggcttttacttggttttcttctttgccatacaattctgtcaatggttgggccgatttggagaaataatttcacagctatttttacagtggaattcatgagatgaaactttctgacttgacagcaattcggcaaaggcatgttgaatctgtgcaggactacattcagagatttagggaaacaaggaataggtgctacagcttggctctaacagattctcagctagccgatttagcttttcagggtttgatagctccgattaaagagaaattctcatcccagtagtttgaaagcttatctcaccatgcacggaaggtaactctgcatgagcaaaggtttgcagaggccaagaagaatttc

SEQ ID NO: 65683 - DNA, 617 bp, Oryza sativa
gagaatcaaacactgatcagccatagctgccgcaacattctgcagcaacccaaccaacaaacccaccctccgctttgactggcggtttcatttagcaaccctgcaagccgcaacgctttttgtcgccttcccaagaatagaagtccggaccattcaaacccagtccagtctccctctctgccacctgcccccacctgtccctgctgccacactgcgccgcgacgccatcggagagcagctcggagctcagagatgcttcttgtacatgtcctctcgctccatctcttccacttccacccaccttgtcttcttcctccacctcctactacttatttgcctcatcaccgagaacgccagtgccaagcttctttgtcttgttgcgtttcttgaatcttcatctcttcttttcttttctggtaatggaggtggcggaggggaggacggtggcggcgacggcggcaggtggtggaggattgggaggaggggcgaggaccgaggcggaggggttggcgtgcccgagtgcgagtccaccaacaccaagttctgctactacaacaactacaacctggcgcaccgcgccacttctgcaaggcgtgccgccgctactggacgcgcgg

SEQ ID NO: 65684 - DNA, 1182 bp, Oryza sativa
aattaggcttatcaatatttggcaattttaatagtgtttagtgtctatttggtttgaagccaaattttggcatgcctaagaaaataggccttttcaatagtgaacttagtctattttggcttcaatccaaacacaactttgccttaccaaaattagtcatgccaaaatttggcactgataaaatttagtaatacctatttaaaccacaaaccaaaccaaccctatgtctcacgagccatgatccaactctgcctgctggtacacagctgccttgtcctggattttttttaaatatacccttctttttacaaatatgtttacaaagaatggcaaaaatataatatcgttacaaagcaaggaatatacacgtttaaaaagaattagcaaaaatatactatcgttacaaagcaggaatgcgaactcgcggcggacgtgtgagttctcatattgtgatgcgaagtcgtgaccttgtttgtatatccacatacgcgagttcacatctccgctgtgcgacaatgatatacttctaccagtcccttcaaaacgtgtatattttaaaaccggtgataaaaagggtatatttcccaatttgttctcgatgtcctaagcttttatatcagtgttgggtgctaaccctaagactgggctgcttgccaaagaaacatcaccatatacggtggcttctaaagtgtttggactgagtgggcatatgggctacttcctcttgggcccaacaaagcacgcaaagccaactccagttggcacgggttgcatgggccgcatttcatataggccctgtgataataaaaaattggagagagagaaacatgtaatctagttttacgctttcctactaggcttacgtaacatgttgatataatacacacaatacgcttcaccactcctgtgatatcttccagggccattcactttaatgatattttcaaccttatcaaattttagtaaagttgctaaaaaagtggctatatttagttaactatataagaaatcttgttaaaattttgataatgctaaattttagtaagatttttttttttcgcatcaaagtgaacatgtcccggttccatctcccgcagcaaaaccccactccctccactccggcggtttcatcctcctgtcctcctggtaagcctcgaaaaaattcccaactttgcactagca

SEQ ID NO: 65685 - DNA, 26075 bp, Oryza sativa
atcagggaccatgtgagaggttatcaaggcatcagcaccctgattttgactctaacccaaccataaactaaccaatgctaccactttttaattactagtttgttggcgtgctgtcattagtgagttgatcagagttttgtgctttgtttgcttgctgagagagagattgacaggaaagaaaaagaaatatgtgggcggttgaggaagccaagacggatcgcacatagtcttgcaataaaaattgtgaactccacatggatgcgactggagaaaagagcttggtcggccggccatggagtctttcttctatggctgcctcctctcaatgtgtcctaagctttgctgctgcctgtgtttgttttctttgattagtctctttcttagagtaattagagtcttttatgaaagttgtcatggacgcatgtatcactcggacaggtagaactggttcaggaattgaagacaaagctaggaaatttaattaggaattgtttagttagggaaaaatttaggtttagtggttatatcggatatgcggaaacacatttaaagtattaaacgcagtttaataacaaaataaattacagattccgctctgaaaccgcaagacgaatttattaagcttaattaatttattattagcaaatatttactataacaccacattgtcaaatcatgatacaattagacttaaaagattcgtcttacaatttacacgcaatatgtataattggtttttttctacatttaatactttatgcatgtgtctaaatattcgatgtgatagcatgaaaatttttgttttgggaactaaacagggccttaagacaaagccagggtcgtgtaccttttgttcattattatgaaagtaccttttggaattggttgacccatggattcatttagtgtgaatcttagatcaattgaaaaatacatgtactctctctccaaaaataaatcgactcaaaataaattaatgatgtctatagaataaaattaatggttaaacacaactgtccacaagatcacaactcaaaataaattggccatgccaaactacaatgggcgccatgccttggtagtaacgtagccacatgcgtaaatatgggcaccattgtcagattattttctagagaacaacacagtaatacctccgtttcgaactactcgtcgttttgatttctttttaacgtttaaccatttatcttatttaaaagattataaaattattatttattttatttgtgacttgatttattatcaaaagtgcttcaaatatgactgtactgttttttaaataaaataaatggccaaacgtggtaagtaaaaggttaaaatgacatctaattaggacgtctggagtactaacatgcatatatgacctgagacatgccttagagatcaaggtgtacgtctctgtcagagttcataatgtgcgtggattggggaagggggcaaccataatctcaatcagggcaactaaccacgtcaaagacaccgtccgtacgctatgcccctgcttcctcttctttcagcatgtttttttattaattagggtacaaaatgtggaattagtattgcaaatcgccctccccatgtcttcgagaacaagatctatccacatcattttctcccttaaacacgtttggttaaaaaaattcttaaaaaaaaacaactgttttatcctagaaaaatgttgcttgtgatctgagagggacaacaggcaacagccatgtgtgtgactcccagggacacgtgtcaggatgtagagaaaccatgcccaggtgtcatgttaatgcaactctggcagtctgcatttctgcaacaccaagctagatctctccatttattaaaacaaactctaatgatttctttttgtttttattagcatttgtttaatgatcaggccaatggcagcctcagaaaaaaaggagaaaataattaactgtgaccacaatcaagattagccacataaacaaaatcattgatatggttggcccaagatgtccaagtcaaggattggatggagcagatcaaaagatagtagagaaaaataaaaagaaaaagaaatggtcggaggagcatgatctgcatcaatcaagtgtccttcgtgtgcttcttctctaggaggctctagaaagcagaaactaatcactaatcatttttctcatgtctcttaattaatctagaaaatttgacggtatttttccaagtctttttttctctcgtttccccttttcaatgagatgaaccccgtgcaccgccaattttaactgtcctggtgatgtttctacgtgacacgtcatggctgttaagtgggattacacctttgatttggctgaaattgcatgtgatgccatccaatatgttggaaaaaatgactcttttgccctgtctcaaggacgtacggtagcaggggagagttggcgccgttggcaccgtgaaacaaatcttgtgctgatttccatgtatgaccctgcctattctctcagtagcaatttcatatgggtacttatctaattcttttctcctgctataatcatgctgaataaacatgcaatattttaaattataaaaaatagcaacaatgctatttaaccagttctttttttaactctgaaatagtttaatgagaatgagagagcatgctggaattgtttgataagaaagagggccggacgcagagcgattgatgccataaatttatttcattttgagtatgttagaaatcttagtggtacgggtaatggtttataaatcatacctcaataatatgctttgttgacttactatgagattcatgaaggaaaagcaccccaaattaaacaattgatcttagattgcagtacatgtcatttttaaattaggagttttaaacaaaaaaaaatattgatacgattatccacgtcactttctctagtgctataaattattctgtcttgtccacgaaaaattacagtgaggcatcccatggaacggaggaacttagaacgaattgaactaatccgtaaaaagttcttttgtaaacttttacattctaaatattaaaggagcccacagcatacatagcttcatcaatatagccatagcttatgtgcgagagccataaaatttatagcatctctaatattcacatgcaaaaacccgtcaatactatacgtatgcagtgattttaccaaactcaagatatactttccctcatccacaattgataaacgcatagccagtttttttttaaaaaaaaataaaatccacaaataatcaacgccacacatttgcatgcggtatgcgcagatagtccaggtggattgaatatatgcctctcgcatgtagaacgtttgcacacggagaaaaatgatatgtttgctcagttaaatgcagagtcacacacactcaacgtgtcatgtggtcgtgacgtgaggcctcaggatataacaacacaagcatgtaacgaggcgtgtacgaggggattttctttgcatcttggtcagggtccaaatgcaatacgcttatcagttatgcatagaatgaagttccgggttagtgtcgatgtattcattcagataggatgtgcatatatatatttttagggatatgtccgcacgcgcatacgagtatatatgttactccatccgtctcattttaagtacaactacacccaactttaatcgtccatcttattagaaatttttttatgattagtatttctgttgttatgagatgataaatagaaaacctacaccacggcatcccatggagacgggatcccctcctcctacctcactcctctccccaaaatcatccgaatcctctcctcctacctcactctcctcccccaaatcacacagcactgcagccctccctctccctctcccctctctctaaagaatgccgagtggagacgaagccggccgggaggaaggggtcgtcgtcatcgtctccggcggccgaggaggacgacgacgacggcactgcgtcagcgaggtcggccaaccctcggcggggtcgcccttgagctcgcctcccctcgttgtgccgctctggctcaccgccctcgtcggtcaggtgtgcgccggggagtcgtcgccccagggagggcagaagcgggagcccccctcgtcctcgccctcggtctcagcgtcaccgttgtccccgctgcggcctgctgcttttgcgcctccgggatggacgccgacagcccgcgtcgacctacaacaggtatggccgtcaacctcctccttgagacttctcgcgctctttggctcgggcttcacccctcacctcgccgtgcctcctcgacgccatcttccgccgttgcggccctccctcctccacgtctcctcctctttttgacagtaccttctaataccccacaagtatcaggcttgataccttggtatcaaggtctgatacctaggtaccacccggtatcttgggtaccgagcatcaggtatcggtcgatacctaattggtatcaaaggtaccaggtaccaaccggtacaggtaccaggtactagaggagcacacatggacagagaaaaggaaaagggagagtcacttaaaatattccgctgcaacggtgggctagcagccctcgatgataaaacataaatattactttactcgtgacttatgtttttaatttttttaaaaaaaataaataagacggatggtcaaaattcggcgcgaaaaatcatggttgtacttaaaattggacggagggaatacatatttctatatcttttaaaaaataataaaaaagagagcacacacatcttctctagccctaaatatgccgaagaatattccatgtctcactctagtaagcgcgaaaacaatttcttcctccgcaaaccagaagcacaattaacgaaatggcaaaaccgtcaataaactgaaaccccgggccttgttatgaaccccccacgaaccttctccccgtccacgtccacccctcgccgtcgtcaaagcgcggcgattaacggcggcgcgcgacggcaattccacccgaatccgatgtataaaaccaccccgcggctcccccaaatcaccaagaagaacacccacctcagattagtcccaaagattattcgcgattaagcttgtttttttttgttcctaatcgcagatacaaagaattcgctttgcgtttgccactcgagaaagattttgttttttttttttggttaacggataattaagcgccgcccctcctcgtcgtcgtcgccgccgcatggaggccgtcggcgtggctccggcccccgcgggggtgccggagaagaagctgctcgaagtgaaggagtcccggaaggcggcgccggcggcgccgtcgacgtcgatggcggccaagtgggcgatgaagaagaagctcgtcggcggcgacgccgggtacgtgctcgaggacgtgccccacctcacggactacctgcccgagcttccggtgcgtgcaactgcccccatatgcctcttcttcttcgggtgtctcgcggttagctgagatgatttgagtcgaaaggttaaagttcttttgctttcttggggttctacacagttttatgtgagctttcgagcaaagatttggatttttttcccgctcttttggggatgtttttttggcctgtgtttggttcaggtcatcccaattccagtttgtggattgatttgagaaagtgatttagatttaactcttgatttacttggtccgataatgttttaagcaaatgttccgataaagtttgaagcgaagttaaatcgatctgtaaaaaatggattatgaaatttcaatttctgtgggcgatgcgcctactgattgagctgcagtatcgttttgaccccatttcttgaagcaactgctcacctgctactgttgctgatctgcagacttacccgaatcctctgcaagacaacccggcttattcagtcgtcaagtaagaattctcctcgtctcctgctctaaattaattccatttgatccatgagaattccattattccatagtccaaccacgcttggtacaaaaaggcttacctttcttcacaccacgtgtgctccttcttcttcttgcaggcaatacttcgtcaacactgacgacaccgtcacgcaaaaggtgaggcttcatctttccatgacgaaaagattactgtaattcggttacagggtgatcatagtttgactgagctaacttaattttgtggtgtttgctgcttgcttcagatcgttgttcataagaccagtgctaggggcacccatttccggcgagccgggccgcggcagcgggtgtacttccagtccgatgaggtcaacgcggccattgtcacctgcggtggcctctgccctggacttaacactgttatccgcgagcttgtgtgcggcttgtatgatatgtatggcgtcaccagcgtcgttggcatagaggtgattaacttgttcttattttgtcacggctttgtgtaacttagttctttgttgggatgctaaacatgttttgggagtagttgatatgtacattttaggatatcagaaatgccattactgcaaaaatcatctgagaacacaatactgaaagtgacacaagcattttagttggcacttggtggccaatgacatgatgctaatgctgtttgtgtgtaaatggtgctcctaatcagttgttgtgatcattctgtttttgttttattgacttgattctgatgtgcatgtttagggtggatacaagggtttctattctagaaacaccgtcgcactgacaccgaaatcggtgaatgacatccacaagagaggtgggactgttcttggaacctccagaggaggccatgacaccggcaaaatagttgacagtattaaggatcgcggtattaaccaggtgtatattattggaggtgatggtacccagaaaggtgcttccgtaatttatgaggtaactcacaggctgataatgatgtaaataaatgtttgtgggatgcccaatgctatctataacacaaacttgttgaaaatgatttcaggaagttcggaggcgaggcctcaaatgttctgtggttggtgtcccaaagaccatagataacgacattgcggtactttcttctttccagcacacttgagtttggattttcttcatgctaatcgctaagattgatgttgaattgtttgcacaggtgatcgacaagtcctttggttttgacactgcggtggaggaggctcagagggccatcaatgctgctcatgttgaggctgagagtgcagagaatggcattggtgttgtgaaactaatggggcgcaacagtggtatgtacctccccaatatgattatgatttatgaacttgcccccacatattctaccagaaagtactaaggagctttaaaatttactgctacagggttcatcgcaatgtatgctactctggctagtcgcgatgtggtatgttttaatcattctacttgttcattgcattgatcaatctagggtaaatgctgaattatatggttgatctacttttttacttcaggattgttgcttaatcccagagtctccattctatctagaaggaaaaggtggactccttgaattcatcgagaaacggctcaaggacaatggccatatggtcattgtagtggctgagggtgctgggcaagatctcattgcgaaaagcatgaattttgtggatactcaagatgcttctggaaataagctacttctggatgttggcctttggctctcccagaagatcaaggtcagatgtggtccaaaccttcatttccttttcatagtggggacaacaatgatctttgcttatgcctcattcaattttttttaaaaaatgctgataattctccaactacaataaatttgatcacatcaggtttcttttattgccaccaatgtaaaactaagccatcatcgaactagtactttgtcttcatatttgtcaatatcgtaaagcctggaagaaccaaagaaccatgatgtgccctgatctcattcagaatgctgaattacttccctttcttcatcatgcaggatcatttcaagaagaagcgcaacttccccatcactctcaagtacatcgacccgacatacatgatccgtgccgtcaggtcaaacgcatccgacaacgtctactgcaccctgctagctcacagcgccctccacggcgccatggcggggtacaccggcttcaccgtcgcgccggtcaacggcaggcacgcgtatatcccgttctacgtaagtccagaacactctttttcaatgatcaatctttagtgttcagttcagttcagttcttcacaccagacatcaaccatatcctgataatctggacactgaaactccggcgatttctacagagaatcacggagaagcagaacaaggtggtgatcacggacaggatgtgggcgagggtgctgtgctcgacgaaccagccatgcttcctgagccacgaggacgtcgagcacctcaagcacgacgacgacgagcaccacctgcacaacacgcagctcctcgaaggcgagagctcgccggtgaaggactcctccaagtgcaacgggacagcagcgccagtgtgagaaccaacgagaatatatatatatatatatatatatatatatatatatatatatataagcatgtaattgtagctttctttttgtcctttttttctgaaatgacattgtggggaagctactgtaatagaattaccgtgtaatatagcaaggctggtttcatcctcgaagcagaatggtaggtttggttttgttgggaaaatagtaagggtttcatgtcatcaattcatcatcctactagtaataagggttaattttgtagtatagtggatttggatcgtgaatctcgggcttgaacttaggatgccaattctcatcgaaaatgtacatagagcaaaccttatttcgcaaaacatttgtaccgataacggcatacaagtaacaaaaaaataatttgtatctgtgttgttcgatgttcaaatggcaatgcaaaaataaattacaatggaaaaccataaaatcagtttcaaaattaaaatttttgcagcgacttgtaagctgaaaggtatacaatgggatttacgcacctacccatgcgtcttgtgtagatgacagttatttgaagtagtacggcagttcagtcaagtgttttacagggaaagcatacagggttcctctacattgacaagatcaggttcacaatcccaatagaaaaccgatgaaatccagttaaattttgttaaaataaaataaaattcggttgatttttttaacttggcaaaaaagagagagtgaattgtgctttctacctattctggaaagtccagcaggatggaattgtaaaccctggacaagattcctacagggatgtgttccaagcagtaggaatcttctccagacttaaatccaaaaactaaagatcagatatcttgtagactaatcgagtgatgtccaataagaaatacgattagtacattaagtacagggcgttgcacagaaaacatatcacaaccccatgctgtgaacacacgctaaaacacatacgcgttaaacccacacacacagcttcaaatcttcatcgaggaaatctgaagcttgagcatacacgttgtcacgtaactacacaggcgcagctgggatcggaaacaacaggtagagtagtacggctactgcttttttcttgttttgccataacaacagtgatgaaaaagaatcaggtctctcctcgaattgaggagagtggaagagattgttctagcctctgtacacgccggagggatcagcgttttgaactatccaagggtgctcgaggagcttgtggaggggcagacgatgcgccgaattcttcacgagcatctgcagatcaaaatgctttcttgaggttcacactctggtggatgttctacttgtgtccaagtgacgatttacttgtcacagttttacagttatgtaaatcatcaggacaggagcatgcttcttacctgtgaaattaggtctttcgcagccggggacacgaatggtttcagtgggaacttcaagtcaactttcacaatcctgcatgtccacaagacatttcagagaacagtgcttgcaagaagtttcatggaacttattggtaattacaggtgagaacaaatggaattaattgtactctgtcgagcatggaggatagattgaacataatcacgagtgtttattaaagtagcagaaaaagataaacaattagcagagtatagctcagatatcagaaacgatagtgcagaatacaacctctaatgggcaagagacaatgagattcacaagggcatttgagatatgtctcaggctagttagtaaaaagtcactgcattctcactctgaaactcatcattacctgcgatatgtttcggagtgttcttttgcttcgaaaggtgggactccataaaggaactcatagcacaggatccccaagctccaaatgtcaacatggtagtcatgttcagtcttctccactggacaaattataaaaattttagagtcaaggaaattcatacatttactgatattttcaaggaaagtaaatggaaaggaaagtacccatttcagggggcaggtaatctaatgttccacacattgtccttcttctgttgaaggtgtgcacagaccaaccaaagtctgcaattttcagttcgccctgttcatgaaagaatgcagccatgtaattaccaaagaccatgtttcaacaagtaaacatcagagagctgtagtttcaaaattgagacagtcagacaaagaaacaaaataatgcaattacctgggacccaattaaaagattttcaggtttaatgtctctatggatcacatgctttccgtgaaggtagatgagcgcatgcgccagtgatgcaatgtactaaaagaacaggcaaatctcaattattacttttcgacaaaggtaacagaagaaaagtttatcaagcatgtgtgcagatcatctacttacagtcgctgaacgtctttcagagaaatgcttgcacctctgcaactccttataaagttcaccttttaaggcatactccaagatcaagtacacacgggtctgcagaatccatgtagcagaagatatgatgataaaactagaggagataaacaattacatcatatcagaactgtggtttttttttttctggacctgatcatagaaatacccatacagccgtagaatgttgggatgacgaagatgactctgaatctcaacttcccgacgtagctgatgctccacctgggactgctttagttggctcttgaaaagtactttcaaagccacaatatggttactctgtttcacagaaagaaaatagattaagttcactgaaagtggaataattagaatcaaaacaaacaggaacaagcattctgaagcatacagtacagttttaggttacaaacatttacaattgcaggagatatttaaaaaaagctttaaagatcaacatattaagcatgacccagaattccagttagaaccatatgaaagtgcactacttttttaaaaaaaaatatactacctccgttttttaatagatgacgctgatgactttttctcacatgtttgaccattcgtcttattcaaaaaatttacgcaattataatttattttgttatgagttgttttatcactcataatactttaagtgtgatttatatcttatatatttgcataattttttttaataagacaaatgtgagaaaaagtcaacggcgtcatctattaaaaaacggagggagtatatgatagcgcactacttaatgacataacttaaggctcgagagtatacaaaagatctatacaaaacttacaccatgcaatgcatgacacggtatcatgttttttcttcaagaaaattggatatctagaaattaaaatcaaaattagatagtttgtcttgttcttttagcaaattcattgtagcagacattaagcttcttagctgagatggagaaatagacgaattaaaaggccttcttgcttcctagtatacccaaaaggctccagcacaacagcaccatattattcaacaataacatgcacaatacccaaaaggctcatgtagatctaagatcggatagtgattatatgtcgtgaggtcaagcaattgtaactagtagtaactaagttagtgtactgagctcaagcaactgcaatacataaacctttcactcaagtaatgctcctgaatcaattagtagtaactaatagtaccaagaggaatggaaaatgtgtaacaatgaatataacaatcagctgtggctgaaatgacaacatgtgagaagaatcacttactctcttttctcttgctaagtaaacatggccgaacttgcccctcccgaggggcttcccgatgtcaaaatcagacaacacccaccgcttcacctcctgcgaatgcggcgaagcctagaacaaacgaccagaagagcatgtcatcatctcattccatacaaagcaggtgaatcagaagcagcctaaacatttcaacctcataataatatcctcaaggtcaatttaatttttagccaagcaaagcttcacataggaagccgaaacagccgcgaatccctgacaaaatcgcccaaatggactgaaattttagggccgtcctgtccaccagatccagagggaaaccatcaaatcaccaaatcctaccgtttcagcgcaccataaacccctcgacatgacggatcgaacacacgaaccctagccacatgactacgaggaagaaaaagcaagcagaaacgcgcgtattcgtgacccctgtcgcgtcaacaacctacaggacccagaaaaaaaatgggggaaagctgaatactagaccaaatccccgccgattcgtgcgaaaccgcaagaacacacgaccaccctaaccccatccaacacgccaaatccctccccaaaatcgcaagaatccaacacccgccggattccaccgcacgaagatccgagaaaggggaaggcggagaggggacggggacgcggggagcggacgcataccttctcctcctcgcagcgcgactcggtggcgatcgccatgggggaacaagagagagaggggaggggaggagcggccgcaacggcgacgaggcggagagattcgaatgggggatttgggggatttgggggaggaggccgcttttaagacgtgggtggatcgctcaacggtcgaatttctttcggcttcatggctggcagcgcgtgcggctcacgtgcgagccgacgagccgtttgtggtcacggtatgggcccccaggatgatactgggccgagagattgcgctcatggcatgggccaccaagatgacgtatctagtgggctgagacaaaaggtgggcctttatgggctctcgtttttggagagcttcgtgctcatgcgtgctgaacatgtcgaatttctgaggagagaaaaacatttcaaataaccctctttttttcattactctatgatgcatgagagaagagctaaaaacaattaagatgatatggcttcatgagagaagagcattaactatatttagtggggatgaaatttatagatatataggattcaaggacttttgtttgaaaagttcgtgggctgagattttttgtttgaaatacgattttattcttggggtatatattgggtgttaacccatctaacttcttgaagaaaccatttgtctcggacaaaccctcctgcagcaatagagggttgacatcaggatacaactatacaattaagattcttttagcacagtcaatcccttacgtacgtagcattccaattgtattcacttatcaacatcactcattcgatattttacctactttgacgatacaataattggctcaagccacccttacttaaaaacaaaacacaataaaatgtgagccgtctgaataacaaaatgtgtacactcatgatgcatcctccccgaaaatcagcacacacgcaatgatcgcacataaacaaaacccccaacttgtacgtataaattactcggtgccctaattgtatattgtacagtattatctactgtatctgtaatcaatatgcaggccaaaataaaaagaatattgcatggttatttaatttgcaggcgacaaaacatgcagacatgcattgcacaccactttattgtctcgccacaaaatgtcataaccaagtggattgcgatctaattaacaaatggctgatggcttatctcatcttggagcttggctaattaagtcagacggccaaagttcagagccgacttgtttcatcttcgcttcttctgattgctatggatcggacaagcacagatccttggagattttggagcgtttacatatgcgacttgatgaattaactttcaatttattatcatcttgtagacttgtacatacttgtgacgataaactagagtagattctcttcaaagataaattaagtttcagtgcatacaggaggtagcaattggctgaaaatgacatattcctttgcagttcatccccaccccccattttcattattagctgtgagcgagatgatcgaacacgtcaaaacaaaggtatttgtagacgtttagtacaccctacattgcagatttgcaactttagcataacgctggaactctgaatttttgaacctttaggtagacagtccatttcaagtagtacatattgaagttgcacggttgatatgatttgacccctatcaaatttacttaatctcctccccgtaaaaaaaaatacttaatctccatatgcgaggaacaaattaataagtaatctatcacactagagcttagcttgacgcgtaattacatatatttacataagtcgaagagtgagacctagtcatttgagaagtgacatttcgttttctcgtgctggaatattcagaaattcagcaacgagacagggggcaaagtgataaaacatcgctgtctacaattctaaggcctactctcttggctcttgcttaattaaacactgaagtaaagcagggcgtcttttccttatccgtgtctgtcaatagagcaaaaaagtggctttagtttgggtttatactccacatgacctgtctagctagccacttttttgctgttttgatgtttagggtgttgatgtgttggattggattaacaagttggacacaataagaaacagacagcattcagtcatggtagatattttgtcaagagaatttgttggtgcagcattgtcagtattttcttgtgtgtttagcttgtcaagttttttttttcagatggcagtagtcaattactcctacttcatgagtaatacaaatctagaatgataaaatgcatactacttccgtttcagattataagacgttttgactttggttaaagttaaacttttttaagtttgaccaagtttgtagaaaaaaaatagtaacatttttaacccaaaacaaatttattatgaaaatatattcaattattgatttgataaaaataatttagtattataaatattactatatttgtctataaaattagtcaaacttaaaacagattgattttaatcaaagttaaaacgtcttataacaggttagtacgtaacatatagaagtagctacacgctggcctacgcgcattcgaggagaataaaagatcgaagctgtacgtatacagttttcaaaaaaagctgtacgtataccgaaaaatcaaatatgactggggcaagaccatgtggacaggtcgatatttatatttatgaactttccacgctcctgtagatcgtttttcatccgattctctgtgatcttgcaaacacggtggaaacggtgctgactgactgactctaataagtctaacgattaacttaatttatgtgatctgagaaatctatccgcctatatatcttcccccataatcatatcgcctacaaatacttatgttttatgaatgacagataaatttatcatcttaaggaaggtataataccagattttctaatgctaattttgctgactctaataccttagatatctcttcagatactataatttttagcgtaaaattcttatattttcagatatttttttgaacatatataaaacctctcaataatcatacatacatctcgtatcaagtccatgtaatgtaacgaagataaaaggcggtgaaggtgaaaggcccagacaaggcgacgaacggcacgtacgtacgaacgtacacgtacgtaggggtagagtagtcgccgcgtttcacgaaagaaaccctgcctttatttgccaccaaggtgggtcccacgtacggtcccaagcagccaggtggtggatctgagccgaccatcgcatggtggacggtccagattgatccgacagggactgggttgcagcagagagctgaggccaacattgtggtcggaaacgattctctgacacgtcagaatcgggcatggttgcattgcaattccaattaactactgcaaatctgcgtattgcatggtaacgaaagaaattagtcacgactgatcagtgaataactcaaccagtccggtcattttccatctgattaatccctcttcctccacacgattctgcaatgcagacaaaccttcagaaccaaatactgtgttcagtcaccttttgctgctatatatcctccgttcttaagtgctgtgattagatccaaacttcagtcattttctatcacatcaacctgtcgtacacataacttttcagtcacatcatttccaatttcaatcaaaatctaaactttgcactgaactaaacacagactaggtaagcagaatcaaaggataacaaaagaaaaaaattcaccgcctgatacaaacaaaagtgtgatcaatcaggctaagctaagcatgtgagcttggaattaaatgtcgcctctccatcatcacaagcgtccctaaccatgtacccctatgtgtactccgctgctaccatgaaactacagtacaagtactgtccgattttgttcctcatgtgggccccggctgtctgccctgcccagcattacaatttataaaatcttatttttgtaagcttagcattacaagttttttttgttaattacaggctctgtttgtgaccgtgatttcatattgcccacattttttttaggggaattgatattggccacttgcagagcagcagggcacatcatggacgaaagcgaatctcgaggcggatcatggctcatcatcctcaggatcaccatcagctatcttctgttcttcccggcccatgcaaactctctgtgcaatttcacacgcaaacatgaaaaactacaagacgagaattaacacgaatccatgtgaagcagatttgttttttgagtctaaacgaacatgtagataccacatttgaagcacagcaaaatactagtagtagctttttgttcatagcaagtgatctaactttgcacctgatgaattttctcatgttcaagtacactacacgcttcttgtaattacgcgatgtttgatcgatcgaccaatctcgcaggaacacgcggagatgtggcatgtactgatcctaacactagtgtttgatctttgaaacgcacgagttcactacactagtgatgatgacaagctcggatcgagagggtagtagtagccgccgccgatgaagtggtcgtcctccgccgtggcggcgccggcgaggtcgtcggagctcatgcagaattccgggaacagcccgccgccgccgccgccaccgacgacgacgacgccggtgtccgccgaccagttggaccccgacgacgcggcggaggcggacgtcgagcccccgtccgtggcggcgccgtcggcgaagggatcccggagcgccgtggcggcggtggcggtcggcagcagctgctgcaggaagtcgtcgcaggtgtacgcctcggtcttgacggtcggtacggcgagcggcgggaggagcagcagcgacgacgacggcgacgtgtgcgtggcggcgaggggcggcggcgccgggagcggcagtaagggcgtgcagacggcggcggcggcgaggcggcgcttgagcttggtgttccagtggttcttgacgtcgttgtccgtcctcctctccagctgcgccgcgatggtcgaccacctggaaggaatcaatcagtcagttaccgccatggcaagaagagagagagggagagagagaggtttaattaacttacttgctgccgagcttggagtagagggaggtgatgatggcgtcctcctcgtcggtgaaggcgccatggcggatgtcggggcggaggtagttgagccaccgcagcctgcagctcttgccgcacctcctcaaccctacaaaacaaaaaagaagacaattcaattcaattcatcgtcagaaatcaagaagagtagtggccatatcatgcaggatgatgagaagacatggactgaccggccttgttggggagggagatccagttgccggcggtgccgtggcggttgatgtagtcgcgcagcgcgtcgtcctcctccggcgaccacgggcccctcttcaccgcctccctgtcgcagcacggcgtcctccccatcctccacacacaccaacacaacacctcctcgatctcctctggatgacaagggagggacaagaagacgcaagcaagaagtggaggctacttgtattgtattgtacccgcgccgtgtcctgtcctcttgctgtgtcctcgtctcgtcgtctgcaaggtcttataaaaaaaaaaaaaaaaaaagggggaaatcgcgcgctgggtgggagaaagagagaggaggaacacggtgaaaagtgtggaaaaggaggccgaggtgcagtgaccgagagggttcagcttcagcagcagaggctgcagtgcagagtggcgtttgtttcccgtttcgatctttgattctcgcctgcaggctgcagctgtgcaggcttccgtttttcttgttcagagtactacaaacagtactagtacagacgcaaggacgcgacaaagtactccagtactctattctctcaattggagtactgcgagtactccaatattttcgctgacaggcaatggtactactgaactgctagtgttatgagaatctactagtgctaatgacaggcaatggagtggagtatggttttgtttacatcagtggagtaggagtatctagttctacttctttgtatactactcctatacctgtattggtctgtgaacagtttgtagtaacaagaatgcaagaggtgtagttgcagccggcgtgaagaagaacaccttgcgtttaccccgacaagcatgcaggcgtagttgcagcgtttgcaggcaggcacattttttgccaccaattgatggacgatcaaactggccgacgtggtttcatcatatatcccgtttgctcttttcgcttattatacacacttctatctcaacccatctactcctcctgcatctttgcagtagcagtttacccaaaggcatatactctagtggttgtagtaagctgagtagcaacttaaggtcctgagtttaaatctttatctgaggggctaagttctttatttaaactaggaaggtggcccgcgcgtatacgcagacacttatattattgaaatataaaattattgtttgttcagaaattttgtctcatagatttaggacaaactaaagtttggataatgttattttataataatttaagggttctatttttcttaaggtatcttagaaaaccattcacgaacttttgagtaggagatggattaagtatttacaacttttgaatcatgtttttttttctcgagtaaataagaaactattggtagttaattatcatgcattccatctatatacatatcatgtagtatggccgcaaataaaaaatgcgagtgcaagatactcaaaatctttgattaaatcgtctcatgaatacgcatgatatagtaataaagggagttaagcatatgcatgggaaaaaaggaagaaagagaaaaatgaaaaaagggatgggaggcgtacgaacccgcgcacgtaggtacgcacctatgctgaggtgggaccctgtagtatttagtttattctaagatcaatttaatctaacggtttataatattggacctaccgatttaagtggaaagtaagtaatagatactttgattttttttcttataatttctaatatttgccctaatttattagagcaccacgtggtagcttgagagcattttaaggaattttaaatgactaattagaatattaactgcgcaatatatatgtatgggacatatggtagtatttagcttcgtccatgtttatatacatgtatagagaaattaattttgtggctagcaagccattagatgtctaattaatagaaattaattttgacacatatttacaattgttcagagtaactcttacatattcaatttacgacttcgatgatccgttgatcaccaatttactaatcaccatgacttgcatgaaaaaaaatgtagtaaggtttaggatagatgaaattgatgaattatataatttatgtgatagctatttgagggtataaacgaatgaattgctaaaaagttataatgttgtttaaagaagacaccatttagaaacttagaaagcatgcaaacaaaaatccaaaatatggaatcgggaaaaaaaacagagtgccttaaactccatttatcacccttgtcgtagtaagagttctatggatattcgtcaatattacgctcacatttataacataatgattcctttcacctgtacgaatagatagtacaaaatccaaatacgacataacacaaatacattacaattattatgtaatcaattcttggtttcaacttaaatagagctaattagtgttgagaaaaacataacccatggtacttaattattctctcgctacatcacacctttcattttcttttcatgttattaacaaaattaatcatctccatatatgatttaatatgtggcaaagcggtagcgctacatcggttgtgatcaccttagatgtctcagacactacgctttgtcacacgtgtgaaaggaaaaggtgcagacgtgcattgtgcagcgggcaaaaagagaatttcggacgctttattcattagcaaataatagatctgatgattataataatatgtccgtcagttctagtgtaagtataaattagttaatatatattttaaattgttattttaatgggtacacatggtgtgcatcttattttaaagggggctgctatataacggaatctcattttcgaacgggatgatcccgagtaggtattaggtgtgatacctatcaggtatcagacgattctacaaaacaggatgatcccgagtaggtatcaggtgtgatacctattaggtatcagacgattctatacacgttttaggtgatacctgcgaagtatcatgtgatacttatcaagtatcatgcgattttctaccacgtatcgcgtgatactcacgaggtatcatgtgaaacctgtcaggtatcagatgatttcaaccacgtatcgcgtgatactcgtgaggtatcatgcgatacctgtcatgtattagacgatttctaccatgtatcacgtgatacttgcgaggtatcggatgatacttaccaggtatcaggtgattcctactagatatagctgggcatcccgttagggtaggagcaccccgacacgcgcagtcgccccctgcagccgtcccttgtagacgaggatggcgacggcaagggcagaggacgggcgcggcgacggcggcggtagcgggggataggcgcggcggcggcggcgacggcggcggcgacgggggacggacgccgcggcggcgactgcggcggtgagggacaacgacagcagtggtgggggatgggcgcggcggcggcggcatcgacgggggacgggcgcggcaacagcgggggacgcgaatcgcgtttgtggagaggagctatcccgttgggggacggtatcccgtcccctagcattcccgtattttaaaatagtgcattacttgagaataatagaccaatgtaataaaaagtagatccgatgatttatataatggggccatcagtttaagtgcacgtataaattagttaatatagatattatttatttgataggtacacgatataattgtgtaaaatttattttaaaatagtgcattatttgaaaataatattacaaagtaaaccggtttaagttatatgatggtagattatttgtttgtaaaattataattgtttaaaaatatatccattatatatataaatggaaaaaaaagaagaaagaagaaaaaagaaaaaaaagctcgggggagaggaacgtacgtaccatctacgtacgtatatactccacctgccaatgcgcgggagaaggataggtgggacccatggtatttagtttgttttaagatcaattttacctaacagtgtataatattggacccaccaatttaagtaaaaatcaagggacatatgttttgcttttttcttagaatttataggattttctctattttattagagcgccacgtggcggtttgagagcgtttgtagaaagtttcatggacttttagtatataataggtagatagatagatggatgcatatgtccggttgaatgtacaagccgagtaaaaaatacccttctctaaaaaaataaaaaaaagtttggctcatgatgattagtattataccttgttattcccctttttttaaactattgttcttttacctggagtcctggaccatatcaagcacaaaagtgagtcatccatgcaagtaccgtacctgaaaacagaggcaacttttggcaagtcaccaaatttaaattttaattactctgtgttcccacccctcttttaaccccagatcttttgtaatgatcatgccgtacttcgcacacggtgctttaaaaagttttaaatcgagtactcatgtctttcgagagagatgctaatcagtaacctctagaccatgattactgaatcccatccatgcaagaaggggtttgcagaccatgattagacccataccaacgtgattcgttttggataagtctccctaaacattagtactaatcaccaattcaccgtcgtcgtgaatcgtgtgatcaccaaaagcaaatgtgatttgattttggtcatggcaggcaatgatctgtcgtttgcagagacgaagaaaaagaaaaggaggaacctagtgtgcccacacgaagaagcccgcggccagcaaacggacggcccagatgttgacacgtcggagggagcttcctccctcgaccgtatgatcgccggaggggtacgggtctcgtggtcgggcccgattggtgaaaggagacctccgttttgcgagtaattttttagcttgacatttgggccgtgttcacgtcagctttcgatccatctgcctggtggtgggcccacgaaattgccttgtcatttccgttctacttcatcccatggtcgatatgtattgaggacactgtcattagtctcgcattttttcaaagggagaaaaaaataactttatattagtcgtccatgactcatggtgtgggtatttaattacctggctggtgtgtgtaactcgtgttgaattgagtcctagatcaatggagaacgtcatcatttataatggaggcatttgcaaaattgccaccggttttttcaattttccaagaatgccacttgaataatagctctagtagcatttttgtaattttctagtagcagtcttgcaataacgatttaaagcagtggtaaaattacaattgcccctttataatgcgggtttaagctgcgcagaacataatcctggcaaattgtcaaaaacatggaacacaataatggcaagaaacacaacagttctactctgacacttgtactaaacagtttttcattttaggtactccctccgtttcacaatgtaagtcattctaacattttccacattcatattaatgctaatgaatttagacatatatatctatctagattcattaacatcaatatgaatatgaaaaatgctaaaatgacttacattgtgaaacggaggaagtacaaattaattttttttcagcgggaatattttgagagttcaaaccaatgtagaacaacgccaatgatggtggtgcatgtgcatctttcgtgtaactaaaaataaatataaaggaaatgagttgtattttcaagaataaagtcttctttccatcgagctcaaacagttgtgacattttgggtccctcgtctttccgtcgagtttaaattacatccctaaaccacaaagtcggaaatcttcacacttaacttgtaaaaaccgggttaaattatatcctatgacagtatgggtggctgtcttcgctgacgtggcatccatgtcggtgcccgcacgaggagtaggtggagtacggtggattcggcttggagaggcggcagatgacgtggttgaagagcgactaggcgacaggggtcggcgtgctagcgtgcgtgtggatgaggtgcgcgcgcatcgactgtagcgaccaacggggtggttggttggaggcgtgggatgccgccgtgctaggccgcgcatggggggtggtcgagggaattggaggcaggagagggagggggagacggccagcaagcccgtccaagctcgagctcgcccggcctccgtacgaggggggagggggatggcgtgattgagaagtagtcggacgacaggaggtgacgtgcacgtagacagtggatcatcggagcgcacctttccgacgcttcatggtgccctgtctacaaggaggagttcgagcttggggaccagatgccgtgcaagcacctataccactccggctggcccgtagctcttgcccccgttcacaaccacatgcaagtaccagctgccgtccttcaccgccgtcgagtccaacgccaacaaccaggctcgctgcaacaccacaccgctagctagcaacggcgacacggtaaaatggcccgaacagggagcagacaatcgtgaggtgtggggcctgttcttgtggttgtggccaccgcgagggctcgaagaccacgacgacgggtgcaaacattggcaatggtgactcagcaggctaacccagagagatgggcccggtcaacttgccatgtaagtgaaaataggggattatagtgccatgggactcaatgtgcgcaggtttgtgccccgggccggcacaagacaagccggaactccggaagctggtgagcccaacctgctcctgtttctgggcccagaaagtttgtcatgggcctggcctaacataaactgctttgcgatccaagcccaatacatggatgcaggccgtaacagagtaacgctgcccccgttctgcagttcaagtggggtcagtgtacaaaccagcgaagctggatttcttacattttagccattgtacacatgttttttacaaacaaaactctggaataaaaacttattctaaaaatacacatgttttttacgccttggttaaatttcttgaggtcaacgacactaatgttgatactctcatcttttatggtagctaagtcgacgaaacggctaatacgcgactagtcgcactcaccctcccgcgcgcgactggacacgtgtcgcgcgcggagaggaggcggcaacggcgcgcgtacggtccctttttttggcgtacgatttctttttttttctgttttttttctcttccgtacctttcccggttttcttttttttctttttgttcttctcgtatatttttctgtttttccttttttacacatacaaatacaaactttatatacacgtatataaattttgtatacacatatgtaaacttttatatacgtgtatacaaagtttgtatacgtgtattttttggtttttacacatacgtataccaactttgtatacacatatataaagtttgtatacacatatattttagattttttatatgtatacacacaaactttatatacaaatatatcttttatacattaaaagtgcatatatataaaaattatatatatgtacatatatatagaatatacatacgtgtgtgtatatatagtatgtatagtagtactccgtaggataagagatcagac

SEQ ID NO: 65686 - DNA, 722 bp, Oryza sativa
acccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattac

SEQ ID NO: 65687 - DNA, 3495 bp, Oryza sativa
ccccccccccctcctaagtcaagagcatatttggaattgaaatatttatattttaaccttctttgtaagaaaatctattttacaaatagatctcatcgctaatccctctgcatctcgtctgctacggtttagggcgacaagggtatgtcactagcatcgagaaatatgtttattcctaaataaatttgtctatataattatctatttgaaaaaaaacgttattaaaagggtcaagacataaaataagaaaagatctggatccaacaagcttctctgtcagggacaccgcaacagcacgttaaacacttcctatcaactacttttgtccctaaaaattaaatatagtactcgctcctcgctctgtttcattataatacctccgattctaaatatattatgccgttgacttttttaaatatatttgattgttcatcttattaaaaaaatttaaataattattaattcttttcctatcatttgatccattattaaatatacttatatatatacatatagttttatatatttcacaaaagttttttaataagatgaatggtcaaacatgtgctaaaaagtcaacggtgtcaaatatttagaaacgaagggagtaagacgttttgacttcggtcaaagtcaaactgttttaagtttgactaagtttgtagacaaatatagtaatatttataatactaaattagtttcatcaaatcaataatttaatatattttcataataaatttgtcttgggtagaaaatgttattatttttttataaacttagtcaaacttaatattgtttgattttaaccaaagtcaaaacgttttataacctgaaactgaaacggaagggagtataagatattgtataacatattactaggaatcagtatatgagatcacatattaatacatagggcctgtttagatactttggcaaaaatttttactctgtcacatcgaatatttggacacatgcatggactattaaatataaacgaaagactaactaattacacagattgtgtgtaaattgcgtgacgaatcttttaaacctaattacgccatgatttgataatgtgatgctacagtaaacatttattagtggcggattaattaagcttaatacatctcacggtttacatacgagttctgtaatttattttgtgtactttaaatatgtgtccgtatatccgatgtgacacgataaaactttacccctatggatctaaacacagcctataatttgtaatttgtgcagcatcagcattcatctctttgtcgtctgcaagtcagcttctcccagtttgcaataaaatcagcgagttccgagatctgagcgacagagcaaccccaaacaatgacacttctggctatcaggattcgcattcgggccatccatggacgacatttcccgcatgcagcagcgtcagcgtggcaattgtccgagctgccatggctccacgtggtgcgcatgtacacactgtgcttgcaaatcaacgaggtggactttggggcatttaatccggcacgttaccgtctgcctccgttgagatctccgacaccgacaccgtgtgactgaccacagattctgcaagccacacagactctcaggctgtgtttacttcacgctaaaattgaaagcttgttgattaaaattaaaacgatatgatagaaaagctagaagtttacgtgtgtgtagaaaagttagaaaagtttttgatgtgatagaaaagttgaaagttaaaaaaaaaagtaagaaactaaacacggtgtcagtgacaccagtgcaggtctgcgtttgtggcagtcgatgtaagctcccagtccgatgcacctcgaccaaaccacacgacgatcacggagacttcgccgtttctgctgaagatatcgaagagatattgctgtcaccgagtatagatgattggcagatgcacttctcttgatccagacgcgcatgcgcgggtcaacacaaggttccatagatgattgggagtgtgcttagggcacccacaatggttatctatatgctctctataagagatccatgtcagcatattttcctacttggaagagattaaatgaagagagagagcaaaactatctactaacctggagatagtctatagagaaaaacgaggtaatggattagagagctataaatacccatgtagacatactattgaggtggtttactattaatctagtctattgctgagatgtacatgttttatagagagcaccttactttaccattgcgggtgctcttagagcaagttaatcgtatagccaactactatatctctaaatgatctataggtaatataatagtcaattcatacaacagttgcttactacactattaatatctagtcccacctatcatatactctctccgtcctataatatagcaacctagtacgggatagacatttcatattacaacgaatctggacaagatggtgtttacattcattgtaaggctgtgtttacttttctgaaattggggagaagtttggggaaagttggtagtttaggaaaaaaattgggagtttatgtgtgtaggaaagttttggatgtgatgaaaagttgggagttggggggaagtttggtgtgaactaaacacatcttaatattaaacgtctcatccgatactagattgctatattataggacggagggagtacacattatgtcttagagtccgtgctgcaactggctacatatctgtatcccactgctcctctctattattttatctctttaaaatatgtttatagctgatttatagtctactattgtacatgctcttacaaagcaccctcttcgttcttaaataaacaaatataatatcaaatatagacatgctcttacaaagcaccctcttcgttctattatttaatttttttttataatttgtatttttattgttagtagatgataaaacaagaatagcactttattcataactttttaaaaaaaattataatttttcaaataaaacgaatgatcaaatgtaatgttgaacatagaaacccatgactatacttaacttttgacgaagagagtatagtattgcttgaggagtatatataaaactatagtatttcaaccttcggttcaatttaattagggaactgccatcatatttagtttattacttcctttaattataagtatttaatgtttagcgcaagatttatccatattgtattcaagcaactttataaaaactattatgtttattacattatggtattattttttgaagaaaatttatgtgtgacaactttttgttcttaaactaagcattttgagaaattatcgatactcaaagctttaagattttgactaaatcattttttctaaacattaaatatgattaaagagagtcaatatagcagatccgctgatattgttaagcccggacgacgaagagcatttgctaggcagatcaataatttttcacacgtatggccaatataatatcataatagca

SEQ ID NO: 65688 - DNA, 581 bp, Oryza sativa
ggctacatgtcaaagaaataaaagatacatggatccttcaaaaaaaagcaacaggtagatttgcaatgtaggagtagtagcaatctccacccacacaacacacatctgaatgtgcatctatgcagtgatctcggatttggcattcttaacattttcttcatctttggttgatgccgctgctgctctgtcctgctctttcttctgcgcccttatcagtacacgtcttgcccggggacgcatctcacgcacttggcgtggtggcatcacaaaaggttcaagagggcgatcatggaatggatgctcatttccagaaaatatcctcagtttgcgatccctgtcctgtgatcagaacagtgcatgcttaataagcaacaacagcattatatgaagctttagcaatttgaagacgagaattgaaggaaaatatagatgttttaccacacaccagagaggaaaagacttgatttctcggacagaatagagttaaatcacataacaaagaaacaccatgaaagatcagtatacaactatcatgtggaacatgaaccaagaaggtatgattggatttacggtatgttgaa

SEQ ID NO: 65689 - DNA, 521 bp, Oryza sativa
tcctctcttttgcttattcctctcctcgccaaacctagctcatagtttattttcactttatggaaaagtaaaaacaatatattaatattgaaatttcttggatcccctagtacatgccctatggggcctatttataggttcatgtgccctagggttattaaatacatcaaaatttacatggttactcgtatgatatgagatatttatgatggtaattatgaacaaattagccttagggctcttcttgagctgctaagtgggccttcattgagtggttggccctttaaggctttgagtccttcggcttgggacaaatgtctttggctccacctggtgacttcgcccataacctctatctttgtgacagtcagcgctttaccgccgtgcttcgccctggcaattgtaaacctgtttctgtaggctcggtcaaaggccctcgtgacatgtctccaacaatatattttctggacatttaaatatttaatacaacttcatccatcagattgcaccaatgcctatac

SEQ ID NO: 65690 - DNA, 1169 bp, Oryza sativa
gctgccgtggccatcacggggtcgcgacgcgtggacgcgcgctggagagcggatggatttcacggcctttcatgcgtccgcgtcgcctctgcaaattttacagaaaagccctctcttttatagatattttgttatacgtcctctctgttcttttctcggtttaaaatattgcgtttaggccctttgcatcctacgaaattcaatacaaaggagacaaaaagaggaaaaaaggactgcgccctgaatcctagaaactgaagggcattttcgcaaaatttccttttctttctctctctctctccccttcgcgagaatcccaggcgcgtaaaaaaaaaaggaaaaaactcccagccgccatgcccctctcatctctctcgctctctcctgcgcggcgcctggatttggcttggccgtggccgccgctgggtgtcctcccagtgccgtggccgccgccgggtgtcctccctacgttgctgccattctccgctcgaaggggatcgatgttgtggatgggtggtgtcctcgcagcgccctcactgccggtgctctccttgctacgccgccgctgacgcagactcgaaggggaggctgtgggtgttggatgcggcagccgcgatttctttgccagcggatccgggggctcatcaatggcgtccacaccagcggtttttcctcagtggtgagctccagagggaaagggcaagctaacccaccctttctttcttcacaatttccctctctgtctgatccagatccaaagctgatggaaagttcgatttaggacattcagggttgtcgggtgtgttgagctcggtggtggcggcagtagcagcttggcggcgatgggagaatttacatgcaggagcccaaagcattgatgttttctgctcttccccaccacggtttgccgctgccatggatgctgttgactcctcacatgtcaaccacgactaggatcctggtgagtttggtgggcttttgtggctgcttgccaccctatccgtttgatttaggggctgttggaaggcccacctcaatttaccatagttttttttaccaaaggtgtggcaagatgcaaattgtgtggctcaaaatttgatggccacacttgtggcaaactttggctaagaaaatggtctatgactagtgggaccaaaagagtagaaagt

SEQ ID NO: 65691 - DNA, 656 bp, Oryza sativa
actgatccctaagctatacacaattatacatgggaagaaattaagaaatataggattgacctgaagtttagattccaggaatgagaggatgacagcaggaatgatacccttcaccccacctccatcaatactcagaattgtgatcatgtttcccttgcttggtggtgggcatgcacaattcttctccatggcagaggcaaacaagtcagctgttgatcacttgcaaatttctctctctggtggtctttctcaacaaaggagagctatttataggtgatgagggaaaagataactcaggatgaaaaaaaagtaaaatgttaactttgaaccacaagcaatgtttgcacgtattttacactcaagcattcagcatctgccaaactgctggcaagcttatccaagcttgttcatgcgttgtatgtatcttcttccaatggtccagtaagatatgaaagtctcatatcttcgaccatctacgtgttttgccacctttaaaacaccacttttatgttctaattttggctctagttgacaccccatatgagtacacacttttatgccctgcaagtcatgttaacaccaaatggaaactgacaatgcaagtaaacattcacacattctgtcacctgctccctcaccctgacctttaatgctct

SEQ ID NO: 65692 - DNA, 612 bp, Oryza sativa
ggctaaattgcgaagcgtgcagcacttttgcttcgctagctgcctctcctcaagtcgctgcgagtgcgagtccacacaacactgtgaactcccccctctcgagcaaaaaaaaagatccaaaattttttcgccctggggttcgaaatcttcgtgccttcctcctcctcgcggcctccaattcgaacgccccagttgctcgcgccgccgcggattccccagatcccacctcctccccagctcgcgcggcccaattcgaagccggttctagggtttcccggcacgaatttagggtttcgggggagcttcggggggtgttgttccttgttccgcctagggtttggaatttggggggcgtggagagatgggataaggagggtgttgggagggtgggagctttgcttggggtgtgtgtgtgtttgggtggtgctgagctgagctagggtttggtggtgaggtgctgaggaagggaggtggggggtggaaaatgttctactcgcagttcatcttggccaagaaggggccctcgggaccatatggatcgcggcgcatttggagcggaagctgcggaagaatcaggtcgcggatacggatatcggcgtctccgtaggtggg

SEQ ID NO: 65693 - DNA, 1147 bp, Oryza sativa
caactagagtatgttctggatactgaacagtgagtcgcagcaagaaaaaggaatataaaacagatatatgtgagcagcagtagaaaaattcagagcatcgagttcttagtgtaattccttaccttggaagaagtcctctagcatctggcatttctttgctataatagaacctgcttttttgggctttttgtcaaaaatcatccgcagcaagcgggcagcgacatcccgtttggaatttttcatccccaagagattgagaaacaggtcccgctggccatatgggtcgagcaaatgaatggatgagaccgtactgcagagccacatccgagcctcatacccacctccagactttataaccgacctgattataggctccaccttgccaagaagagatcgccttgcttttacagcatctgtatcaacactaccaccatctgtggtcccttgaaaaaagagttgaaccatcttcaagagagattttctacctcctgaaattgaaagttgcaaattgcaataacaatgtttcacattctccagtcctcattgaagtaacgcatataggtaacactaaaaccttagattgccaagtaaaattcaacatggatttaacttagccgagatttgatcccaacacctatttatctgttgaaacgtcataggtaattttaatcggaaaccctaaactgaaatgcaaaatttaaaagttcctggctaggaaaatagaaaccgaagcacaacaggtaccaactgagacctctacggcagcggggcaggttagcgtctctcacgattcacgaacacctccaggccgaccaagtcatggagaagaaggcgaggcggagatgggaggcgaggcggaagagcagcaaagaggaaggggcgacaaggaaaggccccctgcccgagaacggcgggaggatgtggcgtgaggaggaaggcggcggcggttgcggcggcggatcgagcaggcgaggagaggaaagcctcacaactcccccgagcaccacgatctctctccagctccaagaggactccgtgattgcgaccaaattctcgaccaatttgatgaacagattaggagcgcgacgcttaccagctgggcgcggcgggggttcccagttcccactagggcacgacgaggaagaga

SEQ ID NO: 65694 - DNA, 1516 bp, Oryza sativa
  unsure (1)..(1516): unsure at all n locations
cccctttttccgcaacatgcccacgcatcgatggagaaagaaaaccgcgacgcatcgggtgcccatatgaaatgaatgaatattccgccgccgctccagcttccggtgcaagccgcagcttggtgccaattttacggtgaggtgaccgttgctntccacagccccaacctccgcgcggcctcaaccctcacctgcggcgaggatcggtgctctactctagtagtagtactctagagtctagtctagtctactctagttgctgcgttcgctagcattcggaggcgatctgaggaggagaagtggggagcagcgaaggttttgatcttttggaaggagttggattcggctttctgggttctgtctgtcgcttgattccaattcggatttcttgctgttgttgttggggtgttcgcggccgatttgaccccggggaatcgctgcttttttatttttttgaaaagataattctacgcggattagatttggtcaagaagtcgtagtacgaacgcgaggtttgatcttggtttcgatccgaagggtctcggttggctgcgtgggaagggggaggaggaagaaggcgacctgctatctaatcctctaccccctctgctgcgaaaattctctgctgtttgctcaagcatcttgctgcttggagccttggatcgaagagagttttagttcttggagttctgagaattgtgttgcttgagccgaattcgatcccaaaaaggctcttttttgggaggctttgaggaggaagaagaacaacatgggggtgatgtcgcggcgggtgctgcctgccttgcacaacctctgctacttctgcccctcgctgccggcgcgctcgcgtcagcccgtcaagaggtacaagaagatcatcgcgaagatctaccagcttccaccggtatggcgattactgaatcctgtcttggcatttcagccatttctgatgcttagttgtagcctctgcgatttgggtctgtggtcaaatagttctagtttctgcgaattggagtctgtggtcaaatgtgtggagggagtttgttgattgagggtgtgatgttgttgctgtaggatggtgaaccgaatgataggaggattgggaagctctgtgattatgtctcgagaaatccgacgcggatacccaaggtaacacattttgatctcctctctgtttttactagaattgtcgcgcaatctgttagcttgaatagtttagactgaatttccagtatttctgaaagcagtctttataggtaccgagtagttaccacataatggctgatttacactgcattgctttagtgtgatggtgattccttttgccagagtacaaccgatcaactttcgctagcaccgatcactagctggaatgattttaggctgtttaagtaggacttaccgagatgaatgaatttgtggaactcggaactgattttatgtctgcagatcacagagtaccttgaggagaggtgctataaagatctgagacatgagaatttcaccttggccaaag

SEQ ID NO: 65695 - DNA, 3105 bp, Oryza sativa
cggagcgttcttcaggtatgtccttctcatcttaggattaaacatgttttatatgctattatggtttttagatactattgtttctattagcatattcatgtttatcaccatgctagaatcattctctattgggcatgtcatgtttatgttaaatttctagattaaaatttgcgtattatgactagatttccatcgggagaatttacatttttttccatcctcccaatatataacataaatattttcatgtgtacgtcattctcccaaattttcatgcccatttgccacccaagcccacatatgtcagcctcatcctccatttggaaaaatgggatgttggaccgtgatggatgaggctgacatgtaggcccaaatggtaaatatgcatgaaaatttgtgagttgtatcagggcatgagtattttggaaggatggtaaatactagtgtaaattctctcgatttggaacatacgtaccgcttgttcttgagacggtttcgaagattctcctcgtgagattcgctaacatcatattctccgaggcacacctgccggactatgtcggcgagaaggtcgccgacgtccgtccacctggacgcgtcgacccatgcgcgctcgcggaactggcggccggaccgactgtacaccgcccgtgcgagggtggtcttccccgatcctcggaacccgacgatggcgatcacccgcagctgctgcggcccgccgccggcaccggcctcatctagcagctggacgagatgctcgataggcttctccatgcccaccgggttcggctccacgtgaccgccgcggggagctgccgccgccagcgccggcgtggcagaggaatggccaccgccgccggcggcggcagcggcctcgacggcgttcctcaggcgtttggtctcatcttccaggcgcgtcttcagcttccggatctcggcggcgaaccggaggcgggtgcggagcgtggccacccaccgcgcggcgcggcggggccagctgggcgcgccggcgccgccgtggtcgtcgcgcggcgcgacgcggtggaggaagcgctcgatggagtcctccatgtcgtgcgtcagctcgcgcatgagctcggtgtacgccctcagcacggcggtcggcctctccgccgccggcgatgacgacgaccgccggagctggtcgtccatgaacgccgcgaggaggaggaggtcgttctgcatggaggcgctctcgtggcttaggtccctgagcatcttgtacctcgtgtcgagcacctccaggagcttccccacgacgcacttggtgaaggcggtcgccgccgattgctccatcgctggaagtgtggaacgtactacaactggtaagctatttcttactagcagtactatatagcatatactactatgaagtttgtattccttcgtttccccagttattgcactgttttcttttttacactaaaaagattccaactttatgaaaaaaaataaggtttttttccattgttcgagagctttatatatacctacccatattgtttgaaaggtaaaaacataaaaccggtttaactaattacattattagaagacaagtctataattaacaatagcgagacatttttaatctaggaggaatagagagctatatatattaatatatctcagaatgttagttacaaggtactcgctccgtcgcaaaatataacaatttttagtaggatgtgacatatactagtagtatgaatctggatagtctgttcagatgcgtcctatccactcaaaaaattactatattttaggacggagagagtatatatatgtacactacaccatgtaagtaaggtagcaggaggtaaaaacaatactgccgacttctatttatgtacacgaacgctgcaaatagatcgttaaaagtttatctcaggttgattgaaacttgtacttactgttatggctaagtaatatagatcgaatattataatacatatagtatacttcatatatatagaaatgaacgatgctctggtgctctctatcgatggtataatactaccaatagtattaagggtaaatcaaaaatttactaataaagtgattagggtaacattggcatttatgttttttcccggctatatcaatatgtggtcatccattacaatccattacactgacatcgatcatattccatcgaaagagacaaaaaagaaggaaaaaaatggttttttcactactaaatgacgattatacccctcctatcacacctggagtttccccttttccgtagattctaattcaccaataaattgactatagaaattactttggataactaggagaaaaccctaattaacaatgtatttaataatcggaaatgttagggagatttttttcgaattctcttgctccaaaatcattaacaggacttaaagcggaatattcagagcaacagaattgatgttgttaatttaaattatcaagatttgaattaataataaattttctccttgcctttggtcgtgaatcatgcctgattcactcctctcttcgtccgtggtttcgttttgcatgacgagccaagtccaatttcgtttccggtaccgtttcctttcctttccttaaacgtcgtcgttgcgtcgccggtactccattctccctctttattgatgtgttttccgccgcaaacatcaattcatctatttaatctattcagttgtttctcatctagcgtcgccgtcgatcacgtgtgttgccgccggaaccgccgccgccgccgtcatcatccctctccgggttccgttctccggtgaggttttcttctcgttttagggttaagctttttcgtgtgtcgccgtgtcgtgtgtagccactgccatgcgcgccgttgccctagtcactgctgagccgcagccgcccaaccgcgccgccgtcgccttgcccctgccacgcgccgagccgctgctgcagccgtcgctgccgcccctgagccgagccgagccgccaccacctagccgtgccgctgccgcggtcccgcgtcgtcgttgtggttttctcgctgcccatacctaccggcctatcgtttgctgtaccgagtcgttgccgctaatagtgcttagttgccgc

SEQ ID NO: 65696 - DNA, 2637 bp, Oryza sativa
  unsure (1)..(2637): unsure at all n locations
agttgaaccaccttctagacataatattattggaaacaagtgggttttcaaaaataaacaaaacgaggatggattgattgtgataaataaagctagacttgttgctcaaggatttacgcaggtggagggtttggattttgatgaaacttttgctcctgttacttgaattgaggcaattagacttttgctggcttttgctgcttcaaaaggttttaaattgtatcaaatggatgtaaaaagtacttttctaaatggttttatacaggaggaagtttatgtcaagcaaccaccaggttttgaaaatcttgattttcccaaccatgtttttaaattgtctaaagctttgtatggcttgaaacaagcacgtagagcatggtatgataggcttaagaactttttgcttgtgaaagattttacaatgggaaaggttgacaaaacactttttgttcttaagcatggtgataatcaactgttcgtttagatttatgtnatgatatcatctttggttgtcaactcacgctttggttgtggagtttgctgagactatgggtagtgaatttgagatgagcatgatgggtgagtttcattccttttgggattgcaaattaagaaaacacctcaaggtacatttgtgcatcgaacgaagtacacgaaagatcttttgagacggttcaagatggagaattgcaagccaatatcaacaccaactggttctacagctgtgttggatcctaatgaagatggtgaagctgctgatcagaaggagtacagaagtatgattggatctttgtttatacatatgatattttcttgtgtatgctagcaataatatgaaggtttatttgtctctagcatagcttgtatgtattctagtctttttaggaggcttagatattgcttttaaaggagatgatgcatgacacttaaattctatatttgaattaagaaaatatgcaatattgatgctagcatatggtttgatttataaatgctttatatatatatgctttattgaattgttattcctcaaatagctttgtaattgctcattgtgtaagataaaaatatttatgagtgagaaaaaaatgaataacgaatccttggaaacagtcttgacgacaaggacgtattcgatatgagcaaaaataatgggtgccgaatccttggaaacagtcttgacgacaaggacgtacccggaaaaaattgagaaaaaaaatatgagcaaaaaggctaaagtaaaataaaagataaaaattctcttggttgttttgtgctaaagctaatttgagaaatagtgataaatgcaataggtctatatgtttagtgtttatttttcaacctatgtgcttgttaagatgttgcattataaatcttatgaaatcatgaattttgattgttgatttgaacttaattgtaaaatctttgattcatgattatactttaatgcatgcttgctatattatagatgggttcatcttctttttattgcaactcatgacttgatatgctatatgtatgctaagctcttgaacattgacgaacataattcttatgcttgatgaaatcattgtcaaaagggggagaagcaaatgagagtttttgggagaagagaagaatttttgttggagagttgtttgagaagagcatgttttttggttcaaggggaatttctttcttttcaaaagtgagagaagttttctttcggattttgagcacgatgtgtacatttgtacgaagtgtgctttttaccactttttgtttttatttttccaaacaccaaaacatttttgatgggtttgccaatgtgttcatgaataaggagattgtaaaataaaagtgtttttaattgttattttgtgatgaacaattggcattggagattattggttttgatatttggaatttattttcgaagtggttttggagatgattggattttacaggtgatctacaggaactgctgtctgtgatttggtccggtcagaccgggctgtgtgtgccggtcagaccagcggtgatcgagcggtcagaccggccaacccgtggtctgaccggccgactctgtgttagtttcggtttcgggttatttatttggatatccatgattgtttcatatttatggcttctagatggatattatatgtatgtaatactgttgtttgctaacaatgagtcaagttggggatagcttggtcttgaaatatggtttctttgtttgattcatatgtaggtgacttgatgtctcgggagagtattgccggtgatggatcgggagtcggcttggggataagacgatgtccgtgacggtcagatatcatgtgggatacttaggctagagttcaatgcacgtggttggtgaatattcgatatgtcatacaatggaggtattgtgtgcgtatgggatgcggagtcgaatttggaaggagtccaaatttggtatgattggagtttgtaaagtttgtttcttgtacgggaaggtttcctatgtggattaggacttctagtatgagtttggtttgtggctttaggctgcctacctcatgtataaatagtgagggagcgtgaggcttcccggtatcgcttttgagagcattgagttaataggttagttaggggtttcgagtttagtcgagattt

SEQ ID NO: 65697 - DNA, 786 bp, Oryza sativa
aaacctgcgaaaaatacatgacatttgtaggcggcgatcaacaccacctacaagaaatcattttcacatacgacatctcaattttcataggcgcaacaaccacccgcctacgaaaatattcttcgcaaacaacaaaaaaaaaacaatccgcccaccacccccatctgccaccggcgtcgcttgctgtggccgacaccaccaccatcgcccctctgctggatctgggagggagggaggaggggagccgcaccgctgcctccggttagatctgggagggagggagggaggggggaagagagaggggaggggtcgtgccgcctcttccgctgccggcgccctcctcctccacctgctgaggccgccgccaccgtccttccccttcggccgaatctaggagggagggaggggaggggaggggaggggacgtgccacctctgccactgccagcaccctcctccctttgccggatctgggagggagggaggaaggggaggggtcgggccgtctgcgcctctgctggctcccaccccccctccgctggatctaggaggaggggaggggtcgcgccgcctcctccattgctgtctatggctgccacccgtggggggtctccgccactgcaagtgccctcgctcctccgtcaaatctaggagggagggagggagggaggggaggggccacgccgcctcctccgctactgtctgtggccgtcacccgggaggagccacgccggcacctgctgggaggaaggagtgaagggggagagggggatggagggggaggtct

SEQ ID NO: 65698 - DNA, 16581 bp, Oryza sativa
ctgggcacaggagcaagcaataacaggaagcgattgttgggagagcgaggtgtgtggtggtggagaaaggggcagatttgtacttcctgagctttttctctctccatttctttgggatataataaaataatgccacgagtgtactatagctaattaccggttttttttcagtagatacgcgttcttatggtgtcccacaactaattatacttttttggatgtcgtgtagcaaattttgccttttttagtggagaggggataagggccactgataaccgtaaaacatacaccgctacaaatacaaaatacattccttatcaaccacaacgaaaatataaatcttaagagcccctttgaatcaaaggaattacgaaggaattttacaggattgaaatcctataggaattcctatgtagccctttgattcaaaggattgaagttttctaaatccaacaaaattcctatggaatggctcatagtatataggttttggaggaaacttagcaagaggtccaacctcttggaaaaaaaaatcctttgagtctatctctttcatccgattcctgtgtttattatgtggtccaatcaaacgatcattcctatgtttttcctgtgttttacaatcctctattatacgcttacattcctgtcagaatcctatgccttttctattcttccgttttttcattctacgattcaaaggtgccctaagatgatttagggctcctttgaaacaaaggaaaaacggagtatgtgagttcctatggattcattcattgtagcagcctttgatttgtaggaattggtcataggaaaaccgaaggaaatattcattcgtcgctgattcaatgggagaaacacaggagtctgagctcatttttcacttgctttacgtaggatcgaagcaatcaagctcctaatgactttcttcactacagaagaacaagcaatgaatggtaatttgttttagctgcaatatatttattagaaatggaaaatggtcccaagttcttaagcaaatattcctatgtttttcctatactccattcaaacacatattcctatacatttcctatggctttacaatcctcttttttttttttgagaggacaatcctctattttacatgtgaatttctatcctattcctatgtttttcttattcctgtattttttcaatccaatgtttcaaaggggcccttaaagaatttcatcgtagtttattttctaaaattgacttttaaactgctgatatcacaaatataaagtttttattttataaattatttttaattgtttctttattttttctacagcatacctaaacaaccagagccgtagcttccattgtgtcagacgaacatggaacctaggcacaaatgtaatgcaccgggatgtcattttgtaatttctgcagttttcccgggagaatcatactagacaaaaatctacagatgctattatcatgtaggttatgcacgcaactttattactggagtagttagtagtttataaaggttaactccacatgttctcaaacgcggtctacctgcggaccagaattagcttgcatatattgtttttcttcggattaaaaacaatggaacaaatggtagaagtttttgatcttataggatctaaagatagcattgcagaccatagtaacatactaattataattacaatcaggatcctagctagatcatccaattcatcatcagaaatactgctagactgagacaatatttgaataatggataatgactcaagagatacaaagcagatatgcttcagctaatctaaaatctccaccatgtctggttaagtgcgaaatatagaaattagttggaggacttgggttttggtgcttctacttcttccgagagctcaagtgaaacggggcagtgatcacttccataaaatcctgcaaaaatggacgtcaatgaattgtaccatgacattaaacagcatattggcattaccatttactagggggaaacaaggaaatttgttcgattcattgcttgtagagaagatcatggaagttaccatgtaatagcttcaaggtgctggtgtttattactggcaggcatgcataaaatttcagttacaggtcaaatgtttatcactgaaccaagagcaaaagaggattccaaagggagcttctaaacttgcagattttttctattgtctgccatatctcctacagtctatttgcctacaacatggaactcaccaacacaaaattacagaaaaggtctactctacccccagaactagcatcaaagcgcaaggtgcaattactaccactactgcgacaaccagctctgtcctgttcacctgggttcatgtaactaattttcatggggttgaggtacctgtcgtattccatttgcactttaaattccaaaaaaccagtgtagtgtgctcacaagtcacaacatgggtcacaagttccgacaacatgcaatttgtattgtagtaatagtccagcatgtatttgcagttcgatgtctaatacagtaaaacaacattttagctaatcaggctcgacaagttatgttcctcaaaaaaagaaacaaaatgcataatattagttgcaaccagctgaagttaagcaagctgatgggataatataacatatgcgccaatctattttcaggaacaagattttcaaaatgatttggagtaaacaaaatttatgcaccacattaacaatgtacctcaacctttattaccatgtttgagagcatgacaccacactacatggcactgagctgtgacatgctagtaagtcccctccatggttgtctaatgcggcagctcagatggtgccaagtgatgtggcaacataccgtgccttggagttatgatggcagagtataacagctctcactaaatcactagtttcctaggataggagattaggagttacttacgaaatacttaggaagtactaagagatacagtatcagtatgttaagaacgtagagatagtagtgtgagagctgtgttgcctcccactattcagaccctttttgccctatccatggatcaacacttgggtctattcttagaacaaatttcattctggtctatttgaacaaagttttttaaaagggccaaatgtaaaaatgacgcttttatatacttgcgtatcacaatggaaagcatgataagcaatgttttaaccccataccttctagctctattccacgaccatgaatgtcacatgaaactatttggtccttcagtttttctgaaacaaggaaatagtcaattcgcattctcttccctcggtacctgtaggcatttttaaatcagttagtcttcatgggattccagttgtaatgaatcaaaagttagcccattagctaagatattaactagaaaagatttaacgaagatcatatttatcatcttgtgtaaggatcaagtttagattaccagagaaaaaaaaaagagaatcagctgacacaattttaactggaagtaggataacttttagataattttcacagttcaggtcatagtgcaaactaaactttctagaagaacatttatatatctgccaaacatacaggattatctttaagcctgtaagcccatttgaattgataaattgtaaactcaaactgttcagataaagaatatttgttcaagataacctttggtaaaatgcataccaatgaaggaatgtaataagatgacatatcaatgtcagatatggacatgctttgataatgcagcaataaaatctacgaaacaaacgaagactagcataataattgaaatctttcttacttgccaattggatgtccagaccaagaaaagccacaatccatgtccttctctttgtgcagatatctgtaagcatctaccagctttcctctgtaaattcaaataattactccatgaggtattaaaaaatttcaagcctagaagtatgtcttgttgcaatgaactaaggggatcctagatccaagcattgcttccttggtgcatgacatacctgtcatgtgcacaaagatacggaagaagatatttgccattatggccgtatgttatacatgcaactaattccttgatcaagtcacagatagcttcttactgtaagctgctggtgacatgatccactgggggcatcactgcgaacatggcttgaattttccttaacttattttctttcctccatgtcgaaggaaccgtatgccatgtgaggctttatttgcttcatattaagttcacagaatattgttagaaaagggttcacattatgctgcctgaactggttcctagtggttttcagcttaaataaggataggaaaaaagttgtcaactccaaaatcagttgaaaactcattccttaaccaaggtgtggtgagcacgtttgttaaagggagagataatgaatgttaatcatataccccaaataagtcctgtccagtttactttctgaacgtttagggcaacttttacatggttttggagttagaggacaagtttaaatctaaggtaagagctgaagatatttttttttcaaaagattataacttgagggtgacaatcttgcttgattacccagttacacatggcgaaataataagaggttggcatgttcctacccatacccaccagtaatttagtcagtgggccaaatgatacatgatctgtaaactgcaaaggcatattggggatatgatctgtaaacagaacaggcatactggcatagatgacctctacccatgcaggcagtagtaaaaaaagtctcaaggcttatgagcaattcaaacttggatcgctccatgcttgatttgagcatggccagccaaggtttgtacagcataacaagctctgagcttgaatagctcagcgtggcttgataattcgagtagtccacaattgtcaaggcctatagcaggtccctggcccccaaacatcaatgaacttcaaccttcccataatcccatctcataaaaattatcacatgttctgaagtcacagtatgtgcaacattgtgaccccatcggcaggttgagcatacatgtaagtgtgagcccatgaggccataatgcagagctgccaacgctgcaataagcctctctcatagccagatcttaagggatggcttaggtaggatgaggatgtgaataaaactatcactgaagattctctaaagttagctcaaggtgagtgtgagacatattcaacgagagcatgaaccatatctgtgatgactactagctagtagccaatatattatatatttttgactcaaatccataatggttgccagtgcactgtaaactacattacagatttaaatccattttaacaagatgggttggatcagaacatatcatcttttatggtctaaaacgttataaaaatgaaattaattcatgtagtgctaatatgtttttgacatcaagtttcaaaagatagtataagaaaagttgccaatgtagaaatgtatcagctttcacgtactgggacaatatattgccgaagcgccgcctctctgacagggtgaatcctggctgtccacaatcctgcagagtaggatgcaagagatttaattgcatcaaaaggctcaatagtgatccaataggacttctattttgtaacaggcagtatgccagctggtacaatagcacgtgaaaggcacatttaaatatatatcacattctcaagagcctaggcatatcagtattctaatggttgcctaggtaggctaggcagcgacctttttagaacagtgatgattcaagtaaaacatactactataatattgtggcactgatagaggacagaaacggattccttcacatgcattgatgttcttgtaactgaaatttgcatattcccagcccttcccaatattgaattggttgaagtggctccagccccacttgctggcgctggcagacgtgtgctcctctcgtgaggttgagcatgcctggtcgcgcagcgtgttcaggggtttttcttgacttaattgaatgccactggtcatcttaacccgctgctcgagtattcccattctgaccccctgaagtcctagtagaaccaaaacaaccactaataaaagaaagtctgcctctgagttggagaatgaagtgctagaaaagaaaaagaacgatttacaggttttcaataatgggagtgcacccaatgttcttaggaatagtagggatgtgctaataggatataacagctaacgcaggctgacactatcttttttagtcaactaaatgcacagtttacgagatgggacaattacattaaggaacaaccctaacatgcaactagaaatgaaaagcacaaactgtttaaggatcatttcaatgtggtgactacatacagttcctgagttgtaaaaagccatgaaaagtaataaatcactcctagtcacttgtaaatagaagacttgaatcagtagagtaatgttacctctttatttggagggatgtatccattgagtttagcactgctaaaaaaatcaggatggctaacatcgatttcttcatgactgaaatatttcaaatacaagcaaagtattagagctaaggctggtttatggaaggtgtcaagtagtggattattactattcatggtgtagcaaatatgagttccttagcaagtccatataaaatttgacagcttactcactttgagatctaatggaaatttcagtacatgaccagttccaaaaaaattctatatcaacaattacctgaagtccatctcctaaacatggaattttggtaaacctaatgaaaagtaaatccatagttttcacacattgtcggaccagtggattttacgagacattttaactattttatagatgatgtgagctaaatatactagacttcaataaaataattatatttcctgtggttgcattggaatttctaacatgttgcactgaaatcacaacatgtcaggactatcctgtggttgcattggaaaatataaaaatatattccatgccactaagtttgctcttgttcaactaatcttgaaatcatgatagcagacaggagtgcaggactgcagggtaacataattgcaatttgtaaataaaagaagaatataatatgaattattcgtcctgcactgattcaagcttcagaatacaaaaatacatatcacagctcattatatgtattttatggatataatatgctcaaatcagccttgacagaaaagaaaagaaaaactgttatcagttctgttgcctactagcttttttgtcaaaagtgtaaagattttgtcatgtatcggttttctgttacagtatgcctgaatcaaatctaaaaaatagtatgaagatgtagctatatgtccaaggaaaacaagataatcagtaactagtactacctgttataaataatattattaattacctgacattcaagtctccacaccagattaagggtttgtctacctgttgaacaaactccaacattcttttatcccatttccgtcttctttgaaatgaattttcctcttctttccatccattgtttggagcataagtgttcagcaagaggaacgattcgaattctgcaataataacacgcccatctggttcatgcttggaagctgaaaacaatacaaaagtggattcctaagaaagagtagcaatatgcgagaaagtaatgatgaaaccaaatgttaattcaaagttgcagtgcaacaagtttgttgacctggaactttctttttcattaaagttttgatgtgcattttcttccctgaacagtagttgggagcagccatactaaaacaatactacctccttcatttttgacttattttctagtcaaacatttttaagtttaaccaactttataaaaaaatatagcaatattttcaacacaaaacaaacatattatcaaaatatattcaatgtaatatttgatgaaactaatttcatgttgtagatgttgctaaatttttctataaacatggtcaaacataaagaagtttgactaggaaaaaaatcaaagcgacttataatatgaagcggagggagcatataggaacataataatataaattatactgagagtatgtacacaaatatccaacatatcaggaagaacaactcagaagttctagaacaatctagcagctgatgtggttatcaacaaaagaaaaacattctcaagcgtcacaacacttaagctaatcaggaataaaagccaccacggtaagtaaataattcatcatcttgggcaactctatattagtcaagagaaatcgtttccatctatgcttgttggtgaaatcttatgtgccgtatgatttgtagggtagatgaagagagacacactaacgttagaatgagactgatatggtcaccatggtgtgcatattaaagtagatcttgtattgagttattcacaccagagcaaagcacatggacactacaaaacacaccgataacgggagattgcctatgaaaggaaaatatgaagtcatgcatgcaactctgaacatacatgttctatccaagttgaatgacactttctttggttcaaacttcttctttataatcatagctgtgcctgcatatttggagtctgaaagagaccaccagacacgatagtctttaaaaggtggactcgacaaagcacgcagcactacctgcatggcatcgagatgtgatcttagaacaatttcttggagcacaacaaatgcaatatactaaacagtcatgaagggaccaaaaaaaagactgtagcttgccattcttgaaaatatcagtcagtatacatagaaacttggttgcttgcgaagtgtactacattcattacacatatatcaaatcttctagttttacaggggtcaatcttggaaaagatagcatcgcatgaagatacgaatcaagtttagaattcttaatttgatcttgatctgcctagtattatgaaaagcacgacaaatctaatattaacttctgcataaaagtcacagaaaatttcattaatcttttaatgcttgtattacctgcttttcatctcgtgatgagcttgtgtcatctttcagttgaccaggattttttggtgcccctttggaaccagctgctggcatccgcacttcctaacaaagaagtttagatactatcctagtaagacatttatgacatgtatacttaaaatgaagttgtaagtactgataaaaaaatcagacaaaagcaaaatagttgtgaccagctggatacaaaagaataagcaggcaactgaacattataaggacaaagaatgaaacattatgaggtttggaaagacaaaaagacgtcctcatgtcctatgtacttgagcgtcaagcccctgaggtagattccaaaaggatgtgcctaatataaatccaataaaactataggatatattgggatcacaagcataagagaaataagttgcaatgtgactaaagaagaggcagtgtgattaaagaagaggagctgccgaactggttcccatgaaacagtagaatagtatgtgaacctcaattttgttgtggttaacaccttatacagtgggcatagtggtaccaaagaaaagctcaatcattcaatatatcacgagttttcccatatcatgaattgaagatttaacttgaagagaacacttcacataccatatggtctacagtttgtcacagtccttgcctagatggagtacttgtgctagcatcacaagtggctaacaaaaaaaaaaaaaaactgggctatgaacactgacaacgagttcctagcaactccactcgcaagcaatgacacaactatcttcaaattgcatgtgaatacaacgcaatgcaagctctgtgaacatctggaaggacagaaccctgggaggaaaaacctcaatctctattaagatcgcacctcccttgtttaatctcccatgggtgaataacgaaaacgtacgctcccaacgtgctcgacgaaacgcccgtgagcgaccgcaaatctggcatatgccacattgctgcacaatcgcctaaaacccactcccatatccccacatccgcacagcactgcagattaaaccctagagggagcaaaagccggataaaaagaagaggcaaaagatcgcgcccaaaaccgaaaacccccgcccccgcgccgctcacctggacgcagatgacgtcggggtcgacgcgggagacgaactggcagaaggccggccagtcgctcttcatccggaggagcaggctgttggcgttccacgtcacgaacctccgcggttcctcctcgcggggagcgggaggagaatccccctccccgacggcgcaggcggccgcggcgggggcgtcgccgccgagggagtcggagtcggaggcggaggcggcggcggcggcggcgggcctcttcttcgccggggagccatccttgggcacgggctggaagaagcgcttcatcgcaacagctgccggcggcggccgctcctcgcgtcgcgtctttctgcgtgcggggctgcgccggcgtcgtacggggattagcgaaaacgttagtccgcccaggcccgttaggccgcgtagttaaaagctcacgtaatgggccgagtctgtccaacctcgtcaagttcttgggctttctttttttctttttcaaaaggaaataagttcaccggacgtccctcaactttacgtttagtttaactagcatccctaagccgcaataccagaaatcttcgccctccatctttgctaaaccgttcaagtgagttccttaacagtatggatggtgttttggatgatgtggcattcttgtcagttaagataaattaagagcctgtttggtagagctagttgggtctggagtgaagttgtggagttgcctaaactcagctccacatctctagttcattgtccatctccactatatcatctctttcgggatttctggagctgagtaggccagccaaacactttcagaggtacctcccattggagctggagtttggagctaggagttaggagttggagccctaccaaacaggcactttgtgagagagatccacttagttccactcctattttaggtggaggtaaaactgtttggttgagctgaagctggagctgtgctaaacagggcctaaaacacacatgtggggcccacgtgcaagtggattttcacctctcgcccctctcttcaccacctctctcctatcttcctcaggacctcgccgctggggtgatggcccacggccagagagctcatccacgggaggcggcaatggcggtgggaggtcggtgccaagggtgctccaggcggcctggtttgctcgttcttgccatctttcatattgtgattgagcttgtttttacccgatctacttgcatgcttaattaatatagttgatgaccttatatcttgcttagataccttgtttgtcaccttttgattcatatacattttgtttgtttgagctacaagttcatagctagtgttttattccattatccgccgaaccttttggttgagacagaaacttccaatcccctaccggaaattccgatttgaaccggaagttctcatcattctaatatgctataaagttgtgataatttttagaaacgactattcacccccctctaggcgacatcaaggtcctttcacccatgtttatagaaacaaatcctgaccagccaccaacattcttggtcttgaataggtgagtgcacttggtcttcaaactgatggggttggccgatgtagtgatgtctagccctgtgatcatgattatatccaagagcagtcatcggcctatggttgaacaagaaagcgtttaaggtgtctgaccaaaataggctgcagctgataacattggttcatctttcttcttatcggctagagatagagaaaggcattgagatattcctatttcttcccagtgactctgcttgcttgtagctactctgttataccactcaacccatttatcggcttgggatggccatgatctaaaggtcgtagacaaatgggctaggtttggattggtctacctaaaagggattctatttgtttctgagttgatgaatatagtgggatctgtatctccaattgggcccatgaaaaagtgatttgattctttcagacttgggactgctacctagggcgctaaatgctacagattgcaagagagggagattgaattgcaagaagacgcaagaattggaaagagtttgagctgatggggcttacctctggaaactctgcagttggcgggcttgacgagctcggggaggatgccattgaagttgcattgggaatcgccactgagagcgcatgtgcggtcaccggagaacgtgggaatcgccggagagatggggaaagtgattttgcttaggtggtgaaaacggaagtggatggcgtggaaattttaagcggtggttactatttaaaagcgcgcggttaacggccaatggcggataaacacttggggggcatgtgttaatgaccaaatttggtaatgcatggatcgtatttggaggtaaagacgaagcagatttggaggggattgtggtgacggttgaaaacatattacacatcggctggagaccgtatcggctaacactagtcggatagggatagccgatacagccgatatcgacaagatgggttacaaagtcattgtcggatttgattgaagggctacaggagtattgccaggcaaggattatgttcaaagaatggcaattgtatctattaattaggatattttagtagtttccttatagatatctttggtaagagtgtgcctaagtgacttgtttgtctgttagagctataatagaagtttgagtcgtgtccatatggaaattgttggtatttcttaacgacattactataaatataattcacagtaatggcgcagaaatacttttggtatattatggttacagagttcatccgcaagcgtacggataaatcattgtagcatttcacccgagagtattccaagggtatcttatttattttatcccgtgggaagatcatgtagagagaacttgactaataatttatatattacttgtgataatcatagtctacgcaggggttaagataatccaagggtagagtgacacacaagcattaagctactcgttctcatactaaattatctaagctaaatggtaagaaaaagaggaagataatctattcctatacttctagtatacatagtatacatacattctagttatttgatatactagctaataccctctatccgatgccctcctggtacttcgagaagccacccctgactgccgagttccttacgacagcatgtcatgaccatacaagcggggctaaaaacggaggagtaccctccctagggaattaacttaggacaatatacacgcgcggaggaatatccgtactgagctgtcaccattagcagcccacctctcatccgcagcatataaccccaaataatgatatcccttaatctagacaccacatctaaactaccaaatactactctaatatcatcgtcatgacatagagtaactgcatatgcaaatattatacccacaccaaagcatctcccagataagctagcagcatattcagtataacataaacataatgtaaagttggtattcatatactcggaaagtattttaataccacaaatgtataaagaagagtattctaataatagtacaaagcttacaaaagaggaaaggaaagctactagagccatacctgaactcctccgaagacttctggactcctggtttctactctattcctattccactagcttgagaatactaaactaacttgagagaatatgagaaagctcttgcttgaggtgtgtgagtgaagtgaagtgaggaggtccttttataggcaggtaatgacggttgtgacggttggaatggtcggtaataccctccgaccgtcattggggatcaatcccaaccatccagaagaagccctgcatccaacggcggcgagggaggttcggccaaaccccctggttcggccgaaccaggggccggcccaaccagcccaagttttggctggcggcctcctccgttgctccacttcgtagatgtggacccccgtttttataacagggatcaatcgtgtaaacagtaccatttccctggatcaagtagtctggtacacacgagttcatagctgaaataccaaatgcacacacacgagagtctagtgcgaattattacaacataagcccgcaggcattgtcttaaatcatcggaccgggcggtccggaatacatcccaaaagcagaaatagataaggcagcggaaataaggcagcggcacgccattgccacaggcaacgaccgtactaagacctactgagcgccatcgtcttcatcaccctcctggtaataggcatagggatcctccgaagcttcatctcccgcttctgattaagtttatatttgcaagggtgagtaccaaccgtactcagcaagccaccacatcaacaatgcatatgataggggtatttcaaaggatggctagggttcttttgcgcaaagcaaattttgtaattcttttcacaagcctaagacctagcattgactgatcaaattttagtaccagtgtttgtatttgaacaacgacggttctgtccaccatccattgtgatcccaaggatagcttcccgccattgagtcgtcatggttttctgaggacgcccaccttcccccttctcaggaagtggctccaacagcataaaaattcatcatgcaataacccatcccacactagataagaatttagagtctagccaagtgtaatacatgtcccggtgctcaataaccgcgagcacggctattcgaatagatttggtttactcacactgcagtggatgtacactttacccacattctgcgactgcccaacacatgagccttgtctcaacacatgagacgcgtcacggcaaagcttttcgataaccttgcattggcagtacccgctccatgaacttttcatcctcatgtactctaggcgtacacagtttctagcagtgagaggagttctggcgcacccggggagggaaaattcacacacatgtattaagttataattatgttcaactcatcacatggcagtcctaacaatggcgacaccattgtagagcccctgccttacacatcgagaaaccactatgcatggatactgcctccgctcggctatttactccgctaggtctatccccattcgagaagtgtggttgtacggggtcgtttcatgcttaacttcatggctcggtccttaattgaccggggacggtactagcctttcccggataccacccaaattcaccgtctgccccggtctaaaacaagtgtttagttttctttcctattttcacaaatcatgtcatcattatcatggcaatgtggcgctcatgtctccacatgccgcatctcaattaccttcccaaaggtaattgcccaagcatataatatttgacaaatatgagtatgcaatattctagtgtagcatttctaagcaagcatcataatcgactagggactcttacgtaatcatggttacaaggatttaaaggtgaacgataatcaaggcatggcataatcataaataggatgttcatcatcgcatgcaatcttatttgtaaacaaaaattaatttcgcaattgggatcaacgtgatcaaagaatagtgatgacttgccttgctcaaggtcttgcgggtcttggccttcactcggatccgcggcttcctcgggctctacaagtgcgtgcaaagaatcgatttgaattccattagaattcaaataaaatccaataaaaatcgaattgaaaaacgagcgcgagaggcgaatcctatatcaactatattattcgcgaagtgggattattcttcctcctaagatattttgtgattcgaaattacgtcttaagacttcatctaattatttagttctcaattccatctaaattactaccgcgaattgatcatttatagagattattaaaataatctataataatctataggaattcatctaattgtttagttcttaaatacatctatgattatagtattactttgcaaatactagattttagttaaccccataattaaattctaatattttaaatatcctaaatctccccctaatttttcctatttattttcccccctttttcctttctttcttttctcttcgttttttccttttcctttcttttctctcctcttttttctttttcctttcttttctcttctcttttttctttttcctttcttttctctccctcttctctccctcccggctcctttctccctctctctctcggctcccttgcccacccgggcggcggcggcggtggacgcgagggggggggggggcggcggcttaccgacggcggcgcaaggcgacggcgatgcccggcgcggcaacgagggcggcggtgcggcggcacaaaggcggcggcgcgacggcacggggacggcgacgcggtggagaggaaaagagaggaggaagaggggtgtggagtggggaataatggagaggggtgggggattttatagggaataggggaaaggg

SEQ ID NO: 65699 - DNA, 740 bp, Oryza sativa
gatggtttgggctagcccagcacacatgcatgacgtcatcaatggcggcagcccaacatctacagtacagcctaatactgttggagcccatgcggagagttcgagagctattgggaaacctgacttttccccaagtttatcccctcggtagagcagtggatttgggtgaagcaaggagaggtgcaaccaaagctagggttccctgcgagaggtgaggaagtccggtgatttggtagtggtgctcgccggatctggagagttccagagcgcaagcgcgaccatcgttcatacacagaggtggtgatggacaagcgccctccaaattcggccggagtggcaagtcaacaagcgaagggtgacggatccgattagaggtggagattaggggaaccgtgatgcgcgcgaagaggatgagcttcgacgccaacttctcgctcaaaatccaacggggaatctaggtgcaagatctcaagggcgtcaaggtggcgaggcagatcgtggtgcgagagcggcggatcgaggtgaggataaaatgcttcgagtgtgggcgtgaaggtcaccatcaggcaacgtgccctaaccctcacctctactactcctgtcacaatactggccatatctcttctcactgtccattgcttttgggaaagaagggtattaagctgtgtgggtttgggttccctgggcaaggtttttacagcctgcaagttgagatttctgatatagagtcggctagagct

SEQ ID NO: 65700 - DNA, 2563 bp, Oryza sativa
  unsure (1)..(2563): unsure at all n locations
agaagagaagagctactagagccatacccgaactctcctgaaggcttccggactccgatttctactctattcctattccactagcttaagaatactaaactaacttgaggtgtgtaagtgaagtgagaaggtgagctccttaaataggcaggtaatgacggttatggtggctggaaaggtcggtaataccctccaaccgccatagggaggaaatccacaccgtccatcgccaaccctgcatctagcggctacacggcgggtcggccgaaccaggggacgacccaatccagcccaatttcggctggcggcctcctcttctgttgctcacttcagacttgtgaattttggcaaaattcatcgtgtcatttctgagttcttggcccattcatacataagtccgatcctcgacatcgtccgattgatttatcgtctgatttgatgtcgattctccttcactttataggtattctctgtaaaaggttagtgaaccagatactagtggaatattattattctaacatgtatatgcattgcaagataactagttcttctctattttggtaatattgacggtcaaaacntgatcgctaacgacaatcaacaacaggtccgacccctaagcaaagagggggcagccgccactccaccccaggccggacccttcttggggaagtgccacgtgggtttgggggcggcctcctccctctaaacatgataccgccgggcccatatcacagacgcagtcagacttatataggtgtgttccttctaaaatgttatgtaggccaacatgtctactttatggtaaacattaaggtatgcaccaacttgccatatagatgaggagagaagtacatcaaagaaatgagcctctcctcctagctacccaatagcttatttcaacatcctaattcacgccatctctaaccatatacgataggttactactattgtgtaactcaaaagggtcttaaacccatctcactcgatgcactgcctatcacattttgcgatagtccctcaatgaactgatctgctagatttttagcaatctggacatatggctgcgttcgaatctccaacaaaagttggatgaaaactttgatattcatatcatgcttttcaaaatattaaatggtgtgtttcatgcgaaaacattctatgtggaagttgctctaaaatatcatataaatctattttctaagtttgtaataattaaaacttaattaatcgtacgttaataccacattgttatgcgtaaaacacttcatcttcatttacatgagtttcaaacacatagtctaattctatcactccgaagtattttaggattctcatagacttcaatcttctttttatatgtctgtatgactttatgttgtcctttaaactgttcaccttaataatcgtcatttgattatcacggttcataagtcactggtttttcaaccacggttaatccatcggaggcccatgaagtactcgatctcaatagtggcagtgctacgtcaaattattttgatttaatgactgaccctcaatcgttcgcaagttgttatacgttgcacacgtgtataccgtgagcgcaacttatccattttttttgtttaaccacattttaattttctctctttaattaggtatctaattgttcttgacgacatcagcatggagcagtggaatgccatagaatcgatatttgagaacaatggtagaggcagcagggtaatcgtgacgacggccatcctctcggtcgccaacagttgcacggcctacaagtccggagccaacggcggatgctgcatccgtcgccatggctgcgtctacaagatgcagactctcggagaagcgcacgccaaggagctcgccctcggcggcggcagcgatcagcgaccgccggagctggagcacggctcggcgacgcttatggcgaagtgcgacggcctcccgctcgccctcgtcagcgtcgccaaccacctgcggtgcctgggcaatctcacggggcggcactggccgacctgtgccacctcctcggctccctcctgctcgacgagcgcaacgtcccgaggctcgccgggacggccgccgccgccgacagcttcgcgaggctccgccgggttctgatggacagctacgcgggcctccctgactacgccgccaggacctgcctgctgtacctggccgtcttccccaacgacggccgccgcctcaagaggagcgtgctcgtccggcggtggctggccgaagggtacgcgcgcggcggcgaggacgtgcttggcaacagcaccgacgtggacgtcgccgacggccacttcaggtcgttcgtcgaccagagcatcatcgtcgcccaccctgccgacgacgacgacgacgacgaccaccgcacgaggaggtgcaggactcacggcatcgtgcacgagttcgtcctgcacaagtccatcgccgagagcttcatcttctcctcccgtgctcctccgaggcgcaagagagtccgccacctctccatccaaggcggcggcgggaacaccacgacggcggcgctgagcacgacggacctgtcttg

SEQ ID NO: 65701 - DNA, 6829 bp, Oryza sativa
ggcacatgaggaagctgatcaaggtcaagatatggtgcgagttcggaggagaagaatccgacagtgtctcgacgacggcgacggatcacctcgccgacgctatcaggagctacatcgaggcacccaaggttgaagagaccgacgcacgctcgctgtcaatcgacatggagcaatgctcgaagcagctgatcaggtcatgtcatggagagagtaagctcctgcactccctgaagcctccatgccgcagctacctcacctcgctgaagcttcatggcgacctgttccggctgcacgggctcatctccatgctcaagaacctctacgagctctgcctctcgtcgacgacgacgaccctgaccagggatctcgtatcagccatcggcggattgcctcttcttcttcgcctcaagctggtggcgaatcacatcgagcatttcgccataggagccggggagttcagaagcttgcaacacctgctcctcgtggtgcatcgtcagaatcccatcctgctgccaaagatcgaggagggagcactgcctcagctcgtctctctcgagctgctctgcaagcatctgcgcggcctctccgggatccagatcagacacctccagcgtctcaaggaggtcgcactcgattctcgagtgagcgagggcacgaagcgagagtgggaggcagaggccaggaggcatccgaacaggcccagcatcttgctcctgaagaacagttacagtactgtcctgcctgacgacactgacagattggatgatcagatggacggggagcttgctcgggagaaatctgcacctgatgatgatgctggcaaccaggagcagattgcggaggtggaatcagaaagcagtgcatttcaattggcgaattccactatgaataattcagtcgctggaaaggaatcaacagctgatgatgctgatgaagaaggattgggaagcactaatgcagtgcccatggagcagataaattctactggctccatcaatgagaccgaggtctccaatagagggaaattcacaatgtcatattttgaggactgctgtccctaccatgaggtaataaactataaatttggcacatattatgtgaattcaactgcatttgagatattatttaattaaggttagagtttcaagatttgatcaaactttttacataacacaacttttaaaactaatgacggaaaaaatgttcaaacaactcgttagaattataataccatacaaaatatttctcaaaacacgtgattatgcaagtttataaaatatgatttccctcctaaaagcttgggttaattggatccatgccattataaattcttctgttttgaaatataccattaatatttacctatttgaagtcatgccattataactttataggtatttgaaatatgccactatataccctttcaacacacttaacaaaaactttagaccaaattgcccttatcttctttctttttcttctcccagctttcctgttcatcttcttctccctttcttccccttctgcatctggcagcttgacttcttccttcccatctctctcattttctactggtgaaccttggccaagggcactctccaacttcactctgacgccatcctccgaacccagtgagaaggaaataaacaggcattgagggccggatcggggcagtatcatggctcggcgtgggcgctgtgaagcgcgacgaggcatgggcatagtgctggcgttgcagcggctcgcatgggaagagtggttggtgcagacttaccgtggctgaggagatcagtggacagtgggtgggtaggcatgggctttggtctatccatggcagcagagatgaacatgagagattgggagaagaaaagaaagaagatgagggcaatttggtctaaagtttttgtcaagtgtgttgaaaggtatatagtggtatatttcaaatacttataaagttataatgtcatgacttcaaataggtaaatattaatggtatatttcaaaacatgaaaatttataatggcatgaatccaattcaatttcttatatgaccctcgttctctcttctctgaatgatatatacatgggtctagagcccatatgtgtgtcattgagacaacatggacaaattaagattagtttgagattgacaggagcaaataagaatgatcaatatataatatgtttgatttttaatgatttttgatgtcccacttaaccatatttgtttattataataaatttataaagtataatatatttatgatcagattatggacgtaccttttgagctagaaatatgcatacagtttctatgctatgatcagattatgaaagtaccttttgagctagaaatatgcatacaatttttatgttttcaaatgaagtattttgtattcataggtatagtcaatatttgaaaagcttgactagatatcgttcaaacttcaaaacatcatatatttatgaccataggagttgcatagatcaaataaaaatatttgaacggttctgatattaaaatattttaagctttacatgaaacgtgatcaaaacaacgtggttttgtgtctggagggacacgtggtaatgtaatgtgggctaattgtggtctgttgctacttgcaggactagagacttgtagtacctaaatgctacaaagaatactacagtttcgtgacacaacggaatgctactgtagtacctccgaatatttgacgccattgacttttttaaatatatttgaccattcatcttattcaaaaacttttgtgaaatatgtaaaactatatatatatacataaaaatatatttaacaataaatcaaatgatagaaaaaaattaataattacttatattttttttaataagacgaacggtcagcatatttaaaaaagtcaactacgtcaaatattttgggacggaaggagtattatggtgtgggtttcagactttttagttgtttctcaagatatgcatcattccatactgcggctatatgcatggtttgagttttagctattccttcaagtattctatttaccctggtcatgtgttaataaggctacatatgttactcacgatttgtaaattaaacaggtttagtccttcctcagtataatatccatgcatattccattgttcttcaaattgcatgcgaatacaatgcaatgcatgctctgagaacatctagaaggacaaaatgctctgagaagaagttctccctgactcccccgggtgaataacgaaatcgtacgccccaacctgctcagtgaaatgcgcgtgagcaaccgcagttgtggaatgtcacattgcagcatactcgcctaaagcttactcccccacatctgtacaacacaatactgtagattaaaccctagggggaggcgaagacctcgcccaaaaaacgaaacccaaaccgcgggccgccgctcacttggacacaaatgacactgctggagaaaggctcattactacaggttgacaaccctttttagtcccggttataccactcacacacacagacacaaacacaagttgttcccatgtttctatcgtaaacactaagggagaaataaacttacgtaagatttatattatagaataaatgagatatatatataaatttggacatatacctaccagaaagttcgtcctcacagacagtttttccttgaatttcccgcggacgtttttatggaatcatgcctgcatttccaaactacaactaatgaagcttgatgcacatagtagcaatagaatcaaccataatgacaatgggatggatgacattacctattaatcatttcaatgattgagttgaaagtttccctgggtttctgcatagagtctaggatatagatcatgctctagaatgtgcatattgcgtgaaacaattaacatatcattgtatgaatacgagaaagaaattagtacagaaggcggtaaaaactcactttgtgttgtatgtaaagagtatgaatctctactacttaaaaagttcgtagtggtggtcttgattcctgatacaacaaacatatatgacagacacgcgtaatctcaaccatccgattggccatatccaacggcgtcaatctcctccccatcacgcgattgctcttccctcgatcgatctcctccccacgcccactcctccttcccccacgccgcgtccttcgccctcctccctgcgtcgcctcctcgctctgccgccgcgtcttccctcccactactcgcgccaccaccggcccctcagccccgctgccgctccttcccttccgctcctttccctcccctcaccaccagcgctgccaccgatccccgccgttggaaaccctcccgtcgataggtcgccgccgacgccgatctctcccgccaccgtcgcccaccgtctccctactccgcaggtctccgacgcgccgcagacggatttccacgccgaccggtcaccaccgacgccgtcttctccctacttcaccgcaggtagttccattgcttccgctcccaccttcctcttctctgatttttatgtggtagtggtagctaggtcttttatctacacttcccctgcttttttttgttcttgctgctagatgagcggattgatcagaacgcaccgatccatcatctcgtgatttttcttaacctttccgtgacctgcaccgttgtggcagcaggacctccactgtgcgtccgccgtggcagcagccaattcctctggacgctcttcttctggcccgccgtcccgaccagctcaggcatgtatacaacagcccagacctgctcacggagcccgccgtcgggaaaggccacgtctcggcgtaagacacaggggtgtaggtcgtgcgatggtggcatggcggccggggaccggttcccgaccctatgcggcgtcttcccggatgtcttcaggcttcagcaacaggttatgtgacacgtcactgccgccgcccttacaccgacagtttcctcaccgtcggcgcctacgagcttgtaacggggcgtgtccaatcgtcgtcggcgcggtgggctccttcctgaggctctgctccatcgtgtactgcctcctcattggcttctgcagctacgagatgtgtacagctccggctagctcaacatcgccaggcgccagcaacaacggcggcggtggcatctctacaggaactttcttttgcatgacgtctgaaggtgagcactccaatgaccaatcacatgaagtctgatgcactaaattaaaattacgacatatacatttcattaacagtctgtaacagattcccaggggcactgatctatgaacaaatttacattttcagtttcaggtgaagcacaaagaaagctgctcttcatttggtttaaagatatacatttctcttgtagtgatccaacacaaattcagcagttccctaccttggttaacctgaatgcttcactcttgagagatgtatatgttgctaaaatatgcctgataaaaagaagtcagtaaacttacccccattctcatgcatataccatcattaaaaaatattaccgtagcgttagcacgggcacattactagtgtcttataacgttgttgcgctaggaatctgtaaatgttatccactgtttcccttgcactgttccatgcagtcatctcattaattatataggggtccatatgaacccaaccatgaaatagccatgctttgggcaattttgaatcttcattgaacaacgcaaaaaaagaagacgtgagttatctgcactcggcgaatattcaatgttacatacgacgggctaaggaatgaaataaaattaggcctaaaagattccgggtagaagctaaaagcgactaggttcattatatctaagtcacgatcaacttctaacggatcttggaaaactttaaacaatggccatttacattaaagatgttaccttcgtcgtctcgcagcgtgacggctccatgtgatgaaacatcgacgacggtatatggatccattcatttactttgaagtttcctatgtccgaaaagcttcacccgtgagttgaacaacagcacctcgtcccctgccttgaactccttgtgcttgatccgcttatcatgccatcttttggttatatctttatagatcttggcattattgtggtaggccttgtccctccattccttcagctcagagagctgcatcttcctgtgctatcggctccctttaagtccatgttccaagtccggatagcccagtgcgccctgtgttccaactctaccggaaggtgagaagtcttcccgtagacaagttggttgctaacatgccagggtgtcttataagcagccctatatgcccaaagtgcatcaggtagcttgttcttccatgccttcccatctcattaacagtcttctgcagaatattcttgatctgtttgttcactactacaaaaaccttcataggtaccggccttataggtgccggttcatttaaaaccgacacctataggccctttcccacgtccgcaagatgaaaaaaataaagaaccgacacctttacgaagtataggtgccggttcattagttaaaatcggtaccaatactataggtattggttttttaaatagaaccggcacctataatatattataggtaccggttctgtataaaaccggcacctatacaaatcgagccgacctgggcgagccgagccaatcgatctgacagtgcgtcgtcgctatccttatccttatccacgcagaccacgcgctctcctccagacctccaccgcgccttcccctcgccccctctgttcttttgcgcgccctcccgctctccctctcctccgccgcgccctccccctc

SEQ ID NO: 65702 - DNA, 1301 bp, Oryza sativa
gcatggaaagatatttttccatgcggtcccttaagccgcccgcatgcgatgatctgcgcctatatatagggagcgcggggagccaaaattttttaagtcccggctcccgcgaaaccctagctgcaaggctgccaaaatttcccaagtcgcggtcgccgtcgtccccgccaccgccggctcctccccaaagtcgccccgccccacgccgccgccgccgccgccgtcaggacctctcccccctcgccgttgccgtcgccgccgccaggacctctcccccctcgccgtcgccgtcgccgccgccaggtcgccgtcgccaccgcacggaactctcccccctcgccgttgccatcgccgccgccaggtcgtccccgccaccaagtcgtccccgctaccgccggctcctccccgaagtcgccccgcccctcgccgtcgccgacgccactgccaggacctctcccccctcgccgtcgccgtcgccgccgccaggtcgccatcgccgccgcacggacctctcccccctcgccgttgccatcgccgccgccaggtcgtccccgccgccaggtcgtccccgccgtcgctcggtaacatttacttttaaaaaaagaaatgtgaaatgtgcaattgtggattgtggattgtttaattgtgcatcgtggattgtgatatgtgcaattgtggattgtttaattttgagaaggtttaattgtggattgttaaatggagatttatgtttaaattgggacttatgtttaaattgggacttatgttaaattgggatttatgtataattgggacttttgttaaattgagatttatgtataattgggacttttgttaaattggcacctatgttaaattgtgacttatgtttaagttgagacttatgttatattgggatttatgtataattgtgatgtttgtttgtagcgcccgttccgtcgtggcgcctagcgggaaaattatctccgaaaaatcctaattgcgaaatttgtttctttgattgttgtctagtgtccgtgccatctcaagatctcaattcccgatctatcatcgagttcaattccgaatccaattccttccaaatcgaatccctccgcaaaagtctagtttgcctcccccgggttcgatgggccgaattccgctcggcccatctcttccccggccctctctctcccgggcgctctctctctctctctctctctccccctctccccggccctctcccctccccggcgtgctccgctctccctccccccgctcagctccgctccgcctcgcccgcgcgccgcgcgcgcgtgcgc

SEQ ID NO: 65703 - DNA, 5052 bp, Oryza sativa
cacatcttgtcagactcccagaagtcagtactagcggcccaagatgaagtgcaatcctggttatctgccgatgtgcctgaaacttatgagtatggcaagccattcttgccaacttatcttatgaacaagctaccatgggaaatgagggtaatgcacgaatggtatatgaaggcatctaggaaaggtctcggtttcataagcgtcgccgtcccggaaggcgctttcatgagtggtcctaatgggatattttttatctctttccaagacctttacgccctctacaagctagataaaatggacgttaatctcgttgcggctttctgtctgtaagtctgaactctttattacatgttgcacgtttcattcgaaacaaataaaccaaatctcatttcttctttattcattgtacagtatgcaattccacgaagctgatagaactggagcaaaggttggatacgtcgatccaacaagaatatgcaaaacacaacacaccgtagagctgagacaggactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctccaataagcctatcttatatgtaaagaccactacatattattccttgtatatccgaaagaccaattgattatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagaagttatccgtcaggactggctggccggtactatcaaatttataccaatacaactaattatcgaacagtacatatatactaaatatatctactgagatcggtccccataattatatcgcagtgctacaaacaaccaccaggaaccaacttgtgtggttattacgtgtgcgagatgctcagagtaaatgggaggtacaaaacaaccagtaaccgagtaggtcatcgaactcttctctacaaagaaacccatctcgcacacacttctcactgagtaccgttttattttcctttctgtgtgcagatccccgaaatcccatatattgcacaacgattcaaccacactactatcttgaacgtggccgctgacctctgtcgattcatccgtcgcgatgtctgcaacgcaagaggtctcttctacgacaaccagagtgaactcgcaatggacgacaaatttaaacctctcagagagtgggagaaagaacatatgcaataacatgtacactacttatacatatgatgaaaaaactgtgccacttgtattatatatttgtatgtaaattacgattgaattaatggttatgtattacatgtttgttactgcggcacttgtcttatcttatatacttactactccgaaatacgataataaatccctcaataatttaatattaattacgaatcaccaaaatgctagaataaatattattttagctattcggaaattgaatttcgcatgcggtctacttaagacgcccgcatgcgaaaatagatcttcgcatgcggtcttcttaggtcgaccgcatgggaaaatatatcttcgcatgcggcttcttatatggaccgcatgcgaagatctattttcgcatgcggccgtcttaagtgaccgcatgcgaagatcgatcttcgcatgcggctgcgacggccgcatgcgcaaatggtgatctttgcagaccatttcgcgcatgcgggccggccaaccgcatgtgaagatcgattccgcccgtatgcaaaaacgctttctgtagtagtgcaagccgagcaggcaaacctcggttgggtcgtagccgccgccgtttagtttctaggcgagtcgactccacgaagacaaaggccgcgcgcgcgagagtcgtcgtacgtcatggacaaacggttttcagtcctcttcatgttcacaatcacgtgacaaattcttccatagtatgggtaaggagtatgtttctttctcaaccacaaggtaactttatagatcaggagagacattttttcactctctcccagttacaatctgttatttttggtacgtactaattaattaattaaccataattatggaacacacaagttcgctccaatccaagctagcttgcccttattttaatttggagatgcactttattatatatagtgacacacgtgcggtcttcatcacctcaaccgtagaattattacaccctgcaaaccacacacacatcgatcgaacaaattaattaggaacagcattattcagtcgtcgtctgatacttatataacagcagcagagagaaacaaattagaggatttatatagagaagttgatgagtgacgtactgttggtagtcgatgaagaccttgccggcgtcggggttggcgatgatggcgaaggcctcctgcgagaggtcgatggtgcccgcgcagccggaggggcagtggtcgacgatcttcacggtgacgctctgcccggtgcacggctgcggcacgccctggttggtcgggcccgtgcacgtcaccacgtactgctgcccgcacgccgccccgccgttccagaacacgtcgctcgccgccgcgatcatcgtcccctggtcctcgaacccgtagcacgccgacgctgcatatatacattgatttaacacacatctctcttatcaattttacttcacgtatggatgatcgacgaatgaaatatgtagaaaatttactgtacgtacgagtgtaagggggcgtgtagaaggtcgcagtgccagagtccgcagcgaccagcgacaccattgcaagcgctaccacggctgcaatgacaaccgaagtgatcaccttagccatcgtcgtcatcgcgatcaattcgatcgatcaggtgtaatctctgggagtctgaaagatatattaattcttgcaggagagatgcagcgaactgaagctgacttgcagggttcagtttgcaccggccgttttatagacaaaggttgcgtaggaaaacacgcaatggcgggccgtgtttccaacgtcgccgctgcatgtacagggcgcaaacctgagatatcttccaatacggacgcacgctagggaactccaaaccaagaagatccacaaaaaacacacattgacacgagaatcgatcataattactcgatatcttctcgcttgttcgtggaccgattgcacgcagtttactgttgcctgtggaatactcctggaagtccgcgaatacgaccggcgaccggtgctatacgcgcgcgcgcggctcacctcgtgttgaagcttgcacatgaacgtccttgtagtgtgtcaccgcacgctagctagttctccgcgaaactaacacggcgcagcctgctcagttgtctgacgcgcgcggcccggcggcgagagaggagacagccaccgaacggtgatatgattaccaactggggccaagtgcccggccgtccgttcgatcgactgtgtgtttggcgccgccgtacgtagaaatcgatcgcgcgcgcggctctccgagtccgaggtccaaaggcagccgcgatgcgagcgtgtgctgcacgacacggccgctcgaggctgctgcacggacgggccgtaggtcttcagcgcgcgcggccggaaggcttcgctgctatgagtaggccacgtcacgtacagagcggtctgaaagcctagcaaagctgcaagggacgacgggacgacgagtggtggtattgaatgggaatatccagtttgattcgttcaaatataagtccaatctggttcaaattctttacatatttttaacctagctccaactattaaaatcggtacaaaataactcccttggtggtatttagggtggttttaattaaggctgtgaactcacctcccgcgtacgtaaaacggagcgacaaatatctatctaataaggactaatatttatccacggggataaatatgtacattcaaggtctttgtaatctatctctcaatcaatacatctcttggcatatcaccaccctcttttccaaggtttttatcactggcggaacttagcacttgacgcagggttgcatcgtttcgatctccagcgaaggggtaagtcctaagttatgttggccctgataattgtataggctatatgacattgttcaagactgcgtctcttcgatctcttcgattgttctgatttggttggtatatttgtctacatgatatttcaattctatgtttaattgcattgtgtttaaagatacatcggtttagctgggactatctcggttaggtccgatcttatgtcttagcagatatatctttacaatcataatgatgttttaaatagattttttatattcatcactttaatatgatttatcgactttactagtttattaggtttatttgttgatgtaaacttatgcatcggtttggtccgacctattagttaggtttactgttgattaatagatctaatctagctagcctggtaactcacgtatattgttttatcggaatgctagcagataagttatctttacatcgatcttccaaccgatgtattctttaaccatcgagcctacgtttaatattttgtttcaatattgtccgattggttcattggacatctacttcatcatattatcatcggtcgattggattgtttattcaagttcttccattatttttatctacatgtcagaatctacatcgaatatatagccgattaaccctattgacatgggctaatatcgctacatcggcttattgacccatggactctttgattattagtttatctatcttgtcaattgcagaatcaaactgactggtacgtgcatacctc

SEQ ID NO: 65704 - DNA, 6544 bp, Oryza sativa
cccgttcaatctagtagagctgtttgtactacttgagttatcgacactgcaatctactgcaatctactcaagcaattgcctaaaattgctcccgttcaatggcatttatttgaattctgactaataatcgttgagttatgtgggttcattggacacatttgaaggaacaagaatggcagttattttcttgatagctgaaaacatgtaaagtttaagatcacataatgtatgttcatgcaactattgcagtagatgaactaatgctatttattactaaaattttattgtaggatccctagatgactctttaatttaattgtttcacttcaattatatgattgcacgctggaatcagacatgctaatttgattgtctttcaacagtgtgatttgcagcttggatttggtgttcagaaaccacagatgtatcctaccttcgaggagcagctgaggatggcctcagctggagctccacagtttgggactatgaacaggcataatcatgtacctgtacccgaaccaacactgatgttaggttatgcgccgcacattggcagctgccctcctgtccagttaggatgggacatgtccatgtcaaagatggttggcgggtgtgtgctccagtcgtccatgtgtgtatggtgcaacactcagttccagcattttggcaccgttgccgatcagcaggctgattcacttggcttcatctgtccggcgtgcaaggagaaaatctctggtcatcttagcatgctcaacaacagttcatcacagctttagcattcagtttcggtcgctcatttgatcttgcagcccgatctggcactgaaagcgattgttctcccgtttatccagaacaactaacttgtccacctctaggttctagataccctgcctcaaaattgcacggttatttatgtaggaattgttatgtatgtatccgtttgactttatgcaatgcatgaactcttcgagaaataacacttttaacactacaaacgtttaacatgttaaacaatggttatcgtaccattggttttcatatccgagcaatttatgaacacgaatgtaagtgtagaaagaactcctttccatttggtgtttgttttcaaacttcagcaagatcaggcctacagttgcaagagaacctgatctgattcccttttctttcattctgcttgatagtgccagatgttttgccaacatgcatcagacaactgagacaaactgttcatgaggcatccattgtgaatcacaaattaattgtggatttccaataaatgcctgatatactagtacaagcattttctgtattacaagtgtttgattagtaagggtctgtttggcactgctccagctcctcctggagttcagccaaacagtttcagctccactaaaactgggagtggagttgggtggagctctattacaaaatgtactagagttgtgaagctggatttaagcagctctataactccactccagacttaactcctggagttatatttaggagacttaactcctgaagttatatttaggagttggagcggtaccaaacagtcactaatactccaaaactagattacttgaatttaaatctaatgtctcagacgtatggtttcttctcaaccacagtggaatcgaggcatcctttattcttcccttaaatccatcttatgctactgatgaccagaaggacacacgttcgcttgccttcaagccatcctgattttgatcttagaccctgcaaatgagcacagcttatcgtgaataaatctgataagaaaaaatcatcctaaaatgaaaatgaggcgtaaaattaagttacagtctataactatgatgatcacgtactcgtggtattcgacgaggatcttgccggcgtcggggttggcgatggcggcgaaggcctcctgcgagaggtcgatggtgccacggcaccccgcggggcagtagtcgacgatcttgacggtgacgctccggccggtgcacggctgcggcaccccctggttcgtcgcgccggtgcaggtcaccgccagccgcttcccgcacgccgcgccgccgttccagaacacgtcgctcgccgccgcggtcatcgtcccctgctcctggaacccgaagcacgccgacgctgcacgcatgcacggccagccaaaatgttataagctcgcacgataattaaagctactgaattacagacaaatgttatacacgcggtttaatcagtagtaaaaaaatatatatctctctgaagaatgaaatgcaactggacagtggacacatgccctcccttctgagaaagaaaaaaaatatatctactatatatctatgcagcattgcgtgttttcgtttacaggttggagaaattttagtttcagaggagtattaaggatcgataagaagctcaacgtgtgtaaggaggcgtgtagaaagtcgcagtccctgaactccctgcgaccagcgagaccatggcaaggctcactacaatcgccacaacaactgagcctatcttaggcgccataacactagcgatcggctactaactaatcacccttgcacaaatgatcagtgttaagcccgtgcagaagatggatttgtgcaagaggtgtagtagtgaatgttacactggttaagccacattatataggcgagagattttactgtgtgcacttggaagttacttccacgatgtaccagcatataccacattctattaaggtgccaccgtacaaaccatctgtcactattactgaagattgctatcgctattgcagtttcttagcatcgagattaactaaccatcattcgtcagtccgcccccatctcattcatccagaggatgatctcacacgagcatgacatgaacgacagaggtgtacatagatagtgtaaacacacttgggacagggcacatcaccagctaagcacatgcaagatttggtaggttgtcctattggttcatactaaaatgcaacaggataggacagagaaaacgtccaagatgctactcctaatatccacactctgctctaggttgatgacagatgttagtaacttggtcgtcgttgtgagttgtactactggatttctcaggatcccagtactgttgtttgcttgacaagtagagtaaaatactaatctcaacattctagtggtacaaggtagcaagcatgcacacaatgtttatcagttctcttctcatcatggagaaattctatgcgttgctctgctctgcatgccccacgattgtgacgttatggccgggctttgcagcgattaaccgtgtagaaattgcaagttgcacgtccttggatattgccggtttggcttctgcggcagaaacgtgcaagagctgacgccgcgggatgctgatcatatcgcgcagccggccggctcggcgaaagttaagttcacattgttttgtgccaatgcggcaatgctgacaggaaagatcccacttggacacttggttattaactttgtcctaactagtgatcatcaaagcgtgcatgggctcatacaactagattatagtttatttacaagtagagttgcattttaatttaataggcaaacattgcttctatttcttatacaactattttttaactagctagcaaaatacctgtgtgttgcaacgagctctaattatattagatgagctaattaaactaaatcatcactctcaagttttgattaacgatgataggataaaacagtgtgttgtacagtgtacatgaagcaaatagagtttctcacttgaatacattattggtcaacaatgataggcccataagatagatggtggcctctacttgtcagatagacgggggtagcagaatcacggatagagtatatagtaaatcgaaggtcttcgcggaagccaacgctgtgcgacccgccctcgcgcacagcgcattgctccgcgtgagcgtgaccccgcgcgatatggttcgagtcgcctacgcgtacgcgatccagagttcccctcgcccgcccggcgcaagtcgcaccgcgcgtacgcgatcccagccgtatacccctgggcggggcctgcggagtttacgcacgcgtgcatgggcgcatctggcatccgcgcacatacggctgcacgtacgcgcggatcaggccagcgcgcgccgcgctatcgcacgtttgcacggggctataggcctccacgcgccctccgtacgtgcgcagagcgcgtcgacaagtacgtactcgtgtttacgccgaggcgccaacactactacaaaaatcgtttttctgtacgagggggtcggtaggttccatgcgggccgcttgtggcggcgcctgcaaaaaccgcccccccgggggcgggttgattagccgcatgcgaagatccattatcgcatacggctgcttaagacacccgcatgcaataataggtctatcttcgcatgcggctggcttaagggaccgcatgcgatgatcggccatatatgctcctccaggcccgagcttgaccatttgaaaacgaagctttctctctcctaaagcaagcaccaattaggggggaggttttcaactcgaaatttttacttgaactctatacgaaaggtgaagaactctctatcatgcttcatttggctccatttttgttatatttcgttggtggaaagtggagtttttttaatattttgacaaggtttgttctaactattttttgcaaaatctagcttcaaaatatatgttttgatgggcaaattttgcatgtaatcaattgtacatactagttacatgtattgttgtatttttttttgggagacaaatgcatttaaacttttgtatgaaatacctgcggtctatttttttatctgtaacttttttgcctttatataattagatggatcggtcgtcatggatgtatgagatgcggagaacgcagccgatatttattaaggaagcatctaaatttattgatcaggctaaggagcatgctttgagggagaatatgacaaagatcttttgtccgtgccgtcattgcaagaatcagaaattgttggtagatcctggtgaaatattgggtcacataatggagtacggattcaccgccaactacaaggtttggacctatcacggggaattcgccaatccggaagatgacgatgaagagttaagtttcgagatgaatgaggcagagaattttataatcgaagacatgtcgcgtgaaagaatggttgtcgatgtttccaccgatagtgatgatttcgatggtggttttgatttagaggatatgctacgccatgttgaaccagaggtgctagcgggcaggtcacgaggattggagaattggcaggcattagagaaggcatcgaaggatcttctttacgatgaaacgaagggatgtgataaggatttcacagtcttgcgttcagtgcttgaacttctgagattgaaggctaaacatggatggtcggacacaagttttaatgatctgatgagtttgttgcgtgtgttgcttcctaagcctaactttgtatcatcgaacacgtatcaagcgaagaaactcatatgtcctttatctcttggtgtagaaaagattcatgcttgtaagaatcactgcatattataccgtaaagaatatgcggaattggaatgttgcccaacgtgtggcacaagtcggtataaaacggggaatgggcccgtagattcagagtgtaccgatccagattctgataagggtaagcgcgggaagattccttcaatggtgatgtggtacctaccaattaaggaccgcctgaagcgtctgtactcaaacccgactgatgctgagttgatgatatggcatcaagagagccgaaaaatagatggtatgattcgacatcccgtcgacgctcgccagtggaagacatttgatgcaaaacacccagaatttgctaaggatcctaggaatgtaaggtttgcgttgagcactgatggaatgaacccgtttggtgacttaagcagctcgcacagcacatggccagtccttctcacaatgtataatcttccaacatggatatgtcaaaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcgatcatattcgttaccatcaatgacctacctgcaaacttttcattatctgggcagattaaagggaagactggatgtctgatatgtctggagaaaacttcatacaaatacctgacgtcgtctttgaagacagtgtacatgcgacatcgacggttcctaccacaaagacataggtaccataagatggctagattgttcgataatacagtggagaatgacactgccccagtagcaagaggtggtacatacgtgtatgagataacaaagaagattaaggttgtatatggaaagggaaagaagaagacagtaaagaggaagaaagctgatggtgacaacggtactacgtcgcctttca

SEQ ID NO: 65705 - DNA, 501 bp, Oryza sativa
taatcacctaaagttgtcatgattcatcatgacccatcatcgccaatgagttctctctcctctaggtcctctatctccatcacttcgtctgtgagactgaatatgtctggctggaggctgaagacaatatatacactgtctagacagagagatatcatcacaacagggttagtatgtggtcaaatgacatatatcaacatatgtttataactttatattattgtgtgctgattgctgaacacacatgtcgcttttctggatttcctcataagcgatcaacttacctgtctgtatatgtcactgcagtgttgcgcaggttaagtaagattcaatgtacggtccaaagcaatcctgagacaacgaagactagccaaggaatgatcggagaagacacggtccaaattaaccgtgtgcatcacggtcagggaaaatgtgtcttcaaaagagaattactctggtctattctccgagaccactgtcaaaaaattaaaaccaaaaggc

SEQ ID NO: 65706 - DNA, 4395 bp, Oryza sativa
ctgcacccccattccagagtagtcctcacgtgtcatgatctaataacaatctgaactgtggcttgtgctatctgtttacctgaaactgttaatataacaactgttttggtgaatgggtaataccactatttttgcatgtccacattaccagttcacaaattgaatcaatttatttgccaaaagtacctttttttttttgtgcgtaaagatcacctgtctgttaaaacttcaacgcatgctgctatcgatgtttttaagctgttatgtttaatttgtgttactccagatacaagcttttggggctgagggaatgacagaggaaatgctgaagtacttgaatgtagctgaaaatgtcttatggaacatggatccttatcagaaaagtgacctctattgcattgccttgcatgctctggtcaaggccaaagatgtatgtacctaccatcttttactgcttagttcgttgtgtccaaacgattaatgtttttttatatattatttttgatgcttgaattttgaatctgataggtccattccttgtttgcggacccacaaagcaataaaaaccttcatgaccatcagatcatacggacttccagcaaatgttgcaatttataatattatgatagagtgctgtaaattgttgccttgtgtcaaatcagctagcgctgtgctatcattgatgctccgagatggcttttatcctacaattttgactttcacatctcttgtgaaggttagtccagttagcgatgcaactgtgacttttgattcttttcttttagttgactttgattttttgggtccacttacttgagtttcatatctattatttgccatgacaggttgtattggcaagagaggattttgagggggcgctggatctgttggatgcatgcataatagaaggaattcagcctgacattgagattttcaatacagtactcttagaggcatttgaaaaggtttggctatgataatacacctttttcctgaatgatgctgatgtctaactcatttctgaacattctgcagggtcagattcatgtcgttgaatatatagttgagtgtattcaccgagctaaaatccgacctgatcaatcaacgctttggtacacattttgtgcctacgtggatcaggaactgtacaatactgcaattgaagcattgcaagtcctcagtgtgagaatgatatctgaggaggccgatgttcttaaggaaaaaggagtaattgtagaagatctaatcctcagcgaagagccagatgctgaattaaagatcatgaagacatttgaagcaactgaacatcttgcgacagccttactgaacttgaggtggtgtgcaacaatgggttccacaatatcctggtcacccgaggatagcctctgggcaaggaggttggcatcttcttatgacggtaacagaagaccacatatatttaccagtattgtgcctaaacagtttgtggtttgaccagttcttcccaaaggatctgtatatacatattgagtgtcttgtgactctctcctgagggctgaggcatcagttcacatccattgatggactggtctcatgcaattctcccagctccacctgctgctggcaatagcggtgttcagagcatcagcagcacaaattctgtaccaatttcattgatggtgacgaaaagatcgaaccgcacagcagcaatagttttttcctaagattttggagacaataatgagaggtttttacaagagcaagagttgagagtgctgttccttgtagcaagacctgctgcttatgagcctctgacgtgaattctttctgatacatgttgtaacaaaaccttagtctgacacactgataaaaatgttgtagtttatccctcttggagaggcccctaaaaatgagagctgcaccaagcatttttcatcggccattttgtcaagtataccatcaaatataatcatattttctttaggttgtcttttgacatcatatttttcttctaatttctgtaggctgttgtaagttgtaacatgttaattactccattagcatggataatcagataattgcttgttactggcagtcggtcctcgattatttaacatcaatcctggctcactatcatatactcagatagccccacgtatcatattcaaaagtgtcaatataatcaaatttagccaataaaaggtttagattgtcaaattttacttatgtgaaatttctcttatgatttgtttgtctgatactctgtctgatcggtttgtcatctggtgcccaccgcttggcctccgtgagatggcacgagcgctcgtccaggtggtcggctcgccgcctcctcgcccgcgctcgccgcgccgcgtgtcgcgccaccgcctccctctcttctcacccccccccccccctccttcctctctctccgctgcctacgatataggcatcggcgagggcgaccagggggatcggaggaggaggaggcccgatggcgttgggggcggtgttccacggcgcgcagctgatgctggatctggcggtggccgggctgtcgctggtggtcgcgctcggccttttcgccgttgtcaccgccgtgctttgctccgccgccttcctccaccactccaagcccgtcgcgtcctagccacccgctgctcatcaccgccgccacaacccccctcggtgcgtatcattttgggtgataaatttgctctagcgtcgtgttcccctgacgcggacacgcattagtttaattattttgggtggaattggggggcaacaattcgctcgagcgccatgttcccctaacgtagaggcgggtactggtgcaatggaatgatctatggatgttgaactggattccctggcattttattctgtcgcgccacattagaatcttcaccgtagcatttaccagatgccagtatccttgcccttacttgtgatttactgcttggtaggtggtccgtccagtgaaacatcctggattggtattccctgaagattgtgcctacctgttgtctctttggtttgaagaatatgtgttgtcagattacgcatggtggcaaaggctatttctttaggggccttttgagctgttccgtgctgttaggtgggcatatttttgttgctcagggaaaaaaataagcaacagacgagaagtggagttgataatcagaaatctgattctcctgttagatggataatctaccgctcattaaaacgacaaaagctaggaatttcacatttggcaactttgtgtttatttaggcaactttgctatatgaaggcgtcgtgttcaaccatatgataaaggccactctattagagtattagtaaaaggggcacgaactagcaatctagcatttgccatgatattcaacattacagatttgttgtaagccctgcaaaactgtttttagttcccatacttgtctgagataattcagcaacctttttgattcaccttgtttattctcgtttgatcaagctctgccatgtagtaaatagtaatcaactaccattcccttgaaatgttgccaattcttccttttcattttcaggaatgagattgttgttggaggcatgccttctcatgcaccatatgcatagcagaaggcgcaccatttgatgccagagcttccttcagacacttaatgtagatgcaagtgtagtgaatcacacgtatcaggtgatagttcgatgcacttgtagttgtatgaatgttatgtttacttgtactattctgccgatattagctgtttgtattgtaaatttcccatttagtcaaccttggcaacttttagggttttacatctcatataccttatgtacattgttttattcttatatggaagtatggaaggttcagctccttgaggcaatagatttcatctaaaaaggtaaaaatggcacattagctgagttagagtgctttttcttatatatgatcttcacgagcattagttcagcaaaagaaaacataaacatgacctaaatacatcatgctccgctgcaactatttgtcatagtagattttggattagattagttatgatggtcaaattatccacagaaacaaaacaaatcaggttactatgttctcttttctgagtataaccgctacaaatactggaaaaactgaatccattagattgaactatccttttgtgttggtgacttgaacaattcataccttgagaaagtttatctggacaaaatgtggctttctgtatagtagttttcattcttacagataaaagacaggagcatacaattttgaaagagataatgaaagtatgtcattgaataataaccagagggcctcaaatttgctttacttatgaggtggttaacaaatggacaaaaacttggaagacaattgcgaggagccgaggaccctcacaaggc

SEQ ID NO: 65707 - DNA, 9370 bp, Oryza sativa
aagtgtttcaaggggactgcggaaaaggatggcagtgcctttaaatgggaaagatggcctatccttccaactgtattcataactttctcaaccatttctgtactctctcttgtcaccaaagccaagaagagaccatttgcttccaatacagtgttacaggtatttccatctgtagtccatgtggccttagcttctcacacctcatggtgggggactagcagaggctggagagagatagagagaaagaaagggagatagatacacacacctgcttcgttaggcaatgatttgttaggattagaaggttacaattaggctggcattgctcaaaaggcttcttgtcgccgctctgtcaatctgcctgtcatacaaaatgcttagcttgtttatgacacatttccctcggattgcaggaccaggagaacatgtcttttgtttgctttagtacgtgtgtgcagatgatgatcaactaaactcaacgccgctggattcctatgctgtatttttatttctccctgtggttccaatacaataataaccctgcagttcaagcgacgatattatattttgctgcagttgcattataaaggtgagtctcattcctgagatgttgcggttcatggagtagattaaaccggttgactctgctctttgttttgccattgcatatagcagattcttagcttgattatgtggcattcctttcctccaagtcggaggaacgaacaagcctgacttgtttctgaagatttcagtaagggctttgagacaggtgagaggccagagcttgcggtccttgtaagaaagttcttctatctagttgtttcctgtagtaccccgttttctgttgctgatgtgaattctaaacctgcttacgcggcaacatgcatcttaggtttcctttagaaaacaggaatcttaaaacaaagtaacaggaaacaaacattttaaattgataatcatacaagattagaatatcctaacatcttaaatcctatggaactacgcgctggataaatataggaatcagaagagagataggtacccatggttttcctttttctaaaaggttgaagctcatattaaaattcctccaagattcttaagttttgagccaatctaaaggaatttcataggattcttacatagctgttcctttgatctaaagaagtatgtagaaaaattttaattcctccaagaatccttggttccaaaggaatccttgaaagtgaggatcatttacccccaattgcttaaaataatttacaggctacatacacaacttgtgacaaaaaaaatccctattcccatacgaattctagatcattgtattttctttgagattcgtgcgcattgtaaccttatcctttcctcctcttcctcttatctccctgtacgcacacgagcaaggtctccaacatgccgccttcatacacagtgcgctgcctcctagccttgtcgattagctagaaggcaccaatgaggccctcctggctggtctccttcccatctcctcctctcctctttctcaagctagaggcggcgaggtgcttccgccatctccagtgattcctactcagtcactctactttgctccttccatcgacaccggtcaaccgggaacaaaaatgaaattgaaaaatggaattgtagctgaacatgctgacctattgatcaaatcgtgttctagaagtatctgcaaaaacacccatcagtcttgaacccgttcctctcaaaaccctagaaaaaaaatagttttctcttctataactcgtacattatctctttcactatcttttatacaaacccacaatcccataatctattacgtagtacaaactaaattaccggttcactcccattacgtccaaacaccacaaacccaattgcgtacagtggcggcgctaggggtatgcctgggtattccttggaatacccaagatttcagtagacaaaataaatacatattatagtacacatgtatattctattttttaattggaacagaagcccacaaacgagctagtagcagcgagcaggccaacctggccaaggcccaaacggccagaattcctactgtcggcatccattcacaagtcacgactcgcgtagtcgcgttcttgtagttcttaaaaaaaaagtcacgactgctcccgtcccaactcccaagcggcggcgccagcacatgtcgatctactgctgcggcctcagccgggctgccggctgcagcggtgggcggcggcacatctcgatctacttctgcggcggcggcggcccgcggccggcctgtgaggtggtgtccagcaggctgcagcgcatcgtcgtcacaatttcagcaggcagctaggtaaagatttctctaatttatttgtcttgctactgctgtgctgcgtgctactttgtttagtaattttctaacattctattctttgtgaattgtaatctagatgaggaagggtactaacagcatatttgcattatgggagaaagctgcaaaggcaaaaaaaaaaaaaaaaaaaaaaaacagcttccacatctacaccaaatcctcctcctgttgagattgagaacaatctgcaggtagcacttgtgcaagcacaagatgatggtgaagcacaggcacagtccgctgttgaagcaaatgatgaagcacatgcacattataacttatgatccattataatccattatattgcatacttgctttgaattttttatatgttggcatacccagccacaggatcctggctccgccactgattgcgtagaacatccccattccacgtcgtccatcatcttatgtgcctaagttagagcatgaccatccaatgacatatctcgactgactctaaccttggaaatctattgtagtttcggtccctcgtcattcaccatgatcaactcctcctagcttcacctgcacatcaaatacaaaggaaacatattttgaaaacaatttttttaacttgatccacattaaaccaaacaaaaatatcttttctcaactatttatacatatatcacatatatatttatcaattactgacaagtgtttgctcaacattcaaccaattatcattttatcccttataatttggtattttcgttggtccaaagtattccccagtagtaaaaccgtctaccactgtcttttttctcttttttcgcaatcgtttttggctacttgaaaatttaaggtgtggaaagctaattatacaaaaggctcttcatctatatacataattcctgcttgttgtttctccatggcaaaatatagggcacaactatactttttttttggatgtttcataatacaagatgcgcattaactagcacccccctcctaaattcattgtttctaaaattcccaagatctctaattctattgattacatactttgaatttattagggcgacccaaataaagaggtgacagtaatttttccttgatctttatgttaggagtattttggaatagagggagtactttattttgcctagattgctcatcttaaagatcttaaaagcaacataagcaagtaatttttggttcttaacaatatggcactctggtgctcctagcaacatggcagatttggaaacagataaaccagagagtgtttcagcacgtagaactctcaactttatcactttctgcgaagataaaggaggcggccgagacctggactgccaaaacgaatagacttgcttagatcatcccttagttttatttctcttatagctttgtacattttttctcatgctatatttaatgaaatgagcacacccttacaccgattcgttaaaaaaaaacaatacaacacggcataaaaaaaaatacaacactgcatggtatgcaccggacaactcgaccgaagaagcagtggagtgtttgttgttgggcaggaactcaaacaacttccctgcggacattttttccacccagactgcaccaaacttccctgcggacattttccacccgaactgcatcaggaagcgtctgttgctgaagaaagaaacagtgcccgaagtgtaacggtgaagtttagtagaccgcctattaaaacaattataatttttactcttttatgtatttctttttaataatgttgtgtgggaatattaataacatttgagccaactggcatatttatttttcctgtcagaattttttttctatgaaatatcatgttggaacatgagtttgtgggaagacatatatgttgttctgcctcttatattagggcaacctcaatgttgggttgctgaatgagcaataggggtgggcccatgtgcagatagctttagctatatctatctctacaatggttatggccttggatgagaaacaagccgggtcccactgggtcccatcaaagaagaaacataccaccaattcgcaaccatttgctgataggctccattagatatcattttttaatctcttaagttcaactgtaagcttagagctgtttttaagcatttaatgccttatgtccatgtccacaatgtatatagctgaaaaaaagtcttaaggctcactcttatggtcacattgtggatgcccttaagggcagctaactttcttagcattatttaggctgtcttcaaagaaatcttcctttgcagtacttaggtctttttcagaggtaatttgagccctgttagaccaagtttcatgggatgtatatctgcacttttggttcatattttagcggggtgtcggggtgacatctttttggatatcaagcaccatgtttatagtataatgaattttgatgctgataatgctatggtgtaagcaacatgggccaatctaggggagatatttaactagggaaaattgcaaccatgccattataattttgcaaaatttgagatataccatcctgacccacatgtcattgactcatgtgagttctacatgtcattgagataccgatggtatatctcaaactttgaaaaattataatggcatggttccaaattacccatttaactattagcaaaattgattatatagcatcaaaagttcacgtatataaccaattttgccttaactatttgccgcaagaagtgatcataagtgaagaactgatcagcgttacgcgactgaaaccaaagctgaacccagtaaattcagataaattctgcaagaaaaacgtcactagtaggcagtagcaatgctctcactggaatccatcttggtcatgcacgcgtagcgccgcagcttctcgttgaacagcacgagggggtccttctccctgagatcgccgtcgccgccgtacgcgtccctgaggaacacggcccagttcatctccgtgccggcgaggtagaaggcgcggctctgcttccgcagcgacgcgtgcatgtgccgcgtgaggccgagctcctccttgaactcgaagatgtggtggatcagcgcgcgcttctccagcgtcaggctgaggaactcgtgcaccacgccgacgcggtacttctccgcctccggcgtccacggcctcagcagcgcgccgctggtgtacggcgagaccagcgggaacgtggtcgccgcgtccaggcggtcggcgtcctccgcgtccagcggcatcgaccggctgtgcgggacggcgaagcggaacgtgcgccggacccggcgctcgtccaccacgaagtcgcgctccagcgcgctcacggcgagggccgggtcccaccgcgccagctcgaggacgtcgcggccgtcggggtcgacggcgacgcggaagtcgccggggaactcgcggacgcggtcccggaagtcgtccggtaggccgagcaccgcgcggcagtggtggagcttcgcgagcgggatgcggcggtggtcggcgagcatcaggagcttccggacggcccgcaccctcgtcgggaggagctggtcgtgcaggcggcgctcctcctccaggagcgagcacatgagcggcgtgagcgcgaggtgcgggacggagtccaccctggggaggtggaagagcagcgggtggcgcgcggcggcgcgggacacgctgcggccgcgggggaacccgagctcgcggtacagcttcccggcctccgcgagggggatccggtgcggcggcgggagggaggccaggaacgacctcgcgcgggcgaggaaccggaaggcggcttcgcggtcgaggacggcgtcgagctccggcacgcggcgcgcggcctccggctcgatcggcgcgacgcgcgggctgctcagcttcttccggagcttcctccgccgcttgcagggcagcagcggcaggagcgaggccgccgcggccgccgccgccgcagaagaagaaggagacggagatggaacggctcggagtagcgctctcgtggcggagaagaggcggcgcgccatcggcggcggcggcgccgtggtggaacgaacctgaggcgagttcagtctatttcgatcaaccccacgcacgaatattaaagcgacagtaaccgttggatctgaaagcctagtagcgttcggcgttagcgtagagcacaccacatcacactcccctcccctctctctctctcgtctcctccctctgaatccatctgtaaatctgttcctctcccacgcgccccgcccccaaatcccccgcgcgccgcgcgccgccgccgacgccgccgtccgccgccatggggacggaggtggccccgatggtggacatgcgggcgctgtcccagtcggatctcgtggcgctggcggcggggtcgccctactccgccgacccccgccgcggccgcgacgccgacgtcctcccgccaccgaagatcgatcgcgccgtcttcaatgagagcgccggctcccgtaagcagaccttctcccgccaccgcgtcgccaccaacctctcccacagcctgaccccggccaccgcttccgccgccgccgcccccgcccccgcccccgccgacgaggactccgagaaccgcctcatcgcgttccacctccagcgcctcttcgcgggcgaggacccctcattcgcatccccgccccagattgcaccgcaaccccagccgcaaaccctaatcacgcccgcgattgccgctgccgtgacccccgcgccctccctgccgacgccgcctccctcgaacgccgacatggaggtgatgaatccgaatggggtggcggtcgatctggcgaggctcgcggagctggtggatccctacgaagaggagatgcggaggcggacggcgggattaggggcagaatccgagctattaggtttcatgaatgggcttgagggtcagtgggggagccgaaggcggcggaggaaattcgtggatgcctctatgtttggtgaccacctgccccgtgggtggaagctgctacttggcctcaagcggaaggagcgtgttgcttggatcaattgccggcgttatgtcaggtttgttcatgttgtgtatagcttgtttcggtagtggtgaacatcagttgttaagtgtcttttgtatgcattgatgatttgggttttgtgtttgaagtgtgaaatgcaatgtgcttgtcacaatcgtttttgctgtctatgatctccttttaaagcttagtttgtaaagtgagcctcatgatagcaacattaagctgatcttagaaacataggaaccacaacaatgggtatttgaatgtgtcgtaatccaactatttgagtttttctttttcttccttgtttttggctttgttttcttccttccctggcgtaggccggtctggccgattgcattgtgtaacaaacactctattcctctaatatattgacgtgcaatccttttgcgcattcgcaaaaaaaaaagatggtgggcacagcatctggacagtgttgcaagatactttgtatccagatttaccttgtctgtggtagtaactagtacgtgcatagacagtgagcatatatttcttctaatcaatagttagttgatcatgtttccttccccacacccatccacccacctacgctgttatatccagttgtcatttctacggttcagtaactaaaacataatcaagtgctcgccttaatatggctgcctctattaaccgtcatgcctgaaacatgtatgatgattcataagtttaactttgtttaaagtaaggattcaacggcattgatctgtttgatagttcgagcattctcgtcatgctcatttgttggacattctttctttgcaaagatatattcttactcatcatgctctacataataggtatatttgctctctagaaaaaaaaacgtactatacatatttcgttattaatcattacattttcagacatgttgatttctagtcactgaatgaagaggctaccttgtattagtaaatgtctgttaggacagtgcaacttcttaatattgtcttcatagtatttattttgaacttggtgccatgttcttcataatatgtgaatatctgctggacttggaagttggatctcatttattggaagattgtgtgtttcatatttttgctcactaccattatttgctctagctaattgtccatgatgtacttgccagccccagcggacatcagtttgctacttgcaaagaagtttctacctatcttatgtctcttcttggatatgtggaggcaaagccaactgccattcagagcagcgatgcagaagtgcttgaattaaacgctgttaatgtaagtccttttagtgcaccttatatgcacaactacctttcatggtttgactaactaaaatgttcaattagtctgtaggccattgccagcctaattcaactgaggaaaagcagagtgcgcctccagttacatctgtgcctttctccagtcaccatggtgatcctcagaggcaacttgataagaatgaaactcaggtggaagcaaatggaaaagagtgccaaaagtgcaatttgacttttcaggaccagagtgcctatgtgcaacatcagttgtcctttcaccaaaggaaggctaaaaggcgcaaggttaataagtctggtgaagtgggagccaacaaaaatgtaacaattgtgactcaagaatgtcacataacttctgaagataaactgggcaatattgaccatagtttagccaccacaaaatctcaaggtcaaacaccagaaaaaatgcctgacgagaccatttcaggagagttaggtggtcgaccatccatggcaccagagccagttggttttcaagagacgaatggcttaactgaacagggaaaagaatcttctgctggtgaacttctctctggacattgtgatcctcttcacaatatggctggtgtacctgagaaggaaaaaggatttggtggagaacctgtccctgggaatcacgaggaccccattgaccatttcagggacccccaaaacccatgatggagcatgtcataatgctg

SEQ ID NO: 65708 - DNA, 573 bp, Oryza sativa
aaaaacaatgaatcaaatatccaaataaaaaactcccagaatcaacccatcacataatcaatcaacatatatataatacggccaatctttataacatcctcactttttaattggaagaacagaaatggaattacatggctctaggaccacccgccaccgctattcaccgcatggtgaagaagtccgcccacccgctgctctctacagacaaccattgatgtcgagatcagctgaagagagagggggtaggatgaggaggatgagagggaaaggcgcggatggaggaagatggtgaatggacgttaaccttggatgttggtgttggactcgagggtggcggatcagatcaatgacaaggacgaggcttcctgcctagtgctaatgcctccatcctccacttcattagtgttgctaattgtgatgaagagaatgaggcactctagattcagctcgtactaggccctaggcagaggcattgagggcaaggaagaagagatctgacatatcagtgccattgccttggtcgccgcgggttgtgccccatcccccttgctagccccaaataggctagat

SEQ ID NO: 65709 - DNA, 8500 bp, Oryza sativa
  unsure (1)..(8500): unsure at all n locations
ctgcaccccctttcagttttagctttttttttatgggttaacctggcaatgttaatttggtcctgttggctttctgtcatcaagctggagtccccagcaaaaacattgtatcagaaacctgttatgctttaagtaaagctgggtgtaggccttttgtccaaaaaaaatctgttaggtgccagcccaccaccacccactgcatttttttgttacggataaacttgatttcttcagcattatataataaaccttccatatgttgttcttttcatatttgtccttctaaaatcacagttttacatgccaaggtctaagatagccaaattgtcatgttatgtagtgtgtaagttcattttacaatttgcatgtgtaaacaatgtcaaaggttcattgtgcaataagtcattttcatagcatggtatcagcgttattgcgaacactctatttagagcatgtagacaaccggtcaagtgtgcatgattatacagataaaatttgaaccttctaagcataaaggtattagtaaatttttgacagataaatcacaagtatggattacctcctttgaatacccgcctttgctgagagctcgagtgacagatctgtagactctttgactcatatgtacagcattctcttccatgagttccaaagcctccgtaacaaactatagataatcaaaaagctccaaaagagatatctaatcaaaatgactatactgttactccatgcaaagaataaaacatgcactcagcagaagatttaccaaaggatcaggtgctgttgcacaatattccagtatatgagaaaaatcttctgaagtcaatgccctgttagtctgttgaagatttgaaagcaacaaggatgcttgctgccgatcacctctgcaaagagcaccaacaatatctgcttgaatggatctagtagccaaactggtcatccatttaaattcatcatattctgcaaccattacatcattgttacctatgcatatgcataaaattcacttctataacaatctaatatgagcattaatcaaaccagagcatctcatggtataattcagcaaggcagtgagacaggacttacagaagttactaacacagataaattaaaaagggaacctcaggctccaaactatatgaatttaccccaaaaaaaaataaaaggaaaacgcttagttccccatttgatcatcacgtttcttgcaatataccgttcatatacaatttgcaagcatagaactgggtaactagattagaaacaacagttatggccttccataaggaaaacatgacagtacaacgaaaaggtgtaaagcccagcaccgtttgaacaagttgaggcctctccggagtgaactccactaaccacattggcttgcgcctgcaaaacgtgcaacttcagcatccagaatacacaccaacgcacagaaaatacataaggacgcaaggaagaaactcttcgttacaatctgcgggggcttgaatgccgcggaggaattggtgcaccggcgagcggctctcgatctgcagtacaggagagaaatgtgaaatcacggcgacacctgaccccgcgcaaaatcattccacggacgatactcttacagtattcgatgcatcgagggagatgtcgtccgtagagctcctgggcggggtcccttcgcggcgggcgaggcgcgtcgcgcgagcagccgggcagcggggctggctggctggctggccgccggcgacgttgaggcgccgaaggccgtcgacgcgaggggggcgacaggtgagggggcaccccgacgaacccgcgcacggggaggcggcggcggcggcggcggcgtggctggtgatgtcgtcggggagttcgtgttggctcgattagagtgcaaagggaaacaggaaagtctaccagttaagtgggctgtgccttgtgggccgtttctgttgatttgggccgcgccgctaagcgtgaaatggaaaatataggtttaggcccatcgggtgctaaacagctattagtaaacctgtaggataggctgcgcatcttgatattttatacccttcagtaattcagtgtaactagccatttagtcgtgccttgcacgactttatgtgcccgtaatgctctcaatcatacttaattttgaatatatttttttacaaaatcatacaacttgataaactattagttaaatctatagattcagctcaagctatatttaaactaaaggttcaaatattatgttcaggatcaacctttcaccgtataccgtcaaaagatgagaatgtttactcagcgatatgatgcataaggcataaaatagtcaaacctaacacaatacacagtgacaaattaaatggcaatctagtccatgatttgaaaccaacacaaattgctcaaagatcatttgacctctgagtatctcaagaagataacataataaacatcccaaaataaaaatacacaattttgttatgaagtgtagtaaaaaattcagagtcatcacaattagtatagtttgtctgtttgtgcattggtgccaaccaaaaacccttcagtccaaagccaagaggatctctcaactcttctttgtaggcgcgagaaagtagatatgcatgagacaactcattgcaggaaattcactgcaacgaaaacaaggactagaaataaatagaagtttcttgaagggtctctaggaggttttatcaattgaaggatccagtggttcacattgcatggcaagaaaatcggacggctaatatttttttatcacattgttgtaagtatttttttatcttttttatatcgaattctttatgtagaaactatgttgcttcttccttaatgcacatataaattaattcttcacctttttatgtcaaaaatttgttccatttaaatctacaatgtgagacaccattattcttttactcaaatataagtataaagttactaaggtgtagtaggtgaaaaaaacatatatacaatttatacttacgtgccacttctttcttaataaatgtgtagtataatggattttccacttaatatttaagcaactacaatagtgacaaataatgaaacccacggattaagataacacgtcacgagatatacacccataatctttagacttttgggcatatntaaaatagcttttttactcaaaaaaaaattaattcgtctgctaggggacaataattttcgtagaaaacttgcttcaaaattcaaattactcgcaaaatccactgccaccaactcaacatgtgcgcccaaaataaaaaccaggctgcagttagccaagcaggcaggcaccctcttgcactctccaccgatccaccaacaccacgagcaaatttctcttccaacgtgggcctccccacgcaccgccgcaaaggcgcgccgatgtcctcctccccgtggcctcccaccacgggcgccgcctccgccgccgccgccgccgcttcccccgcgcctccggaaggagcggctggcggtgccgcgactcccgccgctgcgcccgccacgacgtcggagcagcgcccggtcaaggtcgccccctcccaccccaccccgtcccgtggtctccgcatctgtgtccgactgtccctttgctctttctgctctcggttatacgcggtcacactgagctcgtgttagcctcgcgcaggaagggggagacgccgcggccgcgggggctgctgctgccgtgcagcagcaggaggaggaggaggtggaggcgaagccccagttgctgcgtgaagacgactcgtaattcgcgatctccctctgttactatgctccttgttttactgcaatgcgtgctctgtgtttgcgtaattgcttgtatgaacgctgcctcactcacggttaggcttttttttttttttgccggtaatattacacagagtacgaactctgtaaacgcgctgatgtgtagtcgctatcttttatactactgttgtgggtgtggcacaatgctgacaggagtagaacgatgaggtgaggccatttagcctgttactagtatcatgatgttctttgtgtacatgatgactatgtcagcagcaccttgtcagttttgtcagcagcaccttatcagttttgtggtttattacattgtgcacaggaaagcatatcacttcatttgtgacagtgtgagataccttcacagtgttaggatatgctatgtagtcctatatttgcaaataaccaacaagcagagaaacatttttttccctccgaaaaattgtgccaaaactcatgtatatcacttatttttccttccaaatgtgctgtttctcaccaacatatggagaattctgaaatcaactgcgcataactttttgtcctgtagtatagcaaaagcttagattccgtgcctatgcacccggttttgtttgattttatctttggcatctgcaatttcacttgttctgtcttgtatatttcaaaattaaggtgtcacaatcaccttctctaatagaacccacccttgaggagttgatttgcatgatgttactatgtaaattgcaccatgaactgtttggctgccaataaaggttaacacattttttttttcgaatagagagatcaaagaaggctcaacaaatctagtgcttttaaaatagattgggaaaacagagttctgtaaaaaaaaacggagttgcaaaatatattcttctatgaaaaattgaaggactagcatgcatctttgcttgcagatatcatctgttcatcactgcatacgttaaagtttctgctacaattattgttgattacttatcatgtaccactttactactgttttccagaatagtatgtgagaaaatgaaaaataggaatataacttcagaaattgatgaaggatttaactgtttttgttatatttcctactgtaatgtaatatgttaattccataggtagtaagcatctcaatctgagctcagcacctatattaatataaattcctttctgtgtggtaaaatagtttaactctttgttcgaatttcaaaccctttgatggtttttaggtaacaaagcgaatacataagatctttgaaaaagaccaagttggtacatacttcctccgtttcacaatgtaagactttctagcattgtgcatattcatttagatgttaatgaatctagacatatgtatgtgtttaaattcattaacatctatatgtatatggacaatgctagaaagtcgtacattgtgaaacggagggagtatatactttgaagaagactaaaatttctccccacactacctcaaggcatgctctatatagaatttggaacaccttggccctcattggctcatacttgatatagaaattactctgtcatggtatttaccttctgcttgttgttgccatgagaaataaaaaaaaatggcagttaaattcgtgcattgcattgtcatgtgcagagaaacagaaatccaagtgcacgaacagaagataaacaaatatcaagctatacttgcagcccgtttgaaggccaaatacttctctaataaggattttgatggaggtatttgtgaaatcatcatctatgtgcagtatagatattacctagtatatttgtgcacactttttttttcacacgtttaatcacatacaggcatgccattttttcagtctcatgctatagagatctgctattgatacagtgcatcatttttctttcaaaaaacccatggatgaaatgagaaaacgtgacaaacttaagttaactgttaaacatagttattccattggaggccagaagaaaatccctctttaagttaattatcatcatttatacaaaaaggaggatggaacatttgggaatacataataaactgataaacatagatgcattactttcatgctatttgttttggattaagtttatcctgaataaaaaaaaaagttgaactgaagcatggcatgttacccaattggtcgacatcttaaccctaaaagtctataattatgggaccatgtctctttgcatttattaacagtaagtgtgtacgtcatcttagtatggatctgttaagcttccattttcattgaattttccatttacttactacttccactatcaaagtcctccaaaaggaaagaatgagaaaaatgtgaccttatggaatgtcaccttgggactaacaaggcccagatagactcctagtacctggactaacaagtcaggcatagattgaacacgctctcctagaactcctcatgcaaaattagtgctcagcgaataactagtaaagcaaatttacgagttgaaatgcaaaacacaataaaatgcccaaattggaaattcacctggaggaatgccgtgcctcggcatgttcatttctttgcctggctgcttgcaaaggattgactaccaaataagtcaatcgtcaacttagctgcatgtgggctatgcaatcatgtccttggagatgctgatcatacttccactgcccttcttactatgcttacgtcgaacccaacccccccccccccaccaccaccacaaccgtatgtcctgtttgaaatacgaaatgttcttccattattgtatatactttataacttgacataatcacatcactaggcctcccttctgttctcacatgtaaacgggtttctttcaagtattttgaatttttttgatggaataagccttgtggtctttggtccttgtggtccttctcttgcttttaggttgtttttcccccttttaggacagcatcctttcagttttgcttttagcatctttcggttttgcttttagcatccctaggacagcatctagcatctcctttatgctttattcagtttggatgctctctaggacagcattgcgttcaaattttagactagtgtgggcagcaattagctagcagccatccagccagctatggctatatatatgtatccaacctccctcgggaaggtatggcttttgtgttttgtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcagcaccggttgctcctccttcccctttcccttccccttctccacgcagcagccccccggaggtgagccatgtccgacgctcggtctcggcgttcggtcgcctcgagcactcggcgtcagcaggacgccgagctcgccgcagcagaagagcgcaggcgagcaacggctcagaccgctgcagcagcagcgagggcggccagactggcggcagcggagttggcagcagccagggcggaggcgaaggcggaggcggcggaagatgcggcacgtgcggcggaggtagaggttgagaccttgcgcagcagcatcaacggctccattgccggcgacatcaccgccgacagggagcttgaggagctggcaagaggaagggcacgggagcgagcagagcggtgggcagcagcccacctccacggcggcggcggcggcccaagggaccgcgcgcccgccgacgggaacccagacgagcgcaggcgtgccggcggcagcccggagctcgcacgtggccctcgcaggcagcacggctctctctcccctgaccggcgccatggtcaccacggtgtccagacggtggtcagggactttggtcccggcggtgggtggcctaccctcaccaaaaccaactacatcgagtgggccgcggtgatgagggtgaggctccaggtgcggcacatgtgggaggcagtccggtacggtgacgtcgactacgacgaggatcggcgggcactggatgccctcatcgctgcagtcccgcccgagatgcagttctcgctttcccagaagcggactgccaaggaggcctgggacaccatcgctgcggcacgcatcggcagcgaccgcgcccgcaagtccacactgcaggcactccgcaaggagtgggagaacctggccttcaagccaggtgaggatgttgatgactttgctctccgtctcaacactctcttgcagaaaatggtgcagtacggtgacgacacctacgacgaggagagagctgtcgagaagctcttccgctgcgtccctgagaagtacagacagatcgctcgctcgatcgaatctttgctggacctctccacgatgtcgatcgaggaggcgttaggtcgcctcaaggtcgtcgatggtgatgagccacagcctctctcggggcccatcaccatcggcgggaagctccatctcactagggagcagtgggaggcctctcagggtgacgggaggaagggggagtcatcttccccgacaggcggccgtaagccgcgcaaggcgcggggaggtgtccagctacggtgggcgcgaagacgtgccgagggtggcgcccgcagaggcgcccagggcgttgccaccggcaaccacaagccggcacgagacgacgcctgccgcaact

SEQ ID NO: 65710 - DNA, 4695 bp, Oryza sativa
tgtgggtccatgaacaacatgtcagtgacttgttatggaaaactttttgttggagtcgcttgtagttatttggtgcatcatgagcaaataatatttatgtagttataaaagaatttcttagcacgtcatctagttttgaagatatagaagttgcgatgttatattgagcacatggttatgtctattaaaatataatgactctatcattcatctttacgtaaattttaaatttatttaatcatatgcttgatcttgttaacatatgatagtctttggtttattgatttgcattacctaatgttaccatagcgttagcaggagcaagttactagttaggttggtgcgctgttactgtgcaatacttttttcctagtaacttgacactgttatgctacaagaaaattttctttacaggataagtattaacaaacaggcactatacattttcctttaccattgccttgatttatggaacaaaatatatgatttagccaaaagcgcttcttgctacataacaattgatacgatttggccaaaaggcgcttcttgctacataacaattgagctacattgtttgttgagcgtgtgctttgagatatcagagctacataccagtgaactttgataaaggatcctcacgatttcttacggaatcgttggcgctttgtgcctcctgaattgttattcccatcccaagcacttccccagaaaaacagtgccatccagaacagaactgcaaagaatatgcgtatcctatcctgtaatcttgataacctctcttgccaacctgtcaaaaggaagaaaagactagtacatatggttaaatgcatgcatccattaagcatgaactacaatcctgagatacactagaaatatgttgcgcatgaaagtaataggtagaaccgtagaactagagaagaaaatacaaaaatgattgcactgctctactggctaaaagttaaaatgcatacaattattaagaactaggagtataaagataatgtccacaaagttcaccagagattgactgttcctagacacaattccttgatagcattgtgaaacaatctcgttttggttgttgcaagcaagtgatacacatgatgtacataattcataataaatttcacacaaatgttgatgaacatcactaaccaactaatgaagtctctatatttatgatttaactaaaagttgcactgacaaagtaaatcaaacaagtagatacaactctaactatgatgtctgaaattaaaatagcatcaagaaattaagcattcctaagtatacaagataacgattatagtttgttgacgatgctgcctcaagttcaacacaaaccccacaaaaaagaacagcacacagagtcagccctccaaaagtttctagtgggatggcaaacctaggcagctagtgcttgccggtgttggctgggtgtgtgggtgtgttttttcggtgggagggctttggttctcctactttgttttttttttctttttcttccttccccttaatgaatgaaacacatttctcttgcattttcgaggaaaaaaatcactacggagtttttcccattgttgatgagttccctttgttgcgaagaatgctgaagaccaccaagaaaactaaaaaccaaagttttgtgagatttatgtgcaagatcaatgtacgtgaggaacaattatgataatattgcaatgattgaaaatttgtgtttgagaggtgaagtgccatgtgcttagtggtctgaccagtatggtaccgtagtctgactatggccctagtggtcaaactggggacgactcattttagtttgacttttggtcgcctcgggtttgcatggttggacaggtcacataacaacagtctgactaaggccagctaagattgggttgattaggacttatgtccaagttggttttgagttggatggctattgcaatattcttagtgatttacacacattacatatgatgtgtaaacgctaatttgaatcaagttcagaagaacttgtggtaaaaaaattgtttcttggtttggttatgacgttatgtacagttattacttgagggtgagcgtggtcgatgaccttagataggaacaagacagatgggggtgttgaggttcagtcattcagatagtcaatgagttcatgtgggacacacgggtagataacagtgcatgcgaaggtgagatttccatatggaattcatgggagatgtgcatcttatggaaaagtataataatttaaaaatagtccaagtttggcgaggacaaactcggttatgcgagtctttcctctacagctacgagccctagataaagaaagatttgtggcttgtgacagccatgttgcgggtatataaacactcggggagagcaaaattgttgaggatttttagagaagaattagggatttagacattttccattttcatctagggttttcccatgtggttaagggtgccaaggatacaccttgtaaacattttaaagcaacaaagataaaattcataaatccaaaggtgtaaaatccttttgcttttcctcactgttcttcatttttgtctatttttgtacaagttgatccatccaaaacttgctagggcagaaagaaatagttctgaaaattttcattgttcctttctgatgtttgaaaatgaccacattttcatgttttttatgatttcagggtcaatatgttcagatctataagtcgaagtgcgaaagttcttcttggaacagtttctaaatagataaagtttatattagtcgaaaagttccaggccaatagaagttagggggttagaagacaccaattttacatttggtttgacagattgcaaacagggctcgtggtctgaccatgactaagccactaaggacaatccgacctaactaacagggcctaagtgtgattgcagtggtttagtgatttcagtcctacaattgcagcattaagtagctgctgtttgcaaatcaggccatccacctgatattctaatttatgatttgtactgttttacttctactagggagggcaacatactagtaactatatattacatatgttgcagcagtttcaacttttaagatataacaaatatatttcatattttagtttcctaggcaccaaaagaaaacatggtatatggacagctaacattctcatgatattgaagcctggatgtctggcctgcatgaacaccataaaaaaatggccaacgatacattgttcccctacatctatgtgctctgctgcaaactaacacactacggatgaagaggacactttcttcagcaattcattttgtcccacaacccttttataaaatggaacatgtataaaaaagcatacatttgccgttagacaaaccgacaatcagcatttggtatctcaaatccccggcaaatgagtctggatcggacacaattagtacatagtaattctctagtacaacacatcccaacctcaatcgattaatcaattacttgggagcacggcataaaactgcggaagcaaaaagggaaggggacgcacagcagccttaccgtggggagaccgtggcggcggctcagaggagggcggagaggggccggcggctgcacggtagcggaagccgggccgagaacggtagccacggcccacagctgctggtaatcgccggaagcggagaccggaaaggggtaggaggtgccgcagggcggaggtggaggaggggatggtggcgggtggtgcgagaggaggggagctcgccgccgtcatcggggagaggcgatgggtccgggacgtggcggaatgacctcttcttcctcttcctctgccggttgggcgcggcgctctgcaacaagaaagagacggtttgtttggcaactctcgaccgaattgacagcgagatggaaatttgatttttagttccaatttcttgtttggtagtgatgttgaaattaacagagtttagttcgagattaaatttttaaagaaaatggatggattaaatcttccatgaaaatggatggttcagatttgtttaggcaaaataaaggaggaattcccctaattactatccctatctaggtattgaaaaggatgaagttctttcttcaattctccatcctcatcccatcgaaactctcatgtgttacaaccagttgacgtaaaacacgaggcctgggagatcttcttaactccagtgcaggtccaaaactcgccttcgggtatactagtgtgccagttgatttgatcctgcaatcaacaagaaacaaggacaaagaaaccgtggttaaatccataaacgatagacgatcggctaggtgccgatgacatattatttatctttgagccgatgtcatatatgcatcgatcggcaagtatcaataaataaaacagaactaaatctactcgatcggctatagatattaatgatatatgatccttatatcgatatatacttaaaccaagtgattgggatagatcggtcgccatgccgagacagtataaatcacttagatcgaaatatatattaataatgagattatatatattcatagtatagccgatcagatagatctagcatgtatcagctaatactctgataccactctatactaagatatcaaagcaaatagaatatatcaaacaaaagcctaatattcctaaatgcagcaagatcttaacataaagggcagatttaa

SEQ ID NO: 65711 - DNA, 9023 bp, Oryza sativa
atgcagcattaaatatgaaaagaagaacaatatctagacaatcaagccactagatgcttcatagagtggtaaatatcctatataatctaagccaacgtcgctatttaacctaatcggctaccttctactaacagatgttagccgattgtaggttagataacgatattaccgaagattatataagatatatgataactcgacgaattacataaataagattagagtatcataaagatggaagcactaatcccgagaacgcaagctgctataacaagtttacctcttgttgaagatcgaaatcgatgcagctcaacccgaaagcaagaacttgtcgaaacaaaacgaaagcaacaattcttaaaccggctccaccagtaagatatttttaatcctttcactagttgatctcagccgattttgtctaacacttgtctcttttacagcctcctcctcctccttcttctcctgtacgaccatcatcgagtgaccatactccgtcggctgtagggagccatcatgttgaagaagaagaacaactagctgctcctaccattccagtaagtttccttttgacacaagaatttagatcggctatgtctacttagctctaacttcctttaaataattattgcaggtcctagccgatcttttctgctttgacattagagactatcttgatgagacagaagaggataccacaagcaaagctttagcccccttatccgatgatgtgaagaaaattcttgaagatatctcatcggctagaggcatcatcgttagacagcttagtggttgattgtggctcaattaggactcggctacatgaggttcaagctctgatcccagatgagctagccgatatccttactccggccgtatatctcgagcaacatcaattcaagctagagaaagccaagctgagactagctgaacgtcgggagcgcaaagatatcgaggctacaattcaagccaatcgacagcttgttcatgaagagaaggccaaacttgatcagctatctgagggcccgatcaaatctaatattgatcggctcgaaactcgtaagactgagctcttggcacaacttgaagaatgcaacgccgagctggacatggaacataaaaagctagccgatctcccaaattctgttgaagagcagaaggcaagactaaaatcggctatcaaaaatgttgctgatctgaccaagtttttaaaagtcatccctgtaaccgatgctcaaggtgcccatgccattgaagaagtagaaaaaatcaggcaaagagctatttcagctttccagcaatatttgtcttagtgatatcttatgtaataggtcttagaaatttttttgcaatcggctaagaaactctgactctttatgtaactcatctcaacaatctttaagccgatttaatatgaccccatatttggctcaaaaatatgcaatttttcatatatatatgtgccccccctaattttacaatgtcacaagcattgataaaattataaaagcggctaagggcgatacaacaatatcggccattatacatcggcaaaccataaccgattacaatatgaaaaacaactaagggcgatataacaaaggaggaactgattaaacggcttgctgattatcagtgatcaagggccgataattcgggaaagtacctccttgaagataaaccggtcccgtagtctgatagtcagctattgaaccatcaaccatcgacttcaccatgtttgacaaagtattgactaatatcccagattgattgatcaaagcatgatgtacggcatagtctacctgatcttggaagttattaaactgtagctgtgctgcgttactaacttggttaagattagcacctttaaatccctgagaaccatcaccttgaactccttgagagccaataccttgaactccttgagagccatcaccttggtctcattgaaaaccatctgcagcacctttatcagtcggttgagccgagccatctagagcttgtttcacttctccatccttagaagaaccggtcccaggaacatcagcaactacctttactttgtacttctgaactaatgttcccttgcgagtctccgtgaatgagctcaagaactgattccgtgcttactgcatcattgtatcaagatctttttgctgctcaagtgtcaatttatcaaaagtgatgggcacaatgttggcttcatcaatctcagatagacccagcttcaggatcttttctttaacagagccaggaccagccgaggacggcgatgctactagtttctcggccatgaggaaagctgctgttgtgattctgacttctgataggtcccaccaggcgtgccaaaagcgtgttgacgtaaaacacgaggcctgggagatctgcttaactctagtgcaggtccaaaactcgccttcgggtatgctagcgtaccagttgatttgatcctgcaatcaacaagaaacaaggacaaagaaaccgtggttaaatccataaacgatagccgatcggctaggtgccgatgacatattatttatctttgagccgatgtcatatatgcatcgatcggcaagtatcaataaataaaacagaactaaatctactcgatcggctgtagatattaacgatatatgatccttatatcgatatatacttaaaaccaagtgattgggatagatcggtcgccatgccgagacagtataaatcacttagatcgaaatatatattaataatgagattatatatattcatagcatagccgatcagatagatctagcatgtatcgactaatactccgatacaactctatactaagatatcaaagcaaatagaatatatcaaacaaaagcctaatatacctaaatgcaacaagatcttaacataaagggcagatataacatatcaacgaagcatatagagtaaaactagttaaatcaggtaagatcggctgaaaccccgatgctaccctaatcgtcaaccagaaggcaggctagagattgatattctaagcacgacttaatagatcaaactcaactgatgcagcattaagtatgaaaaaaagaacaatatctagacaatcaagccactggatgcttcatagagtggtaaatatcctatataatctaagccaacgtcactatttaacctaatcggctgccttctaccaacagatgttagccgattgtaggttagataacaatattactgaagattatataagatatatgataactcgacaaattacataaacaagattagagtatcataaagatggaagcactaatcccgagaacgcaagctgccataacaagtttacctcttgttgaagatcgaaatcgatgcagctcaacccgaaagtaagaacttgtcgaaacaaaacgaaagtaaaaagagtggcgatgcgccgagattgtattgaacgtgtgttaaattgattacatggggctcggggtctatttatacccgagaattacaaaacatgtccgtatcggacacgactcttatctctaacaaactctaagataccataagtctttgcggcagacttttgcccgaatatatctctaaggaaattacataaaatatcctaattaatatatacaattgccttctcaagactctatccatgtgtggcaatcatcacgaagcacattaactcaacccgatgatgtataccgagtcgtattgtcggaatcggctgtatcagcttacccaatctgactcggactcagccgatcctgattgtagctgatttggattccagccgattcttactctgttcccgaatcgatcttcgtctttgattccgcttcgatctaatcttcatcttcgatactgacactggtggagaaaccctttgtagtcccggttcgtaacccccctttagtcccggtttccaaaccgggagtaccaatccgggactaaagatcgctatctttagtcccgggtgaaataaccgggagtaaaaatcgatctttagtcccggttggtaacaccaaccgggactaaagatcgagctaaccttttttttttgcatggccctgttgctgcatggtttatatatatatatatatatatatatatatatatatatatatatatatatatatatataaaccatgcatatatatgtttcaatacatatatatgcatacatatatatatatatgtatatatatatatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaatcgccgcgataaattccttgtgtgtggtcaggttatccctcatgcgaataaactatatgaatgtatgaaattgattagtaattaaacaagaaatcgctacgtaatgaaattttgaatttatttgtacatacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgtaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacatatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagaggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactagtttggactttccagaagatgctttcttcagcgttcgctcatagtccgatagcttgatggtctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagtggagcttgcgggggagtaggtgtaggagcacgaggaggagtcggtgcaggatcctgaggaggagtcgatgctggagcctgaggtggagacggtgctggcggagcatgaggaggagacggtgtaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcagaatggctaaatcttacctttattgataagttcttgaaaggaatatgcagctcacatggtgtccgctgagtgatgtcatcaacgggacaggtcgattcgtcctgtgtttgcatatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccatttccctcgagttcgtcctggatgctctggagtctgcagggcgagtgtcagctcgtccctatctctgtctggtcggaacgtgccctgagaggaggcttccactgcatctgttagtcgtcgcgcagcctctcgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactatcactagcctcctcctcctggttcccctccacatccctttccacgtgcccctgctggttcccctccgcatccctctccacgttcccttcctcgttcaagtactggtttggatcctcgtttccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgacataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtcatgtatgctaagtgtttcgggcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaaaatatattaggataaatgcgaagtaacatatatatatatatattgcatttcacgttaacgttcgtcctcgttcgttcgctcgttcacgttccctagctcgttcacgttcgttccctcgttctcgcttgtcttcgttcgatcgttctcgttctcgctctcgttcgtt

SEQ ID NO: 65712 - DNA, 6521 bp, Oryza sativa
tcaacagttgtcatcccactgtcatcaatcattacgcctccactagtcaacctaacccattggcaccggaacagagaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatcaatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatatctttgttattgttgcccggacattgtctggaaggataccccttattacaactggtagcagttgtatcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgagtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatggagttctttttccacatcgccgcgtgaccatcttcgctctctatatgctggcttccaggcccctttccgaacactactttaagatctttaaccatatcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacatggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttctagtcctaacgggcagactatcttcttagcctcgtacgttgtctcgggcaatttgtttccccccggaagaatgttcttgacgagtttcaataaatcgccaaatgccttgtcactaaccccattttttgccttccattgcaccaactccagagtggtatccaactttttgtgcccccgctcgcaacctgggtacaacgaagttctgtggtcctccaacatcctgaccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccactttatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgctggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacatacattttctctctcatcaacttacaactaaattttggagacaaaaaaagtgtgcaaaacataggtgcaaatgtagtatgacaaaaaaaaacattggaggatgaagttgcaaaccttttaggcacctcgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgagatcattagtcccggttggtattaccaaccgggactaaagttaagatctttagtcccggttggtgctaccaaccgggactaaagatcccgggggggcctgacaggtcctgacagcattcgacgcgaggatctgttagtcccggttggtaacagaaaccgggactaaagatcaaatatgcccgttacccttttgaaccgggactaaagatcatctttagccccggtttttattgcatccgggactattgtggaaatcggccgaccgacgaaagatggtttctccaccagtgtgatattaccaaatttggttgttaacacaaccaaacagaataattaatagcatcatccctctaaactctcaatctctcctaaaaactcccccaaccaaatgacccgagaggggttgctgaatttttttatatataatagtccctccgtcacagaatatagacagttttagagttggacacggttattaaaaaaatagatagcattaaatagaaagagattgtgattggttgagcagtggaggtaggtgggaaaagtgaagggttgtgattggttaggaaggaaatgctgatgaagaagttatattttgggacaaatcctaagagcatgtacaatagcaggctataagtcaactataaacatattttaaagagataaaggaagagagagaaaagtagcgggctacagatctgtagccagctgcagcacggactacaagacataatgtgtgtatgacaggtgggaccaggtattaatagtatagtaagcaactattgtatgaattggctgttacattggctatagatgattttgagctaacggtgggctatactattaaaattgctctaagtgctaaaaattgttatattttgggacgaggagtaattaactagcataatgcctgtgggttgcaacggtttctaaataatatttattgacataaattaaaatccaaaatcatatattatagttgggataaacgacgaaggaaatacaaacatacaaataacttttgtccggaacgataattcaatatcatgaaaattacataacttaatccctattttttcatttacctataaagaattcaatacaaagaaaaatataaattatgataatttttaatggatcaaatagtgctaaaactaatactgtgaaaaaacaacttaaattagttagaaattgaaaaaacttattttagcccacaaatgaaaaatccaatacattaattctaaaacggtgcatgtttcattgacataaattagaattttattgttctattcatagtcctatggtctgtgagtgttccatgagcatctttgggctagaccaagaaggaattgtgtcaaaaaaaaacattgttcattgccttccctagctgaagacgagaaacaaaagaggaggggaaatgggtgtcggtgctcctatgaccaaacagtggcgaggaagatggtaggatgtgtctcacgatgtgactcgtccatagatggtggtggtcggcaatgaagaaaaccaaaacagcaggaattgggcaagcaatgtcatggtcttggtagagggagaaacgataatgacgagctctggtggcgaacacgaccggataagtgcgtcaaaacacattcctgaacgagaggattctgttttccttgaactcgcggaaagaatgaaagatggagatgtgtattggtcgctaaggtacaacgtaacgtcttgtacggttgtagtcgggtcatcaacgtttcttctaaatcgtagttatctaaactcatcgaaagattgggccaacaacagtcttgagtgtcgagtggaactcagggttcatcagtgccatgagggagagagggaggcgggagaggagaggcgcaagggagaagagggccgcgagggtgggggagcgtgcagcaacgaagagatgggggcgtcggaaggaagggagagaggcggaagcggagatgcatgggagggctggcggcgtgggggcagggggggtggggggacggactaaagcggagggaggaagccttccgtattttttaattaggtatatagataaccatgaaattgtttcctatatataataattaataaccatgaaattaaatcattagtaattcattggcattatttagcaaaatagtaaggacgctatttggaagatcgtccaggtgtggtcactgttacgagcagcgtctgggtatagacgtagcaaaacggcgtccaccaggcaaatgctgcccgataagctcccgcccaacttagaaggtttctaggtttctcgacaaaaggataccagcgctgctctgctttcttttcctcaattgttgcagcggtgtagccgcgattgcctgttgtagcggcgaagcttgatgtcgtcttggttgcttgttagctgcgctgcggcggagtagcctcctccagagtttgtaaactccacaccacctcttctatttgcggcgcgcaccatccaccccggtcgatgtttgactccaaaccacgaggcgaggtgacgtcgtctagctccacgactccacacgcaggtagacaaggtcgcctttgaccggccgcctccacagaatttgcaccacagcccacaaggctatggccaaagcctctgcctactatggatccttttttttttgggaaaattggaactatgccattataattttgcaaaatttgagatatgccatcgtgacccacatgtcattgactcatgtgggtcctacatgttattgagataccgatggcatatctcaaactttgcaaaattataatggcatggttctaaattacccgttttttttctagttctatgggtccacatgtcaaagaatttaatgtcatctgacttaaggaagaggatctcaatccaaaagagagtggccccagaccatgcacgcggcatcactccctcacttattttttagat

SEQ ID NO: 65713 - DNA, 797 bp, Oryza sativa
tacccatgaattcagaaccccagagtccgcacatcctcaaatacaaagcacttccctagttagatgtaggttagacttgccgtgtcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctaca

SEQ ID NO: 65714 - DNA, 600 bp, Oryza sativa
cggcacgttgccggctgcggccggcggcgccgagacggcaaggcagagcagcagcagcgacgagtactgcagaagaagcggcgggcggctggccattagcggcctgatggcgatggcgatggctctggctgctccggcgaaagatgtacacaaagagcaagcaagtgaaaggacttatgtgatattctaatgacaaattaagaacttgtgtgtcagtccaaggcatatgatgccgtagctttatattaaaatgggttgcttggttgggtgcatgcactggcctaaataagactctctctgcttatgttggatgcatgcatgttgttattgaaatgacaccagggaggcttcgcagaaccggtcgtttgatactttgatgtatagtgacaggtctatggtaattggaagggcaaattttacgatacttgaaaaagtatcgacgtatgaattttggtatctcgaagtgatgtacttaaatatctggagcagggtataacggcttggtttctctatttctataagtactgatatagctgaaatttcggttcaaaattatttggaatgttgaacaaaatttgattaaatagggaacattttttt

SEQ ID NO: 65715 - DNA, 8838 bp, Oryza sativa
tccaagcaaagattagtgttgatatttcttaaacggcattactagaaatataattcccagcaatgacgaagaaatattcatggtatatttatggtcacaaatatgatccgtaagcgcacggatataccattttagcatttcaccccggagtattccaagtatcatatttgtttaatcccaagggaagatatgataagagagtactatgctaatagtttatatattacttgtatacatcaaggtctatgttggggttaagtaatttaaagggtaggtgacacacagaagaaagaactatgatactctcgctaaatataatctaagctaagtggaggaagaataagaaaagaattcattcttgtacttctaatatacaaacatctttagtctaccacttgttagtatacagtcgtacaaccaatactccctaatagtgccctcctggtgtttcgagagaccaccctgtattgtcgagttccttacgacaacctgtcatggccgtctaaccggggctaaatacggaggagtatcctccccaggaatttgtcttaggaatatatactaacatggaggaatacatgtactgagttgtcaccatcagcggcccacctctactgtcccgcagcatatatgcccagatagtgatacttaataatttagacaccacatctacattattaaatactactatatatcccccgagatgacatagatcaactgagtaatcggacactaaacccacaccattgcacctctctggtaggctagctacacaactatattgatacaagtataaaatgaagccggcactcagataatataaatggaataaaataccgaagatgtataaagaagaatattctattaattccataagtcttacaaaagaagagaggaaagctactagagacataccaaaattctcctgaagacccgaggactaagaatacttttataatttctactccactagcactaggatactactaaacttgagagagggagagagctcttcttcttgagtgtgtgcagagagtgaggatgtgaggtccttacatagggcagttatgacggttaggtgatgcaaaatgttcattctgccctccaactgtcgttgagggaggcatcctggacatccacaccccaaaacctgggatcaacggcggagatggggaggctggcccaaacagcccaattttcggcaggccgtctccctgttgtctcgtcagtccagaaggcctagtggatcgtgtgaattctgtgttctttgcgcattcatccataagtctggatctcgacagcgtatgattgattgaccatttactttctgtcgattcttctccatttatatgtgcttctcctacatctatgttagtagtatagtatatagtggaagttgatattttatttgcaaattatgcattgcaagcatagctagtctttattaattgagtaatattgatggtcgaaattggtcgataacgaccgtcaacaatcagttctctagtagtgattcttttcggtgttcgcctgcacgcagtaagctcgggttatcttttgggtattactttctccgtccaagaaaaatattaatcctatctatcaatccgaatgcatgcgtatctaggtcggtagttaggattaagtttttttttataggatggaaggtgtagatcagtgtttggcaatcagctcggtttttgtttcttgttgttttaacactttttctgttactagctaattaaatgaggatagtgttggagacctaatgaaggccgacgggttaggggtgaagaagggatactgtcacataagatttatccgtgtactccctccatgctaaaataagttaatgtaggtgtgttaacttattttgcacagaaaattccctgtgtacccctgaaagttcgcccaatcccttctatgcctctgagatttgctcattctctttcatacccctaaatttcagtttgaatcccttctataccccttttgttagttgaccattaaattcctatcataaagttcattttgccctttggtattattggtatttcttaacgacattactagaaatattcattcctagcaatgacgcagaaatggtcctggtatattttctggttacagatgttatccacaagcgcaccgatataccattgtagtatttcacccaaaaatattccaaggtatcgtatttttgatcccaagggaagataatatgagtagactatgctaatactctttatacatatattacttgtatttatcaaagtctaagcaggggttaagtttaatatacgggcacagtgacacgaagctaagctatagtttaacatctaccctatagttgaacaaatggttttactcattacacattcatcatgtcacacatccaacagcctaaaatcatctgagttacatccaacgtctcccagatcgcgccctccctccaagatccctccctctctcgcgcacctccctctcccttgtacaactgccgcatccccccaacgcatcgggccccacaaatcacgccggccggggccaccccttcctttccaatagcattccctttgcctcgccatcctgctgctcgtgcccctccgcccatcacactgatccgcaccggagtcgcagtcgccacccccgagcctctgcccatcgcatcgatccccgccgtccctccacccattgcacctatccgtgccgccaccgatgacgatctcgtccgcaccgcccctccgcccatcgcaccgatccgcgctgccaggccagtttgccctcgccgcccccgatgtacgccagggcgcccgcctccacgcccccatatcaccgtcggccggagtcgccgggctcgtcctcaccaagccgatcccctccgccaccgatagaaggtacaaaaatcctcctcccctaccagatgatttgtcttgctttgtattaatgggtgcatggactggtggtggtgcggctgtcaggctcttctattatgttgcttgcaaatcagctattaagtttgaagatgtacacattttgtgattagtctcttgtgattaagagaaaattatggtgatttgccactgacactttaacagaaaattatggaggggattcttttgcagtaccagtgacatgagaaacttcagttggttcatgagatggagctgcctgactcccttctgctgggctggttttgaccctgaacctgttgtttctctgaaaaatgtgtcattttatttttagaatgaggggttgccatatttgcttgttatgccgatgtggacaagcttgtcctgttttatgcacaggaattattggtttatatactaagagcaaaattaaaatattttctacaattatatatacatagagaggctcgatttatgggcacaaacgtcctaataggtcaatttaatctctttttgggttaagcaagaactttgtattgatgggtgcatggactggtggtggtgcagccgtcagctcgctctgaactctgaggtggtttgtttttttttctcaggcgcttgcaacactacatcatttccagaacgccttcaccaaaattcactgcatgcaatcaggcgcaagggttgtgttagtgatatgccctaggggcaatcatagagatgattgtattacatactatgtttacatatttatccaactttgttccttgaaatagataactcattattagttaatgaatatgtgattctttcatgagactctttatgttgtttgttactatttctaaaagatccctgatcaaacatcatatatggaacaaatatggttaaatgatcagcacatatattaattgatgatcatgtctcatagatcatagtatctttactacttaaaaaatacgtggtggtgttggtgagtcctgtataatccaagggccgatattcctcgcaggatcctcccacagatcgaagggatcaaataacctcctgctgtcccgcaccacccccacctccgtatcgcactgtcctcacactgccccctccatcgcacgcccccgtcactcctccttcgtaccgccttcgccgctttcccagcgccgccgtcgcgccctcggcggctcctccgccgcgctgccgccacatcagtcgcgaccccggcagctcctccgccgcactgccgccacctcggtcgtgaaccccggcgcctcatccgccgcgctgctgccacctccgtcgtgaaccccggcgcctactccattgcctcatagcccctctcctcctccaaccctacggatttctcctccgtccggtgcaccgcctcttccatccccatatactattcctacttcatctctccctaccgctgtcactgctcaaaccctaagatccgaagggagggaagagaacctaagatcggaaggggagggaagagaagagcgcatatgcggtggcaacggcaacctcagcaggcatgctgtcgacttccatcatccctgtcatcctccaggtaattgattctatttttatttgatttgttggattgtctgtagaagatcgagctgctgctaactcaggatacatacacaaaaaaaacttatgccccaatcaagcatttgggtgcttggctgctattgtgctattgacggaattgaccattcttttttctcgctttgctgttcaaggatccaaacatatgttgatgaaaccggcatcacaggccaagcccaaggcaacagtggggtttgaacttcgaagacgatttaatccctgtctttggtgaaaacacaaatcatcatgattcaccatggtattaggaggtcttgattctgaaatttccaattttgcttttgttactactttatttacatagtttctgtgtagcttaccttatcgttgttaagtatggttgaactagccattttagatgctaaaattctagaagttggaggcttatccatgcagttttagatttggttggatggaatttggattcttcgaacattcttaaactatggctctttttccattaaaactttacattttccatattgtcttcgactgcttgtagacgaacaactacaggggaatatctcatgcttttatggaaccagctaatgtgagagtatcaaggggagtcttggccgaatccgttgctcatggctggtaggagtgaggagtacataggattccacactacgaggtaatctacatgcatgattcatgtgcctgttggtctctttgtctaaaatgatagttcattttggtataccacctgttgaaataaatgggctaagcccaatttaattcaattaaaatctcaagaacccacaagtaatgttagagagaataatactaccttgaaaaattaggtgaaagaacctcaacttaaatatggtgatattggagattccctgttgaccggttgaggtgatggttggactgccacacacatgcgcgcgcgccgagtcggcctcggccgtaggcgtagcgaggcgaggcggccgaccgagccgagcctgcctgctgctcttccgttttgtaacagatgagaataaagtcaccattaacaaatgaaattcattgtgttgtagcctccacaacaaatgagagattcattgtgttgtaacctccacaacaaatgagagattcattgtgttgtaacatccacaacaaatgagatttatttgtgtggtaatggagatctctctctctatatatataaggatgtgactacacagctagtggtagctgtattgtctaaaccagctgagaccctatccacctatgcttcaaataaaaatttatcttaaactacttatccgatctacgatccgattacaccgttgtgttcgtaacaattaaatctttataacaagatctcacatgattatattttgatgaaaaaacataaattacttttatagtatatctaaattacttttaaatttcactaaattacttcttagacatataaaaataaattcaataaaacctaaaattaatttgcatatattatagaagtaacttataacaaaaaagagtgtaactttaatgtatgtcttttttcattggacgtgactacacagctagtggtagctggtttgtactccatctagtctctcctttgaacttgaaaaatgcaatagtatgtatccttttttaatctctttaataacttatatcttttaaaaaaggtacactgtgggcaaatgtctggtagtattcatttcaaaaaaaagcttatatcttttagatcacatattacttctaatgtcgtgacaaagttacttccattttgttttaagttacttttataatatatgtaaattacttttagaccttattgaatttacttttatatgactaagaaataatttagtcatatctaaaagtaacttatatatatatgataaaagtaacttacatatataataaaagtaatttataaatataaatattttttcatcgtaatataatcatgtaagatcttgttgtgaagatttaattgtaacgaacacaatggtgtaatcggattatagatcggataagtaatttaagagaaaactttatttgaataggaaaaagatatacatgtctattgagaaacaaggcacacactgtgtcaatccttctcattgtgccattacagcgcggccacgtggatggacgataggcgcgatcgatcggctatgagatgcgtcgcgtgatacgactaaagcgagaagcctctcagtttagattttacgtatatataacgcaaggcagaggctctcaaagtgtgtgtcttcctcctgcattgttccttggcgatactctccttctgttcctgcgctgtctctctgtttccccggttctgttcatcccgcgcacatgggtgattggaacgagcaggtgcctccgaaactccgtccgcttgagaacctgcacgggtaggcgggcgatcaagtttttgagtagcgcttcaagcgcgactactctgcatcatcttcaccaacatgtcgacaaccggcgacaacaacaacactagagacaaggaggagcctcccgtcaacaccaacggaggcaatactgtctcaaactccagcggagggccattttcggggtataacgtttcactcttaccgttcgttcttcgtttcctacaactgtcggtcgcaatattattgcgttctcttgtctatgttgatgcttattctatattaagcacactcaagttgtatacatctagcactgtcactagatctactcatattgcaaatgtcatgtttattgtcttaatattttggattaaaatatgtcgaattatgaccaaatttccaacaatccaaaaacttgataggtctttttcggtagttggctttgctgcatcactaaaaccacatgctttcgatggttcaaattataaaagatggaaagcacgtgcacttttgtggttgacggcgatgcaatgtttctttgcttcacgaggcaaaccgagtgaaccgcctctctccctgaggaggaggctaagttcgaggctgcggattgcttgttccgtggagcattgatcagtgtgcacgccgacagtattgtggacgtttatatgcacatgccttcagggaaggacatgtgggattctcttgaggccaagttcggggtttccgacgccgacagcgagctgtatgtcatggagcagttctatgactacaacatggtcgatgaccgttctgtagtggaacatgctcatgaaattcagatgctggcaaaggaacttgagaacaacaactgcgagttgccggacaagtttgtggcgggtggcattattgccaaattgccaccttcttggtcagactttggtacttctctaaaacacaagaggcaagagttcagcgttactgatctcattggctctttgggtgttgaggagaagacgagggcaaaggacaaccgggacaaaaagatcgagggaggttctagcgctaatttggtacagaagaagaaccctcacgcatcccacaacaagaacaagaaagtcaaacctgacgtcaaacccaaggctacaatcaattttaagaataaagacaagggaaaggcaaaaggagattgctttgtgtgtggcaagcctaggcattgggccaaggactgtcctgagtgcatggacaagaagtctgcaaacatggttattagtgagggcggaggaacatcggggtatggtaaattttatctacagttctctctgtctgtcactcccctgattggtgggttgatactggtgctaatattcatgtgtgtgctgacatttccctgttttcttcttatcaggtcgggagaggttcctccttgttgatgggaaacggatcgtttgcggttgttcatggtgtaggtacgatcgatctgaagtttacttcgggaaagatcgtgcagctgaagaacgtgcagcatgtcccttcaataaagaagaatctagttagcggctctctactgtgtagagatggttttagacttgtgtttgaatccaataaatgtgtcgtatctaaatatggcacgtttattggaaaaggttatgacagcggaggcttgttccgctttatcttggatgatatgtgtaataaagttgtgaaccatgtaagcgatgatgatgatgagtccaatgtgtggcattcgcgactttgtcatgtgaactttggttgtatgacacgcttagccaacatgagtttaattccaaaattcactttagtcaaaggctctaagtgccatacttgtgttcaatcgaaacaacctcgcaagcctcacaaggcatctgaggtgaggaatttggtaccactagaacttgttcattccgatctgtgcgaaatgaacaacgtgttgactaagggggaaagaaata

SEQ ID NO: 65716 - DNA, 555 bp, Oryza sativa
  unsure (1)..(555): unsure at all n locations
atctctaacgggccttaagttggggcccgtcacggatgaccgtcanccgngacgggccccaacttaaggcccgtttgagatatggaatgttatctcaatcgggcctaaagttggtgcccgtcacggatgatggtcatctgtgacgggccctaacttcaagcccgtttgagatatggaatgttatctcaatcaggcctaaactacggcccgtcactgataggtgtcatccgtgacgggcttaagttttatgtccatctaatatgtctgtgcgaccatatctcaatcgggcacttttttagcccgattgagatgactttcttgtgacggcccgctatttccatgcatgttagagcccgtcacagatagaaggatctgtactagtgacataaatttataaaatcttaaaaatagatattaattaatatatactgtatgtacaacatacactatttttgtgagcaacatataaagcaaaaactagtccataggaaattgctttattatttttgaaatattggattttgcttggaatacatttatttttcaattggtcca

SEQ ID NO: 65717 - DNA, 10777 bp, Oryza sativa
accccaatgcctgcgaaaatagttgattttcgcaggtgcgcgctaggtccgcctgcgaaaatagcttcgagcgctaaaaaaaaattgggcagccacccccgtttccggcggtagcttcccgttctcaatccagttcccaccccttccccatccaatccattcaattcatccagttcatccaaaaaaacaccgaatcaattcatcaacagttcatccaaaatcacctaatcaattctaaaagaaagcaaataaaaacattcaacaaatcacggccgctgcccagccttcgtccgccgctgctgcacgtccgcgccgcgccgtcgtccgccaccgccgcacagccgcggcccaccgttgtccgcgctgctgccgcacggccatggcccaccgtcgtcaatgcggatctgggagggaggggcggccgggagccgccgccgccgcagcagcacggccgcggcccgccgtcgtccgcgccggcgccgcacgggcacggcccgccgtcatcaatgcggatctgggaaggaggggcgcccgggagccgtcgccgccgcagcagcacggccgcggcccgccgtcgttcgcgccgccgccgcatggccacggcccaccgtggtcactccagatctgggagagatgggcggccgggagtcgccgccgccgcctcaaccaccctcgccgctgtggccatgccaccgcctcgaccctcctcgcagccaccgcccgccgccgtgctccccccgcccccctccggccagatccgccggccaccgctctccccctgctccctcctgccagatctgggaggaggggccgggagcgtgccgccgccgccctccgccgctgccgccctccgccgccaccgcccgtcgccagccgccgccgccgggaggggaggggagaggagaggtgaggtggggataggaggagaggtgaatgagagaggtgaggggataagcttgccggctgtgagtggtgaaggtgtggagacttagaaaaaatcttctcctatcccaagtctattttcgcaggcgccgcttaagtggtccgcctggacatcaaatttcacctcgatttatatttttgtaggaggtcatttgactctatgggtcatgtccgcctgcgaaaataggactcccacgttggaaaaaatgctttttctagttgtgtttttctcaatgtatttggtgacattgcttgcgaaccttgagaagagcaatggcattatagactccccgaaatgagtagcaaacaacctctccataactgctcttatggacttggcgacgttcaccccagactcaacagggtctagcacagtatgtccttcgaattcgtcatcttgtggatcccagcttgactcgagtattttgatgtggttgatggagaaaagcttttgttgcatgatggctgttctaacttcattgaccgatggtccatacaatggaatgttaaaggagtcaagcatctccttctccacgaggccctgttgtggaaaagtaagttactttctggttttatatcaaagtcttacatgtttctactcattaacttttttatcagttaaactttttaatgtttggctaaacttttagaacataacaacatttttaacaccaaacaaacatactattgaaatatattcaacgttagtcttaatgaaacaaaaatactgttataatatttttatattattatataaatttagcaaaacctataaaagtattaaaaaatcaaaatgacttgtaatatgaaaactagagagtagataaaatctaaaaactttgaaacaatgatgttgtttcaaacctcaatgacaagtgattgtaatgcttgtgaaattaattcataaagaatatttttatcttcatcaaatatgttgtcattcttccgtccaagaaaagttagcaccatcttaccaccagatatgagttcctccgaacgcaactcaagaaagttcaagaattccttttcaaattgctcctggtatagctttatcacttcttcaggtgtagtcaccgcaatgtaaacgtttccttcattttggggttccttttcacacctctccttaaacatctgcaagcagaatcattgtgatcacaagaaatcactggctttacaaatagaaaaagttataaggctgacttatatatagagacaacaactcaaaacatcaatttactcgattttcattatcacatttctcaaacttctaaatgatgtgtgtcatgtgcaaatattttctatataaaatcattaaaaacataaaaaaaactatttttaaacttgtaatggttaatacttaattaatcatgtgttataatgattagttctgttttatgagcagtaacccgctccagcttaaatgtggtttcgaactcaacctaagtctactttgcatcctctaactacgttatggttggcatttcaaatcttccaatcatcaaagaaaaaaaaaatgttagagagcggctttattatatgcatgcctgcgagtccatccatgaaagtgccaggatctggcaaatgacctgcactgacggatccactctcgatcgtcttccccctacacttcatcgggagcttcccagcggaacatacggagtgcgtggtcgtgttattctggctctttaattttgtatgatttggctcccagatctaattttgtgttctttaattggattttccatgacacgctatcacgatcggtgcatcctcgctttcataaatgtgtcatggaaaatccattaaaataacacaaaattaaattatacgttaagcatggggatagcggatagctagcatctttcttcaaatttttgaaaggaaatgtgtaaaatgtattaaaaatatacattataccatggactagtttagtcatccttatgggctacaacatagtgcaatgacaaaattatcatgttcagtcaaaaaagagaaaaaaaaatactcatatttgtcaaaggcgaagcgtgttgagggcactgtcctagaaaacctatccacggtctctgtaccaccaacgttgatcaacagagatactattgaagcttggctgcttagcagggccgcaacaaccctcatagataagtggcacaaactcagggctaaggtaaacaaagcccaaggctttaaccgcaccgggggccaactccagcaccttgcaatcatccccccccttcccccaacacacacgcacacaccgtcactaacgctttggttcttgcaccgaccacgccttgtcctagacaacattgcccatagccacggcgatcggatctcggagccttctcctctcccttcacctccatgacctcttcgggtgctttgtcctctgccaccctcatcctatcgttggcctcattgtcgctctcaccatcctcttcctcatcctctaatgagggtcctcgtcagagtcctttgggagggacccgttctactagtgatcgaggtagttgtccacttcatcgtcaggtatttcatatagcattggtgggagcgatgacgacaaggtgtccccaccattcttcacctctctctcgctggtggtgatatactgcagctgctgcagtgagtccactatgaccggagagagatagacaggaggtggggaggcgaggtgaccggagtgagtgggagacgaggtgagaggcgagaaaacacccattgccccctacttattggaacaaagataaggcatgggaggtgaggaggcgtgccgtggtaacggagcacatgaccagcgatcagctgattggtcttcaaaggaggaagcgaacgatgttctcgtgtatggtagtggatgtagttgaagacttaaagtagttgcacgaagaatatgaatggacacaaacaggtgtgcttttcaaagtgcgctgccaggaaaatgtcattgacatgggcggccgtttgtcctgcattgcatgtgtacataaacctacttttgtaggcggtgacttacgatagccgcctacgaaaatcgtgttactatgacaccctcaaaagtagaattggtttttacgggtagctatattcagtggcagctcgtggtattatatttacacgggcggctcttgactccctttattcggtaatctaagcatgcattttgcagttttgtccgtctacaaaattaagggtgagtggtatatgaaaatcatttttctactagtggttaagctttatttagcatgcaatcaggaatcaacttatcaatataatggtaataaaatagttaaattagagcatgaataggagtatatcaaaagttgatcacatatcaattaatttgtacaagcatgtaatcatagggtcaaaatgaattataatccagtgcttagttccgcacactaccacaattagaccatcaacaacatgaatgagaagtaccacttgtatcaatatataatatgcaaagactcctaataatagcaacggcaatggtatagcactttgcacaaataagaaaaataagtaaatattcagtaaaaaaaaagaaaaatgagtaaatagggtacctcacaagtcaaaggcaaagcgcgcgttgagggcactttcctagaaaacctatccacggtgaatgtagtctatataccaatgattcaccaatgttgattagggggtgtttagattcaggggtgtaaagttttggcgtgttacatcgagtattatataaggtgtcgcatgggatgttcgggcactaataaaaaaacctaattacagaatctatcagtaaaccacgagacaaatttattaagcttaattaatccatcattagtaaatgtttactgtagcaccacattgtgaaatcatggagcaattaggcttaaaagattcgtctcgcaaattagtcgcaatctgttcaattagttatttttttagcctatatttaatacttcaaggaggtgttcaaatgttcgatataacagggtgtaaaatttttgtgtggaaactaaatagggcctaacaaatatatattgaagccgcatcaataacccacatagataagtggcacaaacactgggtcaaggtggacaaagataaaaaaccaggtggtattatacttagggttcacttattttgtttgtttttgatatttgaggggtgtaaaattttcgatttcatagttgaggggtatttcttgaacctaatagttgatgagaggagtactatattactcctcacaattaatgcaacatatatatggagttatctctactatacattatgtaatgccgggtgcaaaacagatgtgattcctttatacttgaaaaagaaatattgtgtttatctaaaatataaaatgtgcatatttttatacataaaacccaagacttgtagcttttgactaataattatactaacaaaatatatgtttagttgcacacgagttgtattatccaatatttgtattggaatatacttccgtagtatgttgatttcataattaataataaaatatatttcatttcaaaggtcaattgtagaacccaagctagaggagaggaatgatttgattcacaaactagttgagtaacattaaatctaccattaaagatcaaagtctttacgtggttccatcatataaattgaatgctaacaaaaaaaaaacttggccgagaggaattggagggcaacaagcaatgctatttttaattaaaaaaatccaaattattccctgaattttttagtccaccaaattaccccctgaacaacaatagttcatggtaactcggacattttccctttttaagtatgcatgaaactattgatcatattttctttgactgtcagtctgccacgttgcttgtaatttcaaagttagttttggaaattggctatagggagtgcctaggtccataaaaaagttggctggttgagtacattatgttggtcattttgacattgccataatgataaggttttcaacaattaaaagttgtctagtataatgttgattatcttcacatgtaccacagttgactccactctttctccttgatggtatcacagcaagaatatgatactatgcgcagtgacactatacttgaggaatcgttagccaattcttttatttcacttttagatgacgtagtaccaaccaaatgtcgtgcttaaatgtatgtgattttggatttttttttcagttgaaacttttctagagggagttaaggggtttctcccatcaccttatgtctctattttaggtatcagaactcaatggttgtgtctaatggctgtggccggaaatgtaaacaattttcattatctaaaataatgaataaacataatgagaaaaagatcaatgtacaatagtgaagattgtatgggagttaatacgcttatactatgggatgaagagttagcaagatctaatttctcatggtttacaagctttaagtcaaaacattctagtggattggtgatctattagatccaagagttgtacatacagaaacggagtaacgcactatgttgtatcattaatgctctcagcatggatattcagtacaaatctttaagggttattaaccagtttgcacactttcacgtcaaaattacataactgaattaagcactcgatgagataatcgtgttgatgtaattaccggggaaagccaatgtagggaatacgatgaatggaagaggtgaacactcttgtcagggagcacccttgtatagtaggatcttggcaatccaacaacatagtactgcggcagtgtatctgcttcttggtcttgatctttggtgaccaaattatcaagttgttctaatgatttaaataggtaattaaagtcattaccaggcagatcattcaggaagaactgaaggtcaactgggtggtgacctatgcttgcacaatatttgctgatcacttttatcacctcagagatgaagactagtgtattcggtcctgaagggcaacccatgtcggcaacaagtatcgtcttagggaggagtgcagtatatacttcttgtattgcttcctcaatcattggcttagttgcaagcaaagcttttgcctagtaacatccatgtgcacattgaataaagttaattggattggaattataacagctggattttgtatatcctttgacgtattttataatgtacaaaacatcaaactttgtaaaggaataagtaataattaattaaactacaagtacatttaccgtattaaatttatatcaatcgattcatctttcaaagttcattaaagataattacttaaaagctatttcaaatacattgaatgataaatcgacagtcaacagttgaactatttcaccgaagcataaactttttgactcattttacaccttgaactattaaaaaggttcactttcactccccttatatatcagtcatactttacactgaaaatttggtaaaatatagatgcattcacaatttacatctcaatattattttgaaattttctcactgtttatgtaggttggaagcccttaagactgttttgaacatcaaaattttaaaggtcaagcaaacagcgatgaacaagtttgattttttttcaactttgataatggtgccatctatggctctaacaaatttaggcttaaaataaaacttgtgaaaagaataggaaaaaatagaaatattattagggagtaaagtgaatcactttcaatatagtttaggcgtaaaataagcaaagaaaaatagttaatggggttaagtgattcatttatttagttccagggagtaaaatagactgtatttcaagtttaaatatgccctatgaaatcaaagaagatagtatttacacaagctagaatgtcgaacaaaacagagtaaatttatgttcgaacaaaacagagcaattttttaaagaaattttatatgaaaagttcttttaaaaacacaccatttaatagtttaaaaaacttcttaacaaaacataggtaagttataatttagagtaaaagaagaccaagaaaaaaaagactaagaccttattaggcatacttgtttgatgcgcttaaacaggaagtcagtttccatgcacatggatatgcatacacaaacggaagcactcacgagattatattccccagaaagtacaaatagtgatatataatcccatgcattaaggaaaagattaactcgtgtgtacgaaaattttttagaaaataaggaagcatagtgtgtacgaacctgtatcttcgagttcttcgcatagctgttttctccgtcccctccagtcatgcctaagtaagtttccattgaaaaagtggatacttatcctccagggatttacctaatttcttattggaaggagcagtatatgcaatgggaaacttgacatacaaggagaaaccactgtatattaattggacgtgactccacagctagtttgtctaaaccagctaccacttcatctatgagagatattatccacatataatttaaatacaattttctcttaaactactaatcatatctatgatccgattgcaccgttgtgtttgtagcaattaaatctttataacaagatctcacatgattatattttgatgaaaaattataaattacttttataatatatctaaattacttttagatttcactaaattacttcttacacatgtaaaagtaaattcaatgaagcctaaaagtaatttacatatattatagaagtaacttataacaaaaagaaaataactttaatgaatgtcttttttaattggatgtgactacacagttagtggtagctagtttgtactccatctagtatctcctttcaacttgaaaaatacaatagtatcttcttttctcattctacatgaaaaacaaaaatgaaaggaaaaaaacaatcgatgattaaacagatttatagataattacttttgaaccatgcaaaagttacttccaattaacattgaagttacttttaaaaattgttaaacttatgtgtgttgatcagtgctgattaaatttaatttctagataaagtcatatttttatccctacttttagactctgttaaatttacttttatatgtctaagaagtaatttagccaactctaaaagtaacttatatatatgataaaagtaacttacatatataataaaagtaatttacaaatataaatattttttcatcgtaatctaatcatgtaagatcttgttgtgaagatttaattgtaacgaacacagtggtgtaatcggattatagatcggataagtaatttgagagaaaactttgttagaagaggaaaatgacgtacatgtatagtaaaaaaaaagcatgcatgtagtaccatgtagtagctggacttctccacgtttatccgtgtttagacgtcgctagttaaggcaaaatcaagaggcctctccaaacagatttttcaatattaatttatagtgccaaatggtggttgtttcttgggagaacacatcaacacaaccaccatatggaacagccatgtcactgttatttttctgaggaagacaaccaccatttgactttataattctcagttttatttttttcctcaaaattcatgatttattttttgttttcacatttttgcatgttaaacctaaataaactggaccaattgaaaaataaatgtattccaagcaaaatccaatatttcaaaaataataaagcaatttcctatggactagtttttgctttatatgttgctcacaaaaatagtgtatgttgtacatacagtatatattaattaatatctatttttaagattttataaatttatgtcactagtacagatccttctatctgtgacgggctctaacatgcatggaaatagcgggccgtcacaagaaagtcatctcaatcgggctaaaaaagtgcccgattgagatatggtcgcacagacatattagatggacataaaacttaagcccgtcacggatgacacctatcagtgacgggccgtagtttaggcctgattgagataacattccatatctcaaacgggcttgaagttagggcccgtcacagatgaccatcatccgtgacgggcaccaactttaggcccgattgagataacattccatatctcaaacgggccttaagttggggcccgtcacagatgaccatcatccgtgacgtgcaccaacttaaggcccgtcatagatgactcatcagtgacgggctatatactaatcccagtttgacatgacttaatcacttaatctctatcggacattaattaaagcccgtcaccgatgattattttttcatttttcatataaaatgtttatatttgtaagttgaactatagcaaaataattaacttgcagtataataattcattttacgagtcaaaataattttacgggtagtaaataatatcaaatggaaaagtcatcaacaacaaagttgtataactcatcaagatctataacttttattttggtcatttttctatataacattttttgaacagtttgaatttgaatttgaaaatatgacaacttcaaacaacattttcaaatactaaatgatttcaactgaaaaagttatcaacaataaagttgaataactcatcaagatctataacttttattttggtcatttttctatataacatttttttgaaccgtttgaatttgaatttaaaaatatgataacttcaaacaatattttcaaatactaaatgatttcaactgaaaaagttatcaacaacaaagttgaataactcattaagatctataacttttattttggtcatttcttcatctgataaaatgatagtaacattgttcataaattttacatat

SEQ ID NO: 65718 - DNA, 8739 bp, Oryza sativa
ccgccttcggccatgagccgccgccgctagagtcgccgccgcgccaaaccgccgccgccgttagcttcgccgccgcaagagctttcccggccgccgcctcgcgtcgccggaatcccactggagcgcctctcccctcgcgagccggtgagtttttccctcccctccatctccggccggcaattcaagctgccgtggtcgtcgtctcctctcctaacgcctctccatcttctcctagggtgtcgccgctgcccgtccgtgcctccgcgtcgccggtcatcgccgccgtcttcatccttcgcgccggccgccgtgctcacagtgaggagctcctctcctccctccttccctctgtcccgcacgcgctgccgctccctgcgctcgccatcgccttcgtccgccgccgccggtctgtgcgccgcccgccgccgcctcccacgccgctggttgccgtcaccggcgaccgcatgccgccgccgttcgccatgcttgccggccggcttgaagccgaggccgagcccggtggctgctcccttcaccgtccgatcggcttgggccgatccggacccttggtcccgtggaccggccgccttgagccgctgacatgcgggccccgcttgccggcgcccccttcctctcccctttaagccgctgacccgtgggccccacctgtcggcgccgccccccccttcgctgacgtcagccctgggctttattgcgcaataattaattaaggactttttctttattagtaaaaacacagtttatcttctaaaattcataagtaattcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcgtagatttcggccttttcgtcgatccgcggtctctcgaagacgttgctgaggtctcatcagttcgagagcaaggcaagtcatgcaatacgtttgatcatattgtacccaatttacaaatatcccgcatttctattaaatgttgcattcttttacaatgtaatgtgggatgggtcctattcctcagccacatattggttaccctatgccattgataacttgggtatcaaaatgactagatgttggctaaggaaatgcttagccatgcttagttcaactagtacacaaatggggatcacattattacatagactttgtcttttggcatagctttagattggtgccaccgcaatggtattagttaattaaaatacactgaatggtgggctgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcggagggtcttgtcacgatttccccctttgcagtatcatggtgatacttcggggcatggcgacatgtgtggaaaagtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttcggcctgttgcaacgtggtgtagcgttggacagtgattggttaatattgattaattactacaactgttttactgccttcaactactacttttgaatgctagctttatgcaaaagaacctctagcctcctttggttatatcctgcatcatacctcctcttccggtatgacttgctgagtacagtgggtagtactcagtcttgctctcttttcccccacaccagagtagaagttcttctcaattggagccgtctcagagaggttggtttcgtcgctgccgtcaagggttgcctgtggaatggaatcgcccgctgcaggagtcaagtcttcaggcttagctcgcttttaccttttccgctgcatttgtaatcctttatgtttttgtaagacgtggatctgtatgtcaacaattgtcgtttgtgtaccctggctggtcctggataggggtttaatacacattcagcttagaaattctggttcgtgaatttctgggcgtgacagttgtacccaaaaagaaggcgaggactttttcgacacttattcaccggttgctcgcttgaccacgattcgagtactacttgctctggcagcctctcatggtctacttgtccatcagatgaatgttaagacagctttcctcaatggagagttggaggaggagatctatatggatcaaccagatgggtatgtactagaaggtcaggagggaatggtgtgcaagctgttgaagtccttgtatggtctcaaacaagcgcctaagcaatggcatgagaagtttgacaatacacttacatatgttggctttgttgtgaacgaagctgacaaatgtgtgtactatcgctatggtgggggagagggagtgatcttgtgtttatatgtcgatgacatattgatctttgggtccagccttaatgtgattgaggaggtcaaggactttctatccaaaagctttgaaatgaaggatttgggagtggctgatgttattcttcacattaaactactgagaggagatgagggtgggattacacttgtgcaatctcactatgtggacaaggtcctgagtcgctttggttatagtgactgcaaggcagctcctactccttttgatcctagtgtgctattaaggaaaaaccgaagaatagcaagggatcaattgagatactcccagattattggttcattgatgtacttagctagtgcaacgaggcctgcatctcatttgctgtgagcaagttgagccggtttgtttcaaatccgggagatgatcattggcatgctcttgaaagagtaatgtgctatctaaaagggacaatgagctttggagttcactacgctgggtacccaaaagtactggagggctatagtaattcaaactggatatctgatgctgattagataaaggccacaagtgggtatgtgttcacacttggaaggggcgccgtttcctggaagtcttgcaagcagaccatcttaacgaggtcaacaatggaagcagaactcgcatctttagatactgccacagttgaggccaaatggcttcgtgagctcctgatggacttgccggtggttgaaaaactagtaccagcaatcctgatgaactgtgataatcaaacagtgattattaaagtgaacagttcaaaggacaacatgaagtcatccaggcatgttaaaagaagactgaagtctgtcagaaagcagaaaaactccggagtgatagcattggactatgtccagatggctaaaaatttggcagatcagtttaccaaggggctaccacgtaatgtgatagactgtgcatcgagggagataggcttaagacccacttagagttgcacaatggtggaaacctgtccattgtgattggagatcccgtgaatttggatggcgaaacaaactattgggtaactgagagaagagacccaaaaatgagcttatcttcatgatgcacttctcttctaatctgtatggtaggatggtatacaccttaatgtgatccgagtggcttttcataaagcagagatgttggcctacagaacatcttagaaggaacacgcctatatgactccgactgctagtcacagtctatgagatctgggtgatctctagatactcatgaaaaggccaggagtatgacttatacgctccaaacagaggggatgcaaacgacagcccaataccagttaagggtttgagtgaaacctgaatcgcacaaaactgacaattacaaggcataatccattgttcagttatgatctggtgtaactcttttcctaggtggaagttcaacctaacagtctccatcaaaacactggtataactaacaggttcagttttgagaacatttcttgtgagccatgaaatttggtggggattgttgaaataaatgggctaggcctaatttaatttaattaaaatctcaagagcccacaagtaatgttagagagaataatactaccttgaaaaattaggtggaagaacctcaacttaaatagggtgatattggagattccctgttgaccggttgaggtgatggttggactgccacacgcatgcgcacgcgctgagtcggcctcggccatggacgtagcgaggcgaggcggccgaccgagccgagcctgcctgctgctcttccgtttccgttttgtaacaaacgagaatgaagtcaccattaaaaaatgaaattcacaacaaatgagagattcattgtgttgtaacctccacaacaaatgagagattgattgtgttgtaacatccacaacaaattagatttatttttgcggtaatggagatctctctctatatataacgcaaggcagaggctctcaaagtgtgtgtcttcctcctgtattgttccttagcgatactctcgttctgttcctgcgctgtctctttgtttccccggttctgttcatcccgtgcgcacgggtgatcggaatgagcaggtgcctccgaaactccgtccgcttgagaacctgcacgggtaagtgggcgatcaagtttttgggtagcgcttcaagcgcgactgctctgcatcatcttcactaacatgttgacaaccggcgacaacaacaacactagagacaaggagaaggagcttcccgtcaacaccaacggaggcaatactgtctcaaactccagcggagggccattctcagggtataacgtttcactcttaccgttcgttctttgtttcctacaactgtcggtcgcaatattattgtgttctcttgtctatgctgatgcttattctatattaaggatactcaagttgtatacatgtagcactgtcactatatctactaatattgcaaatgttatatttattgtcttaatattttggattaaaatatgccaaattatgactaaatttccaacaccaccgtcatttaggaaacttcaattctcgagttgtggagctaggttgagggtatttgattatttaatctttatagggttctgtagcgtgcactcagcccttaggacttaacatgacagtacatgagcaaatgggaaagcagtgaatttttgcatcaggctggctcaactaaatgattgttatgtccatttggttattaaaatagaattttctgttgtataccacctcacatgctattaagatacattttgatttacatagcaattatgtttctatgtaaagatactaaatatatatttggtcattttggtaactgttagtatctcaagcagtaccacccccattcacttcccacagataatcactctccactgtgtactccatttccttctttttgatctgctctgctcgcttaacttgcatggcatgttggctaacccagaattggcaactggaggggggcagttgctgttcagtggctgacttggctgaccgtaggtacacgtatctatagtcaactaataaacggtatacatctcttcatgctaaatgtatatccttttcatgacagaatttattcaagaacgaaatgaaatctgcctatagtcagtagcaactaaatttacatttttagcatgtaattaataatgtattgtttacaggattcgctcgaatgctactctcaagttgtgggcattcgctacaatgccattttcgctgtctgttgcatttgcaaaatactatttttcatctaaataattatttcttggccctttttgcccctcactgccatctctctctctaaaccacgcactcacaactgagaccgagccgagtgagaggataaaagggcaaagggaggggcaaccatgctggcgccgccgccttcccctaccatccacgacattgagggcggttagaatgaggagcaggcagcagcagttgcgatggcgcggctcggtgtggggaggcggcgcaaccgggaaggcggcggagcaggtggtgggcggccccggcgaggttggggaagaagaagcggcatggatggtgggttaaggcgacaccacggatggcgagaaaggcggcgcgaatagcgggggcaggtggcgcggtcaggaaggtggcggagtaggtggtgggcggcgccggcgaagttgaggaagaagaagcgacacggatggtgggggaaggcggcgacgcagatggcgggggaggtggcagcaccagtgtggtcgcctctcccttcgctaggggtgcaagtgggcctgtctgccacatcctgattttcactttaggattcataaattatttaataaattatttttagaatttatattaaatgttcattaatttacaagtaaagttaaatgtgggaaataaaatttcctaaatataaagtatggctggatttaatttttattaagttcgcattatactctctggaattttctttgattttttcggagctcaattcttaattttaataatacaaacaacatttaagtaattattcacatattaaattaatcattaaatggtctgattttaattttgttaaatacttatagtgttcaagtactttcaggattttttttgaaattatttgagcaatagaagtatttttaacaattcaaggatcatttcagtgattaatttaattggaaaagtaattaaaatccccttttccttttcgggccgaaactggaaaggttcacctttagttctcggcccattctccctccctttcggctggccttatccctcctccgaagtccatttcaggtccctccttcaatccggcctagtagaggatgctctcggagaaagtctgctttacgtccctcgctactgttcatcttcaacctcaggacagccgaactgagaccgagttggctcggtttttctcctccgaatccggccttatctctcgtgttttccgaaaattagttgaggggacttgtttccttatcctcctctatctctttccccaaaaatccggttttatccctttgaattcgacgcgaatttggattcgttttcgagtttatctctccaccaaaccctaggttttcccgacgcgattccttgcgttccaagcccgatatctctctcccgtggctataaatagaacccccaagctctcctctttcgtttccaacccctagctcgagctcccgtgccctagccgtctctccctgcgagtccctctctctccagcgccgccaccatctccagcagcgccgcgccgcctctctggtcaacgccgccttgagccgtcgcctccctcggcttcgcaagggtcagctctaccccggccaccggttcttttgcgccaaatcccgccgggagattgccgtcaccgtgaaccagtgggttgccgccttgttttgatctccggcgaagcctcctcatcgaccccaaggtcgccggacctcgccgcagcctccctcggcatcgcagctgcgaggagaaccccgtccacccctcggttgtcgtctcccgtcgctgaaactccgccgccaccatcgatcggtaccccgtcgtcactcccgatctcatcgccagccgtttttcatcgtcgtgccgcccctcagtgagttcccctcgtcgtgctctttcttctggtgcctcggcttggccgcctaaaccctccatcgccggcaatgatgtcgtcatgacattgttaatcctgttctgtataaggctaaaatcatatttatcttgtaaaattgataactaattcatatgaagtcggaattaagtggttcaagtctctaaattcatctaaaatcatgatctacatgtttgtctactttttatgtactgtttatttggtttttattagtctttttcttcgtttttcgtgttagcttgttgtttccgtcgttgcgaaggttcgtgagtgcgtcggaagtgttcaagaagattaattgaagaccgattattgcaaggcaagtcacacagatctcaaacaaccctttgagcatgttgaacctatctaaagctattgttttatttcaacttatgcattattttcgaatgtcatcgggtggtgagccattcccaattaattatggccgaagatgactttattttcctatgggtaataaattgattagcttggactttatatattggattggttcagctaaatgctatatatataattgcttagccataaatgagatgaatcacactacattgttacttatggttatatttaatggtagctcacgatggttaattgtgttatgataattaattgataattaaaacttgataatggtgggttgtgagcacatggttttgaaggtcgtgctcatgacaattaaggaacggttcacgagctattgttgtgaaatatttaccgtgccaagcacaagccagcgtgggcaacggatttacctttcgtatagcatggttcattgcggggcaccagactgagaagcggcgagaagtccatgagggtcgctggggagtccatgcctctggttgtagagggggtgattatgatccaggaatggtgcactgtggtgagtt

SEQ ID NO: 65719 - DNA, 1247 bp, Oryza sativa
ctatattatgccatcttttggtatccttgtgcacttgcatatttgctgtgtggcttgcagagtatgtcatatgctcaccttgcaataatcaatcaacctcagttgaagaaaaggatccagaagaagacgtttggcttataccccagttgagctgcctgtgggagtggagctgaagccatcgctagaccgttattccgctgctgattttcttttgttttgtaagtatgtaacgttattattatgatggatttctatattaaattgtcagtttgtgtacctcggctgattcctggacgaggattctatacacaaattagttcggaaattactagtgaatttctaggcgtgacattgtccacgaacccgcttataggcaaaattagtacgtaacctgcaggtttgaccaacgggttacctatcaatttgatctataaatgagttttcatatctatgatgcggtaaactggaccgacgcgaaaacccataaaatatgatttatttgacctataagtgaactcgcgggtcggcccgcttgcatccctaccctggcggggaagaagatgccagtaagcttcatttagttccttttttattcaacttcttttcaaatggatcttcagtaacatatcatatgatcatttgttttgaatggttcctctcttttttgacatgaagttgaaactttgaaaacaccctatggaaaaaggtaagattctgatctacagagggaactcaattgcaagctgatagaatgtacttacgaactgtgttctcttgtatattcatacgtagttgtagcatatatttttcgcttatgaattctattggacttggtaggccagactagagtatctgtgaggtgtcttgatttactcttttgttttgcacccgtgctagcaacctttcattatcaaaactgagatgtgccatctatagaacatcagaactatgttacacattttctagctatgaatatactaaaatgttctaccagccaattattttcttttttttcattcataagccttattttgtttctgtttatccataagttctgtagaaattggcaatatatatttttaaaccatacattgtacaagttctgacctacatttatgtgtagtaaaaattaattgatgtcatgtggcaccatctctacaatgttggatccgccctcatggtttcttatgagtttgatctcctcaataatatgaaaggagcgtggtactcacgtgttcgaaggaact

SEQ ID NO: 65720 - DNA, 2720 bp, Oryza sativa
tgggctattacacctccaacaaattaatacatgttcattgggtatcctacaccaaaggcaagaaacttttagtgtcctgtaacaaatttttcctaaatttttagccctacatgtgatttcttttttttaaaaaaaaagaacataactatacccctaaattaaatgggttgattggatccataccattatagattctcaggtttagaaatatgtcattacaatttctccatttgtaaattacaattttatagcactttgggatatgtcattgcttaccagcgcattcataaaaagttttcaaccattttacccttgtcttcttcctccttcccctccttccttcccctccccctctctctctctctctctctctctctctctctctctctcatgtctggggaagcctgggcctccactagagctcctcctctagcctttaccctgccatcaggcgctccttcattgctcgcccgctcctcgaagaggacgagcagaggacataacatgaggaggatgactagacaataacggtcgcagaatggagtgcgaacgttggttacacgaggataacaggtaggtgcttgtggcacgagaagaacgtgcagatgcccgcggtgcgaggacgacaagcaggacggcacatatgacgcgagaaggatgttggcggatgttggcaacacgacgaggacgatcgaacaatgttggcgactaggatgttggcggacgccgatggcgtgagggcgacacccgaacacggtgccactactagagctaggatctagaggtggagctccggatgctagagcttgagcaggtgagagagctccagccggatggcctcgacggatccgcacaggaaggctcgggattagctgctccggtggctcgtgaaggagctcaggcatagcagcatggtggcctactctggtgggcgggcgcccgcttgtcttcctcggagcgtgtacccatcctccttagagtgtgctcgtgatggtgctcaggttgtctgctctttctccacagtaggcaagcgggtgaaggagctagtgaggcagggtataagttgaaggactaggagctccagtggaggctcggtcttcattagacatgcgagagggagggggaaggaagaaagggaggaagaatacgagggcaaagtggtggaaattttttatgaatgctctgaaggagtaagtagtgatatatctaaaattataatggtacggttacaaatggacatattgtaatgatacatttctaaattagagaatttataatggcatctgtcctgatattggttgcatattgagttttaaagtcatgtatgcatgatatttaaaatattatagataataattgctagtgaatgatgatgtggcacacttgcatgtgatttaaaatactctagataaaaattactagtgagtgataatgtgacacacttacatgttgagcttcagaagttagtgaacatcataggatgctgagtgggactaatgaaaatccactactatggtatatgtagcagtgatttggtttgtcttactgggtttgtgttccctgatacaagctggctaggtgctcgatgaaatgtcgccatggagatcggtcactagctgaggacatcggcgtgcagcatagcagcaggaaccacaatttaccacctcaggatgcaggatttggaagatgctcggatcgatgtgaaggttcctttcgctacacacctgtaaatatcaaattgtgctgtcgaatttagtgcgattagacggttattgccaccattagctggttgaacaatggtactatatggttaaattttttttttggggggggaggggaatcaactaaatctaaagttctccggtctaagcggatacatatagatatgaatatgaacatcaatcaaatacgctgtattctgctataatgtgtattttcatcaatattaaccatttagagcttgtttgtatcaaagtttctttctgtgtgtggatgagtggggcagggaggggatgcataatttgcgtaatattcgtaaatcaaaatcctacaggagtcagtggtgtttatttgttgtttggattgaagaaaagaattaaacacgcatcgaaactccatagccatcctgagtgatagccttctctatttagattcctcaaaaaacaaaaacatgatttccctttagactcttgaaaagacaaaatcatctcaagtgccatgtgtcttctctaatctcttcggttcaatgacaagactatgaccgagtacttcacgttctccttcgcaaggtgcctctccacaatctgcgcaaacctctgaaagagtttgtcaagtatatattcgccaaaatggcttgccagcaagggctcagacactgctctgatgcacttggcgacgttcatcccacggtgagggctaatgtgcatgccatcatgttccaagtcatcgtagggatcccaattggactcaaacagctcgatatggtcaatacaaaagagcttgttccgtgtgattactgtcttcacttcatcaatggagggcccatatattggtaaattgaatgactccagctttcccttctccactatcccctgatatacgaagtcacaaagcaaaaaaattcctcatcatcagccaacagccatctatagtgtagcagcagggcattcattctacgtgaaaaaagtactgagctttagacctcagtaaaaagagattgt

SEQ ID NO: 65721 - DNA, 2332 bp, Oryza sativa
  unsure (1)..(2332): unsure at all n locations
cggacgtaaacacatcgattttattcatacgttcgacatgcctgtttatgtgcgcaatcccatcgtgtgcataaaccatccacatacaccgtgaacacctagcatacagtggtttgcaagttgcgttaaagccttgtaggcacgggcaggggtgaaccttgtaggcacctagcgatctctgcgtacgcgtagggcgtgcacgactcgcgaaatagcatatcagccatcacgtacgcgtaaactgtgttgtaggcggtactctctatgtacgtttttacgtaggcataatgcacacacctcgggctgttgtatgggcgagacgtgcgtgaagccttacgcgtacgcgtgtggtgatcgcgagttgcctacatatagttcatgcatgtccatggatcgtggacgtaaactcattcttcgtgcgcgtacactaaactttcaaacgtagcatggatatgtttacacctgagatccacacgtgggcgtgtaccatgtagagcacctcgcgatgcccacgtacgcgtaaaccgcgcacggcttacatcgaatcgacgcgtcaacccttagttgtaccgtacgtatgtgcgcgactgagccgtcctcgcagcctctttccctgcctcctgggcctgacttgcacgctgggcctaatgggctgatgggtgccggctggctggactgggggaggggcacggggatgatcgatacatccaacatccaaagtacttaacactagaaatataactagtagttcaactatataaactactacaatgtacttgcattttttctgcttcttcctcggtggcaagtctccagatgaactgtcgtcctcgtcctcgtcttcgtcgtcgtcatcgtcatcatcatatgatgcgagcagaggatcctttacgtcagcgttccagtctccgagacgtttacaaaaatcattccgcagtagacaaatcgatacgttaacatccgaaagacccaatgatccatatgagtaggctcaatatgttacgactatatggttcttacggtgaataggtgagaaatcacttcatttagtattctttttataaacaataaaacaatttcccatgcatttgcacgggtttctttcctatggagtagttacatacatatacatacgcgcgcggggatcacgagttgcctacatatggttcacgcctgcacgtggatcgtggacgtaaactcatcattcgtatgcgtaaattaacctttcgagcgtagcatgtatgtgtttacacccaagatccacacatgggcgtgtaccatgtagggcacctgatggatgtgttttcgagccttaggcacatatgtcgcgtctcgcgtgcaacaaccctgcagcgtaggatggatgtgttttcccgacgtaggagtaattggtggtgcataacccattcacctgtatgcgtacaccttttgaccgtaaatgggggattttttacatgaacctttagagcgtaaatggtgtacgcgtaacccattcgcgtctgcactagctcgcacccttgctcaacaaaaagaaaaagggcacgaagagatcctcgcaagactcacctctccgaaccccaaccccaattaattgtcccccaattaactgccctcgcctcgcgacgcctcgtgcctagcacggaataaacgcgttgattagtgaaaggagattactactataaagaaggaagcccccctctcgactctctcgctcactcccctctctctctctctctctctctctctctctctcgttctcataacttctctcttcgtccgaatcccagcgannngatggaatgggcggggcgacaatnnccgcttccttcttcttgcgtctggcaaggagaaggggaagtggaagcgacctgggggttccggcgacaaccccctaaaccctaaacccatgtgctcacttggatggacacattaaacatatcctacctccatcctaacatacagctatttctagatagctacatattttgggagtgagtgagtattccttttcatttatgaaaaaaagtataatacactcttatatatagtaatatagaaacttaatcatatcgaaattcagctacatcacatctcatttaaatcaatcatattatcaatcacctctcattcaatatcttcatgtactttgtacaattcaatatattaataggctggtcctagacatcacagtggctcgatcaacactgctttcaaacagtgtgaccaagtcattagcatgattaagactatagctaaaatttgggctattacacctccaacaaattaatacatgttcattgggtatcctacaccaaaggcaagaaacttttag

SEQ ID NO: 65722 - DNA, 530 bp, Oryza sativa
ttgcatctgatggactattatattgttcggttaaaagtaaaatgagtgtgagggtatggtattttaaaaataaatattagtaggattttattggtgagtgattctcgtaccattttttttctacattattcgctacgcatcttaaatatttcctcctccaactataaaccccccctccctttccttccctctcctccaatggcggcggcgcgggccacagtggtcgtgtcggcacgggccacggcgtcggttgtggagaatgttctcgcaaaatcgagagggtaagtcgtgtgcgctcgctctgcttctcgctttccttactcatctgctagtgtgcgtttatatgtgatgggttctttttgtgcgttgtgttgttcatctgcattgggttcattcatctgcgttgggttcatcttcttcttgcttgcgttcgcgcgtgttgtgtgcgttcgtgcgtgcgttgtttgcgttcatacgtgcgtcggtgcgtgcgtttgggtgctcatcggagacacatgatgatgtgtgcg

SEQ ID NO: 65723 - DNA, 1540 bp, Oryza sativa
tacacattttctagctatgaatatactaaaatgttctaccagccaattattttcttttttttcattcataagccttattttgtttctgtttatccataagttctgtagaaattggcaatatatatttttaaaccatacattgtacaagttctgacctacatttatgtgtagtaaaaattaattgatgtcatgtggcaccatctctacaatgttggatccgccctcatggtttcttatgagtttgatctcctcaataatatgaaaggagcgtggtactcacgtgttcgaaggaactgcatatacaaatgaaagtacgcgttgatgcgtcctggaggaatggtggtcttgcataccgctggattaggaggtcaaataataggtggcatgagttaaagttagatcattttcggctatttattctactccttccgttccacaatgtaagtcattctagcattaacattaatataaatgtgagaaatgctagaatgacttacattgtgaaacggaggaagtagatgacaagcctttactgcgactagattggtttttatggttcatgttatattaaggtttttgttacaacaaatttaggctcaatgattatttaacagcattttacgcattttacgcaatgtaatttaatatgtctgtttatttttttcccgttgcaatgcacgggcacccaactagtagagataccaaattaataatgtgaacacatgttggggaacatgttgttggatagacccaacatgagacaccgcaagagccatatgtgttgtgtcatcagtgatctcatttagtgttggtgttgaatccttagacctgagattatcatggttcccaacatgtgtagtagcttacttagagactgataaacgctactccgtaattgggtagttataaaagtagtttccgggtatgctgtgaaacatgtagtgtgatatgaataatcaagatgggatttgcccctcctatggagagatatctctgggcccctcgatgttgtagattatggaaatgcatggccatgccaaaggtgattgatgagtcaatcacaagttatataatctatcacaggttcgagtgaatgattgagcgattagaggatagcacatatctagccttgagcttaatcgatatcgtgaggcaaagtggatcatacaagtatacactagaggttcagccaatatgatctttatgtatgcccggtaggtcaatacgttctgctagggaccgctattgtcacgtggaccgaaaggagttttcgggttacagccgagtgtacatgaatctacagggtcgcacgcttaatgggccggaataaggggattggatggagatccaatatgagtttaattcggatagggattcaaataggagtcctatgggccttggaggcccgaatcatggatcctatatattcgtgaggggtgtgatcggcggaggtattgcatcatgtgagaaactctagccgccactcccctccccgagcaaaaccctagccgcgagcgggtgctagcacatctgcgcgtgg

SEQ ID NO: 65724 - DNA, 665 bp, Oryza sativa
taagaggcaaaccctacattgattttgcgtatgttgcgtgaaggcgacggctcggtttatatagagataggtcgcttgatcagggcgcccgcacgatctctactccgtgtaaccgaaccggataagtcgcgcgtaacttatccggactccacgctgttttcacgcaccggatttttcggaatgtttctaaaacaaaaacaaatccaaatttcccgcagcaaaacaaaactgcaaaaggaggctacatctgcgcaagagtgaggagctaattttgcggaccattcgacgcgtaacaacgtgcacgcgcgccgcctgcttggccaggtgagcgtgcgcgtgtgttccccctcttctctccaccacacatgcttcaagtggctaggagggcatcctcccttttaagaaggtccccctctcctagaataagcaaggtggtactaaactccacatgcatgccatcccatgaggtgggcttttgtgatttttcaaagaattaatcttcgaatgggccttagcccatctattaattccaacattgctttggtccgataagtatgtggccctaaaattttgagttatcaatatacaaaatgcattaccgatgatgtagaacagggttaggtgctgcagctatcaagacagaaactgttccatttagcattcta

SEQ ID NO: 65725 - DNA, 617 bp, Oryza sativa
ggattttgggttacctctcgggtattttaataagttccataacccatccttgtatggaaacataattctcctcacttttagtctagatttcctcccaacatcaaggtttatcacttgctgacggagcatgggggtcctcaccggaagcccgcgcaggcccccctttgccggttcggccgggggcgctaagtaaggttcttcgccctcgatctgaggaacgtccgcgagagagtaagtgcacaagacacggccgacgtagacaggttcggtccgctggaaagcgtaacaccctactcctgtgttctggtggatctgtgcgtgaaggaatacagagagctggagagcgagccagagttcagggtctagcacccattccccttttttctcctccctccagagtcccctttctttttttcttttctcttttctctccagagtccccccctcttaggcctgggcaccattaaagtttctcctgtgcaacctatgagtaggcaatggttacaaagtataaagttccctgctccagttgatctgttctgtctctcaattgcctaaggtggtgagaagcgggtgttctacaatttttaggcgtaagggtaagcctccgtggggta

SEQ ID NO: 65726 - DNA, 691 bp, Oryza sativa
ttaaaaatataccttttttccctgaatttacattaatatatgacttctaattagcgtgcacaaatataccatgttgtcttcagcatgcggggactattgcttgagaacgcgagggtcagtttaaagacggcatcatataactcagcaaacttgtgagctactacctccgtttcaggttataagacgttttaattttggtcaaagtcaaattattttaagtttgattaagtttgtagaaaaaagaatattttcaactcaagaaaaatttattatgaaaatatatttaattattgatttaatgaagctaatttggtgttacaaatattattatatttatctataaacttagtcaaacttgaagtagtttaatagtcaaaacatcttatagcctgaaacggatggagtactttgctgcatttgagttggcaaatgccgagccaacataataaaccagtgtaataatgtaattaaatccacctacctttctgtataattgtgatcatatttgattgacgacatcatgcgccagcatccagacgagttcaagcagatgggatgcaaagtcgatgatgtcctcggactgacccgaacgagtgcatgcagacatggtgcgagctcgtgaccacacggcccagtttacatagaaaatatgccatctcgcggccctataaaattacttcgcttcatgcct

SEQ ID NO: 65727 - DNA, 635 bp, Oryza sativa
ttcagtgcatcccacaactccttagcgtcagtcaaatgcatatacacctcgaccagacgatcgccaagaacgctaagaatgcatcccacaaagagagtagtggcttcctcgaattgcttctgctgatcagcagtaagaactccttcaggtttgccagtactcacccagaagcatttcatagctgtcaaccacagagtgaccctgatctgccatctcttaaagtgcacaccggtgaatttatccggcctcagtgcatcggcaaaaccagccatagtaaaatcacagcgcctataataaggtttttggattgtagaaattataagcacataatgatttaatttattccataaataaatcatgacattgcagatgtaaactagcatgaacacatcattagatctacacatgtaaactaagcagtaaaacatgaacggatcaaatatgcacaacatgtcgaacacgtaccgaggtggcggaaaaaccggttgctcggcaggtactactcgcggttgcgggcgttgacgaaggcgcgcagcacgcgagcagagaggaaggcgagccgtagcgaacgaacagggagcagtcgcgcgaagcgcttccaaaaaccttattgccgcttttcccgtgcaagacat

SEQ ID NO: 65728 - DNA, 514 bp, Oryza sativa
tgaatggctcaattcggagttcgaatgaatagatatgaattttagaaggttttgagccattaaattaatatctataattattaccaaattattgcgcaattattaaatattttcacaaaggaaaaggactgccgctgacgttagcaagagagggggccggcgccgacaggcgggtcccaggcatcattggctcaagggggctcggtccaccatggaccgggaccacaagggcggtccaccgcccgtccacgggatggacggcccagatcggcccaagccgatcgggcggctgatgagagcggtggccgggcacgggcacagccggggctggcccgaccgaccacagagggcgggggcgcgcagtcaccagcaacggaggggggcgggcggcacagggagcagcggcgcgcagcgcgggaagcggcgagaggaaacggaggcagtgaggaaaaggaaggtggcggagctcaccgaggggcacggcgacggcgagagcagcccgcggagggaggcg

SEQ ID NO: 65729 - DNA, 680 bp, Oryza sativa
tacgtagttgtagcatatatttttcgcttatgaattctattggacttggtaggccagactagagtatctgtgaggtgtcttgatttactcttttgttttgcacccgtgctagcaacctttcattatcaaaactgagatgtgccatctatagaacatcagaactatgttacacattttctagctatgaatatactaaaatgttctaccagccaattattttcttttttttcattcataagccttattttgtttctgtttatccataagttctgtagaaattggcaatatatatttttaaaccatacattgtacaagttctgacctacatttatgtgtagtaaaaattaattgatgtcatgtggcaccatctctacaatgttggatccgccctcatggtttcttatgagtttgatctcctcaataatatgaaaggagcgtggtactcacgtgttcgaaggaactgcatatacaaatgaaagtacgcgttgatgcgtcctggaggaatggtggtcttgcataccgctggattaggaggtcaaataataggtggcatgagttaaagttagatcattttcggctatttattctactccttccgttccacaatgtaagtcattacagcattaacattaatattaatgtgagaaatggtagaattacttacattgtgaaacggagga

SEQ ID NO: 65730 - DNA, 17579 bp, Oryza sativa
gctggtcaacgggtggaaaacaggatcgcgtgattttctctcggtttccttagccgagagattatttcccaacaatcccttgatatcatcttgtcacatacaactatatatgtaaaaatgaaaattggatggtttgcattaggtcctttgaataaaccatgtttcttgttaggtcctgtagcataagttgtactttaattgtacttcaattgatctctgtgttgtgctttaattgtactttttattggaaagaacatgctaccacaatttttagtagatctaaaattttgagcattgtcaaatcgtgctacagatattggccttcatagactgttggcgctagatgtctgtgactttgatcaaacagagctcttgtttccaatgttactgatggcaaaattttattttattttattttttccttggcaggaactttgcaaaccattttcaagtttcagaagcttctgaagatatcattgtgtgggaatagtaatgttgcacagatcgacacctgttcactcttatcatctgaattaagatttggtactactctaatcccatgataaatacttatatgcaatactcaacctaaggttcttccagctgagagcgttatactgaaaattatgatcagactaaccctgaaaaaattaatgaaattttacctgttgtggtgtttctgggagctggttccatttgctcgtacgcttgtggcctccggtggcagcgcggttcaggtgttcagctacgcgtggctatgttgagttagtacggtgcgatatcaaccagtgcctttgatctgtcgcattttgatcagtgatgctcatttagtgagttcttacctgtgctagattgctagaatgctaaatggtacagtttctgtcttgatagctgcagcacctaaacctgttctacatcatcggtaatgcattttgtatattgataactcaaaattttaaggccacatacttatcggaccaaagcaatgttggaattaatagatgggctaaggcccattcgaagattaattctttgaaaaatcacaaaagcccacctcatgggatggcatgcatgtggagtttagtaccaccttgcttattctaggagagggggaccttcttaaaagggaggatgccctcctagccacttgaagcatgtgtggtggagagaagagggggaacacacgcgcacgctcacctggccaagcaggcggcgcgcgtgcacgttgttacgcgtcgaatggtccgcaaaattagctcctcactcttgcgcagatgtagcctccttttgcagttttgttttgctgcgggaaatttggatttgtttttgttttagaaacattccgaaaaatccggtgcgtgaaaacagcgtggagtccggataagttacgcgcgacttatccggttcggttacacggagtagagatcgtgcgggcgccctgatcaagcgacctatctctatataaaccgagccgtcgccttcacgcaacatacgcaaaatcaatctagggtttgcctcctactctgtgctacgccgtcgctcgtagacaactccatcccgctcgccggcgtgcaccggcgatcaggagagcaggtctccggaacctctaccttcgatgtcctgcacggggagaaggcggcaataaggtttttgggaagcgcttcgcgcgactgctccctgttcgttcgctacggctcgccttcctctctgctcgcgtgctgcgcgccttcgtcaacgcccgcaaccgcgagtagtacctgccgagcaaccggtttttccgccacctcggtacgtgttcgacatgttgtgcatatttgatccgttcatgttttactgcttagtttacatgtgtagatctaatgatgtgttcatgctagtttacatctgcaatgtcatgatttatttatggaataaattaaatcattatgtgcttataatttctacaatccaaaaaccttattataggcgctgtgattttactatggctggttttgccgatgcactgaggccggataaattcaccggtgtgcactttaagagatggcagatcagggtcactctgtggttgacagctatgaaatgcttctgggtgagtactggcaaacctgaaggagttcttactgctgatcagcagaagcaattcgaggaagccactactctctttgtgggatgcattcttagcgttcttggcgatcgtctggtcgaggtgtatatgcatttgactgacgctaaggagttgtgggatgcactgaatactaaattcggtgctactgatgctggcaatgatctgtatatcatggagcagtttcaagactacaagatggctgacaaccgttctgtagtcgaacaggctcatgagatacaaaccatggctaaggaactcgaactccttaagtgtgtcttacccgacaaatttgtggccaggtgcattattgcgaaactacctccatcttggagaagtttcggtactgcactcaatcacaagagacaggaatactccgttgaggggttgatagcgtctcttgatgttgaggagaaagctcgggaaaaagatgctgcgtctaagggcgatggtgggcagtccagtgccaatgttgtgcacaaggcccagaacaagagcaaggggaaatacaaagctcaatagaccaccaacttcaagaagcagaagaagaacaataacaatcctaatcaggatgagaggacttgctttgtgtgtggccaacctggtcatctggctaggaagtgtccacaacgcaaggggatgaaggcacctgtagggcagacttctaagtctgctaatgtgaccattggcaacactggagatggaagcgggtatggtaatttacctactattttttcagttaattagtctactaattggtgggtttatactggggccaatgtacatgtttgtgctgacatctcattgttttcttcttatcaggtcgcacgaggttccaccgtggatggggaatgagtcatatgcaggtgtgcatggtattggcacggtagatctgaagtttacttcaggaaagatcgtctagctgaagaacatgcagcatgtctcttctatagataggaatcttgttagtggctcccgtctaactagagacggatttaagttggtttttgagtctaataaagtagtcgtgtctaaacatggatattttattggtaaaggttatgagtgcggaggcctgttccgcttttccctttctgatttctgcaataagtctgtaaaccatatttgtggcagtgtggatgatgaggctaatgtttggcactcacgtttatgtcatattaattttggcttgatgtctcggctttccagcatgtgtttaattcctaagttttccattgtcaaaggttctaagtgccatagttgtgtgcaattgaagcaacctcgcaagcctcataaggctgccgaggagagaaacttggcaccactagaactcctacattcagatctttgtgaaatgaatggggtgttgacgaagggtggaaaacgatatttcatgacgttgattgatgatgctactagattttgctatgtgtacttgttgaaaacgaaagacaaggctctagactattttaaaatttataaggcagaagttgaaaattaacttgatagaaagataaaaacacttaggtctgatcatggtggagagtatttctcaaacgagtttgacttattctatgaggaacatggcattatacatgagaggacgcctccatattctcccgagtctaatgggattgctgaaaggaagaaccgcacactgactgacttggtgaatgccatgttggacatcgcggagctacctaaggcatggtggggggaggcattgttgacctcgaatcatgtgttaaacagagttcctaatagaaataaggacaaaacaccatatgagatatggattgggagaaaaccatcactttcttatttgcgcacatgggggtgcttggcgaaagtcaatgtaccaataacgaagaagcgcaaactgggacctgagattatggactgtgtctttctgggatatgctcatcacagcattgcctatagatttttaatagttaaatctgatgtacctgacatgcatgttggtacaattatgtagtctcgtgatgctaccttctttgagagctttttcccaatgaaggatacacatagtagttcgagccaaccctctgaaataattcccagttcgatcacaccaccagaacaaactaaacatacacacgaacatgtcactaaggaggatgtcagtgaagctcctcgaaggagtaagagacaaaggacggctaagtcctttggtgatgatttcactgtgtaccacgtggatgacactcctaagtcaatttcagaagcatatgcatctcctgatgtagactactggaaggaggctgtccgtagtgaaatggattccattatcgctaacgggacttgggaggtgacagagtggccctatgggtgtaaacctgtagggtgcaagtgggtgttcaaaaagaagctcaggcctgacggtactattgaaaagtataaggctcggcttgttgctaagggctatactcagaaagaaggcgaagatttctttgacacttactcatctgttgctagattgaccacaattcgtgtgctaccttccctagcagcctcacatggtcttctcgttcatcaaatggacgttaagacagattttcttaatggagagctggatgaggagatctatatggatcaacctgatgggtttgtagttgaaggtcaagaaggcaaagtgtacaaattattgaagtctttgtatggtctgaaacaagctccaaagcaatggcatgagaaatttgacaaaacattgacatctgcaggctttgcagtcaatgaggcagataaatgtgtgtaccatcaccatggtgggggtgagggagttattctgtgcttgtatgttgattacatactgatatttgggacaaaccttgaggtgataaatgaggttaaatcattcttgtctcaaaattttgatatgaaggatttggaagtagctgatgttatcttaaacattaagctaattagaggtgagaatgggattacactcttgtagtcccattatgtggagaagatcttgaatcgctttggctacattgatagtaagccttctccaacaccttatgatcctagcttgttgcttcgcaagaacaaaagaattgctaggaattaactggaatactcccaaatcattggctcgctgatgtacctggctagtgcaactaggcctgatatctcctttgctgtgagcaagttgagccggtttacctctaatccgggagatgatcactagcgtgcgcttgagcgagtaatgtgctatctgaaaggtactatagaattggggcttcactatactgggtatcctgcggtactggagggttatagtgattctaactggatctctgatgtggatgagatcaaagccactagtggatatgtcttcacactgggtggtggtgctgtttcgtggaggtcttgcaaacagatcattttgacgaggtcaaccatgaaagcagaactgacggcactggatactgctactgttgaggcagaatggctgcgtgatctactaatggatctgcctattgttgaaaaaccggtgccggctatccttatgaactatgacaatcaaacggtaattgtaaaagtgaatagttctaatgataatatgaaatcgtctagacatgtgaaaagacgattgaagtctgttaggaaattgagaaactccggggttataatgttagattacatccaaactgctagaaacctggcagatcccttcacgaagggactatcacgaaatgtgatagacaatgcatcgaaggagatgggtttgagacccatgtgagttatacaatggtggtaacccagtctatgtgatcggagatcccgtgaattagaacctgggaagaacaaaccattagtaaactagaggagagtaccaatctataccctctctaagtgaagatgcatgtactctcgtgagctgcaaggtaggttggttatggcttaatgagttctgttggctttaattagcgaagatgttatcctgcagagcattcttgaaagaactcacctttgtaagcttgactattgatcgcagtctatggagattttgggtgaatcttctaggaagcttactaaagacctaggagtatgacttatacgctccacccgaggggtagtctacagacggtatagtactagataagactctgagtgaaacttgcttgcacgagacttgcaattcaaggcgtagtccattgttcaagttgtgagtaagtgtagtttggagttctaggtggatgttcaaccttaatcggtctccatcgaaccgctggtatataaacagtacatttgaaaaggcaaatctcagtgggattttgagatttggtgggggattgttggaattaatagatgggctaagacccattcgaagattaattatttggaaaatcacaaaagcccacctcatgggatggcatgcatgtggagtttacgaccaccttgcttattctaggagaggaggacctccttaaaagggaggatgccctcctagccacttgaaacatgtgtggtggagagaagagggggaacacacgcgctcgcctcgcctcgcctggcagggaagggcaggcgcgtcgtgctcctcatccttgcgcagatgcagcctccttttgcagttttgttttgctgcggaaaattcggatttgtttttgttttggaaacattccgaaaaatccggtgcgtgaaaacggcgtgaagtccggataagttacgcgcgacttatccggttcggttacacggagtagagatcgtgcgggcgccctgatcaagcgacctatctctatataaaccgagccgccgccttcacgtaacatacgcgaaatcaatctaggatttgcctcctactctgtgctgcgccgtcgctcgtagactactccatcccgctcgccggcgtgcaccagcgatcgggagagcaggtctccggaacctctgccttcgacgtcctgcaccgggagaaggcggcaataaagtttttgggaagcgcttcgtgcgactgctccctgttcgttcgctacggctcgccttcctctccgctcgcgtgctgcgcgccttcgtcgactcccgcaaccgcgagtagttcctgctgagcaaccagtctttccaccacctcggtacgtgttcgatatgttgcgcatatttgatctgttcatgttttactgcttagtttacatgtgtagatctaatgatgcgttcatgctagtttacatctgcaatatcatgatttatttatggaataaattaaatcattatgtgcttataatttcaacaagcaaatgtacatgatacagagagaccatttctgaatttaacaaatttagaaaccaatgtagccatggtccagaagaagtcaaagaaccaatctgactgtatggaggtgtagatgggatcgtgtttgctgcaccaatttctggggaggcatgcgaaggaatgaaagggtgcaaaatggaaaatagcaagaggtggttaaacaccatcatcatgttgccgtaagtatgtaattaggatgctaagcataatttagcaaccgacaactgcatgttttcttagggatttctactactctcgagggatctgtctaagcatttaatggctgaggggtttggctaccatacaggtagcctagcaattaaattgggttagtggagtgtatttggatttttcattgtgctctgatttaatctgcactaatagcttcaatttttcacttttgaacttttcaagcaaattgtttgttttcatgcttctatgtaattggaccccgattaattaaccattgaatttatgccgaaagtacatggcaaagattgtgaaaaagaaatggagtagtactatttgtagatttaaacatatataatttataaacaatttatatgtagcctctgtaagttggttttcttttgaattcaggtaaggtttatctctccagtctagacatcagttttgctacactacagtgtattattcctaatggtatatattacaattgtctatcagaattacgatggtggcatattcaataagatcgttgcttgaggagagaactgggagaatccaaaggttcctaacgaataagttagcttgttttttatttactaagataggcatatggttgcctggtagtgatgatggttttgatgggtaggttttctctaagatggaagacattaatgctccataagcacgatgcaatagtattgtatctaatttagttcttaacgatgatgtcgatgctaaggctccagaacataatttatttatttagatttttttctttcttttacgtttttgtgcttaatacttgtgatcttgtttgaacataatgtcagaaaacttttgaaacatatattgttacttttggttgtttgctttacattataaataatgtcgtagcgttagcacggacatattactagtaaaataagtttaactaagtggaagaaacataaagcactctattactattcttctaatatacactcaaatcttagtttacatctgctaatatacaatcatgtggccaataccccctaacagtgtcctcctggtacttcgagagaccaccctgggttggcgagatacttacgacaacctgtcatggccgtccaaccggggctacatatagaggagtaccctcccttcgaatttgtcttaggaatatatactaacgtggagaaatacccatactgagctatcaccatcagcggcccacctctaatgtcctgcaacatatatgcccaattaatgatatttaataatctaagcaccatgctaacattactaaatactactctatagccgtgcacccgacatagagcaactgataaattagacattaaactcgcaccattacacctctctggtaggctacccacacaattcatataatgcagatataaagtaagaccagtactaagactaagcaaagcaccgaagatatataaagaagagtatttcattaatacggaaagtattacagaagagattacaagagctgctagagccataccgaaaactcttccgaagactccgaggactccgaacactattctatactactacacttagcattataccactaatactaatgtatgaagaggaattgagcttgcttgagtgtgttgagaagtgaagtgaactcctccttttatagggtcggtatgacggttactgatatgcgaaatgtcgattttacccctgtaaccatcatcagcaagcaatcttggatatccacgtgtaaggctaggctgattggacgccgccagggttcggccgaacctgggctggcccaacaggcctccagcttcggcagggtggctgacaggtgggacctcatggcgattttggcagttaaggctgtttccggcggttacacttgacatgtgggccctccgtatccatttgcttgtttaggagtgaggttttctccaatttctctttattttatttgataaattcctgcaacatgttattctccaagtacaagtggaaatatattatttgaaaacaaacatgcattgtaagcatagctaattcttcattattttagttctattggcagtcaaatattgtctgtaacaaccgtcaacgaaacccccaagcttaaacctttgctcgtcccaagtaaaggacgaaaggaaaataaacttggttgttgatcaggagttgctaccattgttatatttaaaatgtacaagtgcatagtttgagtactctctctctcatgttaagtaaatgtgcacggaggcttacccttacgcctaaaaattgtagaacacccgcttctcaccaccttaggcaattgagagacagaacagatcaactggagcagggaactttatactttgtaaccattgcctactcataggttgcacaggagaaactttaattttactagatgctagggcgcgccattgcgcgctgcctgcatacactaaaatacgtccatgtactaaatcaatcaattgataaatatattagtaacatcatatattctatattaactctcctgtgtatatcaatgacaccagacttgagtcagtaatccattctatgtaacaaatatcccatgtaactacaaagtaatgggcactttattatcaatgcaaagcatcccctactaaaacctcagtttgttacactattagttcaaacatgaacacaatgctttcattatataaaaaatataagtaattccgcgtacaaattgctttggtacatacaccaagagaatgcattggtgtcataaataattgatgacaaatttaaaggtcataatctttgcaaataggacaattgaagaacaaagggctcgactttccaatattagattcagcatcgcatcacatcctgaaaaatgtaaacaggttgaaatgaaagcaaacattagctaattaaatcacattcaaaagaacctgcagacctgcaggtacatactaataccctaatagtaacatcttatcatagtgcgcacacactaagggaaaaaaggacaaccttgtttctaggcctatcagtgctagaggaacattgatccatggatgtatttttatgaggtagcagcaatatataggagtattttgcaaaatcacattcatcaagttataaaccaaaaaaaaaaaggattttacccttgaagtaatgccattctatcttctcacagctgcagttttgtagccatatacaggatagtgtaagtggagccaaaattgtagcatatctattgtgtcatttgtggaattactaatattagtatccttcaagctgaaagtgagaaaagcataagtaacttaataactaataagtctccaaaggctcatccatcttttactaatataaaaaaacatagtggcggtgatggtagcattctatgatgaataatattgtactatctttttggtaaatgagtgaatcattccattagatactcatctgtatatgcatgaggccatttcatttaacgtgaactcataaggaaatattttagatttggggataccattttttttctagtttagaacttttgatatatttatgacaaccatcgacaaaatactgatttcaaccaagtataacttcccaattttttgctgaaaactaatcaacgtctagcataagatgcagggatacgcaaacatgatttacatatttataaaaatagtcatgtgcagagcacccacacaataccaagtgaccgctggcccttttgaaagcatgaaagagcagggaaaatagatggctaaatccacaatatatacatgcattttttgcgaggattatatacatgtaatccatacacctttcttaaatgaaatacataaacaacttgcaaaccaaaaataaaagcacaaagggacgcttaaatacataaaaagaagatatattgacatttaaaagaaatcttaatcgtatgagtaaaagctagagaaatactacctccgttttttaatagatgacgctgttgactttttctcacatgtttgaccatttgtcttattcaaaaaatttacgaaattataatttattttgttatgagttgttttatcactcatagtactttaagtgcgatttatatcttatacatttgcataaaatttttgaataagatgaatgattaaacatgtgaggaaaagtcaatggcgtcatctattaaaaaacggagggagtatgtatataattcagcatcaatccatgtatcagtattatatctcagtgctgacatgagtaaaaaaaattgaggtagcaaattcttatattaaaggagaaaaacaacactcaccttcctggttaatgggactttttagcccacagtgcacaaccttttctgtaagcttgcaattcatatctacagcaaagcatttgtagcttgcaattcatctgtaggacaggcatataataaaatctgtcagccatcggcaatggcagtgtgagcatttctattttctttacttaccaaacactgtgaggctctcaacagaactggatagggctctctcaatcatttcatggccaaggtacaacaatcctcatctaacttagatgcttcactttcctgattacaagtttacaacatctccttaaaagttttgaaccataagcaaaatttatgtatatgctatatggaaccaaaaccttcaagatcaaactaaaaggtagtctaaggaacaaaatctatgccaaaacggtaacgataactactatatttgaaaaaatacttgataattccaaaaaaaaatatccacgagattcatttgagtaaataatgagatggaaataaaatgtagccttgaaagctattgtaccaatcaacagcattctgtttactcatgttcaaatgaaaaggagcacataccatgcccagagatttggaagtataaaacaactgaagcatcactcaccatggcttccacaatgtccttgactgtttcaaggctgaaatatttttctatagcctccagcctatagtaacacagaacaaatgagatatacatgaacaaataatacatttttcctaatcagtgacatgaacaatgtggatgctatacatacattcacatgaaaattcatcattatttaagaatataaaaaagcatgcaaggtgaccccattctcagcacattcaaagtgcaaccaatgtatattactaccagtcaattatattaccaagcgaacctagctcccaaagaaatatataaaccacagctttacaggtaatgcaaagattcatgaaccacacaaaatagcactcggcttgattaaatgaattaagaactatatgccttataaatatagaactatctattccatatttccatgacagttttgtgtgtctttctgcagaataatgtaattacactgaaatagatgatggtctgagttctgaaatgcagtccaaaacatttttaccaagcaaaggaaagcatcttgattctactataattcccatgctatgtttaaaagaggacaagattatctagcattccagcaacttctgcatatgacatgttaaagcacttaataatacattctcagtttataaattagaaatatatttacttcttatatgtcttacctacaaataatgctattcttatccggatacacaatatcctcatgtatagaaataatgctgtcatcatgctgagagagagagagaggtcatttgtgaagaagagcaatactgattcagaactaatcatcagctgagaaaaataaatcatattatagtttcaggtttgtcactctatttagtaaataatgttgttccacttttttttgttaatgcgtaagttccaatcttagcatacctttgtcgagttaaaatgataactacacaagtttcttctgtctttgacaccttggtctccacagtttcatttcacttttcaaggatgaatacaaattaccaaaggggtccgtgattgagccctcaagagaatcaagacatgtgcttaaaataagtagtaagctctatcttcaccatttcttccctttctttgtcgtttttttattgacagctttgtagttgatttgagacagtgcagatagtatttactttgatggcatgaagaattttgagaatcaaactgaaatgttgttagaatgaatgggcatgtgtctgatacagtttcccgatacctgggactattttctcattctattcatgcatttggttagcattgagtgcatgaagagtagcaaataagtcaccacagataatgctgtagaaaatccatggccttttcataattaaaccaacttctatcctgttttcattttatcatgccaaaaggaaaagaaagaagaaagaaacatcataatcatgtaacactgtgaggtagcatttcaatgcaatgataaatccctgtcacgttttattgctgcttatttcatttcatattagttccaggtaaaatttaaacaggcacactccgctcttcattataagcttatcttctgtgtttttgtgtagttgaaggagaagaattggggagcatacacaacatgcttttgtgcaagtctattttagatctctagaaaggagacgatccatttggcagaaaatcaaaagaaatccaagaagacatggcttctactcttaaaactgaaaggggcacttaaggtttaaatggcatatatcatgtttcgaagagcttgacgttttatttctgggagttcagacttatgacttatgagagcattcttagctctgatcaagtatattctttgcatcatttttatttgcttactaactttactcttctagccttgaactctctcaaaacagaatgagcggagtaaccttgaattttaatcttgcaagacatttcaatgtctggaaattgacctaagtaaacatgttcagaggggaaaaaaggaagaagagagaaacagctggctgctgggttatgcaaatgatctatagaatagttagcagaaactcgtctggggaagcaaattatgtgcatatttcacgcaggatcatttgcacaaggcccagcttgcgaagccaataatctaatgcggtaacccagtaataaattcgaggttcagagagcattgacattccaactcgatgtaatcgaagtaaccaaatcaccaaataccccccatgaaagcaaggacagcggtattgatttcagtattttacaccccaaaatcagaacacgaattcggccacagtaatccagatcttcagatgcatgaggcccgtcaaatacagcagaataaaaattatcatcagaattaatttagagcctcaactgacctgaatatattgatcaatacagcagggcctaatctggaagctcaggacgacattagcatgatgcatgtttgcatggctccaactcctggactcctgagaaaccaaacatggccttagatattttctcctttaaccacatcaaatcattgaagcaaattacattcaaataaaaagaaataacagaaccagccatagaatatatgcatcacatcattagtaattagaagtcatcagaacactgcaacttaaaatgccagagaaaacacatgtttactgctatcaaccaatagcacttggtttcactggatatattggcatgatttaatttccatatagataccaattaatagtgatgttatcgtgtaataaaaatatactgcatatatggaaagcgagtgattcctttaaaggagcagcttggaatatgttgctcatacaattgaagatgattctaaggaacaaaacctctggaccgatacaatgtaaacaagaccaaaaatcatctggctttgcatcacttgaaacaaaataaagtaaatacatagtctgaaatatacacttcctgataatcttgaaaaatctaaggcttgatgacatattttatatccacggatagtttaacctgccatatttatcttcgccctagcttatctgtattccacaaatttatgaagtagaagaagtatatctgcatatctgacctcatagtactgaatacacataggtaaaagagaaatgcattcttcagtcttggtgagacagaatcaacagttaagaagacactacagatggtcgacatataaaaccactcagacattgttgtggcttggattaagaatgtacgtaccctgaaattagtgtcaggttcaagaaaattaccagcataactggtgcccgtcgcaatctgtcaaattcttcacttacaaattttcctcacttccctttctcctctacacaagccatagaacaaataaatttacatacttttagtaaaagaactatagcagccacatcgaacagtacactgggggaggttcggtttggaattgtggcgcttatgacataggtttcactagactactctagaccttgcaacacatcacgagcttgcaaataagcattgtggtagctaaagcgacaacccataagaaagatcaatgttgcagtgctgatcaatttattttcaccccttgatgcaaatcatctaaaaacctggactaccatcatattacctgaagatgaattattgagagctgaagaacatggaaaattctggtatgcaatccaaaggtgtcaaacctgacatgaaaaaggaaaatgatcagatcaacagaggctcatcataccacaccatcctcaattttaagtcaaccaatctcatattatttgcaattgactgaaacctctgcatgaattaattatttttgtctctcttttccttatggctatcaagcaaccatcagtgaccaactgcagtcccattttaagtatttaacatttaagaaacattaagtacagtaaaatgggagattgagattaacatcttttgaataatagtgccaaatataagctcatcctcctaccagttgtactaaaaaaatttgactgccaataaccaatacgctaactactaaaaaaattcatccagtatgtgaagcttctaaatttttccacaaacacactccaaaatcctattctataactaagtcccaagaaaacctaaaataccaagaaaaatactaagaaagagaatagattaatgcatctagaaatgaatcataacagattgctagaagtgattcgctattgattgttcagagggcaacgagtatgaaatatagctaaccaacctggtcctctgtgttttcagatgtcatggcatggtcacagcaagcagaacaaccagctatggtggaggattgatcagagtcgtttatatgatcctcaagcacaacactggaatgaaaaggtgccacatgtatagaaatacaaatctgaaatattaagtaaccatggggaaaaaatggctcactcattggggaagcatgatatattgcagattccttcaaccaaaaaagccgaaaccaccaaatacaaaacaaattttgagacattacccaaatgcattggctctgaagtgaaatgataggcatgttactgcagatttattcgcggcaaaagagtttcaactttccaatcacccctccacaaacccactccaaaaccctattctataactaagccccaagaaaacctaaaataccaagtaaagtactaagaaagagaatagattaatgcatctggaaatgaatcataacagattgctagaagtgattctctattgattgttcagagggcaacgagtatgaaatatggctaaccaacctggtcctctgtgttttcggatgtcgtggcatggtcacagcaagcagagcaaccagctaaggtggaggattgatcagagtcatttatatgatcctcaggcacaacactggaatgaaaagcccagtcaaaaaaacactagaatgaaaaggtgccacatgtatagaaatacatatctgaaatagtaagttatcatggggaaaaaatggctcactcattgggtaattgcagatttttgatgggatgtctccatctctaaagcagcttctagtattagtgcaagactgcttcactatggaagacatataatcctttgaataagcattg

SEQ ID NO: 65731 - DNA, 664 bp, Oryza sativa
ttggttaatactgattaattactacaactgttttactgctttgaactaccgtctttaaatgcccgctttatgcaaatgaacctttctagccataccttgattataccctgcatcataccccctattccggtatgacttgctgagtacggtggttgtactcagccttactctattttccccaaaaccccagagtttgagtacatgtcagatggtggcttctccgaggagtaggcttcgtccgtgccgtcgaggatgcctgtggagtggcgttcccgctgcagttcaagtcaaggcttagctccatttatcttttaattttccgctgcatttatgtaagacttttataatgtttgtaagacgtggatctgtatgtcaactttgtcgtttgtgtaccccggctggtcctggatgggggttttaatgcacattctgcttagaattctatcgggaatttctgggcatgacagcaactatagccacgaagggcaattttttccattaccatgtacaggtaaatggtctatgatactcgagtataattatgattataattctaaaccctgattgagatgacgtgtaatggataaggcttaactcggtgctcagtctagtcctgaataaaaggacacggatagagatggatgaagtcgttgcgacgatggat

SEQ ID NO: 65732 - DNA, 739 bp, Oryza sativa
ctaatcacgaaaaacattgttcaacctgcccatgatcgcgggcacggctattcgaatagttttactctggccagaggtgtatcaccactgtacccacaagacacagctccacgacatgtcaccatgcgcctcaataccaccacggtaccttggaaaggaactgtgacagtacccctcgcacaacacaactcaccacagtgcaccattcctggatcataatcaccccctctacaaccagaggcatggactccccagcgaccctcatggacttctcgccgcttctcagtctggtgccccgcaatgaaccatgctatacgaaaggtaaatccgttgcccacgctggcttgtgcttggcacggtaaatatttcacaacaatagctcgtgaaccgttccttaattgtcatgagcacgaccttcaaaaccatgtgctcacaacccaccattatcaagttttaattatcaattaattatcataacacaattaaccatcgtgagctaccattaaatataaccataagtaacaatgtagtgtgattcatctcatttatggctaagcaattatatatatagcatttagctgaaccaatccaatatataaagtccaagctaatcaatttattacccataggagaataaagtcatcttcggccataattaattgggaatggctcaccacccgatgacattcgaaaataatgcataagttgaaataaaacaatagctttagataggttcaac

SEQ ID NO: 65733 - DNA, 628 bp, Oryza sativa
caacatactgagcaaagtccggaatattgtcgtcttccactttatcttcttccatttcaacaccgtgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgctggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttggtttctattatttaagattaactttcactagagttttccttctcaactattttataaaaccttgttaagcaaatgaaccaaatttctatatatcctttcttccccacatactatttctctctcatcaaattacaactaaattttgga

SEQ ID NO: 65734 - DNA, 701 bp, Oryza sativa
tctggaaaaaggagttggcagatatctggaatgtaagtcctctcaacatctctgtaatggttggtttcccatacaaggtatattcttcttcccccacagatgtattgccaacagacgtattcacattattcatgatactgacctacatcaacactacaggcatatcaatattgtaggaagaagtaattaattatttatttggcttaaaacccaacgggatttctgtacagtagaactctgagtgacataatagtcagtacatgaaaagtattttaaacattacactgttcgacatagtacacttaaaatgagaaggcaccaattacataccacttctggtatttttgtgatattgttaacaagaggctccaatagctctggcttataacatgatgtgacaaaattaaccatgacttctggagctccagtggtgatatttctggaaaattaacaaaaaaccaatgttcaaaagtgttcatcatgcaaaaaaaaaaggtaagaaaagaaatgttcaattggtaacaaaaggttaaaaatttatttgtttggggagggaaacaacatgacttgtttggtcatccctgtcctatcaaataaatttacttttaactgaacaattatagagaatgtgtttgtagaccgagatatttggcagcagctaatgaagccaaatgcactaacttcagtaacatgtttaaata

SEQ ID NO: 65735 - DNA, 755 bp, Oryza sativa
cggcggcgagcgggcatggcgcgtcgacggcgtcgcggtggggctcgagcgtccggagcttggcggcctcggcgaaggcgccccggcggatgcggcggacgcgggcgaggaggcgctccccggggagcgcgccgtcgcagagcaggacgaaggtggagccgtccaccctgcagacgcccttccccttgaacgcgagcccctcgcatgtcagctcgagcacctcgttgcgcttcgggaagtagcccttgcggggcgggggaggcggcgaggtggtgggggtaggcgcggggggttccggggagagggcggccgcgacggcgagaaggcggcggccgcggtggtgaagcgggaggcggcggcggagcggggagaaggcggcggcggcggcggcggcggccgtggccatgagggcggcgggtggtggcgcggttcggatggagaatggacggtggagatggcgcggagggagagaaaaccgacgatgatgctggtgtcaccggtggtaaggtgctctgtccaagagggcccacttgacagaatcacagaagtcacattatggccatgaaccctgctgtttagcaaaatcattactactcggagtactaccttttgaaatggggaatcttttcaaatactccaatttggattgtttaacgtgaagattccatgaagttacttgctcaagttttggtcacgctttctagaaacccatgctccctccatctcaaaatataataatttttaactctagaatt

SEQ ID NO: 65736 - DNA, 3926 bp, Oryza sativa
ttggtgttctgcctttactcgttgacagacgtcacagagtgctacgaatcagctatttcccttctcatgctgacccaccagaacttttctttgaggtcttggtacattttggtactgccgggatgaatggaatattgagtttgatgagcctcggttagtatcaggtcttttaattccttgttttcgggtacacacaatctttatcccatccagattgttccttgttcgtcctcaacaaaacctcgggcttttccaaccctcatgttctttttgagctctgctatttcaggatcacttgcttgagctatgcgaacctgctccaccagtgtgggctgtgcctctagggcagccacgaatccgtgctcaactataccaaggttcagatgttccaaatcacgttgaacctcacaacatagttgctctacccatgcaacattgcactagctcttcctgctcaaggcatctgcaaccacattagccttgccgggatgataatgtattcccatatcataatccttgatcagctccaaccatcttcgctgtctgagattcagatcaggttgggtgaagatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcatgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaatagcccgcaagtcctaagaaactccgaacttgagtgactgtccttggtggggtccatttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacacctagaggatcccctcatgaagaaggcaggtgcattagtgagtccgaaagacataactgtgcattcgaacaacccgtaccgagtgatgaatgctgtctttggaatatcctcctcgcggatcctcaactggtgatagtctgatcgcaggtctatcttagagaacacagtagctcctttcaactgatcaaacagatcatcaatccttggcaaaggatatttgttcttgatggtgacctcattgagtgcgcggtagtcaacgcacatcctcttggttttgtctttcttctccacaaagataaccggagcaccccaaggcgatgtgctcgggcggatgtatcccttctgtaactgttcatcgacttgcttcttgacttccgccaactcgttggctcccattctgtaaggcctcttgtggatcggtgcagttccaggtaccaagtcaatccggaactcgatatccctttttggtggcattgttgtcagatcgtccggaaaaacctctggatactctctgactatgggaatatcctccagcttcttagtggttttctccactgctacctcttgttcttcaccagcagcctggtttaaactgatccctgacttctgcggcactggagactggaaggttaccacctctccttttgcattggtcaacttgatggtgcggctggcgcaatcaatcactcctctgtgtcttgtcaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgagcactttccaaccgtgtgtccgggtttgttacaattgaagcagagttcgggtttttctcccaacctcttgggctgttctggcagagctggctgaactgattgagctggaatctttagtgaactcggagtagggttgaggctgtgctgctcacggttgttgtgactgccactatggtggttcttgttgaagctacccgggtggtagggacggtactgccggataatcatggtggaaggtccaccgtgatgtcccatcgtggaacgaggcttctgactcttcccctggggagtcctgaactgagctgccttcctcttacggtttactttgttacagtgctcctcctgacggatagccttatccaccagcttctcaaagtcctcataatctctagagatcaactggttaatcaattcatcatcaagaccagacagaaacttctcctgcctcttggcatcggtacgcacgtcctcaggggcgtagcgcgcgaggcggttgaactcatgcaaatactctataactgttctggttccttgttgcagggaacggaactctctcttcttttgtgccacaattccctcgggaacctgtgctttattgaaactatgacaaaactctgtccaagtaacttctgccccagttggacgggtcaccatgtagttgtcccaccaaatagaagcgggaccttgtagctggtgtgtagcaaaagcaaccttctcctgctcattgcattgcaaaagattcagcttcttctcaatggcatgaagccagtcatgggcctcgattgggttggtggtgcttgagaaagtgggcggcttgacacgaagaaattctaatagtttggactgaggaggtggaggaccaaactgcaggttctgttgctgctgctgtgcttgctgctgcacctgttgcaacacctgatggtactgttgctgcatctgttgcatcatcattgtcatcatctgagtctgattgtccaacacctgagcaattgttgggttcttaggcggtggggacggattgttgtcagatgcaccgttggcacgtgctccatcgatcggctcttcgctgccactggcattgttggagtcgcgtgaaccattccttgtctccatctgaaggggataggtagaaatatgagaaaaggaagaaaacaggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacagaaaactagcaagcaaacagactaagaaggcaataaagctaagggcggcgactctgaagctcggagcggcgcttgcgatcgaggaataggactgacatctaaagtagacaagggataggaaccaattcatgctcaaatccaaattaaacaaagcaacaaatgactcaaataaatactcgagcatgatgatttttatgcatagaacatttttcatgaactcaaatgaggatactgatgcaactggctaatcaataaattaatgcataaaataaatgcatagctataatga

SEQ ID NO: 65737 - DNA, 668 bp, Oryza sativa
ttttttttctaaaaccctacactgagctaaaaaaacccgatccgaatgaacgaccaagatttttcccacaagccaaagaggcaaaaccccaaattttcctgaaacaaatccaagcgcaaaagggcatatgcatatgaaaaaaaaaggggttcagagggctcttaggtttccagttggcttgtcctacggtcaaggtcggctctgataccaacttgtcacgcccagaaattcgcgaaccagaatttctaagctgaatgtgtattaaacccctgtccaggaccagccagggtacacaaacgataattgttgacatacagatccacgtcttacaaaaacataaaggattacaaatgcagcggaaaaggtaaaagcgagctaagcctgaagacttgactcctgcagcgggcgattccattccacaggcaacccttgacggcagcgacgaaaccaacctctctgagacggctccaactgagaagaacttcaactctggtgtgggggaaaagagagcaagactgagtactacccactgtactcagcaagtctaccggaagaggaggtatgatgcagagatataaccaaaggaggctagaggttcttttgcatatagctagcattcaaaagtagtagttgaaggcagtaaaacagttgtagtaattaatcaatat

SEQ ID NO: 65738 - DNA, 616 bp, Oryza sativa
tttctgcctcaaagcgcttctcttgtaagattgctcacactgcaagcttccttccgcgataagttattttctatgtaagttttcttccggcgtaagcttccttctgtactgagctttttacttacatcttaaatcatccacgttaaaatagattttataacacctacatctgtcgtcaagaaatccacgttattctttaggaatatactatttgttatagcaaaattatactcgaggcgggttgcgctttatttactcctagtctcctactgccaatgcgtgtcgcgtgatcccgtcctctagaacggcgaggaggattcatcggcgacttcatcgttgacccaagcgaacttctccaagaacgggctgggcttgctctccggtgggtacgcgtcgatgcagtcggcccacgcgcccttgtcggccatgtcgccggtcacctcccacacgcagctgttgcacttgaaccccgacccgaacgtcaccatcagcaccttgtcgcctcgcctcaacctccccttcgcctccatgtacgacagcacgtaccacacgctgctcgccgacgtgttcccccacctgtgcaacgtcatcctcgacggctcgacgtctcgctcct

SEQ ID NO: 65739 - DNA, 10231 bp, Oryza sativa
tgctgatgctgaccccgcggaggccatcgtcgtcctcgcgctgcatgatgcaggagtaggcgtcgtcgctggccgcggtggtggagcgcacaaggcggcggagctccatcttggcgcggccgcggtgggccgggtcgctgctgagcagcacggccgccccgccgcaccggaagaggcactgccccagcatcatggtcctgtccttcccggcgtaccagtgcggcgccagcgactccgtcgagaccaccagcgccatcacgggccgcggcgaccgcgcgcgcatggcgttccgggcgacgtccaccgcgaccagcgtggcgctgcaccccatcccggagaggttgtacgccgcgacgtcctcgcgcatgccgtaccggcgcaccaccctggacgcgaggcagggctccgggaagaagccgctgacgttgacgacgagcacgtcaacgtcgcgggcgcggagccccgtcctggcgaggagctccggaacggcgccgtcgaagcaggcgtccatctcgtcgaccgcgtgaagctgccccgcggcgagctcctcgcggccgtcgaggaggttccgcggcacgtaggtccggtcgccaagtcccgcgcgggagatgaggcggaggaggaagcggaactccgccatcccgagccgctcgttgcgctggacaatctcgccggcgagctccgccgtcagcgtgcggtcatcctccggcttgtagcagacgtagtccaagaggtagcaccgcgtgtggcggcggcgggaggcggccgtccatgccatgtgcgccaccgcgagcgccggcggcaggaggagcacgacggcgagcaaaggcgtgagctccatcgtgttcgcatgcatgtgatgtgtgggtgcgagtgcgtttcagagccaagaggcgactggtatatataacagcgaccgttgcaacgacgaaattaattacagtttctaacttggttttcttgtttcgcagaactagtacattttacagttagcagtagcaattgacgggccaatattcgcaccacatatgaatcgcatgtttcagaaaacggatttgctgaatcttgtgcgcctgaaatgtcaaatctgcagccacattttcaacaacagcttggctattttgtgaaaaagttgcgcttgttttttcaaaaagaaaaagaaaaagataagccagagtaatctgatgttatttgtaaagatagtgaaaaggcacacattttaattattgatagccaaaaaatatcggagggtagcgataaacgggattatcggaattctattggcgatagaaaatttttttagacaaaattagttttctagtttaatatagttttcgtcggcgtgctcaatattttagtttaatatagttttcatcggcgagcccgggcggacggtggctctagccccgttggaatactaccgcttgatagtttgatttaggagtacttcttccagtttgatttacttggcgcaatcacctaagaacgaccaaaatataaaagtgttgccaaaacttgataggaggaagtcgttttccttttaacaacagagctagggctgtgttcggaagtatcggttcccaacacgcacagtacatacaaaaaacggaacggtccattagcacatgattgattgagtattagctatttcttttcaaaataaatataattttttaagcaacttttgtatagaaactttttaaaaaacacatggtttagcagtttgaaaagcacatgcgcgtggaatacgatggagtgggggttgagaaccctgggttctgaacaaagcctaagcatggctgtgaggactcttttttttctctctttctcaatcacacaaaacaaattaagtcgactaaaaacaccttttctatcctggaaactggaagaatgtctaatccaacactattgctgtttatattaacctttaccattcttactgaacttattttgtacctagaaaattaagaataggtgtctccatatccaatcaacatgtaagtcccctgtttagtaagtcccctgtttagtaaggatagtctggtttactcgatgataacacaaggttatgtacagccctgaacacggccggatccgtggcgcaatggtagcgcgtctgactccagatcagaaggttgcgtctttcgattcacgtcgggtttaataccccgatcaaatatccggattatctttttattccttcgttttgatgttcacgcgataagcgagttaatgctgatacgaacacgcctttcttttttcttcgttctgatgtcactacagtggccaagatcacctgtgacgtatctaaatcctcacctttgacggtttcgcgcatggtcagtgatcagtggtcactggtgagtccagtcaccttttacgggtggccgaccatcacagatgacacccacctctgacgagcaagttactagaaagccgttagaggtgttggtctccgctagccttatgaccagttgggaaccgtcataggtgactcatctctgacggccctttaaataaagaccgtcagaggtgatggtctccgtagatagaagctgtcacaggtgatctacatgcaacggccccgaaagtaaaggcccgtcacagataggtcacctctgacgggcctttatttgcgagtccatcacaggtgaggtaaccattgacggattttggttccgacccgtcactgattgacccatcgacaacgaaacaacgatactttgaacttcaagtaatctagctccaatattttctcaactctgccatagtattgatcatgccgatcaccgtcactagcagcctcgatgcgtaacccactgttctgcactgtgtatttgctgtcttgctttaccgtgtgaaaggtgtatccatttatgtcatatccttgccaggtggtggcactccattcaggaccctatgacaaccactgaagtgtttcactagacaagttctgcaacctggcaattcggttattcagccactcgttgaaagaagacatgtgcttgtttctgacccaactctttaatcggcctaggatctcctatcggagaactaaaaggtgttcgtcaacgtacggcaccatctcagtcataagctgcagtaccttgaaatgtgctttatcatataccttccgatccaacctaacaatcttccttccaatagtaccaacaccatcaagcctcccttcgtgatgagatcgtggtaatccaattgaaaatgtttctgacatgtagtccacacaaaaattgatgacctctttggtggtgtaactctcgatgatactcccctcggggtgtgaacggttccgtacataacccttaaggatccccaggtacctttcgcaaggatacatctgcgtcatgaaaactggaccacaacactttgtttgcctcacaaggtgcacggaaagatgttcatctagtcccacaggaaagctggaccacaatttctgcctgtagttcatccagtccctcggaatcaatgatcttttggccgattgcatggaagaaggagcacaaccgctggatcgtgtgtcgcacgcacaaccgctggatcgtgtgtcgcacgcacaaccgctggatcgtgtgtcgcaccttaggaggcaaaatattctttattgcaacgagcaacagctgtgttgtaacaacgtagcaatcatgcgacttcattcctaccaatttaaggtcttgcagtgaaacgaacctactaattcttgatgagtaaccagatggaacctttataccactcaaacatgttagcaaatcaatcttctcttctttcgagagagtgtagcaggctggaggaaggtacaccctgccggattccttggttatgggatgtagttccgagtgaacacctatgtcttccagatctcgtcgggcgttgagaccatccttggtagtacctgggttaagcagtaatcccattaaactcttacatacattcttctcgacatgcatcaaatctatgccgtggcgaacttcaagatccttccagcatggtagtctccaaaatattgacttttttttccacatgctcttctattttgtcttttgtttttccacatgctcttctgttttgtccttcgacatgctcttgtcttttgtttttccaactttcctcttttttccaaactcgttggttattcccatcactaagttgtgcacctctgtccctgttagctctgccgggggtccgactgtatctttgtgtccattgaaattctttctcatattcctatacgggtgataccttgggagaaatctcctgtgacccatgtagaccatcttgtgtgaatgcttcaaccatttgcttcttgtttccttcatacactccaaacacacccatttccctttcacagtttggccagaaaggttgccaagggccggataatcgttgatggtacaaaacagcatcgcatggaggttgaaatactcttgtgcatatgcgtcccatgttcgtgtgccctcatttcatagcctttcaaagtcatcgattattggtttaaggaacacatcgatatcgttgccaggttgtctcggtccttgaatgagcatggcaagcataatatactttcttttgaagcacaacgagttagtaaggttatagttaacaagcagaactggccatgtactgtgacgactgctcaaatcaccaaatgtattaatgccgtccgaacacattgcgaaacgcatgtttcttgggtcatttgagaattcctggtaaatcctatcgattgtcctccattgtactgaatctgctgggtgcctcaacattctatcgactttccgttcttcggcataccagcgcactagctttgcttgttccttattcgcaaacattatctccatgcgcttcgcaattgggagataccacaccacctttgcggggcctcccctctttgacttacttccttcaccttcactctttgctcgtttgtatctagatgccccatagacagagcagacatccaagtcagcatattccttgtaatacaaaatgcagtcgttcggacaagcatgaattcttctgacctccaggcccaacggacataatacttgcttcgcttcatatgtcatctgcggtaaattgttcccctcttgcaacaggtcctttaacagctcaagaagttctgtaaaactcttgtcggactagccattactagccttaagcttcatgagttccaacacgcatgacaacttgttgtgcttcgacttgcatccatcatacaatggcatctgacaatcttccatcaacttactaaacttctcaaaatctctgtcgttgtcctctgcgtcttcaatgtcatgcaacattgtagatagaaattgagtgtccaaatctatggtctctccacctaatggagaaggtacgaacatgccttctcgagctgcggcggtgttctctacatcctgatccaacacttcttcagccgtggcatcaggcgcctcttgctctccatgcttggtccagcagatatatttcttcatgaatccattcgttatcaaatgagaatacacttctgagctatcaaggatcatcttttcattcttacagtccctacatggacacaatatgtacatgctcatcctactttttctgtcattctccgcaaatgtgacaaattcattgaccccctctctatactctatggacgaacgatgaacatggtacatccaactacgatccatttgaaatcaacaacataggaagaaaaatatatgatgatcgatatattgagaatgaagggaagaataatatgttttttaccttgaattttagcaaaaattcgccccccttgcccttccaaccgatttgtgaatagtgaactactcgggatggaaagcagttggcggtttggggggtatttatagacccaacacacctcaaacgggttaggtaaaaaaaagcccatcaaatgtattggtcatacctttgacaggcttcaattgagttgcccgtcactggtatcccttcacttgtgacgggccgggaaacaaagtcgtcacaggtggcggcccatcacctgtgacggcttataatgcctcggcccatcacatgtgaggggataccagtgacgggttggaagcaaaactcgtcactgactcacctgtgacggattttcctttcggcccgtcacaggtgaggggatacctgtgatgggccacggccggatgcctcaccgttgacggcatcccttattacccttcataggtgacggtcactagtgaccaaatcgtttgcccgtcacaggtatcccgtcagaagtgtgagaatctggcgtagtgtgagccaagtagccgtcttttctttcgttctaattttttcatgttcacgtactcccgcatggcgtccaacacaagaggagagcggcgaggaatggcgtgacacgtcgtcgaaggggagaagtgcagggacgcacagtgcagtccaccaaagcgagggaggggagggagagatcagcggcgcgaacagatctccgagcaggtcaccggtgctgcaggtgcagcaatgcgtgcaaccaactgatgaagagacgagggcaacctgtggtagctgtggatatctgctgttgtttctctctgttgttctttcatccggccggtacatctcctggaccgtttgatttgaaccggtacctcgagtacttacctcaagttactgcttcaaggatgataaaaaaactcattgatttagaaaaacgatctcttttttatttctttcccgccgaatcacgtacaaaggccgatctcctctcacgtccttaagtgctatgcagcacagcataggagactcttttgggaactaaaactctccgtcaaaaacataaaaccgattctatctacaattctaacaatggtataaaaaagacaagtcttcctcgtactttggtcataattttttgaatacctgccatgaaagaaggctataagcactatccttctcctccatccctatcgctggcagccttctccatgaaagaaggctacaagctcccgtcatcgtcatcgccaggatgactcgggaggagcctgtggaaaaattgggcgctgacacttttaaactgttgtttctcttaaattatttttccaaatcatgattcaattgcaccattaaattcgttgcaattaaatctttaaaacaatttcatacatggatatattccgatgaaaagttttttttaacttactattgaattatgtttaaatgttgcacgatgttccaccaagtatatcggaattgtttcactaagtagatcgaaaatgtttcaatcatttaaatcggacgttgtttcacctaatataataacaatgtttcagcaaataatgaaagaatgttccagttcattgcgacatttgattcatacatagtgaaacattataagtgcactaggttaatcttttttggtggaacaaaaaatgaaacgaattcccttaatagagggtttatgtgtgtgatttgttgcaaaaaatgtttcaattcactgcaacattagatctatatatagtgaaacattgtgagtacactaggtgaaacatttttggtggaataaaaaatgaaacgaattctattaatagagggtttccaaaatatgttggtgatttgttagcggtgttgtcacagaagaaacattgctctcctgcttcggcaccggcaacattagtggtggggagttcaaactcaaagccatggccgttggtggagaaagattttctcgcgacggacatggtgttgtacggctgtatatatcggtcgaggctatccgtgttcgaggcaatctgcccatcagttgaaaactcgagaacactttaatcatcactttttttattcgcctttttccctaatatattagtagtgcaaataaatagaagttcatcgattgctagctttccatatataacttcgtatcagtatgattagaaatacatattagcatggacatgaaattagaaaaaaaaggatgggtatggattaatggataaatatatgtataggcgtgaacatcagagtggaaaaaaaaggtgtattcgaatcggcatgaacagaacatcagaaggaaaaaaaatgcgtattcctatcggcatgaacagaaatacgcttatcgatgtgaatataaggtaattaggaaataaaaataatacggacattggatcggggtattgaacccgacgtgaatcgaacacgcaaccttctgatctggagtcagacgcgctaccattgcgccacggatccgtttgtgttccaaacagcacataatgttatctgttttaacagttatcagatggctaattttaggtacaaaataagttcagtaagaacgtaaacagcaatagtgttggatcagtccttcttccagtttccaggatagaaaaggtgtttctggtcgacttggttttgtgtgattgagaaaaggagagaaaaaaatatactaccttcggagtcttcactgccctgcttagctctgttgttaaaaggaaagcgacttcttcctatcaaattttggcaacacttaaatatgtgttgttatagaagctagggaaattttgatcgttctcaggtgattggctcaatatgtgtgcgttgatcaaaagtgccaagtaaatcaagcaggaagaagtataaccagagtatcaaacggcagtactccagcaggggtggagctaccgcccgcgcggctccattaaattttaatattaatttttttgtcaaataaattgataagaattttacagcaaatattagttatagtaatttcaggctcaaaaatctttctaacttcgtcacggtacttcagtatattaccgaagaacttcatgatccaaacataaagactaaggctccgatcgtttccacttaaaaagtggattaagttttggatattcatggtacgttttttaaacggctaaactgtgtgttttgtgcaaaaattttctatataaaagttgttctaaaatatcatattaatctatttttcaagtttacaataattaaaactcaattaatcacatgttattaccaccccgttttgcataaaatacttaatctttatcttcaggagattcaaacaccacctaaagagggtgaggtaaaaacctaatctttttcatacttctggcttgtgaaaatctctataagtgaaagtataagtgaaaggtaaaactcaaaataaagcatcgttgaaccacgtcattagagaagcacgagccgtcggatgcaacagaaatacaatatgaaccgttggatcataaaaaaaccgttgtgaaaaaaatggtgaaaggttaaattcttcgggaatattcgacacgttctctagcgtaaaaagttaaattcttcgtgagtctccaacacttctccaggatatacaaagaaacacgagtcgggagagaaaggaacagagtggagattaagaaacgaaataaataatatgggagaattctacgctgtgtagctctcctcctccaactccaactccagccggggctgcgttccagaccaccagcccggcccggtaagaaacgatcagaacaccagagaaacacgataatggagttcggaaggtggttgacatatccggcgcttcactgtccaccaccaccaccaccacctgatgggaatggggaagcacggcagaggtaccttcctgcttcctccgccgtatccccaccagggttggaaatttcagatttcgttcacctccgttacgatattattttgaccgaaattttttattttttcattcatttgggtaatatttgttcaaatttaactaaattttacttaaaatttcggaccaaaattttcgaaatttcggtgaccccgatataaaggcctcaaccgatagagtgaacccttatccccaccgtaaccaccgtctccaaatcaagtagaccagagcatcgccatgaccagatcggtatctactacatcttgtccctcctcctgcaggtagccggagacgccaccgtgatcccagacacatcggtgggggaacgggcatagctcggcactccatggcacgctgctagaggccccgaacaggacagtcacgccgcctgcatctttgctgttctcaacggtgtggcgcgcacctccctctggcttcctccatgctagccgcacagatctgggttgcttctgctactgcggccatatcacagggagaaagtttttgagtgagcagcagcaccgtgtgagagctgattgagaaagaaatagataagggagtgag

SEQ ID NO: 65740 - DNA, 6557 bp, Oryza sativa
ttgtaagcaaaataagcaatactaaattatctgggtttctatggttgaattatgcatgtgaaagtagagtattgagtagaaaggttataaataaataacttgtaaaatataggcttaaacgatcaaaatgtgtatagtaacttgccttgctcgatgtcctgagattgactgatattatctaatgtgtcataagattcctcaagaccaagggttaaacatgtaaaattcaaattcaaaagggattcaaataaaatccaaaaataggtaaaaataaaataaaatataaaaatagcaaaagtggtctcaaaagatagagaatgattttagaagaattttggttcaagtttcactggaaatgaatctatattttaaaatatatgggcttctaaagtttgaaaatcaaattaaatgttaaatggtattgtgtgtgggtcccaccgatcagtctctccctctcttctcttcttcaacctccaactgttccccatttacggccggcggcgctagggttagggattatggcagtaataaagggggaaaggtgttgcggccgaagaggggaggtagatagggttccccggcgacggcgagcggcgccggaggggttaatttggtgtgtgagtaacctagcggctagggtggcggtgacatggatgagctgagaaggtgatcggggtggtgagagttaggcatggctcagggaaggttcctagagcatctatgaggtgtctagaaggatttaagtagcttgccgacgttcggcaaggtatggaagatacttgctgacttgcgcctccattggcggtggtcgagctcacgtcggcagtcaagagggtgatgttagtgctaaccaattacgaaaatggaatctaaggagtatgtcgatggttaaaatggaagaactcaccgagataggttgaaccgacggattgcgaccgaaaaatcctctcgccagcaaagaccatagcagagcatgggcgccagtgctcgcctcggtgtcactaggtgtcaacccagagcttcggttagcctttagtatgctagaacatggttgaatataggtgttctatgggttggtcagggtagagggtgcatgaagtggtgtgaagtcgctcgcgcacaaggtgttcgaccggcgggccaggatggttgatcagatggattggtaaagcagagctttggggttgtggggttatggttggtgatactcgatgatggacaaggaaggtattggggtcatacttatagggtcacaagatgtcgatgagctcgggcgccatcaacgccattgatgagctcgaaaattgggtatggcaggggtggtagaggttatgcagcaacgggggttcccgatcttttgatgagaggaggataaacttcgatttggggaagggcacgacgttggcggtccgactacaactaccacaggggtgatgcgccttagcaaccggtacaccgactccacgttgttgctgttcttgccgtgccaagaacaaccttgaacctgtaagcaatcgaagaacaagcaagaacaagatgataaggaaacagctcatggcacctatcctttctcaaatgcaaccaaaccaaatcaccaggttcaaaagtaacatgtttctttcctttgctcccagcaagtttatacttaatattcatgcgctctatgttctccttagtggtctcatgcagttttaacatcaattcagcgcgctgttttgcatcaaagttcactctctctgaagttgggaggggcaaaagatcaattggagtatggggcagaaggccataaacaatctcaaaagggcacttcttagtagtagaatgttgtgaacgattataagaaaactcaacatgaggcaaacattcttcccacattttaatattctttttcaaaacagccctaagcattgtagataatgttctagtcacaacctcggtttgtctatcagtttgggggcgacatgtagtagaaaataaaagtttagttcccaacttagcccacaaggttctccaaaaatgactaaggaattttgtatcgtgatcagaaactatggtgtttggcactccatgccagcgaacagtctcatgaaagaacaaatcagcaacatgtgtagcatcatcactcttatgacaaggtatgaaatgcgccatcttagaaaatctatctacaacaacaaagatactgtccctccccttctttgttctaggcagccctaaaacaaagtccatagaaatatcctcccaaggcacactaggaacatgcaaaggcatatacaaactatgagggttaaggcgtgacttagctttttggcatgttgtgcagtgagcaacgaacctctccacgtctctcctcatcttgggccaaaagaaatgatcagtaaggatatccttcgtcttcttcacaccaaagtttcccatcagccctccaccatgtgcttcctgcaataatagcatacgcacggagctagctggaatgcataacttattagctctaaacacaaacccattggtgagaacaaatttgttccaagtccttccctccttgcaatttaacaacacatctttaaaatcatcatcgtgcgcatattgctcttttattgtttacaagccaaaaattttgaagtcaagttgggatagcattgtgtaacgtctagacaaagcatcagcaatgacattttcttttcccttcttatgtttgatgacatatggaaaaaattcaataaattcaacccatttagcatgcctacggttaagttttgcttgacttcgaatgtgtttcaaagattcatgatcagagtgtataacaaattctttgggccataaataatgatgtcatgtttccaatgttcgcactagagcaaacaattccttatcataagtagaataattcaaactaggcccactcaatttctcgctgaaatatgctacaggtttgtcttcttgtaacaacacaccacccaatccaatcccactagcatcacattcaagctcaaaagttttgttgaaatcaggaagttggagtaaaggagcgtgtgttaacttatctttcaaagtgtcgaatgcattcctttgtgctgcagaccaagtgaatgtcacatttctcttggtaagctcatgtagtggggctgcaatggtgctaaaatccttcacaaagcggcgatagaacccagcaagtcctagaaagcttctcacttgtgtgatagttgttggaaccggccagctatgtatggcttcaaccttggcttgatctacttcaattccctgcggagtcataacatagctaagaaaagagactcgatctgtgcaaaatgtgcacttctcaaggttaccaaataaacgtgcatctcgtagagcatcaaaaatagcaggcaaatgaccatgatgatcctctattgatctgttatatatgagaatgtcattaaaatataccaccacaaatctgccaatgaaagcacgtaaaacttcattcattaatctcatgaaagtactgggtgcattagtgataccaaagggcatgactaaccactcatataggccgaatttagttttaaaagctgttttccatttatctcctaacttcatgcgaatctagtggtaaccactacgcaaatcaattttagagaacacaagtgaaccactcaattcatcaagcatatcatctagcctagggataggatgaggatatctgattgtgatgttgttaattgctctacaattcacactcatgcgccatgagccatctttcttaggaactaaaagcacggggatagcacaaggactaggagactcacgcacataccccttgtcgagtaactcttgcacttgacgttgaatctcctttgtttcctccgagtgggtcctgtatggtacacggtttggcaaagaggccccaggaatgaggtcaatttggagctcaatccctcgaattggtggcagccccaatggaacctcctttgcgaaaacatcagcatactcctgcgaaatgttagtgaccggagaaggcaaagaaataggagtatcctcaattggaaataaagtttgtttgcaaaccaaagcatagcaaacaacagtgtcagtgtcaacttcatccaaatctgattttgtttcaatgaaacaagatcccttcagcttaatctcatttttattattttgaatagagttggtggatttcttcttatgcttctcaagttcattagccacaatatgatgctagtatgctcctgtttttttgtttgctagctctagcaagttcattctttaaaataacttaaagagacataggatgtaacacaagtttttttccattatgcacaaaggagtattgattggatttgccaaagtgtaaggaatctttatcaaactgccatggcctacgtaataacatagaacaagcttgcatagacacaacatcatagttgattgaatcatgataagaaccaatggcaaaatgtactcttaccaatcgtgttacctttaccttgccgctgctattaagccattgaatatagtagggctgcggatgtggctgtgtgctcaatgcaagtttcttcaccatttcagcactaaattattgcagcttcatccatctatgatcatgcgacaagagcgttccttgatcacacacttggtttgaaacaaggtgtggcgctgattctgttcagccccttccatttatgcgcttagcactcgctgcaccacgaggctctcatagtcctctgcagcctcggccccaatgtgttcctcatcttggtggggcgcgtcgccttcccctgcattgttagttgcaagcaaagcataggtttcttcatctaaatcactagcggaggagtacccaccatcagctctcacgatcattacacgagtgcttggccagtccttgcgcacgtgaccaaagcccttgcagcgtaggcactgaatatctcttgtccttcctgataatgccactgatgatgagctcttggaagatgtagcagcaacccctcttgtgggttcactcgggcatggtgtagagtttgttgtagagggacgcaacttgttgcttgaggacgatggtgctgctgctcgagttgacggtgcagcagcgttggaaggggtccaagagctagcacgacctgcagaaatgttagtcctgaagccagctcttcgtccctgcacttccatttcagctttacaagcaagatgaaacaaacgatatattgaattatattctttgtaggctagaatgtcctgaatttctcggttcagcccacccatgaatctatccataccagcatcatcattttccaccaatccacagcaaagcattcctgtttgcaaagcttgataatactcttctacagatttgttttcttgtctaagttgttgcaatttatgcaacaaatcacgtgcatgatatgaaggaacaaatctagatcgcatgaatcttttcattgcatcccaggtttggggagtgttatttggattggaacaaacaaattcactccactaaatggatgcaaaatcagtgaactcactagtagcaaccctaacacgtttattctcaggaaaatcatggcaagcaaatttctgatcaatggctaactcccaagtaagatatgcatcagggtcatattttccatcaaagcaaggaatggtaaacttgatcttgcctaaagaatcatcattatcacgtgcctcccgccgtggtggagcgcccatgccatggcgctaccggcactgttgtcttcgttgacgaccaagtacctcctcatcatgctcggtgtcagcagcgtactctagttcttcccttgctgcgatgctgctattagcatcatggccattgtggttgcgcctagccgatccatcatgaccatctttgctcattctctccaatgtattcaagatacctgcaagagaagtgttcacagccacaagggacctctccaatgaggaggaaaacttggagttggtgtcaatttgagcagcctccaattgaccaaggcgatcattggcgaccctatttaggggtaggtatgacggttatacaatgcgaattgtcggaaatgccccgcaaccgccatcaggagatgatcaagaccgtccacgccaaaccccagcctggatggctgagattgtggttcggccgaacctcggctgaacctgggctagtgtcacgcccagaaatttagcccaaatttccagactattttgtgtattaaatccctgtccaggaccagccagggtacacaaaacaataagtaatatacagttccaaacgtaaataaagcgtaaaatacttacagaagatgcacttagtcctcacaccgaaacaaaagcagcagcagtggaaaaaggcgatcctagcggggcttcagctccactccacaggcaaaactcgactggggtctgagccttggtcttctaacctcgtcttcagctcagaagcactacacttctgaaaagggggaataatagcaagactgagtacaaccaccgtactcagcaagccacaccaacgatgcagacgtgcaaggggacacaaggacggtttgtggctatttgcataaaggcagttgtaa

SEQ ID NO: 65741 - DNA, 1600 bp, Oryza sativa
atcatggatggattaagtgagctttaaactattttttctcataaaatatttatccaaatcatgatccaattgcaccattaaatccgttgcaattaaatctttaaaacaagaccacacatgaatataacccgatgaaaaaaaagcttattattgaattgtttataaatgttgcatgatgttgcgccaagtatatcggaattgtttcactaggtagatcaaaaatgtttcatcggacgttgtttcaccttatatgaaaataatgtttcagcgaatagcgaaaggatgattcaattcactgcaacatttgatccatacatagtgaacgttacgagtacactaggtgaaacattttaaattgataaaaaaaaatcagatggtcaaatgttgcagttgaccaataagtgaaaaattaagttacatatggtgaaacaaaaaaatagcaactggaacatttaaatattttatgaaacatggtgaagatacacgttgaaacatgtcgctgatacatttgaaacaataagtattaacagactgaaacatatgcttttcttttatcaaaatataatcatacgatatcttgttgtaaagatttaattacaacgaatacaacggtgtgatcggatcatagattgaataagtaatttaagagaaaaatcattttaaagcttgctaaaatacatgcatatatgtatgaatgaggtggagagagagtagtagcaggtagtttcagaaattttgtgaaacacactgaagacgcacattgaaacatatccctatcacatatgaaacatttagttttagcggtttgaaacacatgtttttcttttgacataatataatcatatgataacttgttgtaatgatttaattacaacgaatacaacggtatgatcggttcgtagatcggataagtaatttaggaggaaaaatatttaaagagaggtggaaagaatgaaaagaaacagctaggcatgcatgttacggtaacatggttcgtccgattcatccggctgtcgatttgcagcatttttctgacgtcaacagagagaaaggagaaattagtaagtaaggagtgagctggtcgtagggtctaatattttttatctgatcggatgttcgaagagaagcattttcaaatttttaatcctactccagtaaataaaagtagcggggtgtcgctctacaggtaaatcatgtatgttagttgaggctgtgtttagttctacaccaaaattggaagtttgaagaaattggaatgatgtgagacggaaaaattgaaagtttgtgtgtgtagaaaagttcgatgtgacggaaaagttgaaagtttgaaaaaaaaagtaggaatctaaacagggcctgagttgaattgggagtgccagagtatacaattggcaaagaaaagaagtttacgctgcaccgcatctaccaaattaaaatatcctaaatttttgttttacctaactaaactaaaattgcctgctaatttcattctcaccattgacttttcaatttttattaatcgcaatttttcatttatgttattactaatttgaactaattatagttgttactgggaaactacagtcgcgcaaatgtgcga

SEQ ID NO: 65742 - DNA, 5169 bp, Oryza sativa
tccagactattttgtgtattaaatccctgtccaggaccagccagggtacacaaaacaataagtaatatacagttccaaacgtaaataaagcgtaaaatacttacagaagatgcacttagtcctcacaccgaaacaaaagcagcagcagtggaaaaaggcgatcctagcggggcttcagctccactccacaggcaaaactcgactggggtctgagccttggtcttctaacctcgtcttcagctcagaagcactacacttctgaaaagggggaataatagcaagactgagtacaaccaccgtactcagcaagccacaccaacgatgcagacgtgcaaggggacacaaggacggtttgtggctatttgcataaaggcagttgtaaaacattttattgagcaaaatactaaaactgttgagtaattaaggtaatattaaatctccactgatcaacgctacaccacgatgaacaggcccaaccaacccacctgaactacagtgcattgagtcgattcattaaggtgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggtcgtgacaggatccttcgcataccctctctagccaagcacaccacacctcaggtttcacccccactcctcgcaaggcagcgggcaatcccctctcgtgcctaggtgaatccggaagcgacagaggccgtcgcagggcccgccccgctccatcacacccacccttgcctggatgcgtcggctagaggaaagctacactacaagcccagccgttgcccacgctggcttgtggtaagtacgagaaattcttccagggtttcccgtgaaccggtccttaattgccatgggtgcgactagcaaaaccatgcacccacagcccacccttcagtcgcattttagttggataattatgaccatgaagcatggccagatgtctcgagcacgcagctcattctgatactaaaaggtctaatattgtaattatcccatcaactgagctagtggtaattaagcatggctaagcatatagttctagctaggtcacataagtaacatgagctagtcgatttattacccaatgttgacaaaggacatatatcaagtaaatatggcacaagcgagcagataggtaaaccctgatcccatgtaattagcaaaacacgcatatttatttgcaaatagtaaaacatttgtaaattgggatcaacatgctaaaggggaatgtgtgacttgccttgcttcttcactttgatcttccgaactcttttcctcgtgaccgcggacttccgaaacgacgagaactacacgctggcacgcaaaacaaggaaaaactctaataaaaaccaagaaaacggtatataaaaagtaaacaaacatgtagagctcaattttagatgaattttgcaagttgaatggctcaattcggagttcgaatgaattagatatgaattttagaaggttttgagccattaaattaatatctataattattaccaaattattgcgcaattattaaatattttcacaaaggaaaaggactgccgctgacgttagcaagagagggggccggcgccgacaggcgggtcccaggcatcagtggctcaagggggctcggtccaccatggaccgggaccacaagggcggtccaccgcccgtccacgggatggacggcccagatcggcccaagccgatcgggcggctgaggagagcggtggccgggcacgggcacagccggggctggcccgaccgaccacagagggcggcggcgcgcagtcaccagcaacggcggggggcgggcggcacagggagcagcggcgcgcagcgcgggaagcggcgagaggaaacggaggcagtgagggagagggaggtggcggagctcaccgaggggcacggcgacggcgagagcagccggcggagggaggcggcggcgctccacaggtcgacaatgagaaggggctcccggcggcggaaggcggcgatcgggcggcggacggggaagagcgggacgcggcgaagccgggggatgcgttgcggcgacagccagggtgaagccgaacggcgaccggaggcggaaaaaggcggccggtagggtggtatggcaggaaggtggttctggtggtggaggggaaaaatggatgggcggccgagcttgccctcgcggtggtaaagctaatggcggccgcggggtggctgagagcagtgaggtgtggccggaggcgacgaccggagtggcggaggatggtaacggcttgggtgggtggtggaggtgatgactcggccacggattggtggaacgaggcagtggccggtgctctgcttggagcggcgaagccgacactggcggtggtgcggcttggcggtggctagcgtggcgaggagagcggccggagttcggcggcaagcggcggagagaggttacatggtggggaggtggttccgatggcggttgaaggaaaccgagtggaggccggcgtgcggcgcgggatggcgaagctgatggcacacgcgatgaggcgcggcgacggcgggagcagcggcggcgcgcggctggagatcgccggcgagcggcggcgatggggatcgacgtggagagctcggtagagggcgtgggggactcgggaaaacggggaaaaaggaagaggaggccacgaggattgattttacagctcaagggggcgaggagagggccggggagcggcggatttcgagggggagtggggcggcgtcttgggggtggtgccggcggtttttcgcgggacggagtgggggaggggagcggggtcgtgggtgacgaggtcccacggtcgggcaggagtggtgcagggtggaggaggtgggcggggaaagcggtgacgtggggcggctcgggcggccatggcggttgcagccggctagccagaggaaggaggaggaggggccgtgggtcccacctgtcggccaaagcaagagggggccggttaggggaggaaaagaggacttgagggagagggaggggaggagctgggccggcggcccaaaggagggaggagggcggccgggccggaggtgaagggggaaagaatttgggccgagcccaaaagggaggaaggggaagattattttattttctttttatttaaattgattaaatgaactttgtattattataattacttcttgagctccgaaaattcacggcaaaatttcagagaatatttagggcacaaagaatattacaaaatattctcgcccaatgatttttaaaggaaatttttaattccctcaatatttcacttgattaaattgctttaacttttatttaatttctggaaaatacattatttaatgatttttaatcccaacgaaaatcggggcgttacagctaggcccatctggcctggctctttgcgcatcttcccccctgaccttctctacctatttctcaggattttgggttgactctcgggtattttgatgaagttcataacccatccttgtatggatacataattctcctcactttagtctagatttcctcccaacatcgaggtttatcacctgctgacggagcatgggggtcctcaccgggagaccgcgcaggcccccctttgccggttcggccgggggcgctaagtgaggttcttcgccctcgatctgaggaacgtccgcgagagaggaagtgcacaagacacgggcgacgtagataggttcgggccgctgggaagcgtaacaccctactcctgtgttctggtggatctgtgcgtgaaggaatacagagagctggagagcgagccagagttcagggtctagcacccattccccttttttctcctccctccagagtcccctttctttttttcttttctcttttctctccagagtcccccccttttaggcctgggcaccctttttatctggtcaggggtcaccacaagggcctccagctgcctaagaaaggaaacatgctttttacaatgagggctagtctacagccggaagtgacctctgacaagcagagcacacgcctcctgccccgctcgcccgcttttccggtggacgcccatttcaaccttcatttaatggccagcgacttccttgccatacttgcgctgaagcctggaatggttctgaccgggactaacataccaactccaggagttagcacgccggctccggctagggacgagagccaggaagctctcatcattccgacgggacggggcgaggcgtgtgacaggccgcctgttgccacctaacccgtgatctgaccggtctgtgaccggtcacacaccgcgactggtcacggaccggataagcgtgcgctgcgtcgcattaaatgcggcgtggcgcgctcgtccaacctgttataaatgcggttaggtgagccccgcagtgctcacctaactcacacacgtggcgccaaaaccacagggggtcggggcgtcgcagccctcggggccgaaacgggggcgccccagccctcagggccgaaacgggagcggcccgacccctcggggagacagagggaggggtggccacttcaccctagggcccgaccccccccccccccgagggggtcaggccacgtgggtgaccgcggctacccaagcctctagtcacgatacccctggccccatgtcaccgacagtagcccccggcgttacgccagggcgatcgcccccctcgagggaagcgctcgggcgtgacgccactccttaggcccggtgacaggtggggccggtccctacaggcgggcagaaacccagcggtcgcaaatcgcgcgcatcagcaagggaaaaccgaccgacaataatgagcggcttctttaagactgctacattactcgagcagcgcgcgaatcgggacgagccggttcgtttcgcctggagacatgatgatggcgcttttcacggttggcgagcgtagttaatgcgcgcacgatctgccccatctcaaccgccacggccgcacatttgccgcgtgcgccgcaaacgagcgagtgggttagtggaggcgtgggcgcgagaagccgggtatagcattggcaagggcctaaccacgtcgagtaaggaat

SEQ ID NO: 65743 - DNA, 6621 bp, Oryza sativa
tgagaatattgcactaaaaatttaaattttgtttggcgcgcagctgatggggcgtggctaggggtgggcagaaaaagaccgaaccgaaaagattgagaccaagaccaaaaaaatcgagattgagaaattcagtactaggcagtgaaagaccgaattttgttcggtcaattcggttattctcctcgggtaactggatagaccgaaaagaccgaattatcaaaaaatgtctaaatacaacctacaatccactatatttaataggattaaactctaatttttatatcctacttgttctaggcatgcaacctaataagagtctttattcataagggcttacgaatttttttaggattttctgttgaaaatttccattatttctttgcatatatgaaaatgtcgttgaatttcggtcaggaccgagaccgagaccgaaaaaacctagatcgaatttgtcggtcctgatatttttacgctgaaattcgatcttcacttttcaaagaccgaaaaagctgaaattcgatcttcacttttcaaagaccgaaaaaaccgaaagatcgaagaccgagaccgaaattttcagttagaccgaatgcccacccctaggcgtggcgctgtggtctttatctatgttttcaccatctagtgtaaactttacaaataacttattcccctgcttaatataaacaccagattaatttggcttgtcttgttttttaaaaaaagggcccaactttttttttttcacaaaatagccaagctgttgttaaaaacgtggctgcagatttgacatttcaggcgcacaagattcagcaaatccgttttctgaaacatgtgattcatatgtggtgcgaatattggcccgtcaattgcatctcctagctgtaaaatgtacttagaccattcccaaaccagatattagacataattttcataatctctacatcataaaaaaaaacttatactagatactactattacaatgcaaacaacactatttcatatttaaatttaatgctacttatctcacatgatgtcttggatattgtgtagaaaccgtgtttcatgcaagacatgttttcttctatttcattatttattcacttgccacattatttttcattttagttggcagcttatttaatgctatagacaccattctagtcattgggttgggaatgatctttgtactccctctgtcccattttaagtacagtcatgattttccgtgcacaactttaaccgtccgtcttatttgatttgttttttaaaaaattaaaaatataagttaagtataaagtactaattataaaaatattttaaataagatagaagattaaaattaaacataaaaaacttatagttacacctagattgggattactagtcttgtgaaacaagaaaattaagttagaaactgtaattaatttcgttgctgcgacggtcgctggtatatattaccagcctgtggtctctctagctcatgcatgcatgcgaacactatggagctcacgcctttgctcgccgtcgtgctcttcctcccgccgccactcgcggtggcgcacatggcatggacggccgcctcccgccgccgcggcatgcggtgctacctcctggactacgtctgctacaagccggcggatgacctcacgctgacgacggagctggcatgcgcgattgtccagcgcaacgagcggcttgggataccggagtttcgcttcctcgtccgcctcatctcccgcacgggactcggcgaccggacctacgcgccgcggaacctcctcgacggccgcgaggagctcgccgcccagagggattcggtcgacgagatggacgcctgcttcgacggcgccgtcccggagctcctcgccaggacggggctccgggcccgcgacgtcgacgtgctcgtcgtcaacgtcaatggcttcttcccggagccctgcctcgcgtccagggtggtgcgccggtacggcatgcgcgaggacgtcgcggcgtacaacctctccgggatggggtgcagcgccacgctggtcgcggtggacgtcggccggaacgccatgcgcgctcggtcgccgcggcccgtggtggcgctggtggtatcgacggagtcgctggcgccgcactggtacgccgggaaggagaggaccatgatgctggcacagtgcctgttccggtgcggcggggcagccgtgctgctcagcaacgacccggcccaccgcggccgcgccaagatggagctccgccgcttgtgcgctccaccaccgcggccagcgacgacgcctactcctgcatcatgcagcgcgaggacgacgatggcctccgcggggtcagcatcagcaaggccctccccaaggccgcgctccgcgcgttcgccgccaacctgcagcgcctcctgccgcgcgtcctcccggccatggaaatcgcccggctcgccgccgacctggcatggcagaatctgttgcagcgccgccgccaccgagggcagaccaagctgaagatcaacctcaaggcaggggtggaccacatctgcctccacgccggcggggtggcggtgatcgacgcggtgaagaagagtttcgggctggaggagcgagacgtcgagccgttgaggatgacgttgcacaggtgggggaacacgtcggcgagcagcgtgtggtacgtgctgtcgtacatggaggcgaaggggaggttgaggcgaggcgacaaggtgctgatggtgacgttcgggtcggggttcaagtgcaacagctgcgtgtgggaggtggccggcgacatggccgacaagggcgcgtgggccgactgcatcgacgcgtacccaccggagagcaagcccagcccgttcttggagaagttcgcttggatcaacgacgaagcagccgatgaatcctcctcgccgttctagaggacgtgagacgcattaattggcagtaggagtaaagcgcaacccgcctcgagtatagtttcgctataaaagctcacaaacaatatattccaagataataagggtgtgtttagatcacaccaaacttcccccaaactctaaacttttcatcacatcaaaaacttttctactcacataaactcccaactttttttccaaactaccaactttctccaaacttatccctaaacttcggaactaaacacagcctaacttggagaagcaagctttgcccaaaaagccagcttgcaggggaagcaattttacagtggaaacctctgtcacagcctgattttccgtttcaggatttataaattatttaataaattattaatagaatttatattaaatgttcattaatttacaagtgaagttaaatgtgggaaataaaatttcctaaatttagagcatggatggatttaatttttattaaattctccatgattaattatactctctgaaattttctcggatttttcagagctcaattcctaaatgatacaaagaacagctcagtaattagttaatcaattaatgatctaattataattatgttaagtgcttttcttgtttaaaaatccttaaattataaattgttgtttaaaagaaattattagaaataatcttaaaagcctaaaagagaagatctaattttaatttaataaatctcaatataaaagtgagatagataaaattttgttaaatacttcttttgtttctatagtttctagatttttctaggatttatttgagcaaaggaagcatttttaataaacggaatatcatttcatgaataatttaaatagaaaaatgtttttaaatccttcttttggatttgggccgaaagtcggcccaagtctctcccttcccctcggcctgctcacgcccgacccaagccggcccagtccgccaccccagccttgccgcgcgccgccgatctccttccaaaatccggccgcccctatccttctccgatcaaattgatagaggggaaatgatcctcgggatctcctcttccttttcttttttggaaactttggctaatttcgtttggaaactgacggatttgagctcgattcggatcgatttttctcccttcaaccctagctttccatctccttgccaccgccgtgggcctagccgctgccccctagcccctataaaaggacccccgggacctcctcttttcgccgccaccttcgccctagcctgccaccttctctagcgtcgccttcgcgtggttctttgcgtcgctgccgccggcgggtgtccagtcgggcgccgccatcgcttcggtcgtcgccgtcagtcgccgtctccttcatcagtatcgcgaggtcgccgccgtcctcgtcccgtcctccgtttccgccgcagatcaccggagcgccgccgacaccatcgacccgaagctctcaccgtcgacgtcggtccagccacgccgcaccgccgttgcagccgccgccttcggttgccgttgccaccatcgggttcgcgaggaggagaagaacctcggccagccctccgttgccgctgtttcccgccggagcaccaccgtcatcgccgacccgaagaccgccgccgcctcgacctcgccgctgtcgtcatccgtcgtcgtttgccgtcgtccaagtgctcggtgagttcgccgcgtcgccctctacccgttggtgccctccgtttgcgccgcctcgccgccgttcaccgtcgagcatggtgccgagccgccggcgatgacatcatcactgatgtcagcgctttgtcagccgtagacccgtggtagtccggatcgatctcggtcgtccgattcggtcaattttaggtcaattagatcttgggcgttggatccgtggaccgcttctgtgaacccggtttaccgtggactgtccttgatgacgcaaaaatctcttttccttttaaaaataatactttattgcgtcataattcaattaaaatctatataaatgctttaattcggtttaatgtttaaaaattcataactaattcattgcaactcggtttaatgtggttcaagttgcaaaagttgtagaaaataaagatctatatagtaaaattatccataaattgtgttaaatttatttaatcctttaattaggtttaatcttgtaaaattggtaattaattcatatgaagtcagaatgaggccgttcaagtctcataattcatctaaaatcatgatctacatgtttgtttactttatatgtattgtttatttggagtttcttagtatttttcctcgttttgcgtgttagcttgtcgtttccgtcgtttcgaaggttcgcaagtgcgccggaagtgttcaagaagattaattgaagaccgaatgttgcaaggcaagtcacacagatcccaaacacaattcctttgagcatgttgatcctatatttaaattctctatttatttcaactgtacatttattttcgaatgtcaccgggtggtgtgaacccctattccctttgttatggccaatttgcattgattaccctatttcttgattacctcgggttataatttgactagttggatttatatattggttcaactagatgtattagatctaattgcttagccatgcttagaaacattagcacactattgggataactaatgtttcaccattacttaatgatgtacatggtaaaggtagctcacgatggtcaatcgtgattggttaattaattaatgtgccaactaaaacttgataatggtgggttgtgagcacatggttttgatggtcgtgctcataacaattaaggaccggttcacgagtttcggttgtgaaacattaaccgtgccaaccacaagccagagtgggcaacggctggacactttgtatagcaagactcattgtggtgtgccagactgagaagtggcggagataagcccacgggggtcgttggggagtctatgccttgttttatatgggggtgattatgatccaggaacggtgtattactttgagttgagttatgcgaggggtcttgtcacaatcactcgccatggtgacgtgtctgcgcggacacagtgacatgacagtgggttgtgtcttgtgggtacagtggtacatctctggccagagtaaaactattcgaatagccgtgcccgcggttatgggcgggtctaacaatgtctttcgtgattagtcccacaccactcattaataataatgtgataattgatggcaattaatttagctcctagtttggaatggtacattcctggtttggagatagatctgtacagccgggtatagttgttcaggatggttgggcctgtgcagcatgggtgtgttgttcagcgttgattaatattgatgattaattactctactgttttacaattattaactgtttgctaaatgttgcttttgcaaatgagccctatattatgctatcctttggtatccttgtgcacttgcatatttgctgtgtggcttgctgagtatgtcatatgctcaccttgtaataatcaatcaaacctcagttgaagttaagttgcgaaggagaagacgtttgacttataccccagttgagctacctgtgggagtggagccagagcttcgctagaccgttattccgctgctgttttcttttcatttgtaagtatgtaacgttgtattattgatgaatctgtatattaaattgtcagtttgtgtacctcg

SEQ ID NO: 65744 - DNA, 3320 bp, Oryza sativa
accccgaggtccaatacggtgacaaacactctccgacacctcctatcttccttcttgtagcttgttctcaaatcagaagaaataaagcttccactctcgcccatattttttgtgtttgcctgcttgtgtgctgatgagtagaatagaccgatttctcaacgtcatgagcatgagtctctaccgaccaaaataggtaaacatgtgagaaaatcagtttgttttgatcattttgttctttacatgcaaatcatcattctgctatagttgaaataagcataagaacatcatgataattgaagtaccatcctccgacattatcttagcaattaatacccagtggtggagctggagaggaattgaggggggtgcaccactttgttgtgcataaagcgggataaaaataatacttaagcaaatgaccatataacgagggattgcaatttcggtaattttggacacctcagcaagtgattatctcggccaaaatttttgtttttctcaaaattttatgaagttgattaaaatttagtcaaattcagttaaattatgttaaaatatgccaaaaatcctgaaatttcggtaaaaccaaaatgagtgaaattttagccgaaatcgaaatcgaaaaccctgcatataacacgaacaatttaactgttcataattacagcaccaaataagaagcaataacaaaatgcttaccaaaatatagcgaaagaagttaatatcatatacactcaaatcatcagcccacctgagtatacttaaatcacctacagcataaaagtgagtaaaatcatcaaaatttgcaactgaataaccgtcaaaaaataatttaatgttagatgcattttcctttctcgttgattagggtggtacttgtgaacatattattggtattttgtggtgatttgcttttgagaaatttctccaatacatccgcctgtcatttatagccatgatgcaaaaggagaatagcgatataataaagtcatagccccaaatatgttaatagtgctgtacagttttgcttcaaactgacaaatcctaaccctacaacctagaaaattaataacaacaaaataatttcaaatcttctattctaatttcactaaattcgcttgcaaagatcagattaattaatttatagaaaaaaaaatagagctgaggaaacaagacacaagaaaatttttgaggtcttgcctgttgcgctcaagatcttgaagggaaagaaacatgggtggaattaaatggcgtggcagctagcgagagagacggtcttgggcacagccagaagatgaaccactccggtggcgaaactcatggccggaggtgtccacaccagttcaccgagaggagagaaggaaaggggaaaaagatgcgaacaagaaccacttgccgtcgtgcggcatctgaaacgataaaaaggaaaccctccatccaggcgtgcaaacatttgctcttcctaaactctatgggcctgatctatttagaacgtcgttcatgggccagtaatgtcttcgttgttgttttgggctgatcgggggtacaccaactaggctcgaggggggtgcacatattgtcaaggtagggtggtaagcactaattttgtctttcggcccgggtgcctgggaaccccctctggcccattgggctccgcccctgttaatacccgataacatgaaggcggctctaacactattatcgtccaaaggcttgagatgatacatcctctcagtacttctcgataacacgatggcagctctaccaccgttattgttcaaatgctagagacgatatagatgcttgaagcactggcatggcaacttattggacggctctgctgccgttgccaccaaataacggaggcaaacaaaccttctgcatggccctgaagtgttgttatggatgtccttcgattctataggcatcactcatgtgggcccttgatgtcactaaggtcagctctgctgccaaggatcatgggcaaatagtatggaagtgttgcctggtactattcatttttaaaattttgcacaatatgcatggagtttgtgctcatgtatgctcctcattttgtgttatatgcttactatactgtttgcatgatcttttgtaacattttattttaattttataaaattaattgccaagcatgaaattaattttctagcatgattgataatctctaatcaagcaatatgtaatcttgaagattacttaaggtaatttgcttggaaagtttccatggaaaattatgtggtaatcctgaagattacacacactagtaattctgaagattacgcatgaccaaatttatgttgaccctgcacattgtatttacatgttgtaaataccaaatgatgtcgcagacatgtcagacatagtgaaaagtaattcgccacgcttaccttggatgacataactacctcacttgggcattggatgttgagattgaccacaactctatgggtctcggtcatactattatgttgcccgaggctggcacaaagtagcctaggaaggccattgcatttcttgcgccaccatctccaccaagaccggaagtctgagtatatgaccgagaaagatccattggtattatggcaatccatgaatgatcatttcgactagcaaggatcaattgtgccccaaaggcacaacatgactggatcaccctacgcttccaagactacaagtctatagtagcatataactctacatttatgtgaccagaagttcactgacgctaagatgatcgagaaaaccttatccaccttccacctaggggcagatctacagtagtatgagcggtgtcaggcaacatcaacgactttcagcaaaacctatagcaaaactgcttattcatatgttataacactatgacctaagcataattaacatactatatgacactaatagacacgttatgacaccaacgagtcgattttctggatccgccactgcttccaccccaacaacatggagttgcaataacaatataggaactcaaagtactctatgtactctgagcttatcttagtactacttcttagtattgctagttgtagaaatgtagaatgaggttcttttaatgaatcattccactcgacctactgggtctatggcagtgtctgaagtacaagccaatgatgatggggggacttaggtgaacgaatggggccacattgagaagagatgcagggtaagggaagtatcatgtccaagggtaagagtaagggtaagtcctaaggtaacgacgaactcaagaaggttataggtgacacatctgggggaaagcaggataactgctacagatgtgg

SEQ ID NO: 65745 - DNA, 1861 bp, Oryza sativa
  unsure (1)..(1861): unsure at all n locations
aacccagcggtcgcaaatcgcgcgcatcagcaaagggaaaaccgaccgacaataatgagcggcttcttttaagactgctacattactcgagcagcgcgcgaatcgggacgagccggttcgtttcgcctggagacatgatgatggcgcttttcacggttggcgagcgtagttaatgcgcgcacgatctgccccatctcaaccgccacggccgcacatctgccgcgtgcgccgcaaacgagcgagtgggttagtggaggcgtgggcgcgagaagccgggtatagcattggcaagggtgtaaagacgtcgaggaagggattcgttcctttcctctcgccactctcccccttgccttcgccacttgtgctctaactcttcgtttcctgtgccctacccttgccgcactcgctcgctctcaagctcctcctccgccggcgtcatggcacggagctccgcaccgctcgacggtagcgtgctgccgccttcccgcatcgtgagcgagaggcaggccgggctgccgcgccgattcatgccagaatccgccaccggccgggaggtggtcgcgctgggcgagggacgcccgacaccacactacccggggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgcgagatgtttattggggtgcgcccatctctccggctgttccggtggttcttcaccgtacagccggtgtcgccgccgacggtagtcggtggctgctactttcaaccgcgggggcaggtgctgaaccggtacattctctgcgtncttcngaaaaaagtgggatgacttggaaaagcgantgggtctacaccccccctcgccgaccaagcgcgccctccgactttcgaggccagcccccggcgcaggcctccagctggcgggcgacggtagatctgggagacggctacgacgccgttcttgaccgcctggcgggtctgcgatcccaggggctcacgggggccatggtgttcggcgactaccttcatcgccggatcgcgctgctccagcggcgcgcccggggcgcctgggtgtacaccgggcccgaggactacgtgaggacccaccaggggcgcaaatgggacttggaccctgaggacttcaggatggtggtccaacgggtgctgaatctcagctccgtggaggcatccctcatcccccaaggggtcctccccatctgctgcgatccagagcgcgccaagatcctggccatcatgtaggtggtcggggcgtcggggagcgggccccccgaggccacgatggcgcgggcgggagccgcaggagggaacaatctaccccgggagggggtcgtgcttctgggccccgcgacgggggcccgggggtatccgccctaccgacgcccgggggaagaggaagcaggagggtacccctcccccatctcctccccgagggggcggggcggtgcgtgccagcagcaggcgcccggagggtgctgtgtcgacgccgcagcccgagggggagcgaaagaagaaacggctccgcaagatggggggaccgagccatgccgggagagcctcatctcgcccccgaggtggtcgtttagccgacatccccgcaggttcgtccccgcgcccaccgcgagttttcaaggcgagttttcactcacccgtttctttttgtcttctggtttttcttctgcctaagcgagatcccgtcgcgccctccccgccattccaagtccagccggtctgaggccgaggagacggcgaccgcggagg

SEQ ID NO: 65746 - DNA, 10824 bp, Oryza sativa
atgacatgcttatcgatgctaaggatggtgcagacgtccatatggacgatgatgaggacaaaccttcttgaagaagagaatggcatatttaaggacctgaagtaatctcctatatgtctcttatatgtgccctacatgcgcagaacatgtagaacttagtcatgaataatgctcctaaagagcatgctaatacaatattaagaaaaactagatattttcataccttaactaagaaaactaaaaatattgtgaccattgcaggaagcaatgctcatatagtaggcactgtaagttctaatctagttctccctatggatactctagttcaaagcgtaccctcttaagctataatgatatctgtgcaaacgatttccatatagaaaccgaggttgagcaagatgttgaatatcttctcatatccaaaatagatggatatcaaaagcaagtcgtgtaaagactcccttcatcgccatcgggttttgaactacacgtacataaaacccactaaagaatatgatgaaaacaatattttgaaacccaaagttatttaaaatttggcatgacgggttgggtcatcctaggttgggtatgatgagaagaatcatcaacaattttgctggccacattgttgaaactagagacttccctaatcctgaagattttatttgctttgcttgtgaaaaaggaagttgatcactagaccatccctcctgaagattagggatgagtcaccttttcctggtaaggatacaaggtgacatatgtggacctatctagcccctgtcgggacagtttaggtattttatggttcatatgtatgcttcttctaggtggagccatgtggtcttgttgtccataggaaccatgctttttcaaaactaattacgcaaatcatcatgctagaagctagcttccctaataaccgcgtacaatccatttggatggataatactggtgggttgaggtcaaaggctttcgatgattattgttttgccatgagtattaaggtagaatattataccgcatgttcacactcaaaatggtctagctgagtcctgttggtaattcttatggtcgcagataaaatccgcaagacaataccgactaactcaagtagtaccagccaaaccgaacccctttttttttccaaaaaatcagaccggttttcttttacttagtcaagaacctgtcaacgcgtcaggaatccagatcaatccgctttccttgctccttctgcttgcctcttatcctcggctcgactgacgccgccgcccagtgcctaccatgccgctcttccttgctgaccagccggcctttagagctactccacctcaccacctcctccatgctgccaccaaagacgctttagtcttgatgccgccacagtcctggaggaccgccacgcaaaggtgtagagctcccgctacactgcctaaactcaggaccttgccagtgagggtcgcagctgccatgggcttcccaccatgcagtgaggatgttgatgaccacgggctgactctgacacagaagctgatgccatccctagctgttggaacccgccacctccacgacctggagatggccgcgccaaccctctccactacctacaccaccacttgccgaagccgtgcactgctacccgagctcgtcgcctacaaatcgaacgcactcggagaaaatcaggttcaactctctccctttgtcacgcccgaaatttctatccaaaactccaaacgcttacatgtgtgtaaaccctcatccagaaattagccaaggcacacaataacaaattgataatagagtgcaaatatttatctaattaataggcgaatataaagtcactacacaggtagatagttcctctcaaacaaaaagatctaagcagcggaaattaaaataaaatagcgtagacgactccatcccacaagcagcttgaccaaggctacgcctaatcctccacaccatcagcatcactgtagaactcctcctctgatgaatgattgcaaggtgagtatatgacatactcaacaagccacacagcaaatatgcaagtgtaggggataacaaaggatggataatagtctcatttgcataaatggcatttaataaatacttcagaatttagaaaaatagtaaagtatttcattaaataatattaatccaacgctatacagcatacccgttgcatagacccaaccattctgaacaaccattcccggctgtatagttctatctccaaaccaggaatataccattccaaaccagaagctaaacaagttattaccaattacagcatcatttattatggtgagaggtccgagactaatcatgaaagacattgttagacccgcccataaccacgggcacggctatttgaatagttttactcttgccagagttgtaccactatacccacaagacacaacctcaacatcatgtcaactatgcatcgcgtacttaacaagtacccgaatagagattgtgacaataccctccgcataacacaattcaaagcagtgcaccatttctggatcataatcacccccttataaaacaaggcatggactctccagcgacccccgtgggcttatctccgccacttctcagtctggtgccccacaatgaaccacactatacaaaaggtaaagctgttgcccacgctggcttgtggttggcacggttaatgtttcacaaccgaaaatcgtgaaccggtccttaattgtcatgagcacgactatcaaaaccatgtgctcacaacccaccattatcatgttttagttggcattttaattaaccatcctatcatgattaaccatcatgagctaccattaatccatcattaagtaatagtgaagcattaattatcccattcatatgagctagtgtctctaagcatggctaagcatcctaattaatttagctaaaaccatataatgttccagctaatccaattattaaccaggtgacaaagtataggtaatcaataacaaagggcgataacaaaggcaataggttgcttccacccggtgacattaaaaaataaatgcaatagttgaatagaaacaatagctttaaacgggatcaacatgctcaaaggggtatttaggatctgtgtgacttgtcttgctggccttggaactcttcaaagtcttctcctgcaaaatcggactctccgaaaacgtcagaatctaagtataaaagagaaaaaaatcaccaaaacagtacagaaacaatcataaacagtacatgtggatatttttaacatgtagatctcaattttagaaaaaattagagacttgaaccaactaaatccgagctaagatgaattagttatgaatttataaagtttaaatcggattaaagcatttatatggatttaattagattatggagcaataaagaattatttttgaaaaggaaaaatgatttattgcgtcaacagctcgggttcacggtggactgggttcacataagcagtctatggaacagacggccgagatctaatctaatcaaatcgaatggccgagatcttgttggctgcaaccctcaattctcactctaaactcactcttggctggaggtagaagatgatgaatagtgaaatcaccaagtgttcgacacaggaaaagtttttggtgctgcgtagaaacgttgtagctttttcgcggtttacttctgtaatataaagcaaattacatgcaaactgaaaaatagaaaaaaaaaaaaggcaaagaccgggaggtgccatagtggactccgccatgcgcgccagtactccatccaacgtgcgccatcccccacgtcgaagcaccagcgtgatatgcatcctaaagacacgttccagaccatcgaggccaagaactcgcacacgacgctcacgccgcgaacaagcaggcgcgctcatgcaaaaaccgaaaagaaatgacaagctacagtgacatacatgattttgtaggcgcaggattattcctcctaacaatctccccttaatcctgacgccgagtgacaatctggaccacgcccgccttgttgcgaaattcttgaaacttgatgcgcgcgagtggcttggtcagaatgtctgccacctgttcgtccgtggagatgaactcaacctcaacttttttctcctctatgcactgcctgataaagtgatatcgagtgtcgatatgtttgcttcgatcatggaacacaggattcttgcacacagaaatcgccgacttgttgtcaaccttgaggatggccatctccggttcggtgcccagcacttcagccagcaatcgtgcaagccacataccgaggcaagccgctcctgtggcggcaatatactatgcttcacaggaggaaagggccaccaccttctgtttctgagattgccacgcaattggactggagccgagaaagaacaaagcccctgaggtgctcttccgatcatcaacgtctccccccaaatcactgtctgataaacccagcaaatgtattcccttttcccctgatcttgcaaagcaacatccaaagttcagagtacctgctacatactgtaggatgtgcttcactgctgccatatgattatcatgtggtgtctccatgaatcggctcacatagctgacggcgaaggcgatgtttggccgcgcgtgcacgaggtaccgtaggctgcccaccaggctgcgatacagagtggagtcgacggccatcctgtcactgttcttggtcagcttcagtctaggctccatggggatgcaagtcgaattgcaatccgccaacccaccgatctttagtagcttctgtgcataggctgactgattaatagtgatgtcgtcgtcgctttgatgtacctcaatgccgaggtagtagctgagcaatccgaggtcgctgatgcagaagagagagtgcatctctcccttgaagtgccgaatttcttcagcgtgtgcaccggtgatgatgaggtcatcgacgtagacaccaacgatcagacgcttggtcccctcgccacgagtgtacaccgcgtgctcggtggtgctccgtttgaagcccagctcatgtagacaggtgtctagctttgcattctaggctcgtggagattgacgtagaccgtacagggctcggttcaggcacaaaacacgccttggatgcttgtcgtcgatgaagcccggcggctacgagacatcgacctcctcctccagctccctattgaggaacgccgatttgacgtccatgtgatgcacagtccactcgagatgagcagcgacagcgaggagaagccgcatggattccatctgcgcaaccggggcgaagacttcatcaaagttgattccatggcactggacatagccttttgccatgagccgcgcctcgtgccagatcacggcgccggtctcgttcttgttcaacttgaacacccacttgaggtcgattggacacttgccggccgggagctcagtgagtatccaagtgctgttctcctcaatggatttgatttcatcttgcatcgcttgccgccaatgttcatcctgctctgcttcagtgaggttcgccggctccttcgcgactgccaggtagagctcgtccgaatcgagctccaccagcgccgtcgtgtcgaggatgttcgccatgctccggtagcgacgcggcgcgccctggtcatcatcgacgtttggcgtcgagctcggcggcgacacgaactcaactgggggtgtgtcagaaggtgttgccggtgtcacagaaggcactggtgacgtggccccgacgctgggaggtgggcttgcaggcgcagtgcttgaggccacctcttaatggacggtgaacgagtcgtctgaggacgcctctccttgttcgacaggttctccccatggccacgacgctgcttcatcgaacacggcgtcgcgcgtgacggcgacgcggttggcctccgggtcgaagacacggtagcccttcgttcctggctcatagccgagaaaaaccatcaccttgttgcgatcgtcaagtttcttgagatgcggcttcacctccttgacgtggacgacgcacccgaatgtcctgaagtagtgcatgtcaggtgttcgtccgtgccacgcttcgtagggagtcttatctggtacggccttcgtgggcgaccggttgaggatgaagacggcggtcgtcaccgcctccccccagaacttcccgggcatttgcttcgccttcatcatgcacctcgccatggccataactgtttggttatggcgctcgacgacgccattttgctggggagagtacggcgccgtcagttgccgagtgacgccctcattcgcgcagtacaagctgaactcgatggaggtgaactctcccccacgatcagtgcggaggacacgcagcttgcagccagtctccatctccacccccgctttgaagcgcttgattgtcgccgaagcctcacttttgcatgtcagcggaaacagccacatatagcgagacatgtcaccgattagcaacaagaagtactttttaccgccatgggtggaagacgaaatagggccgcagatgtcgccgtgaacgaggtcgagccgactcgtggcccggaacatcgccattacggggaacggcgctcgacgctgcttgccgatgaggcattcatcgcagacttgcctgacatgctccagctccggcaacccgcgcgccatgccacgggtggagagcatgcgcagtgcatcaaagttaagatgcccgaatcgagcatgccagatccacgcgtctttagaactccttgccgcgagggacaccggctgggcgaggtcgacctggagcacatataggcgccacgttccgcgacgaacgcgacacaacggacgccgccgttggtcatgaagggtgaggattccgtcctcgatcaccatcttgcacccaacctcgtcgagttggccaagactggccatgttgttgtggaacttggggatgtagtaaacgccggtgagcacacaatagtcgccgttcttgcaggcgaacagcacggtgctgcgtccctcgatccgcatgcgcgaggcatcaccgaacttgaccgtgccgtgcacggtggtgtcgaggttggagaaggcatcccgcgccccagtcatgtggttggaggcgcccgtgtcaaggatccagtcggggtcgaccggctacccctcgtcacagagagaaacgagcacgcgttcctcgttcaggtgcacctcgccattggtcagctcgggttcatcgacgggagcaagcttgcagacctgagccatcagcaacgtgggctcctcatcaccaccagcctgctgtggttctgcaacaaggagattacctgggccagcttttcgcgatcccgctttgccttgcggcaatctttggcccagtggcctagcttgccgtagtagcgacactagtctttggagacgttgcggcttcccagttgtgatggcgtggacttggtgtcgccaccattgccgtcgtgcccttgctggcgtgatcccgcgttggcgcccccgattactagtgtcacgagacaactgcccggtctgcttggtgttgcgagcaggtgtctccgtttccccgagcagagcctggcccgcgtcttccccgtcggaatccggatggtcgtcgatggtgaggagccggccagtcaggtcctcgatggataaaatcgtgagatcaatcaatgtttcaattgacaaggccatctgacgatacctgcggggaacaacacaaagtaacttgcgaacgattttctcctcggtgatgtcatcaccaagaagacggaggtcgctgacaaccccctgaagccgaagtgaagtcctcgactgattcgccgggcttgcatcgcatggactcccacgcttggcgtagcttctgcgcatgggattctttcatgcgatccgcgcccactcgcatggacttgagcgcatcccaggtgtccttggcgcatctcagccggcacagctcgcaggatggccgaaagaacctgacgatcttcatgaaagggcacgtcgccggtgtcgacagcttcccacagaccctgagcctgcaggttcactcgcatcaacaccgcccaatcagagtaattggaacgagtaagcgtggggtaggtgacagagcccccttccttgactacccgctgcacgacaagctgctggccgcgagtgcgaggaggggacggcgaatgctgtcgcccacgccggtgtggcgtgcaggactgaccacccacaagagccgacatggctctgataccaaatgttggcggcaaccctcaattctcactctaaactcactcgtggctggaggtagaagatgataaacagtaaaatcaccaagtgttcgacacaggaaaagtttttggtgctgcgtagaaacgttgcaacattttcggggtttacttgtgtaatataaagcaaattacatgcaaactgaaaaacagaaaaaaaaaacgcaaagaccgggaggtgccgtagtggcctccgccatgcgcgccagtactccatccaatcgtggccaagaactcacacacgacgctcacgccgtgaacaagcaggctcgctcatgcaaaaaccgaaaagaaatgacaagctacagtgacatacatgattttgtaggcgttggataattcctcctaatagatctgaccgatctaccaccggtctagggctgacgtggcgctgacgtcgatgatgacatcatcgccggcggcggctcggcacaccatgctcgccggcgaacgacggcgcgacagcgcaaacgaagggcaccagcgggtagagcgcaacgcggcgaactcaccgaaggctcagatgacgacggacggcaatagatggcaacggcggcgaggtcgaggcggcggagaccttcgggacgacggcgacggcgatgatccggtggtcttcggtggaaacggaggatgggacggggacggcgatgacttggcgatcccgacggcggcggcttgcacgcggctagggcgcggctggcggctggaggtggaagacggccctgacaggtgggccccacctgttagtgggagagagggggagagaggggcggctcggcttggtgggctggctcgggccgcacgcgcacaggctgaaggaaggaagggagagagaagggaaggttttgggccgactttcggcgcaaagccaaaagaaagattttaaacctttttcttttttaaattattcatgaaatgcaattccatttattaaaaaatactttcttggctcaaataaatcctagaaaaatctaggaactatagaatcaagagaagtacttaataaaattttatctatcccacttttatataggaatttattacttaaaattagatcttttcttctaggcttttaaaatcatttctaataattccatttaaacaacaatttataaatttgggattttttgggtctgacacccttgctttgtgatttgcttgattgcaatcccatggaagcctcactatatttattggggaattttcagtctgattcaagaacaaattgtagtcatcgtatgattccctttcatgtccaacgtggtgtcttcttttgcatgtctttgtccgcagcgatgttttactcgagccaaagttggcctctgagttcaagtccattactacagcatgaaccataaagcacaccttacactacctcatggcatggctcctatatggttatcttctgcagcatggcctcgacgtggatagcacgcacaccgccgtgacacctgacttcccgagcctcctttaccttcacgatatcccgcagagccttgcaccattggccaacatcgtgataacgaccgccgctgatgaattgatgcgtgctattgtgccaagcttagcagatgaaaatggcgtatccatgatcaggccagctagggagtgatgaggatgctagttcatgatcttccgataggtaatgataactctcgatttggtggaaacttgacacacacgatccggcttccgatcaacacgatccgaaccttgcaatcgcaacaccacatctcctctggttatcaaccattctgaaacccgatcgacctcgtcgagaaggctaatccctgcatgcgaatcgaagaacaaaagcaagaacaagatagatagcaacaccgttgcatatgaatgattaaacacttgaatttggggttcaacaaaccgatctagcggcgaaactgtaatggcagaaataatctaagaaaaacccgattgtaaactatgatggctactgaataaaaatgatttaggacgtcctagggttgccctaggacgcacacccacttgggcttaacctacgacacaattacaaggcccaagacccaaatcagattcggattagatgaggtatgtggcttgttttgcagattcccaacagctcggtgggaattttgatgtgggaccaacaagtactcatgagccctaaaattcctattagattagcggctagatccgtttgaaactgatgctgttaggaggcccgaatccgaatccaaaacgtgtagaactttatatcttgtcttctatgaacctaaagtgatgtggtgagatagaagtggacttggagaaggtcttggtttggtccccaatcaacttctttgatcatccatgcattccttacgctatcgcgaccgagaaaattaccttttcccgaacgctagtgtactaatccccgtcctaggaaaagccggggtacaccgaacaaacatgatacaaaaggcacatctttattatatcgataatatttacattattacaaaggcacttaaggcctgacaatcaaaaataaacagcagcggactagcgggcctacggctccatcttcacaggcgctcaactggggtata

SEQ ID NO: 65747 - DNA, 14014 bp, Oryza sativa
aaaatcacaaacatggctactcattctattctggagagatatagctggcattgttctagtgactacatcatccttgattggttctgtgatgatgtgataggactgcatattgctatcattcacaggagaagcttccttctgattgctgtttgaagcagatgacagtcttctgcttggtatcgccctcctgaggttgattgccctttgctcggcctggagtaggtcggggagagacacaacttcttccatcgatgacaattctttgctgaggctgtcggtgcagagaatggttggtgctgaaggtattattgctatgatttattgcagagtcaggtgcagcaggaggagcattggtgctgtggatgatatcgtcgatgttgctgttggagctaactagctgatgagacaatcgtagggttgttcgttggatttctgcggtcttggtcaacaacacactgagttggcaatccttgggcacatggtttgtaccttcgcacagaaaacatgtgaccttgcgggtgggacactcccctggtggatggtcttcttcacaataagggcagagtgtgagacacatgctagcaatgtgtccaatttctccacaacgggtgcatgcctttgattccatctcttcctcgccgacatgtcggggagactcatcttcatcatccgaggagacttgatctgacccttcactatcagatactctgccaccatggcttagaaggtgctgggtcaactgtcgtgcacctcgaaaggtatttcctctttgatgtctaggaatagttatccctgctggaggccattcggtgctggtaatagtcatcttacgtacttcttcttcagttcgcatcggtgcttttctctgctgattcttactcttcttgcctttggcttgcttagtacgtgaccccacgtggtacgaaaggctaggaggaaagcaattctcgggattcaatggattctctccattgggctctctactttgcacactaggctgcaagcttgacttggtgcgaggaggctggtttagcgatgtctgccctgctaaaccaaaggaaggggcttctttggcatatacccatggacaattcagggcatagtgtcctcgttctctacaatcgtgacaaaaggggacatcctcttctggcattggaagctcattgacctgggtggcaaatgctcgatcaaacacatactgattttggtcttgacttccaaccaatggtagctgtgaactaagcagcatgcttggaatggaccaagggtgtgccctggttaactctcttgaggccagtggtggattgagttgaaaacttgagttacttgaggcatacccgctgacattctttcctttttctctgttaaacatctgttacagggattgaggtgagagaggaaacaagccaggaaagaatagaccagaactagagacaggaccttaaaggaactaactcttcttgctgatgtgttgtttgtttcacgtattctgcaagttgattaagcaaacaacctagcatggttacatcacaacccgctgatgcaaaccacgcgctacacacacaagcaaggaaacacacgactaacgactctaccctagagggtggcttaggttctgtgacgggttctcaagatcttcactcctgcttcacagctggcttcactgcttcctccacttcgctagcggatcctgcagtcttctggagtttcggcagacaattgacgacatcttcttcttcacaaagctgaccaactagtactagttgaaatttgaagaaggaagaaagagtaaacattttgcaaatagcacaggggaaaggaggaaaaaggaactttcgcaaatagtttcatttataaaatatgtccttaggttttatccacttggcttatcctacagtcgagatggttctgataccagcttgtcgcgaccgagaaaattaccttttcccgaacgctagtgtactaatccccgtcccaggaaaagccggggtacaccgaacaaacatgatacaaaaggcacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaaggggggggaaaagattgagcaagaatgagtacaaccacagtactcagcaagccacaccggagatgcgtaattaatgcaagggagtacaaggggataataataagggttaagttttgcagtaaaccgcatttaaaagtcacttagttgcccaaagccattttaaaaagacgatcctagagctacacagtgttattaatcaaggtcgtgaaccctcacgaacctgccttaacccaaggcctacgatgattcagaccgaactggcaacccgaccctgggtcccagctcgtcccaagccaacccaggccaaccattccacattttagttgttaagcaaattttaagaattaaaacactaacttgggtacattgctaggcttgcccataaccgagggcgtggctattcgaatagattatactctgatcagaggtgtacatctttacccacaagacacatcttcctcacgtgtaaccacgtgccacataccaccacggtatacggacggaagacatgacatatttcccaacccatcctagccataaacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtgaaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataatccaacaattccataatgtccaaatgatatgagatttcccaaagtctaaagttataaaaccacctaatgttgcctaattaaccagcgaagcatctacctaagttcatactagtggaaccataaatagagtacccactagttggggttttattttcctagggtgaacaaggtaataataacaatagcaataataatgtcttaacaacgataaataggcatggctaaataaaacagtgataacgcgggaatttaaataaagcggtaatgcattaatttaaatcaacataattttataaactgggattcaatatgctcaaggatgatgtgacttgccttgctcgctttcccaaacgtcggcttcaacctccacgaagagcggatcttccgaagctgcagcgtctacacgaccaacggaaaagaaacggcttttactctaataaactccatataacaagcagaaacaaagcacaaaaatgggttcttgacttcttaaggaaaaattagagacttgaacggtccaattccgagttcaaatggccaagttatggccatttgaaggttatatgctctttaaatgaatatttgcgaatttcttcatttaaattttaatttaaaatcggatttattgcgtcagccgaggagaggggcgcgcggaccgggtccatgggagtggggcccacgcggcagcctcacggtccacggtggaccgggtgcacgcggcttacgccggccggcgccgtgggtcccacgcgtcagccgcacccgagggcacgggcggctgacagccgggccccacatggcagccgcggggcgcgcccgaaggcggcctcgccggcacagccgacgggaggcggcgcgcccgcgccccgatggtcgccgccggcgaccaccggcgcggcggagcggcgcccgagagaggggagggaagggggaagcgaaacggcggtccacggctcaccccgggtcgacggcgacgacgggaacggctaccggagcggaggaaggcggcggcgcggctcgggtcgacggggacggcggcgttccggcggtcggcgggtgaaacggaggggtggacgaggtcggcgaggacgcggcgaagccgaaggaggcgacgccgaggcgggaggcggtccggggtgacgacggcggcggaccggagctcggcggcgacggcggagagagagagcgacgtcgcgagctcaaatccggcgaggaggaagggcggcgagaggcggaaccggacggaggaggtgcggggagggtttaaatagagccggggcgagagaggctggccggggaagggaggaaaccggcgcgggaggtcggccgccatcaatggcgccggcgagattaggggagcggtttccaaccgaatccgagggagagagggagggaaaaatggggggaaagagagagggaatcacggggagtgatttccccctctttattgcgcgcggggacggcgggaggcggcgggattcgcggcggcggcggcgctagggcacgggcgaggcggcgggagcggcgggaggatagggatgacaggtgggccccacccgtcagcgagggtggcgggcgggcccgcccgtcagcggcacgcgcgcggggaggaggccgattgggccgcgggggagaggagagagagggagggaggtgggccgagccggcccaagaggggaaggggggaaaaaggactttttagggcttttctttttataaaaccattttaactttgtttatttcttaataattattatttgtgctctgaaaattccactaaaatttgagggctccttttagaccaaggagaatttaacaaaaattctccgggccacattcgaatttttcttgtacgtattttaatgtttgccaatttcttttcgaattttaattaattctattattccttttagaaaatgaattttatttcggaatgaatttatcaggacgtgacatacgctcggtctcttttccttcacccaagtaagtacctctgcaaacgagaacacacaaaactcattgtgtagcaatgtttgttcaaatatataacaagtaaatctaatatagaacatatgcacctttggttgatgaatacataaggtagtcatggttatatccgagctagttgtgtcctcattagggaggctgtcctaaacgttctcggcccaatttgtatgcttgtcatccatacactgcctatgtagcaatccaacacgcaccatcttgtcaacacctcctaaagcaacctcaaggatccacccacattgaccttcaattgaatgacatcaatctatgcggaagcacgaagccgagaaattgccatgtcgtctccacagccatcgaacgacccgaaggccacgtctagccatctctctatcgaacgcagctcaccgaaacgcccgtgccaccatgccccaattgttcgattccacctgttgagaccaccgatcacctccagcttcaatcaacctgagcgtgcgaccacacgtcttcctattgaatcgcccgcctgaagtttctgacccaccggttggatcgccaatcgcttccatcgcatcaacccgaacaccatgtctggttgtctccctgttgaaaacaaccactgaacggttcataccgtcgcctgaagtgtccgatccacctgtcaaaatccgttgatcaccatcgtgcaccaccatgcacacatgtccttccatggacataaaccacgagcggtgcagtgtgggctaccccatcgcgcctctatccatggacctcctgcaggctttgataccacttgttataaaactggcttcaatagcacatcgagaaccaaacgtggaagaaacgccataggatatccaaacatgataacaacactgaggcacgatatttgttaacaaggttcagctgtagcctacatccctgtggcactgattacgggtgctactctccgatccagcatattagagcatatcagagttacaacgactcacggccggacaccgacgatagccgctccctcgctctatgttaaggcccagttctttcccccaactttcccaactcacctccctcgcacgcgcacacttttcaaacggctaaacggtgtgtttttttgccaaaaaaaagttgctttaaaaattatattaatccattttttaaagttttttatagttaatacttaattaaccatgcgttaatctatcgctccattttgcgtgtggaggggaggggttcccaacccctccaaaagaacacagcctaagtcaccatatggtttcaataggttggctcctctatttaagagagatcttatgatagagtccaactcttcctctattcctaacacctagtacaactccaagttctaaactggaactaactttgtagacatatttgatgcgaactataacatttataatttataatttactattttttatatgtaaacataataataaacactaaataatgaagaattcactagataaaaaatagtttggctgtaactaaaggactaaagaagcactaagtatatgaaaatatgttatctcttgtactaacgagctaaagagcagttcatgagtcagctcattaaagtcacaagctaaacgtttagcttggctcgatttattaagattacagttcgagtcaatccgaaccaaactcgctacgaatcaatcacaagctttgagtttcttttccacccctataccgtagtaaaaaaaaccggacctacccaacggttgaaccggaaaaccggaaccacaagctacgagttttttttttccaccatgcctatacctgagtgagacacaattgtaacaatcggtactataaattcaatggccaaccaaatcctactttcgggtaaatgattgtccacggatgatcatagctaccccagggatttttcttaaaacatactactcataatgtccaaatcaattaattaattagtaagatttctacttatgtatagtatacatactagaatatactacaattgtcgatggtaacctttggtcaaatataacaaaattaagttccattcataaaattaaagtaaatcgatcagtgtcacacacagacaggaccggatggttggtggttttgcagctgtgcgcattaaatggtccagtgcatgcacacagaaggcattataaatgtaacttttatcccatgatgaaagccttctcttctgctggttccatctggccctccctttcaaccttttttcagaatttaattgcagagatttatttgacttggaatggactatatatcaggttcatccaatcagaaaaccgcggcggagctgccgacccgttcgctgaaaaagaaccttcttagaattaaactgccttttgcctttcatctccacaccctgaatctcttgtaaaagatataaaataaaaaggaatatcaaatttgttaaaatgacttgtttttaccagtacttacgtgtagcaaaacttgaaacatatagccagcctagtatattattaagatcatgtgtcagaaaagagccattatattgccttcgttgctagaaattagggttaattggatcaatgccactagaaatatgttattttagataaatgacagtactattcatgatatcggctacatgtcactcgaatttatagaaattgggatcatgccactctgtcgtattttccatcaaaactctctgtaagcctcaattgcacgtgggtaagaaagaagagggggattgaaggaagatggaactgacatgtgggtccaacgtctaggggtctgacggaaaatacgacggagtggcacggttctaatttcccaaaatttcagtggcacatagctgatatcatgaatagaaatgttatttatctaaagtggtatatttgtagttgcatggatccaattaaccgtagaaattatcattttctttagagaaattataatatttattaatattaaaggaaaagagctgaacctacatcgaatatatggaaacataaataagctagacatgtatatacatgaaatcgctttttttaatatatctagttccacacaattgcgctgggaaacccactattttttaacttaaaatcacaaagaaaccagaacagatataccactgcgttgccacaataaacaggaagatatatagaggtgtacgtgcatgctatcctccgtacgctactttcccgtcataaaatgatgattggtttatcgaattaaatttgaaaatatactttttttaatattttacgttcatatacatgcatggaaaatatttgtacaaatatacctcctccagacaacggtgacgcgggaccgaggcagtgcggctctttcattccgcaggaccggcggtcgcgcaggacggccgtgtggtaccacctcgctcccacatcccgagagagcggtagcgtggtggagggcagtaccgcgtgcaaccggcgcggtcccacgcgatggtgctgcacgaccggctcggtcccacgccgtacgaccggctcggtcccgtgcaacggcgccgcgcgaatggcttggtcctgcgcaacggtgccgctcgatcacctcggaaccacgtgcgaccgccctccaccacgctgcctttctcccggactgcgggagtgaggcgttgtcgcacggccgtcatgcgcgaccgctcactacaagatatcttatgatagatgacgcttcatttacgtcacaaacattgaatttttcgtcacgtttcgtaatctgtgacgctcgcgtgacgaaaatttattcgtcacctatcatgcgtctctaatggcattctatgacgaaaccttattttttcgtcattaatctagtgacgatccttctgtcgtcataactttgtgactctcacattcgtcattatctagcctaaaaaacgtcacaaaatatcagatggcccattaaaatccatgtattgagcaccctgtttatgggcttagcccaatggcaagcccaactacattttagcctggcccatctatgatgtagcatattttcagcccaattttattatatccatttgctttaatatcaaataataaatgggccaagtccattgcaaaagcccatgtaagccaaaacattacaccacaccattttcagcccatcatattatattcatttatattagtatcaaataacaagtgggctaagcccacataggcccaacaatcaaccacaataacaacaacccatatagcacaaaggttacaacccatatagcaactggttcttctgataatgcaccagaagtcttacaaaccgaaaaaaaacaaaggtttcaacaaactgcatgcaccatcaacaatcacctacaaggatatgttgtatcaaactagcaaagatatctgattctaaggttgccaaatgttcatagcatgtatttctgagatatttcaccactccagatggcaaaatcttcagctgcctccatcctgtacatttcttctcttgaaaatcaaccaatggcatcaatgtatctttaccctttacaagatcctactcaacagacatcattgtaagtacagagaaatgcagtactgaaatgcagtatacagtagagagaaatctaatctagttctcaacaaactgacatagtatacagtagagagagaagtacagagaaatgcagtactgaatgcagcactacaggaaagaaactcttaagttaattaatttcaggctaagttaaaactactggtgcaactgggtaaatttggaccactcatccaaccaaggattggaatcaaaccagcaagctaaagtctaaagggtagcctctgatcaggatcagattcttcaccagctaattgaagcagaaatgctgaatgctaaattgcttgcttctgtaaagcgcactgaactgaactaaatgaattacagtgtgaaagaagatacagtagaagtagcagattacttctctgttttagcagattagctcatggcaagatgtttagataatggaatagatatctagtttgattgccagatgcaagttgatctctttgcctagaaattgagcataaacatgcacagtgcatgatgcactcactctcattcatcagtcatcacctacatgaatgtaatttttttacaggcggttcttaataactactaattaaagtattggtgtaagcatctaatgtatgcagactgcatgccaatattcttagggatcacatgaataaaaaatcattttgaggtagcaaatgtttgtgttcaagaataggaaaaggtagtaagaagaaggtgggaaaatgacacttatctttctagtcaatgggatctttgaacgcagtggcacacaaccctctgtagcttgcaattcatatctgcaacagagcaactgcaagcttgcatccttctcttttcatcagaaacttacagctccaaatgaatatgcaatgaaacaagttcagaatatttagtctctacctatgtagcgtggcaagaaagctctgctacataaattgatttactttctgtaggacaggggaataagacttaagtacacatgccaagaattaccattgctgagaggagttgcaactgtacttagatctaagtatcatcatacgcaagtaaatgcatccagaacttgcagatcgagggaacagtgctaccggatgaatcgtaggatcaaccatcattcaacagagacagacagagattaaagcttactgttgtggctcgatgatggcggatgagtgctcgacccatcggcgctccacgggaagccacttgagcaccctcctgcccagcggctcgccgcgacgccgccgctgattcaccgatgcggcaggggactgcgacgcggacgcactacctccggacctccctgctgcccccgaagagaaggcccgacctcgcctcctccagccaggagggcaggccggtgatgcggcagatgcggcgtggatcggggatgtggctgcagcgttgacgaggggggagggtcgccgccgccggccgtcgccgtgcccgccgcgcgccgagctcctccgtagggcggcggatccgggcctcccgaggacggcgccgccggatccgccgccgcaggccgtcgccgagcccgccgcccgccgctgtcggggaagggaggccaccgccgcgcatgggaggtcggggaacgaaggccgccgccggtgccgagcgagtcgccgccgagcccgccacgccgcacagctcccgtcggtgagagagagagagagagaggagaggaggaaagagtgagaggctgagaggagaggagaggataggataggataaggacggtggaagttaaaatatcaggagaggaggggggagagaagaggagaggaaaaattttgaatggaggaggagggaaaaaatttaattttaaaatattaaaatttctaatcgaattttatcatactaaataaacttatgtgaaaaatttttttttgtcatttcgccatccgattttgatttaactatataaaatttgaattttaaaatataagaaaatctttcaggtagtaaatgatttcaaatggaaaagttgttaacaacaaaattgtataacttatcaagatctataacttttattttcatcatttttctatatgactttgtatgcacagtttcaatttgaatttcatattatgataaattcaaacgacattttacaagtactaaatgatttcaactgaaaatgttatcaataacaaagttctataactcatcaagacctataacttttatttgggtcattctttcatccgacaaagtgatttataacattattcacaaaatgtacatatcccttatatagtttataaactataggagagatatgtaaattttgtgaacaatgttactattactttgtcggatgaagaaataaccaaaataaaagttatagatactgatgagttatacaactttgatgttgatgactttttcagttgaaatcatttagtatttaaaaatattgtttgaagttgtcataatttgaaattcaaattcaaattattgaaacagagtcatatagcaaaattaccaaaacaaaagttgtagatattgatgatttatataactttgttgttgatgacttttttagttgaaattatttaatatttgaaaatgttatttgaagttgtcataagtcaatcaaacttagatggataaataaccaaaataaaattggtagatctcaataaattatatacctttgtttttgacaatttttttacataagttcaattagtatgataaaattcgatttgatgttttaatattttgaaattaattgagaggagggaggcaatatgaacttctggttggagggaggaggggaaggggcagcttggcggctgggccggctagttcagtggcgcggcccatggaggagtagaggagggttgcacagcttgggccgaggtgggccgagggagaaaggagggagagggaagggaatgggaggaggaaaaaggccgagcgggctggcggggatttgaatcagactttagtacggatttggcccaaatgacaaaggaggattgtttttagtttttctttttaataaattctgttaattgtttttttgcttagtaaatatttcggtgctttgaaaattcaagtaaacatccaggacatattttaaaccgaggagaatttatgaaaaatactttgggtcacaatcaaattttttcttgcacgtattttagtgtttgccatttacttttaggattttagttaattatattattcattttagagaataatttttaatttgggtgaatttatcaggatgtgacaattattttagggcgttacaaagggcagttcaagcattcatcaattttaaaaagaaaaaaacttatgataaacgaacattgttaggaacttgtgacgtttgttggttggtctcttatgacaaaataataacagtcacaatacaccattagacaagtttatgacgatctgtatttgatcttagtgacgaccaccccatttttgtcactaaccagcaccgccccatattaaacgtcataaaacgaaatggcatagtgacgaaaagcaccatcgtcacaaggaattcgtcacagaagatcacatttcttgtagtggctggtcacgtggaatgggaaagcggcaccgcctcggtcccgcgcgtccccgttgtgcggaggaggtatatttgtgcaaatattttccatgcctgtatataaacaaaaaatattgaaacaaaatttatattttcaaatttaattcttggtttatccccagtacgtgcatgatattttttttaggtgagcacatgtattaagaaagtagatataaatgattaaagaaaagttgtgaatttgtgattggttgagaaaaaaagtgaataaattaattggtaatggttgtgattggttgagagaaggcgtggtagatggagaaataactttattcttattttaattatattttaagatggaggtagcagcatgctactgctggagaagcttggaagctagaaattggcatataaggccatcaccaatgcggtgcttcagcccgtccccttagcgccggctgtccccttttccgtccgcgtcgttccccttggacggaacgcgtccctcagctagggaacgcgttgctcgccgcacctcgccagcttttcgtggggagacgcagccaggcgccacactgtgcgcgtgtgcagctcatgggcacggtgtcgtctccccccccaaaatttccccttgcaccctcgcctttctcgctctcccctcggtctcatcgcgccgcgcccaccactgccaggaccgccactgtcggccttagagagagagaagacatcgacgacagtgacaatggatccgcgacggcgacgaccggatccgatcgccgtgcgccgcggcagcc

SEQ ID NO: 65748 - DNA, 633 bp, Oryza sativa
ttgctttacattataaataatgtggtagcgttagaacgaccatattctaagtaaaataagttttactaagtggaagaaacataaagccctgtattactaatctttttaatatacactcaaatcttagtttacatctgctaatatacaatcatgtggccaataccccctaacagtgtcctcctggtacttcgagagaccaccctgggttggcgagatacttacgacaacctgtcatggccgtccaaccggggctacatatagaggagtaccctcccttcgaatttgtcttaggaatatatactaacgtggagaaatacccatactgagctatcaccatcagcggcccacctctaatgtcctgcaacatatatgcccaattaatgatatttaataatctaagcaccatgctaacattactaaatactactctatagccgtgcacccgacatagagcaactgataaattagacattaaactcgcaccattacacctctctggtaggctacccacacaattcatataatgcagatataaagtaagaccagtactaagactaagcaaagcaccgaagatatataaagaagagtatttcattaatacggaaagtattacagaagagattacaagagctg

SEQ ID NO: 65749 - DNA, 3562 bp, Oryza sativa
ggaggggaggaggtgcgccggtaaatgaggagaagagagagagagagagggaggagagaagagaggggttgatgtgaccatggttaccacagatgcaaccattgctcacatcatggatgaacaagatgacatcaaggtcaaggcctccaagtgctggaatccgatccggccacctgctgcattgctgatttcaaacagccgccaaatctccatacgagctctgttttcggcccgtgagtacttgatggaaagctctcggagtcctctttccaacggatacagcctcattgcgaaattccatcttattgagccgcaattgaagcaacaaggtgctgcgtcacctatcatgggcctttgggcttgtaacttcgtttgggaccctggcccaagtggggcccatgtggggtgcgccctaatctggtggagcacgaccctaggatcctcatggtcgttctcccacccctataagtagctagataccccttcagggttgcttgggttttgattaattgtaagtttagccattgctacttcgcttgcagcgcgcgtgtcggctataccgtccgtctgcttgttcggaaccccactttatcatgtatcaatttatctttgtgcgtcttgtctatctagtaattcagttgctttatatcttgttcttgcttgttctcgattgcttgcaggaataaggttgatctgcaccggcaagatcaacaacccacggagaggtgtatcgatcgctaaggcgcaacgcaacgtcttgtacggttgtagtcggatcgtcaacgtttctcccaaatcgtagttatcatcaactcaccgaaagatcgggccaaacaactgccttgagtgtcgagtggaactcagggttcatcaggggtagtatagtaaaatacctacgtaggctttttaggttaggggcactcgttaggctactagggtatctttcattgtgtggggggtttcccagagagtgccctcagttagtgagggtactcttagagtgtccctgattgtagatgccctaagaaaaggcaagaaaaaggatttgtatcattagatgttactacctttatattttaatatatgacgtcgttgactttttgtccaacgtttgaccgtttgtcttattcaaaaaatttatgtaattatcatttattttattgtaacttgattcgtcatcaaatattctttaagcatgatataagtatttttatatttgcataaatattttgaataaaacgaatggtcaaacgttggtcgaatagtcaacagcgtcatacattaaaatacggagggagtagatattactgtataatgtatgtctaccctaagaaaaggatatgatactacataatgtatgtcttgttagatgtttctgtaatgcaataattactgacaggccccagtggtcgtcccctatacctgaggctttcgttccgattaacgttagtataggaacagaaatcaattaattaacttcctcttaaactctctagccagctagcttgtaccagaagccatgtacaaccagcacgtacaattaaatacactgttacgatacactgtcgtctcagcacgtgaacatgtgtccagcttcctttcggttaattagggataaaaatggtcacgaaaagtttcgattgacagatgctcgtttttttttcattgaccgaagcatctgaaaaaggtaaataaagacgaaaaggacaaatttaataaatttgaaaatggaaatggaacgattatactattttaccgattacttccatatatacccaacggaaattactatatttataagataataagtttaatttattgttgtaagattgaatatctatgatcatactccctctattttttaataaataataatgttaacttttaaacacatgtttgactattcgtcttattcaaaaattttattcaaatgtataaggtataatcacgcttaaaatattttaagtgataaaacaattcacaacaaaataaattagaattacgtaaatttttttattaaaaagaatggttaaacttgtgacaaaaaaactaacgatgtcatctattagaaaacaaagatagtattacatataatcatgttatgtgaaatatatatatggttttacagttattcaaacagtacttaccggttaccggattctaatcgataccggcacgttctcattcatataattccgttttcgattttctgatattattgcagcttttcattctcacctctacctttttattctatttttaagaaaaatatatatggtcacagaaatggttttgatggtgttctccaacccatttgttgtctggataaacattttacgtagaactgtgggagtgagcccaaaaaaaaaaaaaccgtacgtgtgtccgtgctgctgattttgtccgacatggatgcatgcgtgcacatgtattaagctaagctagtagtagtaggcagcacagatcgatcgagcacgtacgttatgtgtacagcccgaaactagctggagtagatcgatcgatcgatcgatcaggagcaaatcatatcctttgcttccagtaggaatgtgcgtacgtaggacgatatatgtgcaggttcgatctccgtcggtggcgttggccgtctccctcgatctctcaaccacgaccggccggtggcgtaattccttcgatagggttccataccctctctgcaagatagagctgctaattaacatggtcgacgatccaagaagctatcctttctaattcgtcactccgattccacaagcaattaaagtcggtttagagttctcaattacatctttttgctaaagtttggatttttagatatagtagaaaaaagtgccagtgcgttgcaacaggtaaatgctattttaattttattgttgttatacgatttaactagcgtaaaattaattcactatgggaatctgcttggatattctttttagaaaatcataagctacaattaggagtccgtagttaatctcaagttagcacgcgagtttttttaaagaaatttattgtacgactccttttgtattttccaaattaaatgagcttaaaatccaactcaaatatggatatatatttctaaaagtcaacaaatttaaaaaccaactcaaacacggatgacgtaccaaaataccggcaaaaacatcttcaatttttataacaatagagaagagatagataagagaaaagatatagattaaaaccgaaacataaaagtaaaaccgactcaaacacggatgatgaaccacggaaatatcttcaatttttataaccgattaaacacggatgacggaccacggaaatatttttaatttttataatagtagagattcgattcgatgactgtatatgtagcttattttaatcttttctttcatactatatatttatgtcaagttttcaaaatataaggattttaaatttatagcaatttcacaacctattcaattcaccttaaccattcaaccgcaaccagttttcatttaattttgtgtagctcaattttaatttctactaaaacggttaaaaatgcttatgttttaaa

SEQ ID NO: 65750 - DNA, 8769 bp, Oryza sativa
aatactagtaaagattatctgattttaatttgagacgggggaattatttaccccaaagcacacaaagtagctgcgagatgacactgaaacccacccaccaaccaacacgcttgtcccttttcggtcattattggaaattaatgtaggagtagctaagcttaagcttgcttgtactatatatctagctagatagcgtgtttgcacatgcatatgctccgtacatataccatgaatccaatcagtttctttctgttaagcgacgaccgccgccatgcatttgtctgctagctagctgtccggatcgatcttcgccggcgagcgatcgagctaggaacacgaaggccagctgctaattaccttttatgtagctgcgatctacttcactctccattctctccgtcttactttaatgatcataaaatatctctaagtgattatattatgatttaatgtaagttgtatagttatacttactacgctacatatacttttgataatatataacatattttgaggtattttaaaatcttatgaaaataaacaagagcgatcaaattttgagcttaaatataatatgttaacgtcaattgtttaattagtttttatatatagaaaggttccggtaattacctcgaaactttaatatctcagaacatgatcagcgtatatatatatatatatatatatagtcggaaagaacttcattattctttgcatatatatggaccactgaaacaacacatggccggcatccgagaagtctaattaagagctaatcaacaaaacacacacatgtttttcctaattaacaatcgttgaaacccgtaaatatggctactaatttgactttattacatagatgcaattatgcatgcatgacacttaatgacacacacacgctagtaagactgatttggtctgcacctacgtactcgatcctttctatttcagttccaattcagagatgaactagttggctagcacagatcaatatccttattaccaaatttcaacatatataatattgtgaatctgtgatatgtgtgtgtgtgtgtatatctccatgcatgtacacatatgtactccctctctgttcttttatgtacgacgttggttaattcatttttgaaataattaacgttatatattaaagaagggaatagagaggtgtaaacttttaatttgtggagatgggtgggaaatgaattaatccgttttaatttacttagatgatgaggctgtctccgtcgacgtcgttgatccacgaatacttctccatgtaggggttggccgtgttctccggcgggtaggcgtcgatgcagtcggcccacgcgcccttgtcggccatgtcgccggtcacctcccacacgcagctgttgcacttgaaccccgacccgaacgtcaccatcagcaccttgtcgccccgcctcagcctccccttcgcctccatgtacgacagcacgtaccacaggctgctcgccgacgtgttcccccaccggtgcagcgtcatcctcgccggctccacgtcgtcgtcgtcgaggcccaggctgcgcttcacggcctcgatcacggccgtgccgccggggtggaggcagaagtggtccacgcccgtcttgaagttgatcctgggcccgtcgccgccggtgtgcttggtggcggtggcggcggtggcgcggcggcggaggagcttcttggtgatgagcagctgggcggcgaagcgggcgagctcggtgatggggaggatgcgcggggcgaggcggcggaggttggcggcgaaggcgcggacggcggccttggggagcgccttgctgaggctgatcccgacggtgccgtcgtcgtcctcccgctgcagcgcgcaggcgtgggcgtcgtcgttggcggcgatgttggcgcgcacgaggcagccgagctccatcttggcgcgcccgcggagcaccgggtcgttggtgaccagcacggaggcgccgccgcagcggaacaggcagttagccagcatcatggacttgtcggtgccggtgtaccagttgggcgcgatggactccgtggacacgacgagcgccagcgcgcgcggccgcgtcgccagcgtgttccgcgccaggtccagcgagatcagccccgcgctgcaccccatcccggcgaggctgtaggcggcgacgtcctcgcgcatgccgtagcggtgcacgatcatggacgccagcgacgggtccggcgagaacatggaggcgttgacgacgagcacgtcgacgtcgcgcgggccgaaccccgtcctggcgaagagctcggcgatggagtcgccgaagaagtcctccatctcgccgagcgagtccccgtgcgtgggctcgccctcccggccgtcgagcacgttccgcggcgcgtacgtctcctcgccgatgccggagcggacgatgacgcggaggaggaacctgtactccggcaggctgagccgcttgctccgctcgatcaccgcgccggccgcctccgtgctcaccttgcggtcgtcggacggcttgtggcacacgtagtcgaggaggtagcaccgcgactgccgccgccgcgccgccgccgtccacgcgaggtacgccacggcgtgcgccaggaggagcacggtgaccaaggcaagcagctccattgctgatctctctctccttctacaagtagaaagctagtgatgatcagtggtggtgttttggttttagtggttttggtgcggagagagtgtgtgtgtgtttatataggccggtttggtttgcacgcaaattaaagcggtcagagttgagagaaggtggcggatagtattaattaattttggtcaaaaaactaaatttaccctaaatagaaatatggattactgtagatgtttcctttcgcaatttggaaaatgacacgtcatgtgtgcaacttgccgtgccctgtttgtacccttgtcgttgttttgggtaataaactcgtgcagcgctatttgctgtatcctgcagtcatactcccaaaattagcatctttccaaaattagcatataagttttttgacatggtctttagtatataactttcataagtaatcatttagtcaaaagttataaattactaatatttatttttccaaatacttgcaagtctatagaagaagtaatgattagtactccctccactaaggggaaacgattagtcccggttaacaactccctttctatcggttgtagcaaccgagatgaatgaatcgggactaaagatctcgacttaaagatgcatagcaagtgaaaaaaatatgaagatgcatagcaaatgaaaaaaaaagaatcggaacgaaagatctcgacctaaagatgcatagcaagtgaaaaaaatatgtgggatgtgggattttaactcaaaatctctcaccttagccctcatgcgtctaaccattgcatctaaccattccacctactacacacatctaactagaataaaaatgcttttcttttgaactaaccctgaagacatctttagcaccggttggtacaccaatcggtacttaaaaatacatttttagtatcaattagtaacaccaatccagactaaatatacatgtttctatggacttaaacttttagaaccgatactaaatcatctttagtatcagtttttaatctaaccgagatatttgtgatattggataccacgtcaaaagattcgctctagtagtgctccattcacaaataatcatcatatatggtatgtatagcgataccagtatatccccgcatgccacttaattaaattggcatggatcaacattgtgtccggcgcatgcatcaagggtagtgtgccggccaatgatattgcttgatgtatacatgcatcataattacaattagttgaatggtagatagaataatgcatgcaaatgatcatttagtactgcaagaaaaacaaaaggtcacgtaggagagagtaccaaatatggtgatcacttctgaataacacaaaaaaaattatatgatgattatttgtgatggagggagtataagatttggtaaaactttcaaaattttgatcacatatgcttattctaaaagaataaatgatattatagaattatcttaatataaaattgatggtcaaagttttaaaagagtgatcaaatcatatcctaatcaaatattaatgattgtgtttgcgtagaggtagatcaaaaactcgaaactagctcgtggctcagaccaacttgaactcatagtcataataagtcgagccctattagacttttagctcacattagtactccctccgtccttaaatataagggattttggttggaagtgacacattctaattcaacgaatatggacttctaatccaacgaatctggacagttctgtccagacttgttaaattaaaatgtgtcacttccaaccaaaatcccttatatctagggacggagagagtactacagatcaccacatctcttcatatatactccctctgtctcgattttggtttgatgtgatatatcctacaacacgaatctggatagaactagaatgtatcacgtcccaccaaaatttcttatatttggagactgagggagtattatgcttcttgagtgtaatgcttagtttttttagttacttaaactccttgtgtttagttttcattataattagttagtgtttattattatttatgatataatggtaaagttgaaattataaaagatggtataaatgtgttaacgagctagctcgtgagccaagctgagttaagcttttatctcagttaaggttaacggccgaagcctagctacctggttaaaatgataacagtcaaacgaaccgagccttgacaggttgagcgagctcggtatccccctaggaataaaaacgatcagaagaccgagagtattggaaaactgagaaaaccaaacaaattcaagcttactgtagataaaattacaaaatgtctctcttttagccatgcactgaagttatagatttatttgaggagtcgaggcctctaaactatatatggatgatatggacggtaattatcgtattatgaaagcggctgtttccccctaaaaaaacatcagcatatattaaaatcgttttcatttggtaaatcgggttgaaactcgctgttcacctgggaaatatattttcgcaggcctaccacttaagcggttcgcctataaaaataccctttatttttacaggtggacctcttatgtgatccacctacgaaaattggcgtggatataaatagatatgacatggcagcaagattttttctaagtctcagctctcctctccctcaaccctctcttcgtcagctccctcaacaacctgcggcgggaaccagcaacggcgacacgcagaggcggcggggtcagcgccggcgagggcggggtcagcggcgggaacggcgaggcagcggggtcggcggtggcaacggcaaggcgcggggtcagtggcagcagcggcgaggtggcggggtcggcagtggcaacggcgaggcgcggggtcggcggcgacaacgacgaggcccggggacggcgacgacaatgctcgaggacggcagcatccacacccagcgcggctcccctcccctccctcccagatccggccaaaggggaggagaggaaggagaggtggcggcggctgcccctggaggtggcggcaggcggtggcggcggcggcgccccccacccccgacggcggcggcacccctacgcagttcccctaaccctagatcggctagaggtgggtacgggtgtgggtggggtggcaccgatttttttttcgtcgagatgattttcacaggcgggggactgggccgcttttgaccgcctaaaaaaaggcatttttctagtagtgtttctcccttcttattcagcttatctttgtgcggacgatgaattaggatacagagtaggggtgaaggagaagattggagtaaaaccgggtgagatgttcctagatttggagagcgaggcaggccgtggtccgtaatatactagtttggctggcatgaaaaatactatgatactgtagtttatagaagctatatgtgttgtgattgttaattactgaagtgaccaacgattgcaaacttcaaactgcaatattgactattgagactaatcttatcctactgcatgtcaaaaggtggctgacatccttcgtctggaatgtctcaagacgacgattatatactcccttcattcaaaattatatgatgctgttaattaatttttcgcataacatttaaccatttattttattaaaaataaataaataaatattatttattttgttacgactggttttatcataaaagaaaatacaatctttatatgtatactaattttttctataatctttatttttaactaatttttttaataagacagatcgttaaatgttacgtgaaaagtaaacaacatcttttttttttgagaaaaaacaacatcatttatcttggaatggagcgagtatatatttcccattattcttttttactattttccatgttccgagctctttcgggccccttcactctacagtaaaatccataagcaccgattagggtgcatgaaaaagtggccgacatctcatttaaggtagaagtcaaaacaaatattagatgatcctccaacctagctaattaagtgatctggaatgtcaattagtactgtgcatgctatagtttggctgttaattactgatcggcagtgtagtgatgatcaaccaacagttgcccaactgcaatgaaacgaatgctatcctattgctacggtaattaagcatgttaaaagggtggatgcgtgtcatcattaatttaatttaacgcaaaaaagttgaaacgggtcttaatttaatttaatttaattttgccgctaaaaacccctagccaaccttggtctaaaatgtcaaacttcgattatttcctatcattatcttttggttgggcaaatgctcgatgatagaagttattgcaaagaaagatacatatatggggcacaacttgccatgtctcttttgacaccactatcataatattaattagtgatcactcggcgattgttcaactagttcctcactacttgtacctaccacttgaacctcgttgcctttatttggaagtcacttaattaattggagggacaccgtacgagaattgtagaaaatccaccactatagctactactaagcctatatcaagaacagcaaataatcaccccaaaaccctcgcaaaaaaaaaaaatcaccccaaaaatatatacccttgcacaaaaaaaaagtttcaaaaatgtatacggttcacctcttgtttgtaaaactattttaagctcgatcttaattaagaacatgtccgtcctcgatctacacataaattactagttaattaacagagtgcatatactgccaagacgacggcgcccgcgggacaaagtgatcgatttcgacgtgattttgactctaattttctgttcgtcggtgcttctcagcgtttgggtctatcaagcgggtggtggatataaagcatatgcatgcatatgttttgcatgccacttgagcggcgcaaataattcatggacaagtttgaagcgtatgttgaattgttagccgactttaaaaatctgtgagcgtgccttaatttgagatgcatagcagaattgcgaggattaactgccgtattaattaggacgtatatctacacatgattttgatggtttacaactgcaaagatatatgattataaaagaaaaaaaattggaataataatttaggtagatagcagaaagaacgaataaataatagacttgaagaaaagtttccaaaaggttaaagctttgagagtatgtagatcatatgtcgatacatttttaagtaaaaatgagtcgatgttttccactactataatagagaaggaatgtagtgatgattattactccatctgtcccaaaatatagcaacttttacatagatggtccagatatgtagtactagcatacatcccatctaacaaaaaattgatatattttgggacggagggagtattaatcaaccttggtggttcattaacgtgcacatcacttgttgtttcactactgaagaaaccatctttggtcggttgcccaaaatccacaatagtcccggttcattaaaaaaaggggactaaaaagtatttttagtctcggtttataagtgaaaagggactatgtgatctttagtcccagttgataacaccaatcgggactaaagaacaactcatatcagaggctgtcagatccccagagatctttagtcccggttggtggtattaccaaccaagactaaagatcctaactttagtcttggttgttgttcccaacgggactaaagtttatgtagatctttaatcccgattagtgttaccaaccgaggctaaaaatcaatataccgtatataatcccttacacttatcctcaaaaatttctatctcctattcctcctctctctcacactcttatcctctccttatattcctattcctcctcctctctctcacactcttatcctctccttatattcctattcctcctcctctctctctctctcacagtacgtcttatcctctcttgttgtttctctaggagcagcgccggcgaggagcaggcggggcatggcggcggcctgcgcgcggtagcggggccagtgcggcgcggtggcgtgggcccgcgtgtgcggaggtggatgccgggagggcaggcggcctgcgtgcatggaggacgagaccgggagggcgg

SEQ ID NO: 65751 - DNA, 782 bp, Oryza sativa
attatacttatatgtagacatacaagacagagggttcctcatgtgtgtaatattggctaacacaagtatttagccctaacgcttcaagagtcattgctgccatgatgcacatattcagggagtgaagatgaaatctccaaattctaaaggtatcagaattcaggtgaaaactacaagaacatagatggctctgaaaaatttaggtgaaatctttgtactactgtatctctgaattatgttcatgtatgtagctacatattcagagttacaagctgccaaagagctacatattcagaattatgtagcatccgatggttcactgtttcggatcaagacatgtgctaaaattagtgagctggtagcccaatctgggcggtgcagcgtgcttacttgcagactaattcgagtgaatcacaggctaaccaggcctatcggtcaacaagtatatgtcaggtaaaaaacatgtagtgctaagggaatactgttcattagctcaaacaacaccatggttaccttgttgatctatgattcaaggttacctcccttgtcattctcccaattctaagtacacccgaaacaaattttgattgcaatcggtgcaaaattcgttaaactacagaacaagcaagctggtcaatcagttaccctcgacttctaagcaactaatggctacaagttcccctccaaatccatcacacaagcaccaatatgcagacaaatcgagtaaatcacagggcaaggttgaaaaaagaaaaacacatataaccaagagatttcatttt

SEQ ID NO: 65752 - DNA, 4582 bp, Oryza sativa
taaagaatcctcatagttccgtccgattagtttcacttccttgtgcaagaaccataaccgccttagggtcctcatctctatcatgtttagaaggttggttgtggatgcttttatttatcataaatattgcaaatcttgtatgtgtctgtggcactaatcttgcagcgagatgtctccatggtcgagcttgtgaccataaacaaagcaatgccgggagatatcccggattatcttggtaacttttctttccaataaaagtaagaatcagtttttaggatattatgcaccttcgggtattcttagtcagtaaccatttcaggctgagattaagaatgagggacgtacgatgcctaagaacataggaactacatcaactgctcattttggtgatccttggtgttggtacacaccttataaagatcccagtctcacacacttgatttttgacgtctcataacgcaaaagtccaagtgtgggggaggaatgtcgacgagcttgcatgacaagttccatcaaccaaggccaccttgtttgcagttggcgttagtcttaccttgcagataaaaaaagaaaaaaaagaagaaaaaaagaaaaaaagagagacagaagataaaaaaaagaaatgaaagatgggacaagaggaagagagcaagagggctgacgggctacatctagttcaaagaccgcattatgtgcgagtttttaaaataggccatacacctcgctagtagcgatcatgctacctcgctacaccaagcccctctcttgagctcatgtgccaccttggcttagccttcatccactcctagttgtgcacaacctctcgctcctgcaacacctacacacatacaagcaagaggagatgccctcttctttcctaggtgtttgctgctacactctagttggcacttgcatctttgcctaagaagagatgcatcctacgtctctacaaaattttgccaacggaacacgccttcaaggcacaaggttcttgcacccgagatgtgggcataaccgaaccacttgcttgagttggtgtggtcaaagtaccttccttcgccacaacccacatcaagacggaggagagattgacaatcacatgtgaccatgccaccgctctagagatttcaacatatacatcatgctggcggtaagtgcactcaggtataggacatgaagcaaaagattcaccatttcttttactcatacttatctctagttgagtctagcttgatcatatatggttatgcgtcctcagtccatttttcgtatgctatggtttgggtggtcgtcaacattcataggctttttaaattaagcatgatgcttatgataaatagtctgctttaatcaaagttgatgtggtgtcaagtttgtttaaatgaaccgtagagccagtactttcatggacttcggatgtatatccttcgtagactaacccctgcaggaaccttttcaatttgacgggtgagttctcaagcatgagtcacactggaggtaagtcaagggccaggaacaaatcaattgccataacaggcaaaggagagacatatcacctctcaagttgcacggtacgtatattgccaaatactcctttgctatgcttgtaactttatctcagccatgtatgagttctgcttaaatagaagtttggtgaaccaaaaaaaatgtttttaagaataaaagaaatgtctctcggagaaaaaaaaaagacaaaataaaattatggcaaaattatgggatccatgctcattaagttttcaatccaattcctttatagcatggatgtgaacaacaaattttgaggctatgataaaatcttttcaattttttgtagtccctcgagtatttgttgtccactaaccttttgcatgaaaataaaaagacaactaaggagcagtgtagaataacctcaacattcataccacgctccttggactatgagaagacagatgcacagggaaccaagcagagcaaatgcaatactttgttatagttgattcggttcaaagtttggtaagttcgatctggtaataatctcaaacaccctgtgtatcattgcgtcatatagtcgtcctgctaggatacccaccatgctcattgttgccataaaaaaataaaaaataaataaataaataaaagtgaaataaaataaagtaaatttaggcacttcatccgcctagagttacttaaataaaatttggctcaccggtattttaccccagtagaagtccattttactttccatgtttttgttgaataaagacaaggtacaaaacaagtgtgggggaatcatttccgaacatccgacgcgcaacagcatcaactcaacatgacaacatgatgaacaccaacccacggctgcgcacaaaattcagcagccagaacagagtcctggctgggtcggttgaaccaagtgttcgcccaacccttgcttggtccgattctgtcatccttcgccgtgtggtcaggtttgcgcgtctcctcccttatcctccactatttgtgagttaaacttggcagaaaaattgaatacaaatttagtttgactccaaatgaaaattgaaaacattaactctcaacaaatagaattttcctatgattgatcatgtatactttttattctttgctaacacttgtcacttgtgaacaaacatctatcatagggaaccttgctcatctaagtaattgatgtatgtgatatggttatgacgaaagaaattcctgtccaactgtcatgatacttgggattttgttttgtgaaattaaaactttttcgagcaatactcctcagtgactatataattacctaccaaggccatgtataattatcattgcagaaacctttatatatatgtatatatacatatatgtatatatatatatatatgaatatatgtatatatatatatatacatatatatatatatacatatattcatatatatatatacatatatatatatatatatatatatatatatatatatatatatatatatatatacatacatacatactagcaatagtgcccgtgcgttgcaacgggaaaaacactgtttgatagtgacaccttgaaaaccttaaatcggtaaaaatcaagtctaatttgatatattaacaaataggtagaaccgagtctaatttgatgaattagcgtagaatttatgatttagttttagatttatttttcgagcctacttaggagcttatccgacggattttgattttaaaaatctaagtcacattgtttgatcaaatttgctttcgacccaggtcttcctagtcggcccaaacttgggctggcccatcttcggcgagctaattcaatttgacatcccgcaagccgagcagctgagcgcggcccacatatgcggggacggtccgatgcacttcgacggcccatttggcacagtgtaatcagcggcggcggcggcggttttttaagtagtatttttttcgattcggatctatagtttttttcaccacttaggggaaaaagacttttgttgttgttgtttttctttattttattttttgtgtggcttttctttttctttttatgcactttctgccttcattctcccttttattatttttttaacaaaaacgacctcaagtaccttattgcaagattatagggactcaaatgtaaatataaaaattacatggactcaaatgcaaaagtacaaaccaaaaaattaaaatcatataaaatggaatgctctcgaccgtaggttccgtttttgcaaatatatcttcaattcgacacatcaatttttcaccaatgtagagtcagactttttttttcttttttgaaagggaagtcggacttttttttcttttctaaaagggaatcggatataggtgtcggacttttttattttattttttcgctattatttttttttgacggacgaaggaagcatctctcattttgacttttattgttgttgtttttctttattttattttttgtgcggcttttcttttttctttttatgcacctttctgcatttgttctctctcttttattatttttttaacaaaaacgacctcaagtaccttattacaagattttagggacacaaatgtaaatataaaaattgcagggactcaaatgcaaaagtacaaactcaaaatttaaaattatataaaaatggaatgctctctgtaggtttcgtttttgcaaacagatcttcaattcggcaatcaatttttttcaccaatatagagtcggactttttttcttttctaaaagggaagtcggacttttttttcttttctgaatcggatataggtgtcggactcttttattttatttttttcgttattatttttgttttgacggacgaaggaagcatctcttattttttaagtagtatatatatatatatatatatatatatatatatatatatatatatatatatatatagaactactatagagcaccctaaggtgctacgtattaaacagcacctgatacagcttctaaccccacccctgcaccctcccaccctgctccccaccaggtccatagtacgtagttaaaatttaactcaccaacgaccaatctcga

SEQ ID NO: 65753 - DNA, 165972 bp, Oryza sativa
  unsure (1)..(165972): unsure at all n locations
aactttaatcctaatgcaatacttcaggcactggcaacccgctgctcctagatgtcgctctactatgtacccggactgggaggacttaagtgatctcgagggctgtcaccacctctacacctacctcaacgtactgtggaatatgcagcaattactggataataattacctaaataccacatctaagtaattaatatctactttagtgtttataactcaccaaagcaatcactatattttagttgattataatgaacaataatctcgtatgctatttaggaactaaccaagagataattctcacaagataaatctaaattactcaggaagaatattacattgaattcagagtaataaacagaataaaaaaataggagaagattactgacaactccaggattcttccgacttcttctactctactctcttcctattctaatatacaatatagtacaatagagcctcttataatttagctcaagcttggaagtgtgggagtgaagggagggagtgatgtccttttatagggcagttatgacggttgtgagaaggagaaatgtccgaactgcctcgcaaccgtcactgggagagcatctggagcgtccacaccaaaccccaggatcaacggtgatcaggggcgtttggccgaacctgggctgggccctcctggcctggccttcagttggtggactccctggactctcctctatccatttctcatagttttgggctgatttactgatgttttgatgaaattcacatcccctccttgtatggatacataattctcctcactttagtctaatttcctcccatcttcaaggtttatcatctgcatacaaatagacaccatcacttgtggaatatatgagattaagcacctatctctatgttgaatattttattatctggactttatgcagatgttggtggtatagaatcggcatttaacagccgccaacaatgtggcaatgagaacatagtggtatccatgaatgcacttcaagaatgagccagataagcaaaggacattcctgagttcgtgatgcatatagcaggatgaaggtacttctttgtatctgttaacaacagaattttgcatgagatttggagaagaaggaagaagatcgaagcggatttggtataaggtcgagttgatttccatgtcggactgcgcattggctgagtaccgtatcggctaaaaactggacaaaggcttgacttgccgatatggcaagtcgccaatatggcataacttgggctcggcatgggcctagacaggataaccgcattgccaatcagagatagagctcatgtaaggcaattatatctattaattaggttagttatgtcggtttgttagatattttgtaagagaccgccgtatatggtcttgtttgtatcttatctttagaaaggtttgagtcgtgtctataatggactaagtttgtactcggggtataaatatgaaacccttaacattgtaatatgggagacaatccaataaaacttcctcgcatcgccacccttttcgcttttacttttcaacgagttcacttcacaacaagtaacccgtctcgatggcttgtgctatcggggctattatgtcattttatccttgtatcatgaccattgttatcttatgtctttgttaatctagtcttagcatatcgatttagctctatcgactgcttctcgttttaaagtttctgccggtatcggctaaatcgtcttgctagattagattagcttagacatccaccaccctaaaaattcagtcaatgggttgactgtttagatatcgtgtttcttttcatacttagtgctgcatcagtacattcgacttactaaatcatgtttagaacaataatctctagcctgcttcttgattgttaataggggtagcatcggggtttcagccgatcttacctaatatacatgcttctttacctgtttcatgtatatttgccatctctatagacagatcatctaatattaatatattaagtctaggtcatattggctaggctatcattattgactattgacctctatttggtatattactatagattgatttgcttatatatttttgctctaaatattgttccatcgactactttcataatattgtcttaaacttctttattaaatctgatagacagtattacagctgatgaggcatgtttaggtttaatattcactgatatatccagtccatagccgatttggtctagctaactgcattggctgagaccaccaatgataagctatcggtcgatcggctatcgactgactaactctgcttttgtctttcttgctgattgtaggattaaatctactggcacacccttggtacactcgagcctaggcttagacctacactagagttaagcagatctcctagtgtggagattatggataccccatacctacacggcatgtatagtccgactgggtatggggtaccatgtttagatagaatatctttaagaggactcgggttaggttctaaacttgcatatcaaggaaatatctgagatcctagtcggttacgattgtattttatctgtaactacatattccgttaaggatatggactgtattttgtaataaggaccccttcccctatataaggaggggtccgggtgcctctaggggcacgattttctcccagatcatacgatcaataatacactcggcggattaatcctcggacaggagtagggtattacttcttgattaagaaggcctgaacctgtataaaattccttgtctctaaacccatccacttttccaacttgatagccaccccttttagtattgctgaaatcttgtttcgacagttggcgcgctaggtaggagtagcgtcaagttcttcgccgattggtgcgatgggttccgtcttcggcatcgacgacttcgtcttccctcccgggcaagtgttccggttcggcaacctagacttcatcaccaacgacttcggcaagatttctctcctcgactcagattcgaaccagtcgggaagaggccagatctccgccccgttcggtatcccgaactcggccgaggtctaccccaaggtcatctccgccgagttggtttcaaaccactcggacaagatccaatctactccaacacgaccagatcaagacgatggggcctatccgccaatcttgatgaaactccccgacgatttggctgctgtcttcactacaagggcgtcttctccccgtaggcctaggcgggatccggcttcagccccggtccggcctagctccagcgaagtcggcatcatactccagccactcggcacagtttcgacggaccaactggacggctaccttagctcccccggcgtcgagtcacgaccaaccgagaacgtagagtacgatgacttcggctatcgctacgacaaccgcaacctcgacgacttcgacgagggctttgaagataactacacccctctctacctcggtgttttcatggctgacaacgagacggaagaacagcgccaagcccgagaagcagaagggcgacatgtacaacaggaagccgaacgacgccgattagaagaggagcgctaggcacaatagcgagaacggctgcagcgtgagcaacaggaacgcgaacgggctgcaaaggaggctgaggaccgacgacaatgaggcttggatgccaggcgacgagcgcgagaacttatcgggcagcaagacgtcgagggaacagcagtctttcgcacccctcaacaaaacgcggttgcagcgatcactctcctcgacaccctcctcaaggaagacgcactcaaccatgctgatcacgtcatcaacatcttgaaccagactaagaccatgatcgccgcctcggtcctggttaactccgcaagcgtccgcacgccgactggcagccgagttccccatcttcgatctcaagattatcaccagccaagcctcagtatcgccggcgcgggatccaattgcaggagcaggggccacgaggagcgatctgtccactcgcctcccgaacgacacagggagcgccgagttgaacggccacgctccccacctcgcaggcgccccgtcgatcttcgtgatactatcaaccagcgccgcgcggcacgaggctacgccccccaccattcaccgaatcgctatgacgacgacgtggatggagtcgctgccttttcaagtgacctgcgtcgagtggattggccagctggcttcaagccgactagaatcaagaagtatgacggcaccaccaatccggagtcttggctcaccgtctacggtctcgcgattcgtgcagcaggacgagatagcaaagccatggcaaactacttgcctgtggctctagcggattctgcccgatcctggcttcatgggttaccccatggcacaatcggatcatgggcggaactttgcgaccacttcatcgccaacttccatggcacctttgaatgccctggcacacagtttgatctctacaacgtcattcagaagtctggagaatcccttcgagattatatccgacgcttttctgagcaatgcaacaagatctccgacattaccgatgatgtcatcattgctgctttcaccaagggaattcgtcacgaagatttagtcggcaagttcgggcgcaaaccgcccaggacggtcaagcagatgttcgaaaaagccaacgagtatgccaaagacgaagatgccattatcgcgtccaagcagtcgagcaccacttggaagccgaagaaagatacgccgactacgggagggagtggaagtaccaatcgcaaggaccgtaagcgtaagcccgaggaacttgttgcaactactacacattcctcccgacaacgttcgcgcgtcaacacttttgacaagatcatgaactcccaatgtccgcatcatcccaattccaatcacgcgaccaaagattgcttcgtctacaaacagattgcagaacaatacgccaagaacgcacgaaaggcctccgatggagatcaaagtgcatcgaaaaagaaggacgatgatgacgatgccccgacaggttttcaagaccatcgcaaggagctcaatcacatctttggcggacccttggcttatgaatctaagagaaaacaaaagctgaccgaacgggagatcaacgctgttcagcccgatacgccccaatatcttcggtggtcggagacaacaatcaagtttgaccgctcagatcatccagaccgagtggtccacccggggcggtaccccttggtactagacccagtggttcgtaatgtcaagcttcgcagatccctcatcgatggtggcagtgcactcaacatcctcttcgccaaaaccctagacgacatgcaaatccctcgcacagaattaaaaccgagtaatgcgccctttcacggagtcattccagggctatccgctatgccgctcggccagatcactcttccggttactttcggtactcgggagaacttccgcacagaaaacgtctgcttcgaagttgctgatttcgagaaaccgtatcatgccatacttggacgcccggcgttagccaagtttatggctgtcccgcactatacctatatgatgatgaagatgcctagtccgcgaggagtcatatccctgcggagcgacatcaaacaagctatcacatgcgacaaggaaagctgcgagatggcccaaacccgcgagatcacgatcgcccgagaagatatccgactggctgcaactacggcaagcgaaggagaagtgcctgcaaccaagatgccaaagagtggagaaagcgacgccaagaccaagaaaattcctctagatccctctgattctactaagaaagctgtaataggcgctgagttagattgtaaataggaaagcgtgctcatcacctttcttcaaaataataaagatatctttgcatggaaaccatctaatatgcctggtattcctagaaaggtgattgagcactctttacatgttaaggaagatgctaaaccaatcaagcaacgactccgccgcttcgcacaagataggaaggatgcgatcaaggaggaactgactaagctgttagcagcaggcttcatcaaggaagtccttcatcccgactggctggccaacccaatcctggttcggaagaaaatgggacaatggcgcatgtgtgttgactacaccgacctcaacaagttctgtcccaaagatccttttgggttgcctcgcatttaccaggtagttgactcaaccgccggctgcgagctactcagctttttggattgctactcaggttatcatcaaatccgactgcttaaagacttcattcatcacgcccttcggggcctattgctacatcaccatgcctttccgattaaagaatgcaggagcaacctatcaacgcatgatccagagatgtttttcaactcagatcggtcgcaacgttgaagcttatgtggatgatgtagtcgtcaagaccaagcagaagtatgatttgatcacggatctagaagaaacctttgcaagtatctgcgctttcaggattaaattaaaccctgacaagtgcatcttcggagtaccgtcagggaagctgcttggatttatggtctctcatagaggcatacaagccaacccggagaaaatcaatgccatcctcaacatgaaaccgccaagttcccagaaagatgttcaaaagctaactggttgcatggcggtgctcagccggtttgtttcacgactcggcaagcggggatgccctttttcaagctgttgaagaaaacagacaatttccagtggggacccgaagcccaaaaagcctttgaagacttcaagaaactcctcactactccaccagtcttagcttcaccgcatccgcaagagccgctgttgttatatgtatcgtcaacttcccaggtcgtaagcacagtcctggttgttgagcgtgaagaagaaggccatgttcaaaacgtccaacgaccaatctacttcgttagcgaggttttggctgactccaagacaagatatcctcaggttcaaaagctattatatagcgttttaattaccctcaggaaactatctcactatttccaaggtcactcggttacgttggtcacatcgttcccattcggcgatatacttcataatcgcgaagcaaatgggcggatcacaaaatgggccatagaattgatatccttggatatatcgttcaagccgcgaacttcgatcaagtcccaagctttagctgactttgtcgccgagtggaccgagtgccaagaagatatgcccgaggagaagatggagtattggaccatgcactttgatgggtcgaagaggctttctggcgctggggccggggttgttttaattttcccgactagagaaagactgagctacgtattgtggatacatttttctgcatctcacaacgtagcagaatacgaggcgcttcttcacggactaaggattgcaatctctttgggaattcagcgtctgatagttcgtggagattctcagttggtcgttaatcaagttatgaaagagtggtcctgccttgatgataacatgaccgctaatcggcaagaggtgcgcaagttgaaagacaaattcgatgggctcgaactcacccatgttcttcggcacaataacgaagcagctgacagactggctaattttggttcaaaacgagaagcagctccttctgacgtgtttgttgaacatctttacgaaccaaccgtaccaaggaaagaaacaatcgaagccacggacgctcaaaacgtaggtatgattgaagccgactagagagagcccctcataagatttttgaccaaacaagaactcccccaagataaagatgaagccgagcggatctccaggcgcagcaggctctatatcattcatgaaactgagctgtacaagaaaagtccatcaggaatcctgcaacgctgtgtatctttagaggaggggagacaattgttaaaggatatacattcaggcatctatggcaatcacgctgccgcacgaaccattgttggcaaggcttatcggcaaggttttttctggcccacagctgtgtccgatgccgacaagattgtacggacatgcgagggttgtcaatttttcgccagacaaactcatctacctgctcaagagttgcagaccatccagttgtcttggccgtttgcggtttgggggcttgacatggttggcccgtttaaaaaggcagtcggcggttatactcacctctttgtggctgttgacaaattctccatgtggattgaagctaaaccggtcatcacaatcacggcagacaaggctagagatttcttcatcaacattgttcatcggttcggggtacccaatcggatcattaccgataacggcactcaatttactggcggagtatttaaagacttttgtgaagacttcggcatcaagatttgttacgcctccgtagcacaccccatgagtaatggacaagttgaacgcaccaatggcatggtacttcaagggataaaagcgcgagtcttcgaccgactgcatccctatgccgacaagtgggtggaacagctgccatctgtactttggtccctgcgcaccactcccagtcgagccacgggccagtcaccgtttttcttagtctatggagcggaagcaatgttgcctagtgaggtggaatttgaatctttacgtttccgcaacttcagcgaggagcgctatggagaagaccgagtagatgatcttaaccgattggaaaaagcccgcgaagcagccctaattcagtcggcacggtacttgcaagggttgcgttgttatcataatcgcaacgttcgatcacgagcttttttagtcggtgacctggttctgagaaaaattcaaactacacgagataagcacaagttatcccccttataggaagtaccattcataatctccgaagtcactcggccaggttcctaccgacttaaacatgaagacggtactcctatcgacaattcttggaatattgaacatcttggtcgtttttatgcttagccattacctttgtatttccctattttgactgctaacatcaagttttcccttgagttatcagtcgggggctactataataataatggagtgtgatttttatcaattcaatttgcttacttgatttatcattgccttgcttgatttttttggcttagtcaatgagaattgaaagttttttaataacttttgtgggttttaggctcaataaggtttgacaaaagcttttaagaaattaggagctaagttcgaaatatcaagcacagcataaattcatcagtatagtacaaattgtgccgccatcatcttcatcatcagaatcattgttataatataacatcactcggtgtcagttttttcctcatcggaattatcagatccagtcggccgaaggtcgttgtcctggaatctctcaactacatcaactgctatcttatcggcggttttctgcgcatcgttgatgaggtcaagggcggcttcttcgctcgtcccgtctgcaaagccattaatggcgtcaatgtcgatcttcgggtataaagacttggtcattgccaacgccaggcttgcccccatactcccagcctctttgatattcgtaaagtatgtatccggagcaactctcagcttgtcgaagatttcggaagcatcaaatgtactcggaccattgttattaaagaacatggtttggacgagtagggtagcagtgttggcgacttcatccctagacccttcaagcctcttgattttgttgaccaagacatcgaattgagcttgagacttgattttgcgatctgcataaatagatttatatcaacaaatgggcacaagggaaggcatagtttctagggtattagtcaccagtaccttcgacgtctttcagagccgagtccctttgtctcgccaattcggccttgtcattctccagagcttggatccgtttttctaattcagatatcttagccacttgcactgcattgcttcttgttagttgatattgcaagaatggcagcataagtaagttggatagagattgtattcaccttttgacgaaccgctcatctcaaagttggagtcttgaagctcagcgattcggtcccgtagatcatgctcagtttttctggcaagctccttggcttcgtgcagctgattcctagtggcttcaagggttttgagatggggaaccaacctctcaagagttgcagtcttcgcttcgttcttgagatggattctctgcaatacgaatttgtttgtatttgagcaaagtagtaagcaggatagttgaagccgtgcataaggagacttacatttacgatgcgagtggcttggccgagtgccttttttagcaggcatacttcttcgtcttccttttgcttgtttattataattccctgaggttgcatgtcatcgtcccaccacttgactaaaatgggcgggcgagaatcctcagctgattgtatctggaggatctcctcttcgtcgctgattattgggccttgagcatccatgaataaaggtgaaacaattgaagaaggtctgtcagattaaaacggattttggagaatgtgttaacctgtaataatttctggtcaaggacgagcaggctcttgtactttgacaggagagctgggccctggatctgcactggcatcctttctgggagggctgttcgtttgagtttctacttcaggaatatctttacttggctctgtacccgactggtttccagtcgggggctcttgattagcatcggctccagcttgggccgactggttcccagtcgggggttcgttgctagcttctacattgtcggttgccggttgtttgtcacttgaacaatcctctgcagttggcccggtttcttttgaaggacctgtctccacgttagtcggctccgagtcttttccggaaggatctatatcagatggcttcctacaaatttgagttatgccatcattattatttcaatagtgagtgagcagcactacgaggaagatggtcaaatgattcgtacctggaagatttcctaatctttggcattggacgactggatgttttcttctaaggattggtttgccttggctgttttctagtcacctctttattgccagattttccagcatcatcgccttcatcattactcagaaccaatttcctcttgcgcgagtccaactggatggctgattttgagatgtttgattgagtatcagaccgaatttttggtccaccacttgcctgaccagtctgccggcaaggtgatcggcgttgggcaattggagggtctgatttcatcaaggcgaattcctgggcatgatgattcaagttttctatcaactttgcaggtgataaaagcatgcttagatataggctgggattttaaatacataccggttgagggggattgaaggcattgtatggcaccactggcagcaagtgcgaatagctgactacaattgcatttgagaagattttatacattctctccttcataaccttgaattcaagggattcaggatcttcacggttagggtcatgtttgccgtcgaattcaaaggctgtgcgagatctttctttgattggggccaaccggctcttgatgaaatgtcgggtgatttgttctccttgcagaccttgctcctttagcttcagcatacgatccatcagggcgagctcttgggcggcttcctctcccattggtagtgaattccaagtgtcctgataaactggaggaagacaggagtactcggggagtgccggctcgaggttttgtacataaaaccaatttgcatgccagcctttgtttgaagttttacagggcatggagaaatacttttggctcagagttcctctcagttggaatctagctcccccaactacgcatggcttgcttttgttcggctggggtttgaggaagaagatacgatggaatagggcgaaatttggcctgatgcctaaaaaagcttcacaggcgtgtatgaagttggcaatatgaactatggagtttgggtttaggttatgtaaactaatcccgtagaaatccaaaattccctggaataatcttgaggttggaagagaaaatccgccatagaagaaatgagaaaataccacgacttcatgggtatcaggggttggaaatgcttcgccgcacgccgcacgccgcccaatgatctccttcgccggaagaacgccgtgcgccaccatctccttcaggttttcctctgttacatcagagggcgcccattgactctcgaagctttctctctcttccgccatgacagtgaattagatggtgtgatttggttcgagatatggctaggaatggatgggaacttgatgtggtggctgcgcggaaggtttttgtggagctcaggaggatggatcgaagaggatttgttaaccctagtttccgccggtgtggttttgcactgtagcaagagaatgggggaaaatggcgagagtttcagcagggaagacgaaacgacactgtgcctgcggcgtttatttcgctagggtttcaggagtgctaatgggcctgggcctgtacagtacttcagcccaattctattaccagcgtggctagttgtgatccttagggacttaggcatttttgctcacaacaatatggcccaatgctgtcaaaatcctttttgaagcagttagatgattctttggaattactacgatgcaaataaaaaggtgcccaacagaaaagtgttatactaattttgtaagtctttttaggctgcaaaagttgtttgggtttgttgagataactggtttttgaacagttatgtgctcggcatattatatgcttattcttctggtgtgagtcatagcctaggctattttgacttatcacttgttatgttatcacatttatatcacatttgatggatctttttgagagttcttactcagattcttatcaaatgtgtgaatttatggacctttagagtgtttttcacgcaggcctttccatattttcatttttggtatattaaagctaaaagcagtcggctggatgttttattgaacgccgcatatgctttgctatatgatgcttggttgtaaaaccactcggttcttgactatatgtttagttttatttaactaaccacatagtcgggggcttagacctgtactggagttaagcagatctcctaggctgtcgtgtttttacatctacagtatctgaactggagaattgacatcttttttttttactctgaatatatgtgcttcaagtggagcttaatagttcgttgctttcaaaatgaacaaaccaattcttcatgaggtattctgttcaccacaattgcatttgattctagagggactccatgagggtacaaaaatccccttctactggacttccttgattcccatctatttgtagttacacaagaagctggcaagtttgcatggattggtataagttgcaggttggcatttaagaattttattcactacgcagtacgcacacgattctatatatcaggatctttatttgggtggagcctttcttttttttgtgcttttgctaatagcaggacctgcacagttcttaaccattaagctcagcaactagatttcccatgcgaagatgtacaggatttttagattttccacaatttcttttcctcgtgtttctattgttttttcacagccatcctcaaagagtgatcttctattcaagcgacggttattatttttgaactataaaggatattcatcatttcttgtcacaactgatcgaaacatgaggaaaaacaaaaatttcagaccaatagaggttgatttcaggtagattaccaatctactaactttataaggatggattttatctctgctcagggttaggcattgcaatggtttatcttcttcctcatctgccttttttttttgcataggcacgcggcatcaaccactgctctgccgcacctatgaggtccagggtcacatccagttattgtctttaaatacaatcttcattgagggcatgcttggttgcctggatggcacctagcctgcatccggcgtgcaactagcggatacgcctaatgggcgatcgatcacctcacgacaggggcagcgatcgattcccccctcccccctcttctccacctggttttcttttttggcaccgtattactttcctattttagtaaatttatgcacctaaagtttatacacctcaagtttacacatctaaagtttagaccaaaagtttataagtcaaaagtttatatatccgattcaaatttgaatttgaattcaaatatttttcatatatagtatttctatacatctaaagtttatacacctaaagtttatagacctaaagtttatatatccgattcaaatttgaatttgaattatgtctgattcaaatttgaatttgaattcaaatatccgattcaaatttgaacttgaattcaaatatttttcatatatagtatttctatacatctaaagtttatacacctaaagtttatagacctaaagtttataaacctaaagtttatatacccgattcaaatttgaatttgaattcaaattttttatatatagtatttctatacataattttttttaacttttttgttttttaacaaaaattgtggagatgtgtaaacttgaggtgtacaaactttaggtgcataaatttactaaaataggaaagtaatacggtgcctaaaaaggaaaccaagtggagggagagaatcagaatctgatcgcctcctagcaacccctagcgatcgatcgctaagtagcattctcggcaactagcagcctgtttggttgcctggatggggctcagccaggcccatgtgatgcaaaacacaatgtaatttataacctctactatggattaaccttaccatccataaacagttttctttttggaaaaaaaatcttgctccacaaactttcgggggtaacctcaccatccacaataataggtatacacataagatgtatccatccaaccaaacaacatctcttgtatgcaaccatcccatccgcccgttgctacaaccaaccaaacaacatctcatggtatccaactttatgtcatgcgagcaatcaaacacatgcatgtgtatcccctaagccaggctacactcagtctggataagagagatcgaccatactagggggatacgagcaaccaaacacaccctgagtttcttcacccaactaataacctttgcacatgacagatgtgtgttgacagtcgttatcaattagtctcgcgtgtcaatattactaaaataaagagagaactagttatgcttgcaatgcatatttatgttagaataaactattttccactagcatttggattctaaccttttgcagagaagaagtacaaaatggaggagaatcaatagcaaagtagatgatcaatcaatcaggcgctgatgagattcagacttatggaaatatgggccaagaactcttaaatgacaagatccaacaagcccaaaattcaaaagtctgtggagagaagaagtcaaagaggccgccagccgaaaatgggttgtattgggccagcccatggttcgaccgaaccccacctgcgccgttggatgcagggtttggcgtggacgtccaggattgcatcctaatgacggttggagggtatttctgaccattctaaccgtcacaactgtcattggggagctataaaaggccttcacctcctcacttcttccacacactcaagcaaggagcttctcatactctctcaagtttagatgagtcctctagagctagtggaatagaaatagaatagtttctttagtccttagagtcttcggaagaattcaggtacggctctagtagctcttccttcttttgtgagacttgtactatttatagaatactcttctcaatatatttatggtactttacttcactctgattactttccgatatattattcgggatataattgtctagctagcttacctgggagatgcattggtgtgggtataatattcatttatatgattgctctaagtcatgacgatgattgtacagtagtatttggtagcataagtgaggtgcttaggctattgaatatcattatttggggttataggctacgagttagtagaggtgggccgctgatggtgacagctcagtatgagtattcctccacgacagtatataatcctaagttactttcttgggggggtactcctccgtatttagccctggttggatggccatgatgggttgtcgtaaggaactcggaaattaggggtggtcactcgaaaccccaggagggcattgtaaagggggtattgattatataattatatagtagataatattatctgaagtggtatgtatgtatattagaagtataggaaatgattattttcttattcttttccacttagcctagaatttgtatgtatgagaatattgagtgcttttgctttgtggcactctacccttgaagtaaattatcccctgcttatattttgatattagcatggttctctctattataatcttcccacgagattaaactaatatgataaccttgaaatactctcgagtgaaatactacaatggtatacccgtgcgcttgcggatatgatctataaccataatataccatgaatatttctgcgccattactgggaattatatttttagtaatgtagttaagaaataccaacaatgtggtcacctactggtgttgagcataagtcacattagaagaacgaaaaaacatgatttttttggttaggaattgccgtgataccataagtaaacattttgaaaagtgattggacaaagttttgacattgaatcttaatttaggtgaaggtgcatatctgtaatttgttatgacacacactctgaaaggtactaccgtactacgacgctcctccttttaggtgctaaccccaccatccgccatcctctattgaacaaaaatgtggagtatttttttaaatttaacaaaaaaaatgtggagtaaatttaacaaagctaatgatatcgtggcttaaatttgttcacgagtttcggttttgaaacattaaccgtgccaaccacaagccagcgtaggcaacggctttaccttttgtataacatagttcattgcggggcaccatactgagaagtggcggagataaacccacgggggtcgctggggagtccatgccttgaattataaggaggtgattatgatccaggaacggtgcgctgtgatggattgtgttatgcgaggggtactgtcacagctcctttccgaggtaccatggtggtattgaggcgcgtggtgacatgttgtggggctatgtcttgtggttacagtggtatatctctgtccagagtaaaactattcgaatagtgtaacatactaaaaattagctattttctaattatgcatcataccggttcttatgtttttattaacctcctaaacctaggatattataattaaagagacctcctaaatttaacctgcataaaatctctttctggtatttaatttcttttgtgtctttcctttaaaaatatatttagttaaattaaggtgtttcttgattttgggttttaatttaaaaaccttcctttgacaaaattccttttattcaaatttagtttgaaaatcttttatgaatcatggtccaagaaatcctccaacactatccttgaacctaaaccgaagcaattccaaatttgttggaattaattgtcaacctatcctttgattccaaacctatccttagttccctttccaaatttcaagtatccaaattccttttttcaatctagccaccaatttaatttccgtggcttgatttcctcctcggcacaaaaataatattattacaaatattgtgaataattgctcttgtgctaagagaatagactttatccctccgccccaaattcaaaacctcgtttagcccatatctaattctctaaatttcataccacatattttgggctagaattctatttactctactccctccatattccctccacatactcaaaaatattcaaatctagagccatattatttatggtattgaatattttgaatttctatttgagtgcattaaataaactccatctctaaagtattgcactcaaaccaactatagaaatatctcttttggaaattatattcaaatataatttcctttcaaactttcctagtcaatctcctccaaattctattcaaaatttagaaaatcatctattgggccaaagtctcctcttttcttccttttggcccaattgaccagggtcggcccagccaagcccagccggccagctgagccaacgcctctcctcccgtgggcgcacagggcgcccaggccaccgctgccgtcacggcttttgccgccgccactcgaagttttgcgccgccgtcgtcttgtcttcgacgctaagcaaccgccgcccgacgtcagcgccacctcacgcctctgatgtcagccgccgagccgaagcgccttccccggccaatcaactgacagaacgggcgacgtgttcgtcttctccatgccgccgccaatttttttccgtcgctgctaagaaacgaaagccggcgccgcctccttctcctccactccaccggcgccgtgaccctcttgccctcctcctccaaaccgacctctccctcctataaatagcccgccaatccctccccttctctgcatacaaaccaagctccatctctctctctctcctgccatgtccggccgtcgccgtcgtcggtcgatctctttctctatagctcccctatcaatttcctcgcacctccggctttgcctacctccgacaactccattttgcccctttcccccttctcttcccctttgaatcaagtcaccaccgtctccacccatgccggccggaggtgagcccttaccgtcgccgttccggccttatctctcactccttctaccagccaacggcctccccaggtgcgtggtgctagggaacaccacccgccgccggcgtcgccgccatccagccaccggagcaccggcgccccacctccctccctcttctctgttgccggcaagaaagagaagaagaaaggaacgggaggaagaaggagagaaggaaaaagaagaagaaaaagaaaagcctgacaggtgggtcccctgcacagtgacttttctcattttctagatttaattcaaaacccaatctttagaagcccatatttcctaaaccgtagatccgattccagtaaaacttggacctaaatttatataaattcaaaccctatcttttgacaccaaattttgtattttataattttatttgaatttattcaaatatcgtttgaatttatatttgccttttcaaatattttcttttgtcccaaattacccctttagccactaaaaagccgccggttggaactttatgccttccatggggacgtttgcgcggtctacggacctcaacgtcgaaccgttggttataaagcccggcaaagcctaaacccaaggtcgaagtgctgcttctggcaccccacgccttgatgcgtatagcggtcggagcttcactattccctcgacctccacagcacgccgcacagttagctctcgagctctgtgtgatcctagtcgctccgccgccactcacggttgtcggagtaacacttccgcccaactaaacccacacaaacctcctatccctctaaccgttatgctgtctgttgacaccggctagagaagataccaaacctagtcgttatgatctagcatcgactaacacacaaccaaaccctagccctcctaaccatttatcgttttcttgttattttatggcttttattgaatttagttcttcgtctttcttagtagagtctattatcttttggatggcaacttgtgatgttttgaggatcggataattaggttgcctatcttggatttgtttgcgttggagcaaggcaagttattattcctcccctttgagcattattatcctatattctatatctctattattccatgcattagccattcatgattttaaatgcataacttgaacatatagtaaaccagatatatgctagattttgcttagccatgcctagttagattgcataaaatataatgaacttagattggaacagtatggtagaaatggttgattttcgggtggctagtactgttccaaccgacataagattgccaagtacatgtgaagaacgaactagtacgaccgcaattctagaatggggacagacttagcaaagtaggttatctagcaaaggtggtacctctgtacagtggttcttctttaagtccttgcgcaggaggcaaatttacgccgagcagagcgattataatatttaccgagacgcaggtaaatatattgattattgcgcactgtgtgtgtattgtgaaaacctggttgggatgacgggggtctctcaaccagttctctctaaagacctcgggaacgccagaactcctctcgctgctgataacgttacgttcagagcgcgtggggattatagttcatggaacaggtaccgttgatgttagtaaccgaaaagctttgccatgactaagctgatgaatattagcatgtcatggattgcgggtaaagcgtacatctactgcagtatgagtatctctgaaactattcgaatagccgtgctcacggatattgagcatcgggactcactatggcatcttggttagaaatataactccagattttattaaatattgttgcatttcaaaacattatagactttctccttctactttctcagctttctgcaaatagatctagctctactcaaatactattatttcatacattcatacttgaatataatagcttgctgagtacgttgtactcacccttactttaacccccttctttcagagttaatttggagttcttgccgaagccgagagttcaatcatataagttagttttcatttcaatctagttctcaagtctagattagttagatggtttaagtctatagcaatacactagagttggtttattctatagcttctgctgtattagttagccacaagtttgtaaatacccatatattttgtaataacatctcctttggagccttattcaaatgtatgcaatgaagatccagattgttgaacctgtatcaatctactgatccagggcttgatacagttaaacatgtcggtttccgaatcattagttttgggacccaacaaatagccatacccgtggttgtgggcgggtctaacaatgtctttcgtgattaggctcacacttctcaccataataaatgatgatataattgctaataatttgcttagctcctggtttggaatggtacatttctggtttggagatagatctgtacagccgggtatggttgttcagttttggttaggcatatgcagcatgggtgtgctgttcagtgttgattaatattaatgatttattattctactgttttacaattctcaaatgtttgctaaatgttgcttttgcaaatgagccctatattatgccattctttggtatccttgtgcacttgcatttttgttgtgtggcttgtagagtattccatgtactcaccttgcaataatcaatcaaacctcggttgaagaaaagttgtgaaggagaagacgtttggcttataccccagttgagctgcctatgggagtggagctgaagcttcactagattttatttttccgctgcagtttttttcgtggtggggactaagtacctcttatgtaggtatttattgctttagttattttgatgaatttgtatattaaattgtcagtttgtgtatctcggctgatttctgtatgaggattttatacacaaataagttccgaaattaccagtgaatttctggacgtgacatacagtatccaacccggcacggcactggccaacgagcttctgggttgtgccgggtcgaggccacagcccatgggttggtatggcatggcgtgtactgggtaggcatggcccagcacggcacgaaaggcccaagccaccagcccaccgcaggtacatgtccacagtgccgcacccagctgccaatgtgtgcgcgcggcacgctcgcacgcacccccgtgcgtccccgcctcccttcgcggctcacgcgggccgcccgccttcaccaattgcagcatgcgcgcatcttgcctcccgccctctcctcacaccgcccgcctgcgccaagccgctagtcgccacagccatgcctgccaatagtgctagtaggcgcccgcccgtctgcaccaatccagctgagaagatcgttggagcacaaaaaaaatataaaaaatgcgaaaaatatcagaaaagttctattttttttacaaataggacactcactatggagattttgaatcatccaaaccttccattttgtgctatcttttgttcttttgtgtgctagttcaattttcttatctaaacaaaatttgttcaaaatcaaaaatactttgtgaagtccacttttttttagcaaaactgcatgcacaaggtgtaaagaaggtaagaaagaattggagaatcccttttttattattcgtattttatgttatatgtatatttcttttgaaattccgtccatgtggttataatattcagcatggacgatccgagcagtctgtcattcaatttgggtgactttgaccctaattacctatcagcgtcatacataaataacgagtatgatgcctccggatcggttccaacaccgtcagttttggacgaggtaccggtggcttcagatggatcaggaactatgagcaggagtccatcgacgaacaccagctcaaagagatcacgaacttcggccgtttggcaacattttgatgaggtggctgtgacatgccctggtggaaggcaagtaacgtatgcgaaatgtaaaatatttaaacgcgacaaataatctgctacagaattttctactcctttatatctttaatttcaaaatcaaattcttggagtggaagaacccatctaattaatcgaagttttgcatctttcttagtgagcaggaattttagagcagcatgatcaatgtacacaataaccttagcaactaagtaagacttgatcaccccttattaccccaagtgcattttctatgcgagaaaccaaagaagtgcactcaataggaccggaaaacttgaaattttctaaccattggcgaatcatgtattacataagagaaacttttatctttctaaccatgtcaaataagataatcaacttatcttcacgaatgggtctaagattagctctaggaaataaagtcatgccaagccatttatacatgagtctaagagtaggattatggatgccatctaggccttctacataacttgtttttctcagagttggaagctgccttccaaaaattaattttgcaagttttgtcaaaacctaaaagcagactcaattctttaaaagagagatagaactccttacagaaaaaccaaaaagaaatgccatcatctacttctagcaaagtagcaaggtacataaaaaatttctaggtaagtaagcgagaacctggctcatctaccacagcaaatttctcccatcctatagccttccaaacaatacgaaaatcaacatccgtacctattttctgaagaagttctaggtcgtatgctggggtgtcagcaaatggccgatccttgagcatgtgatagccctgcatctcccggtctcctatgaggtcgaggttggagtcatcgagaagccttggcgaggtgtccacctcctccatggagacatcggtggaagagtgtgtactcgacttatcttggtgatgacttgaacatgagcttgatcccttcttgaacaaacccgtgattcttctcttcatgactgcagaaagagcaagagcacacactacaaggaaatcggcctagcaccacggcgccaaatcgttgcgatatgggtgttttcgttgcaatacagagaaatcacaacgaaaaaatttcattggcatgcgttgcaagtacctctgatgcgatagggtatcgcaacgagtgctcacgcgttgccataaaatcgggctgttgcaacgagacgaagcatggggaaagattgaagaagcaacgatatttagcgttcgagttgacattgcaatagttgttatcgcaacaacgttagatagttgcaaacaagaattatcacaacgtttcagtttcgttgcaatcctgtatattgcaacgatatttgcaagtggcaataacacgtacggtgttgcaatatgcttaaaggatatcacatcgacgtaggactcgtcgctatacaattaaaggatatcacaacaaagtaaatcgtcgctattcgcttgaaggatatcgcaacgaagttagagtcgttgccatacaccaaacgtgtatcgtaacaacatgtaacccgtggctgtacgctcgaaggatatcgcaactaagttcaacatgtaaccggtggctatacgctcgaaggatatcgcaactaagtatggattgtggctatatgcttctaggttatggcatcaacatgcatcccgtcgctataggctacaactatatcgcaacaaagtaaacccgtcgctataggattgaaccatatcgcaacgattggatagaaccatatcgcaacgaattaggagtcgtcgcatacggtaggatatagcaacgaagcgaaatatgtcataacaatgatttatttggttactgcaacatatatattgaaatttttgaggtagcaaactatcattagtcttacagcccattgaaataacgagtacataaatatgacgatacattgtaacttgtccattcatccattcaacaataaaatgtccataaaccctatattgttccataacccctctattctttgttcccatgtctaccaatctttgagtcttaatgtgccgcccgagtttgagtttcctgctgaatacaaacatggtttgaactgcatgatagcaataggttgggctggattgtgaaatggcaatgcaaaaattaactttcttaccagttgtttcctgttgcttgctcacgttagagcaccagatagtagttgtttagaggaaatgtatttcgctgctgtccctttcccaacattttcagtaagcatactctttgtaactttggaaactttagattttcctatagtagggtccacattttctttgtttgcagtgacatcgtgtcgggtcccaaaattaattacttggatccgactatgattaatgtatcaatccatggatcagtaaatattgatacatacaatataactggttcttcattgcatatgttaaagttttacaatactaagagttttacaattaggtactcacctaattgatcaactagaattaatacatagcggaagtttctatacattctaactagggaggtataacctttagggattttctaaattatcggggtcatcatagtaatagtcataggggtcctcctcttgacccatatctgaaaaaggggttatgagagcaaggatgagtattcacaatactcagcaagttatcatggaaatatgttatgcactggcatattgtagggttctttgcaaaaaaaaagtaataatcaatctggaagagttatagcaagaatttataaatatatagactttaaatttctaaccagtgtaccatatgagtcccaatactcaactccatgagtacggctattcgaatagtttcaaagatattctactgcagcagatgtacgctttacccgtagtccacgacttgctgataatcatcggctttagtcatggcccagtatcaagttattaacaactgtggcacctgttccatgaacttatatcctcatatgctctgaacgtattgttaacagcagcaagaggagttctggcgttctcgaggtatttaaggggaactgaccgtatgacaccacgtcatctcgatcagggtttagaaatataccatatagtttatacacgagtatcacaaaccatttacctgtacctggtaatggttaaaagttgctcttcacggctataaatgcctcctgcgcgagggcttaaaaataagaaccactatacggaggtgccatattgctaattaacataatatctaggtttgtccccattctagaaacagcggtcgtacccgttcgttcgacataagtacctggtaataactatatcgatcgagacggtactagccacccggaaatcatccaattctaacgtactgtcccaatctaagtataagatattttaaccagattataagcgaagtaagcaaggctaaattatctgggtttctatggttgaattgtgcatataaaatagaatattgaatagaaggctataaataaataatttgtaaaatataggcttaaatgatcaaaaggtatatggtaacttgccttgctcgatgtcctgaaattgattgctgttatctagtgtgttagaagaatcctcaagacctagggttagacatataaaattcaaattcaaaaggaattcaaataaaattcaaaaataagaaagatagggaaaataaaataaaatagaaaaataacaaaaggggtctcaaaagatagagaatgattttagaagaatattggtccaagtttcactggaattggatctatattttaaaagatatgggcttctaaagtttgaaaatcaattaaatgtgaaatggcactgtgtgcgggtcccacctgtcagtctctctctctctctcttctcttcttcaacctccagccgttccgcaaatgtggctggcagcgctggggtttgggattacggcggagctagaggggggaaggggttgtggctgaggaggggttaatttggtatgtggttgagctagcggctagggtggcggtggcatagttaagccgtgaaggtgatcggggtgatgtgagtcagacatggctcggggaggggttctagagcatctatgaggtacctagaagggtttgggcaacttgccgaccttcgacaaggtgcggagtatatctgccgactagcgcctccattggcggtggtcgagctcacgtcggcagcccagagggtggcatgataatgcaaaccgattgcaaaaatagaccctaggtagtatatagatggttaaaacggaagaactcaccgagatcggttgaaacgacggattgcggccggaaaaacttcgcggcgacgaagaacagagcagagcaggggcgacggtgctcggctcagtacggcgaggtaaaactcgacgcatggcttcggttagggctcactatactagaacatggttgatataaggtgttctaagggttatttagggtgaaggatggatggaggggtgtggagtcgatcgcgcacaaggtgttcgaccgacgggcgagagtggttgatgagatggattggtgaagcagagcttcggagttgtggagctatggttgttgatgatcgatgatgagcaaggaagggattggggtcctatttatagggccaggagaggtggatgagctcggacgccatcatcgccatggattaactcaaggattggatatggcaaaggtggcagaggctgtgagagggtggccaaggtcaatttgagtggcgggaggccacgtttgaatacttaccggcgaaggattggcttgaccgcgggtagaaacggctggcgacgtgttagcgccaatccgggcgcgacgcgcggtggcggcgagggttaaaacggccagcttaagggtgaatggtttgaattgtgagaggggaaaccaccgtctatcttcaattgaaccgtgcagcaagaattggcgcgattcatgctgggtagaataaaaatcggactcggcgacggctttggacgggagcgcacggcgtcaagattggtgcggcggtggtggtctgagggcgtcggacaggcgacgacgcgccaagacgatcgggcacgtgcaagcggccccaaagccgacgcgcggcgacacggcacgcggctaagtcggatgcccaggcatgcatgaatgggaggaagaagcaaagaaagccacggatttgagtgggatgtggtccccaaggatcaaatctagactttgcacaagattgggtagaggttgggctgtgttagttgggctagacattctgtcgagcacctagtgtgaaatgaacagtgaatttcaagaattttgaatatttttcctagagaagatttgaatttaaactatgaattttgaaaagtttcactagggtttggaatatagcaaatccttactaatattagggtaaattagtagggttctaaaggagtaacacttgaaccaattaagaatcaaataaatttttaaagcacactaaattaatcaaaagccagcatgatgcagtcaaattttagtttaaaatttgaggatgttacaaacctacctcccttaaagatatcttgtcccgagatttgcttaggagtcttcgaaaagatacgggaattccaattgtaaataatcttcccgttcccaagttgcctcatcctctgtatgatgattccattgaactttaaacatttttattgccttagtacgagttgttctctgtgtttcattcaaaattctaataggatattgtggataggttaaatctttattcaattcaatagtacttattcctctggaatacgtaaacatttctttaattgtgaaatatggaatgtaggatgtacatcagatagataatttggtaaagccaattgataggctacttctccatgtttagcaattatttgatatggtccaatataacgaggggctagttttccttttactttaaatctttttatccctcgtaaaggtgaaacctttagataaacataatcaccaatgtcaaaagttaactctctccgtctagagtctgcataactcttttgtcgagattgagctactttgagtctgtctctaataagtcgaactttttcttcagcttcctttaaaaggtccgttccaaatatacttctttctccgatttctgtccatatcaatggtgtttgacatttccttccatataaggattcatgtggtgacatttttaaactagcttgataactattgttatatgaaaattctgcgtaaggtaaacatttgtcccaactagcagcaaaatctagagcacaggctcttaacatatcttttaatatctgatttagtctttctgtttgtcctccggtttgcagatgaaatgctatactaaaatccaaataacttcccaattcataatgtagtttctgccaaaagtgtgaagtaaattgggtaccacgatcggaaataattctttttggtactccatgtaaacatactatccttgtcatataaagttctacgagttgtgctccagtataggttgttttcacaggaatgaatcgtgcagtctttgtaaatctatcaatgattacccatatagaatcatatctagtagaagttttgggtagtccagtgataaaatccattcctatttcatcccatttccattcaggtatttgtaaagggtgtaataatcctgtaggcttttggtgttctgctttaacttgttgacaaacataacataatgcaacatattctgcaatatgtcgtttcatatttggccaccagtataagtctttgtactacctgggtgtaaagagtaggctgagtcaggtgcttcttttagtattaccttccttaagattcctgattgtggtacgataattctatttccgtaccataatattccttccaggtcttcggtaatatctgtagcctttcctcgcaccatccgttccttaaaagtttgtattttagaatcctccttctgatgttcttttatttgatccatcaaggtaggttttaactccaaagtgttcaattctccatacttaataatacccagatttagtctaagcatttatgcttgtaattgttctgacattatttcttgttgtaaattgcaataaactttttgacttaaagcatcggcaaccacgttagcttttcctggatggtatagaatttccaaattataatccttaattaattctaaccatcttctttgccgaagattaagatctatctgagtaaaaatatatttcaaactcttatgatcgatgtagattttacaatgatttccaatcaagtagtgtcgccaaatcttcaatgcgtgtactactgctgctaactccaaatcatgagttgggtaattttcttcatgaggtcttagttgtcttgatgcataagctactactttaccttcttgcataaggacacatcctaatccttgtcgagaggcatcacaatagatctcaaaatctttttggatgtctggcaagattaatactggcgtagtagtaagcttatgtttcaatctttgaaaactatttctgacattctggtgtccattcaaatttcctgtccttcttaagtaatctggtcatgggttttgcaatagtagagaaatctttaatacaccttcgataatatccggcaagtcctaagaaactccttatctcaggtactgaggttggtgttttccattccattacagctttaaacttttccggatccacggcaactccttccttagttattatatgtcctagaaatgcaacttgatctagccaaaattcacatttactgaatttggcatataactgatgttgccttaacttctccaatactaatcgtaggtgttgtttatgctcttccttgctccttttaattgatcaaatagaccgtcgattcttggtaagggatatttatttttaatagttacttcatttagagctcggtaatctacacacattcttaaacttccatctttcttctttacgaatagtacaggtgatgaaccctgagttcctctcgacactcaaggctgttgttggttcgatctttcggtgagttgtgataactacgatttgggagaaacgttgacgatccgactacaaccgtacgagacgttgtgttgcgccttagcgatcaatacacctctccgtgggttgttgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagctgacacgcgcgctgcaagcaagtagcaatggctaaactttaatatatcaaaacccaataaaccctaaaggggtacctagctatatataggggtgggaggacgacctagggatgcctaggggcgtgctctacctggttggggcacaccccacatgggccccacctgggccggggtcccaaatgaagttacaagcccataggcccattataggtgacgcagcaccttgtgcctgtgatttcagccacacgagatggaattcggatatgaggctagatccgttggaaagagggctccgagagtattctatcaagtactcacgggctgaaaatggaggtcgtatgcagattcggcgaccgtttgaagtcagtactatagcaagtggccgaatcggattccagcacttggacgacgtgatctcgatatcttcttgttcatccatgatgtgaacaatggttgcattcgtggtagttatggtcacatcatcctccccttcttcacggaaaaccatcctcggtttttccatatggtgctatttgcgtagtccatttacaacaacctgtttcttccaatcaaaacaaggcaaagttgagacaatttggttagcaataacatttctctctagcttgtatgttttatccacatgtacaggaagttctaaatccgagcagatgtaaactctatgcacaaaatatattccaagatcattatattcgccaaagatgtgaaatataatattggttggatatggcaaatcagacttagcaaataatttctccttcaaattatcgagctcacaaaaatcatcaaactgaacatagcccaaagtatttaaagaagatctcaattcacgcttctctacttcattagcaatgtgaacaacatgcttaaaatcagcgcagtatgaattaacagtaggaatagcatgttcattcactagttgtggcatggatataagtgaagcattatcacataactcttctttatcacaaggaactgcaaacaaatcaacttgtgacaaaggaatctcagcagttggttccactaatggttgctctgctatagtatgaaaagtggacaaattcaattcattaacaacacactcaccttgattaatttcagcaccattaagttttacctttgatgccctcttcagatgatggaggtgcctcgactttgagtgtgaacaatggaactggcggctctttcatgtctctctcctccttttcatgattatgcacttcctgcaaatggttagtattagaagacaaaaacatagcatgttgcttcttcatgtcctcctctattttactttcagcattgcaagcaagttgtaacaaatgagaaagaaatgtatatctttgacaatcaagcatgtcctgaatttctttgttaagcccacgtaaaaacctcaattctttagtttcttcgcattcatctaaaccacaacgtaataaacaaacttgcatatcatgagagtatgaagtaacagttctggtatcttgttttaaacattgcagtttgttgaacaaaatgtcagcataatacatgggaacataaacatctctgaaatatcgtttcaggtctttccatgattgtggtattttgttatgcctacaaagatgtttccaatcattagaagcatgtttaattaaaacactagaggaacacataaccttttgtttatcagacaagacatgcttttgaaattcactatcaaccgctagctcccaattaatgtaagcatgaggatcatagtttccctcgaaataaggcagtgcagatttgatcttacctagaacatcatcacttacctcataatggtcatattgatcactcctcatgtctcgacgaagatgtcgatgttgagcacagctatccccaattatcttgcgtatccctgccattgttagtagaaaacaaaaaacatacacaaaaatatgcgcgttcctattaactactaggtagtggcagctcaaaaatcacacacactcaagcttttaaccaagctcttccaagatcttaccattgaaagtggaatggtgacatacactgactcaaccaagcaccccaatggaagttggatgtatcgatgccttggcaaatacttgcggtacggctgtaatcaaatctgtggagctctgggtaggcttatatatgtagcaaaggaatagcaaatgctcaactcagataatgcaaagttgaataattgttcaaagtcaagtaccgtgctggtcctaggctagaacgtactagagacgcgagcctagacacaaatgatagcacaagatagcactaggaacaactcatgcacaactctgatatatgaagttcaactcaaacataacagtattttctcttttctttctttcttctttcttcttttcttttttttctttccttttcttttctgttttttttggtgcggattttttttcttttcttttttatgcacctttctgcctttttttctcacttttatcttgatttttttaacaaaaactgactcaaggaccttaatgtaaggttacagggactcaaacgtaaatataaaatctatagggactcaaatgtaaaagtctaaacccaaaattaaaattatacaaaaatggaatgctgaatttatgccggttccatttttccaaacagatctcgaaaccgacaccaaacaaaaattcaccaaggtgtttgacacaactcagaaccgtgaaagggagggagggagtcggactcggccaaaggggcgagtgggagtcggccaggaggtggagtggatggcagtcgaatttggtgtatgggataaaaaggaaactgatttttaaccaatccaatctactatatctttccaaaacaaacttgactacttccaaaatcagatatggtaattcaccttcctcctctcatgcacgacacaggcacggccaaaatagaagaacgcccagtcagcaaacccaagatgcaactcaacaactgcaaaaccaaccggtaaaaacttttgaaaactacaaaaatagaatcgtggcagcgagccgattcagttttcgtaggtcccgacgacaacagatacacggaggtgacgacgactgtggtacaaaacgtgaccagaactcgaaactctacacgaactagacgctaacaccagcaactcgactcgacgatgtaacacaaaactcaacaaagcaaaaactgataaaaacaatgcaatggcacaatatggctaggtacaggacaatttttttatggcaattttctggttatgggtagataaaactcaccgagcaacgaaagctctgataccacctgatgaaccctgagttcctctcgacactcaaggctgttgttggcccgatctttcggtgagttgtgacaactacgatttgggagaaacattgacgatccgactacaaccgtacgagacgttgtgttgcgccttagcgatcgatacacctctccgtggattgttgatcttgccggtgcagatcaaccctattcctgcaagcaaatcgaagaaacaagcaagaacaagataaaagcaatctgatgttgcaaataggaatttaatacaaatgataagttggggttccgaagaacaagcagacggacggtctagccgacacgcgcgctgcaagcaagtagcaatggctaaactttaatatatcaaaacccaataaaccctgaaggggtacctagctgtatataggggtgggaggatgacctaggggtgcctacgggcatgctccacctggttggggcgcatcccacatgggccccacctgggccggggtcccaaatgaagttacaagcccataggcccattataggtgacgcagcaccttgtgcctatgatttcggccacacgagatggaattcggagatgaggctgtatccgttggaaagagggctccgagagctttccatcaagtactcacgggccgaaaacggaggtcgtatgcagattcagcgaccgtttgaagtcagtagtgtagtaggtggccgaatcggattccagcacttggatgatgtgatctcgatatcttcttgttcatccatgatgtgagcaatggttacctccgtggtagtcatggtcacatcaacatgagttccccaaagtgaagaactttgtcgaataaagcctttttcttgtagctcagctatctgtttcttcaattcttccaattcattaattggcatcctataaggtctttttgatataggtgccgttccaggaagtaactctataataaattctatttcccgatttggaggtaaggtacttagatcttaaggaaatacatccaaatattcttgcaccactggaacttcttcttttggtataagcatacaaatgtctgtcatatgatattccatagatagattgggtttaactattatctttgtattaattccttgttcatcagtaaggataacctctcttgttgcatgattgattagtccattattcttggctaaccaatccatgcccaaaatgatatctatagtttgggtaggtagtacgatcaaatcaattaaaaatatttgatctcctaatttaatcggaacatttctacaaatagatgatactaatacagttcctctaggtgaatatattatcatagccttgtttaaattatctttaggtaaagactgattccaactggcttttgcagataaaaaggaatgagaggcaccagaatcaaatagaatagtaactggtttagagtttatggtgaacatacccatcaatatattaggatcttgttgagcttgttctgctttaatatgatgtacttgaccacgtccaagattaggtccactcttaataattggaggatttttctttataaaacctgtagtagatggtttctgataagaagtttggccacccatattttgacgattagggcatagtcttgcaaaatgtccaaacttcccacaaacatagcatggagagtcttccatccttaatccaggtcttgatagtattggtggcatgcccggccttgcattggatagagatggcttaaatggataaggcctccgaacttgtagtgaacttctagttggtgattgtcgttgtaaattcattcttctcttacggaatccttccaccattctacgatcattttctagcctaaccactttattgactaggctttgaaaactttcatgatcttgactaatcattggtcctcgaagttcatcacgtaatccttctataaacctttcaatcctctctttctcatcttgaatgtctgaagcaacatatcacatatcgagaaagctgtgtaaatttattcaaatatttttgtactgtcataaaaccttgtcttaatcctcgaaattcattctttttcatcctgatcacagctgtaggtataaaagcatttctgaaagctatggtaaattccatccatgtaatgatatgggtaggatcttctatagaagcttgatatgcttcccaccattcattggctggtccttctagttgatgggttgcaaaggttaccttctcttgttcgtttgttctgaccaaggttagtttcttttcaatagcccttagccagtcttcggcatccataggttctttggattttgagaaaactggtggtttaatcctcagaaattctgcatgtgcactataacctttatttccttgattttttgctatgtcctgtaataattgagtttgtcttgccataacttctaccaaggtagtaggatttggtgaagggatttctcccgtatctccttgacccgtgctgccattacccgtattcatctagaaaatgggtaattgatatcttctcaaaggggagtcaacatccataattaaacatagattttatttatgaacaacattgtacatggtgtatgctacaaaagaacaaaccaagaaaaaccacaaccgcaaaagaaggggtaatcacacatagaagttagagaggagtaggatcactaacaattctacacttaagatctctaactatctataacttctattcatcaagccatccaccactgccttccgcgggattagcaaataacgatgcaggtgcgaagtgtgaaaattcatgaggagatgcagaagttgatgcagtaatattgggggcagagcaggagtaagggtcttcattattttcttgatcatcagcatgtatagaaagatgttcctgtgtctcaagctctcattcttctggatcttcctcttcgtctggagattcagtccaaattggggcagtatttaagtcattgatatcaaatacccgatttggcctgagtacttcaggttcttggctaggttcactgatatcgatagctgaatgcatttcttctgcttcatcatcagaataaataggatacaacggtggtggtgatggtggtaaaccttgtaaaactccttcaccattatcctgaggatgtggttcatcttcacgtactggtgagatatgtccttccataccatcatcatcatcatcgtcatcactacccatatttgggatttggtgaagacagaaggctgctcttgcaacacaaatattgaggatagaattatgtttttctctttcctcatataattcgtgaagtatacgatatttgtgtttgagaacagcttctctgcgttcagcttcctccaaacgtttacgttgtacatccatgtgttctagggcttcttcatacatgtcatctgcagcttccatccagatagacatagttgcttttactggttgttcatgataatccacgtcttgaagagtacagtaatcttcgcccggctttcgcataggatggtaagaatagcgagagtgttgcagcttatcttgatagatatgattaagacgtagaaaagcctccctggacacatcatataatgcagctcatacggtatcccacctatgacgtgttcggaagtaatacatatcacgttcacctcttgggggattgatcttcacagtcatatcacactcccaacgttctccccattgataggcatgtgaatagaattccggcttctcatttatcttcagcttagtcatcaagctgattagttgatcagtgtagtcattatcatggatagtaatcgcaatttctataactttttgctcatgcccttctgccattgtcctaaaatacacagatgacattataatgcatgctcgtggattaaatctaccccccttaaaaaaataaggttgaggtaaattcaaacttaacttagttagtagtccttaaggttcatcctatagtcaaaacatatgctctgataccagtcctctcgggtcccaaaattaattacttggatccgactatgattaatgtatcaatccccggatcagtaaatattgatacatacaatataactgcttcttcattacatacgttaaagtttcacaatactaagggttttacaataataggtactcaccaaattgatcaactagaattaatacatagcggaagtttctatacattctgactagggaggtataacctttagggattttctaaattatcggggtcatcctagtaatagccataggggttctcctcttgactcataactgaaaaaggggttataagagcaaggatgagtattcacaatactcagcaagttatcatggaaatatgttatgcactggcatatagtagggttctttgcaaaaagcagtaataaacaatctggaagagttatagcaagaatttataaatatatagactttaaatttctaaccagtgtaccatatgagtcccggtactcaactccatgagtacggctattcgaatagtttcaaagatattctactgcagcagatgtacgctttacccgcagtccacgacttgctgataatcatcggctttagtcatggcccagtattaagttattaacaattgtggcacctgttccatgaacttatatcctcatatgctctaaacgtattgttaacagcagcaagaggagttctggcgttcgcgaggtatttaaggggaactgatcatatgacaccacgtcatctcgatcaaggtttagaaatataccacatagtttacactcgggtatcacaaaccatttacctgtacatggtaatggttaaaagtagcccttcgcggctataaatgcctcctgcgcgagggcttaaaaataagaaccactatacggaggtgccatattgctaattaacataataactaggtctgtccccattctagaaacagcggtcgtacccgtttgttcgacataagtacctggtaataactatatcaatcgagacggtactagccacccggaaatcatccaattctaacgtactgtcccaatctaagtataagatattttaaccagattataagtgaagtaatcaaggctcaattatctgggtttctatggttgaattgtgcatataaaatagaatattgaatagaaggctataaataaataatttgtaaaatataggcttaaatgatcaaaaggtatatggtaacttgccttgctcgatgtcctgaaattgattgctattatctagtgtgttagaagaatcctcaagacctagggttagacatataaaattcaaattcaaaaggaattcaaataaaatccaaaaataagaaagatagggaaaataaaataaaatagaaaaataacaaaaggggtctcaaaagatagagaatgattttagaagaatattggtccaagttttactggaattagatctatattttaaaagatatgtgcttctaaagtttgaaaatcaattaaatgtgaaatggcacggtgtgcgggtcccacctatcaatctctctctctctctcttctcttcttcaacctccagccgttccccaaatgtggctggcggcgctagggtttgggattacggcggcgctagagggggaaaggggttgcggccgaggaggggagggagctagggttctccggcgacggcaagcggcggcggaggggttaatttggtatgtggttgagctagcggctagggcggcgatggcatagttaagccgtgaaggtgatcggggtgatgtgagtcagacatggctcggggaggggttctagagcatctatgaggtacctagaagggtttgggcagcttgccgaccttcggcaaggtgcggagtatatccgccgacaagcgcctccattggcggcggtcgagctcatgtcggcagcccagaggatggcatgatagtgcaaaccgattgcaaaaatagactttaggtagtatatagatggttaaaacggaagaactcaccgagatcggttgaaacgacggattgcggccggaaaaacattgcggcgacgaagaacagagcagagcaggggcgacggtgctcggctcggtacggcgaggtaaaacttgatgcagggcttcggttagggctcactatactagaacctggtcgatataaggtgttctaagggttatttagggtggatggatggacgggcgtggagtcgatcgcgcacaaggtgttcgaccgacgggcgagagtggttgatgagatagattggtgaagcagagcttcggagttgtggggctatggttgttgatgatcgatgatgaacaaggaagggattagggtcctatttatagggccaggagaggtggatgagctcggacgccatcatcgccatggatgagctcaaggattggatatggcaaaggtggcagaggctgtgatagggtggccaaggtcaatttgagtggcgggaggccacgtttgaatacttaccggcgaaggattggcttgaccccgggtagaaacggctggtgacgtgttagcgccaatccgggcgcgacgcgcggcggcggcgagggttaaaacggccggcttggaggtgaatggtgagaggggaaacgaccgtctatcttcaattcaaccgtgcagcaagaattggcgcgattcaccccgggtagaatcaagatcggactcggtggcggctttggatgggagcgcacggcgtcaagcggcgatttcttgcggcggaggtcgtcccggctttgtcgtcgtcaagattggtgcggcggtggcggtctgagggcgtcggacgagcgactacgcgccaagacgatcgggcacgcgcaagcggccccaaagccgacgcgcggcgacacggcgcgtggctatgttggatgcccgggcggcgcgcgtgaaggggaggaagaagcaaagaaagccacggatttgagtgggatgtggtccccaaggatcaaatctagactttgcacaagattgggtagaggttgggctgtgttagttgggctagacattctgtcgagcacctagtgtgaaatgaacagtgaatttcaagaattttgaatatttttcctagagaagatttgaatttaaactatgaattttgaaaggtttcactagggtttggaatatagcaaatccttactaatattagggtaaattagtaaggttctaaagaagtaacacttgaaccaattaagaatcaaataaatttttagagcacactaaattaatcaaaagccagcatgatgcagtcaaattttgtttaaaatttgaggattctacacatcgcttgttgggatattctgtttcgtaaagtttgttacgcaatatgtaattatatattatgactggaatgattggtctagttcattacctgtttcgtaagtgcacgattttctttctctgttgtgacatcactttttaggtcaatatgtgttatgaattatgctcaatattgttagatgtaatcatgtaattcaatgcacagtgatgggtagaaatcttgttcaaggtcgttacctggattgtaggatgctctttttctttgttcccagcatttcctgtaaacaaactctttgcaactttggaaactgtatctttgcatgtagtagggttcacattttcttgggttgcagtgacatggcttgttgggatattctgttttttaaagtttgttaaacaatgacatatgtaattcaatattatgattggtatgattggtctagttcgttacctgcttcgtagttggccgattttctttctcttatgtgataacactttttgggtcaatctgtgttatgaagtatgttgaacattgttagatgtaatcatgtaattcaatgttagatgtagttaaatgcacaaaaccatgatgactgaattatttgttcaattctttacctcattcgttgtttctggtgcgtgcactggtctctcttgagtgtgcagggctgttgcatcagtataattcacattgctccactctgcttctttgttggaagtgtttgtgtaacaccccaggtaaccacgtaccaagagtgccacaccaaaaaacactcaaaccactaacttccaaaattattagaaatttcggcagagtcttccctgtaaatacggacatccacgacatgcaattataagttaaactaataacaatatcattcccataatacgatccatccttataatccatggggaagaaactattagaaatctaaaagattattataagaccaaaccaggatataattttaagtgtcattatggatctaagcaatatagtttgatagtgagcaagtagatgtgcatataaggatgttacttcccgcccttgcatgccggtctcaatgcgtacctaaaaccaaataaaacacaagagtgagtataaaaatactcagcaagtacaatatggaactagaaaacacatatacacatcgctgacaataaagcatgaacagaagcctttctttctttgataggaaacacatttccaaacaccaagtcaaaaaagatagtagttcccatcccgggcaggcatgaattgaaatagtagttttcatcccggacaatagtaaatacatcctagcatttgccggcaaagccaagtaagcgtgatcagcgcttacccacaggaacttgaataaataaccaaattgcactcccatgactacgcatggtacttgaataattgaaaccggaatcaaagaaccaaatggaaacacgtccatggcaagcagggaacttgaattatttaagcagaactagaatccagaatattaaaacaagaataacatcgtacacataagatcaacttgaaatctaaatagcgtgaacaacaatatgaacataagcaattacttatcacgttgaaatatatcagaaataaatagatagagtaacaatccatgaatcacacaattagttcgtcatgcatttgcctcgaacgaacggttggtatcatgcacgatatgatggaccaccacctaatcataaacaaaaccttagcaaacatattcaaacatgcatataaaacaatgaaaaaggtgaacctactgccccatcccatcaaatctcaataacaaggaacgccgcttggactatacacaagactgctgcttcaaacctttatatcttgaaatatgaaaaggctatgactgaaaatatatacattttgaaaatctacagaacaatacctacaactttcatgtagaaagcatatttttattctgccatttaaatggtctaatttgcgcttgaaagcaggcttcagaatctgtccagaatttcagactgtccacactaaaacaactataactagagttctactcgcccaatcagggtgtactttaccaatatagaaagataagaaaatcctctacaactttgtctataggcggcctggctgattccactgtttaacctctccaaaaacagttcaatctactactatccagattatgacacaaaaacaacagtcatactaaaaaagttatatctcctaaaccacttgagataaaatcgctccctttggtcagaagatatatccaaacattatctacaacaccatagttataaacttttgcataaaataacatttagagccccgaaacatcgaaacactgaagcactgcaaatctacccacatgcagaactgcaacaaaccaaaccgcaactacccaaactccttctctagccttccctaaccatgaattaatgcactaaagccatgctagaacaactgatacaacaaggggataagcctcacctagggtttctttagtgaacttgtgaggagacaatcggggagactccggtctaacccctccttctactcctctcctccttctcgttccgtttttctacttctcttcttgatccaagctatgaaggtggagatctagggagaggaatttgctgtagatgggagagatgcaaacacaggaggaggggaggaatgaggcgccggccagggagaggggtggcggcactatgaggggaggtgggattcggttcccctctctctagcttttatgggagaactaatgggctgggtttatgggccttctcatgttggcccacttctaaagatatttttcttttatttatttctgttaacatctttattttaacaagtcaacccaaactaaaaaacctaaatatcttttaatatacggggtattacagtttgaatcaatggtagccttggtattaaaaaaatgtctggtcagatattagcagtaatatttgtatcatcaatcactaaggatacatcttctccagactctcaagaagcatgacataactattcaattcattaccaattctctatgattttaaaatgtattatgaacagagcatgtacacatattaaaaaatgcagacaatatgaatgtcttacctcctgtgtcaatggttgtttactctgctccgacatcactttttgaatctccttcaccaattcatccttgagataggctttaagttattcctgattttcgtgttccttgcaagttcatcctttaatatctgaacctcacgagcttgttcttcaactatctcatgaagttggtgttttgtttgtttctcaaaatatccgtgtccacgtttctatgttgattttgttcctgttgtttccttgtatgtgttctggaaaacatcgtcttcttgacccccaaatgtgacacttcttgatccttcatcacccgcctcatctgaatctgtcatagccaacttccttgttgtattattctgatgcaaagaaaaaaaatgtaagacatcgatttaggtaatgttgcgactcaaataatatcttgttatgtgcttgaaattacaactcatgtaaatactttcagacatcttatttgaccattttccgtgcctcgtgtgagtagacttccaaagttccagaacacctggctcagcaccagtttcttcatctctctacgaatgaaatattttgcatcattagtattcatttgattattattttgttagttcatctgaatgtaaaacatattcacctgttcccaactacactgagagaatggtttggaacccataagatgcatggttttcatttgttgcctattcgtagagttctgggtgctgaccttctgcacagataagacacgcaacgttcagcaattagcaagtacaatatgcacaaacgcttgtgttattaattgtacaaaaaagtgcctcaccttaaattttttggatccaaagtacatgatcagtcttgaggcttatttttcattctgtcttcataactgtcatatgccctgtacgtagcactaaaagtggatcaccatcctttgtatcgttctttggcaatcttccataccatctgcctagaatcatcattctgcgggatgtcccatgaattatgttggaaacattacattcaattacattgagaacataggtgcaaattgaaaaattcatttgcataacagatagaaaagaataaagatgtggcatatacataccattacacaatctgcaattgaattcttgacatcttgcttcacatctttccactttctaacaccaattagtggagtccttaaccttgtgtacattaccacttcatccacaaatgtacgcctattgtctccacatggaccacccagttttgctgaaaattcaactttaagtttacgagaagatgacttcaacctcttggtaccatggccaacttgcttgccatctacttacaatcacgtgagaaaagttcatacaaaggattaagtgttgattcaattgcagcaatgaaagtaaaaatttaaagaaatatgaactgaatataaccttgtgtatgctttgttattttcctagcatgagatggccattctatttctggcatgtcactgctgccattgatctcgacaccatctgatgtattcttattattggtaatataagctttgtaagccactgccaaaaaatgtacacatgtgcgctttgtagattataaaaagtaattagaaataataagtactccaaagggaaaaatacatactaatttgtttcagaagcccttgatcccttaaccattcagtgtaagttttaatggtttcgtccctgtaatcatcgtatagatctgcgagataccaacaaaattatgtaagtaaataatacaggtacagatatgcacaacttgctactgcaatacaactagcatatataccatgaacagtttcatcatcctcttggattgatgcaagccattctttgtatgcatcaacctcatcatcatcatcattatcatcgtcacactcttgctcccttggtcactttagaggtgtaatgttgacatgtcgttcttttacttgttgtgtagccagtactaacctgactttcttttctgaagctacgtccctaatcatgcattctgcatctcttctgtaatcaattgcctcaaggcttgctatatcatttccacatctcttcttgtagtacaagtagtcgcgcaagccaaaccctagctactcttatcaaagattcaaatcatatgttacccttgtcaacattggctttgacccagcgctctttggaccccttgcagttgatccatacctcccatatctcacctgtcaacttgatgctatttgtgtggaaaacaaccattatgataatatagtaggaatatcaaacattgatttacatgaaaaaaatatattcagtacacttctagtattcttatatagtaacataaacaaacgagaaaaaacaactctgttttataacatcaaaaaatgaaaatgtcaattaggcgcaaaatgcagccctctgtattatcaaatttgctgacctcatttagtacacactagggcaatgtttggcaaatgagaaagggaaataatttcacacccatctttaaatcctaactatacattctcaatcttcaatttaatcctaacccatcattgattttcccaatcccaatccaatcccatatatcccattatctaatcacaccctaggttaatatgaacatacgaagatgagcacatgaaagatgcgcactagttggaaaaaatactcacctttggcttaacgggtcattcaaatcctcttcttcaaaaacgacgtcggcatcctcgactattgccgtacgaccaagtatacagagacggtccacaggtcaacggaagcataccccgtgtgccaaccgaggcgagtggccgacaaacggactccactagacaccatgcgggctgcacacgtggaaacaacgcggctaccgagcgaacaaacaaccacggtcaccacacgcacccacaaacgactaccgacaccggtacacgggtaccggggtcgacaaacacacaacgggcatggggcgacatcgaaaggacgagaacagggcagcgagaggatggatccttaccaccacgcgatgaggcatgggaacgacgatgatgaacggcgcggcggagacggatgggaacgacggagacgaacggacgacacttcggcggcgatccttggatgaaggcaggacgaggccgacgcagggcttgatgacacggagccgatgacgaagacaacgccgaggctgcagcagacttgacgaaacgcgggcgacgaacgaacgcggcttgacgaagggacgaacgccacgacgaccaagaacgatggcaggacgacaaccggaactggcgaggaggcgacgagggcagctggcagcagctgcacggatgcgaggatgacgcggaacacgccgctgcgatgacgacgatggaggcggcaccgcgggatgacgagccggcaaggatgaacggtgaagacgatgacggacaccggcggtggggttcggatggaggggaggtgatgccgaggacgacgctcgctgctgcgatgccactgttgcctgcggggatgcacttctggaggtctccgagggaaacggagagcaggccggggaaggggaggcgactgtgacgccgggggaggcgacggcacggccggccggcgtgctgacgcggtggcaggggcggctggagttggccggcggcgtaggagagagaggaggtcggcgacggtgtggctagggagctcgggaaggtggaaaaccgaaggaaagggggactagggctccgttttataggcaatggaggggagtgccgaccacaggaggggacgggaacgacgccggagaacgtggccagcggcatcaatggcggtcaaagaagagggattaaatcctagtgattgggggcgggattaaaaggggaaagttgggggaaataatgaggaagggatggggattctgtttttgcaatttatttggccggaacttgcgcagtggagcgggatcgaaggatggcggcgctagggttcaggagagggacagagaggagcggccggctggaggttgaagacgaccgggtgggtggacccaccggtcaggcgcgaggcgcgcacgtgcgccgcgcgtgcagaggggcgcgaggggaggagggaggcggcctggggtggctggtcggctgggccggcacagggcaggggtggcccaagcggaagaggagggaagaggtggaccgggaggaggaggggaggcctgggagaaagaggggatgaaaaagagagggggggaagagagacttcggccgcgggccgagggagagaggaaaggaactttgggacggacttggcccaaaggaaaaggaggattatgtttagtttcctttttaataaactttcttaattgttgttgttgcttaataattgttcttgttgcacacaagcaaagctacaaccttataaagaagcaataacaatacataaaaagaaagcacacggttctttaggttataagaaacattaggagacttgaatgggtcaattcagggttcgtatgatcaagatatgatcatccgaagtttaatgctgttattgcaggggcgtgagcagtagggcaaggacaaggcgagtacatacactccgtgcacgacgccatctgcgggactgcccaaagccgtctcttttcgggtgccttcccagctagcgagcaagcgaccagctgcatccggagcttctgcggcaccaaaaccatctccaccatgataagcagagtcaggtaaaaattcttcgcaggtacccgccaagagtgcctcatctgttgcctcgacgggacgcattcagtgccaccgttgccaagggtttgggcatgtgtagaaagattgccctagtcaacaggcatatgttgctacagaagatggctacatcaccacctccaacgtggaagaggaagaggaagaaggagaagttgaggatgaggacggcgaagtctttggtcgtgatgacacaacggcctataggaccatcattgtaaagcgggtgctcagcacgcaggtacagcagcctgagaggttgcaacgccataatttgttccagattttcttcatcatcaacaaccgtcgtgcacgtgtgatcattgatggaggtagctgcaacaacttggtgagttctgatttggtcaagaagcttggcttgaccgcacgtacacatccacatccttaccatattcagtggttaaacgtttccggaagagcaaaggtaacacaggtttgcagggtttcgttttctattggctcatatgcatattctgttgattgtgatgtggttccaatgcaagcttgttcacttttgttgagtcgtccttgggaacatgataattatgctacacacaatggtaggagtaataaatacacttttgtgcataatgaaaagaaaattacttcgctacctttgacccctgctgaaattgtagaagctgataaagagcgagttgctagtttgaaacttgatgaatctgaaaatcagcaagttgttaaatctgtttttccacctaaaacggataagctttcacctagctctaaggttgagggaattaagttgaagggtggtgttatgcttgcaacaaaatgtgacattgctgaaatttcagatgatgatatttgctattccttgatatgcaaacaagccttggtatctctagatgatattggtagttcgatacctcctgttgttactaaccttttgcaggagtatgaggatgtttttccagctgagatacccccgggattgccacctatgagagggatagagcgtcaaattgatttgattccaggagcatcattgccaaaccgtgctgcttatcgaaccaacccaaaggagactaaggaaattcagcggcaagttcaagatcttttggaccgcgggtatgtacgtcaaagccttagtccttgtgcaattcctgtaattttggttcctaggaaagatggttcttggcgaatgtgtgttgattgtagagccattaataatattattattcgatatcgtcatcctatttgaatgtgtgttgaattattccacgtatgataaggaattgtatgctcttgtacgttctttagagacgtggcgtcattatttgtggcctaaagaatttgttattcactccgatcatgaatcgcttaaatatcttcgctcacaaaataatttcaatcgtagacatgctaaatgggttgaatttattgaatcttttccttatgttatcaaacataagaaagggaaagataatgtgattgcagatgctttgtctaggcgctatactttcttgtcccaacttgattgtcagatttttggacttgaatcaattaaagaacaatatgtgcttgatcctgattttaatgaagtgatgttgaattgcaaagagggacgtacttggaacaaatttgtgatcaatggtggatttgtttatagagctaaccatctatgcattccagttggttccattcgtctttcgttgatacaggaagcgcatggaggagggttgatgggacattttggagctaagaagacgaaagatgttttggctttgcatttcttttggccaaggatgagaaaagatgttgagaggttcgtggcatgttgcaccacttgtcagaaagctaagtctcatttgaatccacatggtttgtatatgcctcttcctgtaccttctattccttaggcagatatttctatggactttgttttgggaatgcctagaactaagagggggagggatagcacttttgttgtggtagaccgtttttctaagatggcacatttcataccatgccataaaagtgatgatgttgttcatattgctgatctgtttttccatgagattgttcgcttacatggtatggcttctactattgttttagatcgtgatgcaaaattcttaagtcattttttccgcacaccatggaacaagttgggtacaaagctattgttttctacaacatgtcacccacaaacagatggacaaacagaggtagtcaaccgtactttgggtaccatgttgagggctattttgaagaaaaaattgaagatgtcggaagaatgtttgcctcatgtggagtttgcgtacaatcgggcaacacgttctactaccaaggtaagtccttttcagatagtgtatggtttcaaccctcgtgctcctattgatatcttgcctttacctactagtgagagggttcataatgatgcaaaggcacgtgctgaatttattttgaaaatgcatgagacaaccaagcacacaattgaaaagatgactgaaaagcatagaattgctggtagtaaagataggcaagaagttaagcttgaaccgagtgatttagtttggttgcatttgagaaaggatagatttccagaattgagaaagtctaagttgatgcctcatgctgatggtcctttcaaaattattgagaagattaatgataatgcatataaacttgagttgcctcccgagtttggggttagtcccacgtttaacatttcagatttgaagccatacttgggagaagaggatgagcttgagtccaagacgacttcaattcaagagggggaggatgatgcggacatcactacctcagatacacacaacaatcctccaacggtcattcaagtaccgataacaagagctcatgcgcgataattgaatttagaggtgagctcattcctatgttcttctttgtatgaattcgagagtagattgctacctaatgattatattgtgattagaaacaatggaggagacaaggagacacttggagaaggacttagagccatggaggatcatcgaggacgtccaagttaaagtggaggcccaaaccaagccgacctcgagtgtaattcagagtccaggaccagtctgcactaaaacgggcgcccaggtcgcatacatgctcggattggggcattctttatatggatggaaagctaagaagataacctttccaatggttttcgtcccacatccaaattatatccaagtcaatgggaatcgaccgaacaatttgacgtccagaatatgtcacggtgctgcgtcaccgtatttgggcctttgggccgtgtatcgtgttagaacccattagggttgcgtcgagagggggttgcacgaccctaaactctatatatcagtatccgccgccatctttaggtttttgggttttgcttagattattctgtcgagaacagtttcgccgctagatcggtttgtaagaccccaactcgtgagtttaatcattcatctgcaattttggttgttttctataccgttctcttttgtgttcttcgattggcaaatagggattagccttctcggtgaggtcatccgcgtttcgacacgggtgataaacagaggagacgtggtgctgcgattgcggggctcaagagcgtccgcgttcgagaagccggatcgatttgtgtcgcgactccgcccaaatcgttgtttatcagaacctttcagaagatcgggaaccctagtatttatgtcaggaagggaggaaccttcttttgccgagcctgaacctgagccttcaacatctttgggtctgactagagagtcctccccagagccatcgccggattccaaagaaattcaagctccgggttgtgctcctaaatttagggatgatcctcatagcgattatgagaaaaccttgacgggcatcctccctgataatatgttgatagaggaagtaatgacggttctgcttcatgagtcccctgaatctactctagaaccggatgatcttcatttcattcaaaaagattctggtgagacctttgaattgcactccaaagaaccaccatcacagcttccccatcgagcctgaaccttattcctctggccatcaaaatgttgttcttgacatttgtcaagaaacaaccttgttcttgcacgatgcatctcttgggaaggagaacctgcaagccatggacaagcttgagacaccaactctagaggatgaaagtccacaaatgagcatgaaagattctctttcaaagttcctcagtgttcatgctcacataaagaatcctcatagttccgtccgattagtttcacttccttgtgcaagaaccataaccgccttagggtcctcatctctatcatgtttagaaggttggttgtggatgcttttatttatcataaatattgcaaatcttgtatgtgtctgtggcactaatcttgcagcgagatgtctccatggtcgagcttgtgaccataaacaaagcaatgccgggagatatcccggattatcttggtaacttttctttccaataaaagtaagaatcagtttttaggatattatgcaccttcgggtattcttagtcagtaaccatttcaggctgagattaagaatgagggacgtacgatgcctaagaacataggaactacatcaactgctcattttggtgatccttggtgttggtacacaccttataaagatcccagtctcacacacttgatttttgacgtctcataacgcaaaagtccaagtgtgggggaggaatgtcgacgagcttgcatgacaagttccatcaaccaaggccaccttgtttgcagttggcgttagtcttaccttgcagataaaaaaagaaaaaaaagaagaaaaaaagaaaaaaagagagacagaagataaaaaaaagaaatgaaagatgggacaagaggaagagagcaagagggctgacgggctacatctagttcaaagaccgcattatgtgcgagtttttaaaataggccatacacctcgctagtagcgatcatgctacctcgctacaccaagcccctctcttgagctcatgtgccaccttggcttagccttcatccactcctagttgtgcacaacctctcgctcctgcaacacctacacacatacaagcaagaggagatgccctcttctttcctaggtgtttgctgctacactctagttggcacttgcatctttgcctaagaagagatgcatcctacgtctctacaaaattttgccaacggaacacgccttcaaggcacaaggttcttgcacccgagatgtgggcataaccgaaccacttgcttgagttggtgtggtcaaagtaccttccttcgccacaacccacatcaagacggaggagagattgacaatcacatgtgaccatgccaccgctctagagatttcaacatatacatcatgctggcggtaagtgcactcaggtataggacatgaagcaaaagattcaccatttcttttactcatacttatctctagttgagtctagcttgatcatatatggttatgcgtcctcagtccatttttcgtatgctatggtttgggtggtcgtcaacattcataggctttttaaattaagcatgatgcttatgataaatagtctgctttaatcaaagttgatgtggtgtcaagtttgtttaaatgaaccgtagagccagtactttcatggacttcggatgtatatccttcgtagactaacccctgcaggaaccttttcaatttgacgggtgagttctcaagcatgagtcacactggaggtaagtcaagggccaggaacaaatcaattgccataacaggcaaaggagagacatatcacctctcaagttgcacggtacgtatattgccaaatactcctttgctatgcttgtaactttatctcagccatgtatgagttctgcttaaatagaagtttggtgaaccaaaaaaaatgtttttaagaataaaagaaatgtctctcggagaaaaaaaaaagacaaaataaaattatggcaaaattatgggatccatgctcattaagttttcaatccaattcctttatagcatggatgtgaacaacaaattttgaggctatgataaaatcttttcaattttttgtagtccctcgagtatttgttgtccactaaccttttgcatgaaaataaaaagacaactaaggagcagtgtagaataacctcaacattcataccacgctccttggactatgagaagacagatgcacagggaaccaagcagagcaaatgcaatactttgttatagttgattcggttcaaagtttggtaagttcgatctggtaataatctcaaacaccctgtgtatcattgcgtcatatagtcgtcctgctaggatacccaccatgctcattgttgccataaaaaaataaaaaataaataaataaataaaagtgaaataaaataaagtaaatttaggcacttcatccgcctagagttacttaaataaaatttggctcaccggtattttaccccagtagaagtccattttactttccatgtttttgttgaataaagacaaggtacaaaacaagtgtgggggaatcatttccgaacatccgacgcgcaacagcatcaactcaacatgacaacatgatgaacaccaacccacggctgcgcacaaaattcagcagccagaacagagtcctggctgggtcggttgaaccaagtgttcgcccaacccttgcttggtccgattctgtcatccttcgccgtgtggtcaggtttgcgcgtctcctcccttatcctccactatttgtgagttaaacttggcagaaaaattgaatacaaatttagtttgactccaaatgaaaattgaaaacattaactctcaacaaatagaattttcctatgattgatcatgtatactttttattctttgctaacacttgtcacttgtgaacaaacatctatcatagggaaccttgctcatctaagtaattgatgtatgtgatatggttatgacgaaagaaattcctgtccaactgtcatgatacttgggattttgttttgtgaaattaaaactttttcgagcaatactcctcagtgactatataattacctaccaaggccatgtataattatcattgcagaaacctttatatatatgtatatatacatatatgtatatatatatatatatatacatacatacatactagcaatagtgcccgtgcgttgcaacgggaaaaacactgtttgatagtgacaccttgaaaaccttaaatcggtaaaaatcaagtctaatttgatatattaacaaataggtagaaccgagtctaatttgatgaattagcgtagaatttatgatttagttttagatttatttttcgagcctacttaggagcttatccgacggattttgattttaaaaatctaagtcacattgtttgatcaaatttgctttcgacccaggtcttcctagtcggcccaaacttgggctggcccatcttcggcgagctaattcaatttgacatcccgcaagccgagcagctgagcgcggcccacatatgcggggacggtccgatgcacttcgacggcccatttggcacagtgtaatcagcggcggcggcggcggttttttaagtagtatttttttcgattcggatctatagtttttttcaccacttaggggaaaaagacttttgttgttgttgtttttctttattttattttttgtgtggcttttctttttctttttatgcactttctgccttcattctcccttttattatttttttaacaaaaacgacctcaagtaccttattgcaagattatagggactcaaatgtaaatataaaaattacatggactcaaatgcaaaagtacaaaccaaaaaattaaaatcatataaaatggaatgctctcgaccgtaggttccgtttttgcaaatatatcttcaattcgacacatcaatttttcaccaatgtagagtcagactttttttttcttttttgaaagggaagtcggacttttttttcttttctaaaagggaatcggatataggtgtcggacttttttattttattttttcgctattatttttttttgacggacgaaggaagcatctctcattttgacttttattgttgttgtttttctttattttattttttgtgcggcttttcttttttctttttatgcacctttctgcatttgttctctctcttttattatttttttaacaaaaacgacctcaagtaccttattacaagattttagggacacaaatgtaaatataaaaattgcagggactcaaatgcaaaagtacaaactcaaaatttaaaattatataaaaatggaatgctctctgtaggtttcgtttttgcaaacagatcttcaattcggcaatcaatttttttcaccaatatagagtcggactttttttcttttctaaaagggaagtcggacttttttttcttttctgaatcggatataggtgtcggactcttttattttatttttttcgttattatttttgttttgacggacgaaggaagcatctcttattttttaagtagtatatatatatatatatatatatatatatatatatagatactactatagagcaccctaaggtgctacgtattaaacagcacctgatacagcttctaaccccacccctccaccctcccaccctgctccccaccaggtccatagtacgtagttaaaatttaactcaccaacgaccaatctcgatcccacccctgcgccccctcccttcactcccatagtccgagtaaattttttacttgatgttatccaacttcttagtagttctatatatagttaaaatttaactcatcgatgaccaatctcgatcccacccctgcacctctaccgccactcccatagccgagtaaattttgaactcgcgcaccaccaagagctcccctcaccccaccatgtcaacactcctgcccaaacaataataattttttactcatgccaataattctatttataccatccataaccatcttaccgtatctataaccatccgctggaagtaaaaacattactaaccctaataattattatagggaaaaatatgtagcaaaccctatatgtaatgcaaacgtagaaactaccattggatcgaaaaatggacgcccgatattcgtccacataacatgagttaaaattttacccgcaaattcactcatgagttaaaatttcactaggagtaaaattttaactcatgcagacgtggacaaatctcgggcatccatttttcgatccaatggtagtttccacgcttacactacatataaggtttgtgctatatatttttttctatttatagagcccatgacttgcggggagtcaaaaaattactacctgtagaacaagggcctaatttttactgaccctgaaaatctgcttccgttaagtaaatgttttactggtagtgtgaactgaataaccgagaaaatagggattgggtggccacgtggagatcagcagggggagcgctctggctgagggtgcggggaaaaacgaaaacacgatctgtgggagaaaaaacggaaaaaccggagaaactctgcgctgtgtgagtcgcgccacgatgttgcatagcgcgccatgatccgtgagtcgcttcgtatagcgctaccgtatatatataactactatatggcaccctacgtgtcatatagctaaatagcacgtctcaacgtaagccctcccctccatcctccacatcctccacccaccacatcaagatgttaagtaattttttaactcgcgaacgaaaacataaagcgctaccttattggatgagagacacacgaaggtgcgtagtaaaatatttactcacgcgccatgtgcagctaccctctttcatattgagatgtttagttatatttttacttgattaaaatatgagtatttataccgtaggaaatcctatccaaccattccttcctccgtcaattactccatttttttgggatctacggcacggcagcctcaaccgtgattccagcagaggaaaggatgacgactccttcaccgcgcgcttgccagcgagggcttgatggctgcggccaccggcgacgaagaagatgttgaggaaacacagggctaccggatcggaaggatggcgacgagagaagccaaagatggctatgggcgttgtcgctcccctggtctagccatgggcgacgggcgccggtgtgctttccgagccatctccgccatgggaggaggcgtttgacagtgttgtgggcggtgtcgctcccatggtctagccatgggcgacgggcgccagtgtggtgtcctggccatcgccgccataggaggaggcgtttgtaggcggcgacgttccccttatgttgcggctggaggttggctgtccctgtgctatgcttggattccaggcaaatctggcactgatggctgacattgcccgtgcatggccacacctgctgctcgtcaatttcttccacatctacaagctgggtcctcaccaacaccggtgtcacctctcatgttggtccctagctgtgctctcctttatctcctctctttcaatcaaaggggtgggtaacaacaaccctcttcttaccagtagaacaaatatatgtttcctcttcgatggtgcggtcttaatttgcaacagtatcgccttacatttgctcattgattttgttgtagattgccagcacccaaagacagccgaggacttcctcaagcttagccccagccccaaggttgattgacaaatgaccttgattattcgtgcatacgccaacggttcacaatccacatgatcaacatttgcattttagtaaagaatgtgattaccttcttttgtttagttgccgctgctagcatcctacgagctcattaatctgaactaggggatgtttggtttcgattgtgaattgttgttcaattcttaggattgttatctgaatggaatatctgatggtgattctgtatcagagtatgtactacttttctaaattacatatgactaccacccattatcaaaatccatgcataaaaaacagaatcattttttattggctcagacctgggctgtaggcaggcactagaacggataccctcatctcaatcgggcggtaagccccatctcaatcaggcacagcgtccgtcacaggctagaagtcactgatgtgaagagttatctcaatcgggcaaatggccgtcacgaatgaatatatctcaatcgggccctaagtaaagcccgtcaccgaccagtcaaactatagcccgtcacagatgacctatctctatcgggccacaactagcgcccgtcacagatgactactaacctttatcgggcctaaactagagcccgtcacagatgatactcatctcaatcgggcctaaactataacccgtcatagatgactgatgacctcaatcgggcctaaactagagcccgtcacagatgactgctgacctcaatcgggcataaactagagcccgtcacagatgactagtgacctcaatcgggcctaagctagagcccgtcacagatgacctcatctcaatcgggcatttagttatggcccgtcacagatgactataatccacaaaaaaaataaattttgttttttgtctagcctcaggcctttgctagccatgcccgctgcaaaaatgacagaaacaaacacagatatccaatatcctcagctccccagcatcacccattcatacatatgcattcacatacacagacatcaacatatttcacacaaccacacattcacagccatctcatatttcacatccattcacatatttcacatccatttaaatatttatcatatttcacctgcaaaaccgagttaattggatcaaatatttatttagcaagtcttaacataaacatatgaaatatatacataaatataagcatcacagttacatcatcacagttgcataataagtgttcatcattgcctaaacatagaatttcaacattgttcatcatttcagtttaagcctaaacattcctttggggttaattatttcgcggaggatgaagctggctatctcctcgcgaacctcctcaaagctggtagtcagagacttggttattgtgccctacattgtcataattctagattagttgatcgatcatatataagtactaaaatgtagttagtctatcacaattgagaccaccgacctcaaactcagccaaagtcttcaccttttctctatacagaagtcgtatgttgtggcacacatggaatccgcactggtcacctatttgttgcttcaccgggaagtcttttttgtggatgagggtgtcatgtcctgtcttcctgaggcctcctctttgcacgtattgggcccacgcttcatctatcgctagttgaattgaggtccaatcatatgcgttcttatcaattctggagttcaggtaatgacatgtactccatttaggtgttatgaccagaaggatccaatgggcactgcgacattaatatagtgaaagttaattaagtactcaaggaatgtgtcatgctgttatgtcttactattgattataggcacacataatgtactccttgtctcggcgggaccacaaggtgtcgtagatgtagttgaccattccttgacggtcattctggagatttgtgacagtgaccacttgtagatcaaggaaggcaacttccggtgcatgcttcttacaccattgccaacttaacctacacacaggatcaacgatcttgtaagcaagttaaaccgattgttattaccagaatgagttgggcgacaatacttacaaggagtagcacttaaggagacttgtgtccaccgctcggagcctgtagaggtcgaaaagatccttgaagtcgatcacgacataatttattggaccaaggaatggctttccatcgtgctgtccaagtatatcggtagctttacttggcttcctggcgttagatttctccatgtagtataagtgaaggtccttgcaagcggtgcccattgcggcaagcacgtcatctccaaccaatggcatgcctagttggaactcctgtggagcgacgtatttcttcttgacctctttgcccttagtctcttcctggcccttgcccagatctagctttcttggagctagaagcgaggtctgcacctttcctccccttcctctccccttttcttcgggtttatcgagagtaattctctgaggggaagagtgtgccttcctgctcttcttcatcggtgggggttcatgaatcgccttgctgtcggcctccgttcggtcctccccaaaatccgtgtcgtactgcaactgcacatcgtaagattgtgcatgacgatcttgagcatgaggggctgaaggagcagtggcgggtctctttggtggaggaccgcctggtgcagtggttggcctcgctataaccctgatctcaatgaggtccttaggccattggatgaaggtaccacgggcatttcctagtgagaggacctcgtcgttcggtggatacttcagagggaacagctcgtattcgggcttcaccgagtcgacttgaacttttgcacagtcggccctgagttgcgctccatgcactcttgtctctggggtcggcttgtacgcaagtccctcggttgctagaacagtgaaggtcagcatcaccctaactgtgagggtgcagctcgttggttcctgcgatagattaatcaatttttttagaatattatatatcatatggattcgttacatctttcatgtattgagtaagttcacggttaccgttatgtggtcgacggcgctgtcgaccgatgttggattttctgccaattcagttgatgcgcaactgctgcgtttttcggtgggacttcctaactctttgtgcgcagcagcagcgccggcctgggggatctgttgctcttctcggatctcttgcctaatcttggccctcatcgactcgagcttttcgtcgaattcagatgtcagcttagctcgtatcgactcccggatcttggcttcaagtcgtgcatctttctccgccttgttggaagtccgcttcttgtactgccacgcatagtctggaaatccatacttccagggaacagaagacccaacgccccgtgtccgtccacggtgttccttgttgcccaacgttttcgtgaggaggtcgtcctcgcgtctttgagagcaggcctcttgcgaggcttgttgctcggcaaccaactccttctgcattacaatttagtggggtcaaataaactgcacgatgggaaacaatgcgaacatctagtttgactagacacttactatagcttcgtatactcgttgatcttctgcatttggcatgaagattgtgccatcatcatgtttctggtacctagccctggcccagttcctagcccgagggtgtgggatatcgccaaacacgagcggtgtgtacgattcctctgcttcttcatcctcacgctgccattcctcttccttaccggcatatccggcggtaccaagccggtgcggatgctggttcctggtctggagcaagcgatatgccttgcttctagctctggactcgggggtcgacttcttcgcatggaattcctcccagacctgttccgtgatccaaggaaatttctctcttggatctggatttgccgggttgtaaacgaactcgccgactagcttagtcttgaagttcttccaagcagtgcccataaccttgaaagcagcccgcctgagacggtcctcatgctccgcaggataatcaaagctctccttgaacgttagcgaagcaatgtccttctctgcggccggcacgagcttgaagtcgtcttgcagaatactgaatttctgccttcctatgaccccgcagatagacctaaatcggctcaatattttccttggagatgtcggcaaccctacggcgtccaccgctgttatgcggaaccgttccttaggaattttgttccctgtcctaggagtacgtgcccttgaggacccactagttgtcgtcgacattggttcgccttgctgagacattgtctacttttttccaaaaaaacaaaaaaaacacaattgagtgctacaatctattacaatctattaaccacatttcacaataatttcattaatgcaccacatttcatcccaacataaataaaccacatttcatcccaacacgaataaaccacatttcatcccaacataaataaatctcatttcatcccaacataaataaaccacatttcatcccaacatgaataaaccacatttcatcccaacatgaataaaccacatttcatcccaacataaataaaccacatttcatcccaacatgaaccacattgcatataaataaagttaaatgaaccacatttcatcaatcactacaatcatctatcacaaaattcataaatgcaccacatttcatcccaacatcgacatgtctcactaacagttcaatcacatatcatccacatccacatttcaatgacatgtcattcacagttagcagagggcggcgcaatggaggactcacctgaggatggccggtggggctcggtggcggtggcgcccgggctcggtggagggcggcgccggtcggtggagacaccgatcgggcaggtcggcaccgggcgggcggcgtcgtgctcggtgggggtcggcgacgtgggtcggtgaggacgcgggtggcgactacgaggaaggccaacaccggtccggtcggtgtaaaggctcggtggcggcggcggcgggctcggggggggggggtcgacggtgaggaggctcggcggcggaggtccgaatggagggccgaggaggctcggtggtgacggcggcaggcttgacgagggaggacgactgcggcggcggcgggctcggtggtgacggcggcgggcttggcgagggaggatgacggcggcgctagggttctaaggaggcgggaaactgtagcgggacttagaaaaattttcgatccgctctgagaaaccctagttatattagagtgatgagtcatctcaagcgggctttgccgtagggcccgtcacagatgactcatcggtgacgggctccatactaatgcccgattgagatgacattcaggcccgtcacggatgactcatctgtgacgggccctaagataatgcccgatagagatagattaatctctatcgggcttgaactaaggcccatcaccgatgactatttttccattttccaggcaagtctttatatttgtgagtacaagatatatagctgttgtataataattcattttattagtcataacatattttcggatagtaaatgatttcaaatcgaaatatggtcaacaacaaaattgtagaggttatcaagatctacaacttttattttggtcatttgtctatataactttgtttccaacagcttgaaattgattttgacaatatgacaaatataatcaacatttgtaattactaaatgattttaaatggaaatatggtcaacaacaaagttgatcctctcatcaagatctacaacttttattttggtcatttatctatataactttgtttcaaacagcttgaaattgattttgacaatatgacaaatataatcaacatttgtaaatactaaatgatttcaaatggaaatatggtcaacaacaaagtttatcctctcatcaagatctacaacttttattttggttacttcttcatccgataaagtgatagttatattattcacaaaaatcacatttctctcatctggtttataaatatcaacacagatatgtcaattttgtaaacattggtactatcactttgtcggatgaagaagtgaccaaaataaaagttgtagatcttgattagctgtacaagttagctgtttatggctttcccatttaaagtcatgtaatatttacaaatgttgtttagatttgtcatattgtcaaaatcaatttcaaactgttggaaacaaagttatatagacaaatgaccaaaataaaagttgtagatcttgataacctctacaattttgttgttgaccatatttcgatttgaaatcattgtcacttattccgnaagagattacttgctctactcgcactctacaattagaaaatggaaattatttgatacccagcagctatatagttttgtactcacaaatatacaagacttatctgggcaaatggacaaaatagtcatcggtgacgggccttagttcaagcccgatcgagattaatctatctctatcgggcattatcttagggcccgtcacagatgagtcatccgtgacgggcctaaatgcaatctcaatcgggcattagtatggagcccgtcaccgatgagtaatctgtgacgggccctacggcaaagcccgattgagatagattaatctctatcggctgtaaactaaggcccgtcactgatgactcattttccatcttttatttgttgtgagtgcaaaatatatagcctatataatttttattttggtcattattctgtataatttttttcccaacagcttgaaattgatttcgacaatatgacaaatctaattaacagcatttgtaaatactaaatgatttcaaattgaaatatggtcaacaacaaagttgatcctctcatcacgatctacaacttttattttggtcatgtgtaataaaacaaaattagccatattaatgactacacatatcaagtctatgcaataaaacaaaatactttattcattacaatagataagtacaaatgcatcagccacaaggttatgccttcggtatgatctgaacgagcatatgccacaggctcttggggatcatcgtcaaggtcaatgtgaggtcttatatgaagattatggttgttttcttcttcatcgacgacgttgtcaactcctacaattcggcgctttccatccctcacgatgtgcatcttcttgtttgaagggtcttttatgtagaatatctgctcgacctgtttcgcaagtacaaatggttcataggcgtatcccaccttagatagatctactaaagtgaaaccttccttgtcggctttgacaccagtgcgtagattcacccaacggcagcggaacaaaggaaccttgaacttgacgtagtttagctcccagatctcctcaatgtggccgtagtatgtgtttgacccaacttgatcctggaatgcatctatacggatgccgctgttttgcactgtgcttttgtcatcttgtttgacggtgtaaaatgtgtatccatttatatcgtatccttgccatgtgtctatggtccaagacggtcccatccccaacaactgtactgtctcatttgggacaaccatggacattgtcacacgattcttgaaccattcgttgaaccgagaattatgttctctgttaatccatgcatcagatcgccccaagttctcatctcggattttcgctaagtgttcctcaaagtatgggccaacttctgccatatgttggagcatagcgtaatgagcctgcgcgtacgacgcttgatcgggcctaattcttttccttccgattgtgccaacacctgacaaccttccctcgtgacgagacgctggaactccgataggatcggcatcggacatgtaattgacacagaactcaatagcgtcctcggtcgtgtaaccttcaatgatgctcccctcgggtttagctctgttacgaacgtacgacttcacaactcctatgtacctttcaaacggccacatttcccttagaaaagccgggccacatagttttgtttgcttcaccagatgaacagggagatgaaccattatatcaaagaaagacagtgggaaaaacatctccaggtgacagagggtattcataatatcggtctgcagcccatctagatcttctggatctataaccttctgtccaattgcattgaagaaggcgcacagacgttgaatcgtgtaacgcactttcggtggtaaaatgcctctaatagcaactggcaagatttgtgtgattagcacgtggcaatcgtgagacttcattccaacaagttttagatcgtccaatttaacatacttatcctcgctgaatagcccgatggaactttaatatccttcaagcatgataacattgcgatcttctcatccttcgatagtgtgtggcaggctggagggaggtacactttacctgtctctgcatctcgtatggactggagttcgctgcgaatattcatgtcctgtagatcaaggcgtgcgttcaacccgtcctttgtcttcccgggaatattcaacatcaggccaaccaaactctcacacacattcttttctacatgcatgagatcaatgcaatgatgcacatcaagatctttccagtaaggtagccgccaaaatatggattttttcttccacatacccttctcctttgtctagctacgttttcttttcttcccaaactcattgcttatgtccttgaccatattgtggacctcatctccggacaaatctttgggagcaggctgaagttctctcttaccattaaaaattttcttctttcttctaaatgtgtgacatagcgggagccacctcaggtgacccatgtataccatctttcgtgatttcttcagccaccggcttcgtgtatgttccttgcaatcggagcatgccttctttccttttatagtttgtccggaaagattaccgagtgcagggtagtcattaatggtgcaaaacaatagaactcttagcttgaagttctcctgaccatgtgcatcccaagtttccacaccttctttccaaagaatctccagatcgtcgataacaggctccaggaatacatcgatatcattgccgggttgccttggaccttggattaacaagcacaacataatatatttctgtttaaagcataaccatggcgggaggttatagttcgcaataagaactggccaagtgctgtgagtactactcatgtcaccgaaaggattcatgccatccgtacaaagacatatcctcatgtttctagggtcggcagcaaagtctttgtgttttcgatctatattcctccattcaatcaaatccgctgggtgtctaagcataccatcattccttctttccgtggcgtgccaacgtactaacttcgcttcgttcgggttggcaaagattctcttgaaacgatcaatgataggtagataccacacaacctttgccggaccacccctctttgacttatttccttcgtcagcacttttctttcgcttgtatcgagaagccttgcagacaggacaagcatccaagtccgcatattgcttgtggtacaatatgcagtcgttgggacaagcgtgaattctacagacctctaaccccagtggacacagaacctgctttgcatcgtatatcgtcttgggcaatgtgttctcaacaggaagcatagccttcaaaattcctaaaagatctgtgaaactcttgtctgtctatccactacttgccttcagcttcattaggtccaaggtaactgacaacttagtgtgttttgctttgcatccaacgtacaaaggcgtctcggaatcacttaccaacctgctgaatttcattccatctctctcattctgggctgggtcctcaacgtcacgtaacatgtcttgcagcagatcgtgatccacatcaaccatttcaccgcccaatggagaaggtataaacatttcatgctcattttcatcttcctgattatgcgcaccacttctgtctgctgctgctccacttcctaattcttgctctccatgcttcacccaacatgtatggccctctatgaatcctcgttgtatcagatgaccgtgtacgtcctctccgctatcaaacatattctcgttcttgcaatctgcacatggacaacacatgtaattactgtttcttcttatccgatcctcctccacggcgttcataaattttattacgctctttcggtactccgtagaatgacgtttcaaatttttggcatacatccaacttcgatcaattggtacaaaataaaaaaaataaattagaggcacatattataagatcagtattgcaaaagtaagacgtgataaaattgctcaattaatgatttatattactcacttgattgatccattttgatcacttttgagaatttaatttctgttttccttggaaaaaggacaaaaaatcgcccccaacagcctcccaccaaaatagtgaacagtgggatacagttacactaggtggtggggggtatttatactgtgcaacaaatatctgtaatggccctaaaacaatcaaccgtgacgggcatacaagtaatctctatcgggccttaataaaaggccgtcaaaaaagagtgtcatctgtgacggacaataaacttatctcaatctggcctctagttggagcccgtcagaaatgaccctcatctgtgacgggtttcttttaggcccgattgagatatggaaccctcatctcaatcgggcctcaactatagcccgtcacagataagtgtcatccgtgacgggctttagttttatgccgatataccatggctgtgcgaccatatctcaatcgggcgaaacttcggcccgattgagattacttccttatgacggcccgcaaattccagtcttgttatgggccgtcacagatggaaggatctgtactagtgaggtcagatctatggcgcatggctggtgatgtgcgatggtgatgggtcaaccgatgtgtggactaggagcctgggacgcacggcgtcaaggccgaccacgtcgtcacgtggtgaagcaagccaggatagatgcttactatcgccggctatccaatgctgggccagctgttcttcctcactcctagaagaacatatttcttgtttttgtgggctagcttgatgtgtaatattttttcacccgcatagtgacttctacaatgtttgtattatttactcataatcaaattttcatggttcaaggtaacaaaacgaacggtaacatattgctatttcacatattattctaagataaatgaagcaacaaatgagaattcatgggagtaaaagagaacatgtagtaaaatacatgagtaaaattattactatgaggacatgagtaaaaatattactatgagaacatacgagtaaaaatattactacgaggaaaatatatccgagtaaaaatattactatgacaactcgcaaaatatatgcaagtagaagaattaatgtgagaactatatgggagtaaaaattttactaactttggagagatttttaccaaataagttatgtcacgcccagaaattcacttataatttccgaactaatttgtgcataaaatcctcgtccaggaatcagccgaggtacacaaactgacaatttaatattcaaatccatcataataataataacgttacatacttacaaaagaaaagaaaacagcagcggaattaacggtttagcaatggcttcagctccactcccacaggcagctcaactggggtataagccaaacgtcttctacttctggatccttttttttcaactgaggtttgatgattattgcaaggtgagcatatgacatactcaacaagccacacagcaaatatgcaagtgcacaaggataccaaaggatggcataatataggctcatttgcaaaagcagcatttagcaaagatttaagagtaaaccagtagagtaattaatcagaaatattaatcaacactgaacagcacacccatgctgctcaggcccaaccatccagaacaaccatacccggctgtacagatctaactccaaaccaggagctaaacaaattattaccagttattgcatcaataattatttgtgagaggtatgagactaatcacgaaaaacattgctcaacccgcccatgaccgcgggcacggctattcgaatagttttactctagccagagatgtaccattatacccacaagacacgattccacacatattgccataccccgaagtaccaccacggcactgcaaagggactccacagcgacccccatggacttctcgccgcttctcagtctggcaccccgtaataaactatgctatacaaaaggtaaagccgttgcccacgctggcttgtggttggcacggttaatgtctcacaatagtagctcgcgaaccggtccttaattgccatgagcacgaccttcaaaaccatgtgctcacaacccaccatcgacaagttttaattatcatttaattatcataacacgattaaccatcgtgagctaccattaaatataaccataaataataatgtagtgtgattcatcccattagtaagctaatgtttctaagcatggctaagcaatcatatatatatatatatatatatatatatatatatatatatatatatatatatatatatagcatttagctgaaccaaaccaatatataaggttctagctaatcaaattataacccatagaaaaataaagtcatcttcggccattaattaattgggaaaggctcaccacccgatgacattcgaaaataatgcataaattgaaataaaacattagctttaaacgggttcaacatgctcaaagggttgtttgggatctgtgtgacttgccttgcaataattagtcttcaattagtctttttaacacttccgacgcactcacgaaccttcgcaacgacggaaacgacaagctaacacgcaaaacgaagaaaaagactaataaaaaccaaataaacagtacatataatgtaaacaaacatgtagatcatgattttagatgaatttagagacttgaacggcctcattctgatttcatataaattaattgtgaattttaaaagatttaactctaattaaacctattaaagaaaagactattccaaattaattaaacaatttacaaataatttatatctgagatataagactaaagcatcctccggaaattattgtaatgaatttagtagacgacatatagtaaaaagaactaatatgtcattgaaaagagataacaggatttatattgattttgatggccaagatggcgctgatgtcagcgatgacatggctgccacgcgggatcgacgccggcgagcacgggaacggcggttaccagcgaaccacggtacaatgatgcaaaccgagggcaccgggtgagagaggagatcaaggcgacctttaccaccacttacgcgacgacagacggcgagggagatggccgacggcggcgaagtactgtccacggcggcgacggtgtttcggcgacgagcagcagcaacggaggggtggacgagcttctcctcgcagctgcgaatccaatggaagcgacggcgaccaaaggcgaccatagacgacaacgaacggcgcggctggagatcggaacatgacggcaacccactggttcatggtgagattgacttccggcgaggtttcggcgcaaggggaacggcggccggggtagctctcacccttgcgaagccgagggaggtgacggggctgaccggcgacggccgaggcgacggcgcacggcggctggagaggcgaccggaggtggagagagagggagctcgcggggaggcggctagggctagggaaaaactcgggaaaaagagggaacggaagaggaggtcttgggactgctatttatagccggaaaagggagagatcggctcgggaacggaggaatttggtgtaggaagctaggatttatccgagttcacccgaataaaaacggccaaaattcgtgagatagataacgaatttgatgggggtttcttgtggataagatagaggagatagagaggaatccgtttttgcaatcaattttggaagggaagcaacggagcgaccggattcggcggagattggcgccggtatcgggatgaacacggcctctgtccagccggctggaggtaggagaagcactgtagcgagagggagtataattagactttaggctgggctgaggacagagagaagggatgaaggaatgggccgaaaagggcccaagctgaggaggaggatttttattacttttccaaataaatcaatcaccaaaatgatctttgaattgttaaaaatacttccattgctcaaataatttcagggaaaatcctgaaaatacttggacactcaaagtacttaaaaaaattaaaataagatcatttaatgattaatttaatatttaaataattgctgaactgctctttgtatgattaaaattaagagttgagctccgaaaaatccgagaaaattccagagattataattaaccatggagaatttaataaaaattaaattcatccatgctttatatttaggaaattttatttcccacatttaacttcacttgtaaattaatgaacatttaatataaattctaataataatttattaaataatttataaatcctaaaacgaaaatcaggatgtgacaagttattactaccatctacatttctctgttctcgagctgaataaaaatggcaaacggaagaaaatatactgctaaattataaaaggactggattcagtaaaaattttactacagtaaacttttacgtttactctctagtaaaaaaaattactattgatggaaagttgaaggaaaggaaagcaccatgtacaaactttttactccagtcaaactgtgcatggatggatgggtgggtacgaattgaaaggagcataaaatccggaaacagcaggaggaaataaacctcaagtaaataaattactcctactatggatgaaacagagagagaagatagtgatcctatagtgatttttttacttttgagcgatggatgaatggcgagcaggaagcaagttattttactgaagcagtgatttttctagtggacaattgatacatgcgtaaggactataggaggaaggaaattattttttttttactgaaaccggggaggaccggtcaatgccgcaacttaagaaactaaaacgagaaaactggggaaacgatggatgcatgtggatgcggaaaaaggcaagtaagttttttactactggatgagtgcacgagggatgtgcggcaggaggagaaaaaaacggaaaatacggagggaagagtctatttcctagcgcgtcagagacgccatgtaatatatatatatatatatatatatatatatatatatatatatatatatatatatatatatatatatatatatatatatgctgcttgacattacatcgagctttgtcaaattattgtgacccatgtgagatgcttttcgtactttcatgatcaagattacacgcacactcgacatacacacattatgctaaatttctacactggaagctagcatctctcatccatcatttattttatccattatccacaaaataaatactccacctcatttatgcctcttgcttcgaaattctttcaaagaaaaaaaaagagaggaagagaggtatgactatgcaaaagaaaaaaaaaagataaagtcttgctcatacaagtatggagcgttgataaaaaaatgaataaaaaaaatcttgctcatacaaagtatggggcatgataaaaaaaaaagggaagaaaaaaaggtagccatgcactctctcatatttccaatgaaagaacattggaggaggaggtatatcaaaggagttgttgtcttcaattttccattttccacccataaaacaaccatacacatacatacccatacatatatcacacacatgcacattcttgatcagagagtatgacttgctatctcctttggtccggtattttggctttgtaatatatgtgatgcaggtatgcctggattgatccctaccgagctccacctctatagcctgttagaatagggacaattcggcaaacatgccttggtgaggatcgacaaataaaatcacatgagtgatctgagagaaggtcatttgaggagtacaactactttgcgaaaatataaaaaaaccctaagagattgacaggaggaataagatggacttgagttacgaccgttccattcatcaattgcccaagatggtaagtttgacactgcaaaagttcacaggtacatgtgtggcttaacatattttgtatacttgtattatatcttgggaaattttattcctcattaatccttaacctttactcgggacgagtaaagagctaagtgtggggggtttgttgacggctgttaagtgccaaaataacaccgtcaatacctgtataaaatcataaatgtgaaacatctaacatagtggtaggatgtatttctaacaatttccacgagtgttggtgtatattcgtatgcaggtgatagagagtgacatgggagagagtgagcataaagaatggaaatatattttgcactaacggactcacatggttttgagctacaatatataaaatgtgcaatcatttggagtcaaatcatggagtatcataaaaatagggcccacatgtcagcatcctgaaaaggatgtgggccaggggaactagcagctagcccaatccagcccaacttcggtatgacggttgtcctcctcatcctatgacagttacgagcgttaatactggtagaaaccgtcatcaaaaggacacatggcaagaggagaaggaagatgctctttggattctatggagaatattgcgggcatctccactctctcaagttacctccacactataaatacccctctcttctccctcattcacacaaaccaaagcatgagctgaattacaagaggctctagtgtattttattgtatattagaatagggagagtgtaagatagaaggaattggaggaatcccggagttgtcggtaatctcctcctatttttgtatcttgttaattactctgctttaatagaaatatcatcctgagtatttaagattttcttagtgagaattacttcttggttagttcctaattagcatacaggatcattgttcactatagtccatttatttataatgattgctttagtgtttgatcggcactagagtagttattaattgcgtagacgcggtgtctgggtaattaatctccagtggttgctgcgtatcgcacagtacatttgaggtgggtgtagaggtggtgacagccctcaagagcactcaaatcctccctgtccgggtacgtagtagagcgatatctaggaatagcgggttgccagtgcctgaagtattgcgttaggattaaagttaagctttccctagacaatatttctcattaggaaattctctctgtcctctgcccacattagctttgtttccttggatgaaccggaggaagagataatcacacacgttcctttggatttgatacccttggaatactccgtaggggaagtgctacatcggtatatccgtgcgcttgcggattctatctggatcgtaagaaatatcaacattgttgcaatatcaaagaatgattgcaacgattcatgtttgcgttgcaatacctatagactaattcgcaacgatttaggtttgcgttgcaatacctatagactcatttgcaacaaagtagtttcgcgttgctatatacatgaatcttataacaacgctctaaatttgttgcgacatggataactattgcaacgataacaaaaagcgtggcaatattgtcaccctaattacaacgcagatttattcgttgcgatacttcctacttattgcaacaaaaaaaattacaatcgcaacactacgcaattagtggcaatatgcccccctatcgtaactaaattagacttcggtagcaataacccctatgtattgcaacgaaaatcacgtcgttgcctaaaatttcgtggcattagcccgaaaaccttgtagtgactaggcaaactctaacgggagataagctagtaacacaaaaattaattctacccgcctgttagccttgcaccaaagcaacttgtatatgctaaaaattgaagcaattgcagaaagtgaacttgaggccagcacttaaaagcttgaaatgaatttgagagcaagagaggttgcgaaggggagtggaaaatgtgttcaaatggggtgaacttccctccgccggccattctcctcttatagaggtcccataggctataactgccatatggggtgtggggacctgttaacgaccaaatttggtaagatgtgaaccaggttcaacattaggatcgaggcgaattcgatgaagagatcgattcgaagaacagagtatgcatcggctgtgaaggtatcggctggagtgtacattggctgggatggatcggacagaggatagtcgatacagccgatggaggcaatgcaaccgattacgatgaagacagcttcgaggctgtttttagaatcgttcaaagtgcttcacaaggattgccacgatagagataaagctctcggtttgggcaattgtttcaattaattaggatattttatgtaatttccttagagatatgtttgggcaaaagtctatcgcaaagacttattgtatcttagagtttgttagagataagtgtcgtgtccggcaaggacatattttgtatctcgggtataaatagagcccgaacccatgtaagcaaacaacacacgttcaatacaatctcagcgcatcgccacccttttactttcgtttactttcgacgagttcttgctttcgggttgagctgcatcggtttcgatcttcaactagaggtaaagcttgttatggcggcttgcgttctcgggattagtgcttttatctttatgatactctaatattgtttatgtaattcgtcaagttatcatatatcctatataatctcttgcaatattgttatttaaccttcaattggctgacatctatcattggaaagcagccgattaggttaaatactaatgttgacttagactatataagatatccaccaccctatgaaacattcaatggcttgattgtctagatattgtccttcttttcatatttatagctgcatcagttgagtttgatcttataagtcgtcattagaatctcaatctctagcctgcttttggttgccgattagggcagtatcggagtttccgccgatcttacctgatttaactcttttatatctcatatgcttgattgagatattaaatccgccctttatgttaagatcttgttgcgtttaggtatattaagctttccgtttgatatattttgcttgctttaatatcttaatatagagtggtatcggagtactagccgatacatgctagatctatctgatcggctatgctatgaatgcttataatctccttgttaatatatatttcgatctaagtgatttatactatctcggcatggcgatgatctatcccaatcacttgatttaaacatatatcgacgaaagcattatataccattgatatctacagccgattgaatagattaagttctttcttgcctatttataactgccgatcgactcaaatatgacatcggctcaaagataaatgatacgtcatcgacgactggctgatcggctatcgtttatagatttaaccgctattttcctgtctttatttcttgttaattgcaggatcaaatcaactggcacgctcacaaacttaaaggcaagattttttggacctgcactggagttaagcagatctcccaggcctcgtgtttttcgcatcaacaagacccccagtttaatacaccggaaaccccatgtgtcttgcaataccactccctgaatcaataggtggtacacatgtagcacaattgaatatcacaagctgacattgtttacaggtatttctacattaataatactagggtagcccaaacaggtcccaaaatagaccaagcatggtcatatacattacaagataccaaaagaaatagatagggtagcggaagcgaagcagcggcgatccatcgtactccacaggcaacgactggtgaacctagggtctcaaatccattgtcttcgacatgcactcgacagcattgcataaatataatcgactccaattcctttctaaaagatttaaattaagcaagggtgagtacatacgtactcagcaaaccaccactacaaaatgcatctggtgctcacaggggaccaccactacaaaatgcatctggtgctcacaggggttcaaggatggcttggtttagttgcataaagctagttttcacaattcatttcataatcctatgacttagcagttttaactgaaaaacaatgttaatgttgaagttgtcattaatcgagggttcatccaccttcccacgcctcgcattccattttacaccaactctaccatattcccgcacatcgggcaaggttactcatgtcttctcttctctaaactaagcaatgttaaaatctactagtagcatacccgtgctaacgctacggtgacaactaatattgcaaatgaaacaaccaaatgacagcgacacaatatatgcttcatgaatggtacatagaacagatagttaggctaaaaaagcgatagagttattagaaaaaaaattaatcaacatatctatccacaataccatctaggaacaagccatcccttgcaatgctataaagtacaggtattactcctctcaaatacacaatataataaatatctaaaattagcttgacttaagccatccatttcgcttgatgtggtcctgattatctggacaaggttacaaaacaaccaaaacgtatattgtcactctagttatttgtatttacacaaaaaagaatattggtcatttcataacttgaagataaactactgtgataagcaaggtggactcgcttggatgactaacaaatgaacctctgaactaaaattgacgctcatttaatacatctgtaatcaaagtcagttgatcgatgttttcatctatgtgtagaaataaacaacggcaaacaaccgatatagctaaattttgcccaaaaaattacatgtcttgtcatatcactaacaagtatatgcatatgactaaagtttctgcatatcattagaaatatatagctgcattcaacattttgaaaaatatatattgtaatttatgaaccaatgaatcactaggggtaaaattaaaatgttatatattttatacattttacatttttaaaatgtggttaatgatcaaactatcatgactctccaatatctcaaatcaaagctgtagctatatatatacaaaacacattgtggtttgaggcacttttctgttgcactggaaaataaaatagataccaatcaaatcgagaatactgaaaaaaataagaattaactatttatagtctatagtaaaaccttcacttttgaaacctactacagactcatacatacttgagtctagttgaaggttcaggctttcagctcactagtacagatccttccatctgtgacggcccctaataagactggaatttgcgggccgtcataaggaagtaatctcaatcgagccgaagtttcgcccgattgagatatggtcgcacggccatggtatatcggcataaaactaaagcccgtcacggatgacacttatctgtgacgggacatagttgaggcccgattgagatgagggttccatatctcaatcggaccctaaaagaagcccgtcacagatgtcatctgtgacgggcaccaactagaggcccgattgagataagtttaatgctcgtcacagatgacactcttatttgacgggcttttattaaggcccggtagagattacttgtatgcccatcacggttgattgttttagggctgttacagatatttgttgcacaatataaataccccccaccacctagtgtaattgtatcccactgttcactattttggtgggaggctgtagagggcgattttttgtcttttttacgaggaaaacagaaattaaattcccaaaagtgatcaaaatggatcaatcaagtgagcaatattaatcattaattgagcaatttcatcacgtcttacttttgcaatactgatcttataatatgtgtctctaatttgttttttattttgtagcaattgatcgaagttggatgtttgcgaaaaatttgaaacgtcattctacggagtacagaaagggcgtaataaattttatgaacgccgcggaggaggatcggaaaagaagaaacaatgattacatgtgttgtccatgtgcagattgcaagaataagaatatgtttgataacggagaggacgtacacggttatctgatacaacgaggattcatgaagggctatacatattgggagaagcatggagagcaagaatcaggaagtggagaagcagcagacagaagtggtgcgcataattaggaagatgaagatgagcatgacatatttataccttctctattgggcggtgaaatggttgatgtggatcacgatctgctgcaaatgttacatgacgttgaggacccagccaagaatgagagagatggaatgaagttcagcaggttggtcagtgattccgagacgcctctgtacgctggatgcaaagcaaaacacactaagttgttggatagacaagagtttcacagatcttttaggaattttgaaggctatgcttcctgctgagaacacatttcccaagacgacatacgaagcaaagcaggttctgtgtccactggggttagaggtccgtagaattcacgcttatccaaacgactgcatattgtaccacaagcaatatgcggacttggatgcttgtcctgtctgcaaggcttctcgatacaagcgaaagaaaagtgctgacgaaggaaataagtcaaagaggggtggtccggcaaaggttgtgtggtatctacctatcattgatcatttcaagagaatctttgccaacccgaacgaagcgaagttagtacgttggcacgccacagagagaaggaatgacggtatgcttagacacccaggggattcgattgaatggaggaatatcgatcgaaaacacaaagactttgctgttgaccctagaaatatgaggatatgtctgtgtacggatggcatgaatcctttcggtgacatgagtagtactcacagcacttggccagttcttattgcgaactataacctcccgccatggttatgctttaaatggaaatatattatgttgtgcttgttaatccaaggtccgaggcaacccgacaatgatatcgatgtattggacgaggataagtaagtatgttaaattggacgatctaaaacttcttggaatgaagtctcacgattgccacgtgctaatcacacaaatcatgctagttgctatcagatgcattctaccaccgaaagtgcgtcacacgatccaacgtctgtgcgccttcttcaatgcgattggacagaaggttatagatccagaagatctagatgggttgcagaccgatattgtgaataccctctgtctttctttgataaaatggttcatctccctgttcatctggtgaagcaaacaaaactatgtgtcccggcttttctaagggaaatgtggccgtttgaaaggtacatgggagatctaaagtcgtacgttcgtaacagagctaaacccgaggggagcatcattgaaggttacacgaccgaggaggctattgtgttatgtgtcaattgcatgtccgatgccaatcctatcggagttcctgcgtctcgtcacgagggaaggttgtcaggtgttggcacaatcggaaggaaaagaattaggcccgatcaagcgtcctacgcgcaggctcattacgctgtgctccaacatatggcagaagtagacggatagtcaaacgttagacacagaaacctaggaattgagtctttttggaacagagggagtagatgcaagggcacaaaactcggtaagggtgaaaaaaggcattatattagttagcactaacctccaggctttccaatattgacaagattaacaaagaagcatgaatatggtctggtctttaatttgtcatattcctttttcatataagattttttttatgactcgaggaagtaaataataatacaattatttcttgaacatgcataatttatcatgaaactaatttcgcactgtagtttatcttatcaaaagaagtaacacatagcatgagagacgcactgctaattgtgcctcctgcaaggaagaaagttagtagagctaatcgtttgatagtagtgttagttccaaaggctactgcaagaaagagagaagcagattactcttatcttttagagaattttcttactatgtatgtaattctatactaagtaattctgcaatatttttcatgcacaaatcctccttcacttcagtttctcatatactcaatcctcaaacaaggagggcagagatacctgcctcaatcacaagagctgaaagctttcaaaaatttgatgaagctacattgaaacttcagtctgaagacctgaaacaccaaaaacaattgatagtttgactccgaattgatttgtgaaactattctaaactcaattgcgtaaattactaaattggattgaatacaggattggttatagggcattgagtaaaacttctgaaacatttgcaaaatcaaaattgtaatcttaaaacctaaacagatgcataaaccaatcagtaaagaacgcaaggcaagcttaattaacctttgcccgtgctgtcgcagtagttgttgcacgcacattagtattgatccagtccaaaccagttctccatgtactcatctaggcttgcatgctctgtggcaaccggagagaaattccacttgttagaactcttaacccacaaaatagagagctaaagactaaaaccacagtttcatctataagaacactcaatcctcgatggagagctaataactgaaaatgcagttaggattgatgtgtttcaccttcactttcctgcacatgcaggatgacacctcagaaaaagaacaaaatgctgatccatcgtgcttgcccattgcagggagtcggcgtcgtcgcacgcgaaggaggggtgtcggaatctacggcgcccggcggctgctgtgatgcagttggagcggcgactactgttgggttaggcggcggccagcgttgcgtgtgagaggatgccgggcgtcggtggcgccgcgcgcgaatgcggggtgtccgaaccgacggcgggcagatatccggcatcggcggcggagatcacggcatagattctgtgtgagattggtggctcgacatcggcagcgaccgcaggcctggactggtttgccgcaaagatcgtttttgagccgttttctcgcccgcgccgcctgtgtcagctgccacaacgccagcccagaccgtcgaagaaccaccgccaccgccgtcgtagtcttcaccagctgtcgcacctgattgtatcaaacacatttagccacaccacacacatgacgttcgtttcggcaggcgggcggagccggtcagcggctgccgcggaggagatcgtcgctggctcggcgatcttcggcttcagaaattcctgcacgaataataagaaaatctttcacaatggaagtcatcataaatcttgggcaggaaaacaagactgaatccccaaggcaacgcaatacacgtgaatccccaaggcaacgcaatacaggagaacaagacagaatccccaaggcagaaacaacacatggatttttttcattcagaggtaaactaacaatcattcagagttggcgatcggtgcggtggtagctcgtcgttgcgttgtagctcccaaatcctgcggtggcggtgtcgagaagcagcggggtgaggagacgaagcgacgcggggcaatgggctgatgggtaggaggagcacgcgaacggcggcagccacggcgactgtggcgatctggaggattagtcgtcggcggcggctggtggtaggaggaggcaggtgggcagcacgcgtggctagtgggcgaagtagtaggcgtcggcaacggtggcgtccacggcggttgcgggtgggtgacggcggcgtcgacggctggggtggatgggcagaggaggcaagcgggcagcgcgcgtggtgagtgggcggaggagtaagagtcggcggcggggaggaggaggagtaagactctgcccggcgggggatctggagcggaggcggcggtggttgtgggtgggtggcggcgtcggcgaggaagaatcgttcgtgggggtggattggcggaggagtcggcggcagttgcgggtgggcggcggtggcgagtggcgattggagtggagaaaccgtctggcagtctactgcgatggcccgtttgatatgacgatccgatggttgatattacacgtatctgtccgatgtctctgctaggaatcaagaccaccattacaaattttctaagtagtagagatgagtttagttaagagtagtataagtcttggcgctcattaaatgtgagtacggctattcgaatagattggtttactcacattgtaatagatgtacgcttttaatttaatggagatctttagtacacaacctaaacacacgcaaataaataacaaattctattatacaaactgggctaggccttccctagaggaaaaccagactttatctgagaatgctatttcttttaaataaacttctaggaattatacttcgcaaatagagtttttagtaaatactttactggtagctattatttgcaatatagttgccaaaagacttaaccctttacagggactcatagaaaataatcaaaacaatatttcttttgtaaaatagtatttgttttaatgactatcccaccgagggtgtccatccataatagtaatatataattttatttacagagcaaatataccagaggggctctattatatagagaagggtttttaggaagataactagtattagggcctgttcactttgataaaaaaaaaccttattaaaatttggcattgccaaaattttggcaactatgccaaaattttggcaacttatcaaaatttttgcagaatttcttatatagttaccaaaatttaacagcaaactaaatatagccacttttttagcaactttaccaaaatttggtaaggttgaaaatggcatcaaagtgaacaggcccttaatatatttcataatcatggttctttaattaaataatatttgaaatcaaaatacacgcatattcttagaagttcctcatttagcccatacataaccggaaaacgaaaaataaaatcaaataaattctagcatgcaagggagggcctcatcggttgccctatagcttataaaccaaagccaaaatttgaattttaaaacttgattttgaatttgattttaatattttttcaacattgtttttttttcaactttggcttttcaatcactaagaacatacatacaaaagttttactcgcatattatttttttaatcgctaataaaccgttatggcttataataagaagtgggcaaccgatggggaccggagttcaaaagatttttggttattccgaatttttaattccatattttagagtcaaaatttttagggtgttacatggggcccacaagttgtttgaaagtggcacagctgaccgttgctttgccggttcagccgaaccccttgtgggctgtaacatacccaaaatttaaaatttaaaattttgcacctaaagaattagaatgactttttcctatctaggaatcctagaatttttgcatcagacatctaaatgagcccatcatagctagaactcaaataacaatttaggacaatttaaaacttttccattctaatttaatttgacacgtaatatatttcatgtttgcattagcacaaagtgtggtgtgtgatttgagtccttttaagtgtttttggaatttaattgcattgcataataggtatcatggcattaattaaaaactggaggcaactaattttgtagaatgacttaataactttattccctaaaggtcattcaacttaaatattccagcctaatcagtggcaaactctaatatattaaattggacacacttccctggacattgtcatgagcataaagttttataaacacaataactccttaccctgaagagaactaataatttgtatagttaagtgatcaccacacacgtaatccaacttctagaattcataggaaatttatattagctttaaatattatgaactcggttttgttagattaataaaatatttttcttcatttgtatagacagcaagtaacacatcatgtacagataaacatctaaaactatatatataggaaactactaacatagaacgcattataatttgtagaatgcataagaaattcattttagctccaaaaatgatgaatccaattatgttgaacttagtatatcatgacctttcctgttaaaaaaatgaaattgtacagaacatggttagaaactacctttaaattcgaataaagcctaaatgacataattgtagcctaggacttgtaaaattcctatctcccaaaataaatgagataaaatagaaattcttttacctaaattcatataaggacagaaccttcccactgcgcacaaaacattcattttagagaattttgtatttttcgcataatttggtatttatttgcatgtcgtgttatttgtctagataatttgcattcacgttaaaggagtgacttaggaattgtccaagttgcacaagatcaaggcaagtttttcctcccccttcgtttgatcacattgaaacccatgttttgggagatgaaatgtgttgtttgcaaagttgcatttatattttattaaaccaatatttgaaaacttgggatatggtagttatccctaacttgctgcataaactcccttgaattattgtacacctctccatttgtatacttaggaatggttagagtacaacacttgtgttcatttggggctacaaatgcttaatatgctactatgtgcttagccatgcttagaattatgcaaataatatttatggtcactttataaatgaaattttgggtattattttgctgctgtacagatatgaaaattatgattatttctgaactaaaaatgaagttaaacttattttaggcttgggcgacaagtggtgtgcatatggtggtagttgcacaccaatagggggagtgttcgcccgggtcgattaaggaacgaacttcgtgtcaccctctaatgtttaccgtgcatcgatatgagttattatggggtaaccttggcctattaagttaagtatgtctctaaccttgtactcgggaggctgttctagtaaagatggcggtcacggtttgtggagctatctttaggaactacctatgtgtgtgtgtttgtttgtaggatgactagttccctatgtatgtgttctatgggggacagatgttccacctcacagcatgggcgtctaagtccgtccaatacaatgatagcatgcctcgtgggggaacggatgtgttcgccgccacagcattaggttaaggcgtgggccctccacctaacggctctaggacttaagcctagggtggattcacacttatcgtgctcatgcaaggttaggtacttcttaatgtaaaagctcgttgtgtcctctagaccacactcaatgtgtagagagtggtggtaccgacgggtaccggacaaactagagcgattcatatcatgtgggtaaagctatacaaactctgcagagtctaaacctaatcgattagcaatgctcatggtcatgagcgacatagtgagtggtatgggtatagttttatgatttatgttttcaaattgtgattgtgaaatataggttggaaaatggtaactagtgtagaattgtattgattatggtacatagatgaataatgtgagacttgatgccggtttaggtatcaagaatgattataatatgatatatgataaatattatgatatatctatgttcgtgttttgtcaattgaattgtcaactctctttacaaatgattgtgaactaaaatttgtctttatgctaaaatttgagctaaagaaagccttcctttgaattatggccttacatgtagtatgttaggcttgttttgtagttgtcagtacattaatttgattaatgtactgactcttgccaattgtttatgatcttgttttgcaggtagtaggtttaaattatgtttagtgattcgggtttcgactacttcttctaggacttgattcattaggggtctaccactagtcggctgcttatgggaacgggtatacaagcttccgcagatcaatatatattaggccggttggcctgctatgatgatattaagtgcaagttccatattggtcaggattttgtgtagaccttgccgttatttttggtcattaggattgcaagaatgtcttttgcatttgtgttcttggctaagctattgtgctatagaccatactacagaaatttttttcatcccatattgctattaaaggatcagaaacataggcattgaatctttaaatcaatataacgcctgccaattgcttgcataatcattaatttgattgctagctgtgagcataaacttttatagaacatgcttgatttaatttttatttttgacaccagacctgatttaattttcattttaaaatgaaactcctgtacaattagagtattaaatgtagactaaaacaaaaatcaattacacagttcgctaggaaattgcgagacgaatcttttaagcttaattgtgccataatttgacaatgtggtgctgcagtaaacattcgctaatgagggattaattatgcttaataaatttgtctcacagtttcttggtggaatatgtaatttgttttgttattagactatgtttagtactttaaatatgtgtttgtatatccgacgatgtgacatgcagaggcaaaaaattttgctacctaaacaagccctaagcctgcctatgttctgatccgtatataaaagttgactttattgtgggatagagagagtaacaggacggtatctacttgtagggatgctaatataggctgtgtttgctgctcagggttcctaaccattctttgtcgttttccgcgcatactttttgaactgcggtgtattttttgtaaaaattttctatacaaaagttgtttaaaaaaatcaaattaatctattttcgaaaaaaattaactaatacttaattaatcacgtgttaatggaccgctctattttttttacggagagaaagagttcctatacaagatctccgaacgcagctatagtactgtttagctgaccattcgccataagtaaattgggcgatgctccggtgctctctgtattatactacaagtagaaaagatttgtaccgttcattattaaagataaattagtaatttattaatataataagggtaacttagccattttccatttttccacctcatggatcggcaggtcgatggcatcaagcccatgcaccttgacttgctagttggctgtgagcctgtggctagctcggcacatcgtccagatcgattccatccagaaattaaattggatcgcaagttatggcggcggcgagtggcaagtcctccgcccggcggcgcgtgttgatcctgccggcgatgacgcactccggtggcgtttgaatcttataaatatgaagatgaaaattaagtgtttcatataaaataaggtggtaataacatgtgattaattaagttataattattacaaactaaaaaaaatagattaattttatattttagagtaactttcatatagaaagttttcacacgaaacatttttttagcagtttaaaaagcgtgccacaaatattcaaaattttattctctcttcacagaggattcgagcggggcctccaccgtgcccctttcttctcgtccacccatccccggcaacccatctgtgccaattttgcacgcatgagcatctctccgatccgttccacgcggcagcggcgcatgggctactaggattagtgagtgtaaatgacaactatacccttccacaaataatttttcctgaacaataatacccctccacgattctactaccgttaagtgaggtggtagtagaaataaatttaaaccctttgatcaagcagtccattagcgcgtgatcaactaagtattagttttgtatcaaactgcgcacggaaaaaggattaatttgatttttaagcaactttgtatcgaaatttttttttaaaaaaggcaccgtttagcagtttgaaaaacgtgcgcgtgaaaaatgagggagaggggttggtaacagcatgaaacgaacgcatctgccctgttcagtcaactgatggatgaagattatatacataaaacgagaacactattaacatattgattaatttttaattattttatacataaaaaagaaataatttatctaatattttgttaaaaagttttcgcataaaatacaccgttcaaaaatatgctaaaaaaatcaaaataaaatacgtttctttggctgtgtttagatctaggaataaaaatttttgccgtgtcacatcagatatacggaaacacattggaagtattaaacgtagtctaataacaaaaaaaattacagaatccgcatataaactgcgagacgaatttattaagcctaattaatccgttattaacaaatgtttaatgtagcaccacattgtcaaatcatggagcaattaggctcaaaagattcgtctcgcaaatttggtcgtaatctgtgtaattagttattttttagtctacatttaatattacatgcaggtgttcaaatgttcaatgtgatagggtgtaatttttttgtgtggaactaaacaccccctttataagaaaagaaaagaacagggctagcactgctcaatgctagcagtacccacaatggtcagcaacaacgataacgaaaaatggatgagcaagagacattgagagaccccatgtatccttcggggtcgaacggacatgctacgaaacccctatcctcttgtcaaaggatcattgaagtctggcctgcggcctgcccgtacttgtgatccgcctgcacgacgacggcacagtgcaatggatacaggaaacagtgcacgcctcactgctacacgttcccctccctacgcacgctaaaaaaaatttctctcccacagtgcaagggtcttcatgcgtagctttggttttttcgtttcagcccctcgcattttctatttcagtcccttgctatctttctattaacaaagaaatccaaattttacactttgtatctcgaaagtcagataatacgtatagatttctccccaatcagataagcctgaagctgccgtttcttctcccctcacaacgtcccatccccatccccatcgccggcgcccctccctccccatcgtcggcgccctctctcccatccccatccctgtcgccagcgccccttccctccctgtcgtcggcgcgacgagccgcgatcttgaggttagtttcttgggttgctttgctgcagagactgatctcctgttttttctttcttcttggactgctctttcagatagaattttttagatcggttttctgttgaggaaggcaagttctttcgagggtgatttgttgtttgttctcgatgtcttttttattgattagtactaaagcatctattctagattggtcttgtgttcatgaatacgcttaaggtgttgaagccatcaatcagttcagtgtgtgctaacctgttccaggttctcatctgggttcatgatttgaattggtttagttttttttggtctttgcgattatgaaatttcagtagttagatgttgattttctaatagatgaacagtcgtgcagtgcagtatgtcaatcggtcaatgactaatgcagctgttcatgtcttgtgcttgattcaggagagcgcgggaggagaagaaacacgcgcgcagagagggcgatttggggatgaagcgcgccgggaggaaccgcgcggcgaagacacgcctcagcaatgcgtcgtgccctcgtttctccacgccgccccacctcgatagcattgaagaacgggtgaccaaatttggtcacatgcgctcacgatttgtgggccaacactaggacgtggcggcgatttttggctgctcaactacgtggaccgctcgggctgaatgccagcagggtgcactgtgaatggcctgccagccgcgcccctgcacgttatggccagctgcagtcagctcgtagtaatggcgagctgaagtcagctcgtagcaagggcatgtttgggagttttattccgaaaagcagcatgctggtaacgagtttatgagaatcttttctagctttggtcttctagttcatttttttattctatataactataagttcttagaatctgaataaaaaatgaactctttggaagagcttttgattctgcgagaagtcacagcagctataaactatccaaacaggctctaagacatacttcctctctctctctcttataatgtgttcttatttatagaaaaattaaactctactaaaaatccattaaacttcctagattctcatcctaccatatggcacttctataaacccttctaagccgtcacatgaccttttaataaattgatggacccatagttaagtagatttacatttgcaatgaacccgacattatagggcatatattagatatgttttttaagaaaagttcatgtgcctaggtacgtgcttacgtgaaaaccacgttcggtgcgtgtagctcaccctttctattcctttcgtattctatttcaatgctatattaggggctatttgggataggaggaacttattttagtccctctcgcaaaagtttcagtccctaagtcccttccatccaaacaccaccttattaacataaaaaatcattggtatttacaacaataaataaattttaaattactaaaactgaatctcctgtcctatacacctacgtatgaacgtatgtacgccctccttcctgttctgcggccagtgttccccttctattgtttcttgtttctgtattagttttttttcaatagtggaatataatatttcggcctttgctcaagaaaagctacaactaattattacaaagtagcactcgagataatagtatagttcaaataaaatagaacacatttaaataggaaaagccaaaataaggagaacacatttattctagcttatttgtgaatctctatccatagtttgcataaagttgcataaccattgtctccaacttgcgacatgcaactttcaaaaactctccatcttcatcacacctttgtaattgtgcccaaaaccggagccaatgagttgccctgaaaattacctgcatatagaaaatagatggtgatttatcaaaaaccatatcatttctactcaaccatagagcccaacaaatggccgaagctctgacaagtatcagtttactctttttcttgtcaacccccaaaagccacctatcaaaaatatgagatatactaattggaaggttaaaaccaaaagaaaactaaactgctctccatatgaattttgcataatgacaatccataaagagatgttgaatagactcattattcatacaaaagcaacacctcaagctgccgttccaattccgtctcgccaaattgtccttagttaacacaacccctttaagcaagtaccacataaagatcttaatcttaagtggcatcttaagcttccaaatacacttatttctctcaacatagccattattaattaaagctaggtacgttgatcttaccgagaacctaccgttcttatggtagttccatctaaaacaatcagaagaacgattcaactggatatgcacaatagaagcacacaactcatgccaatatacaagattttgaccaactaaagctcttctgaaagcaacattaagcggaacagaacccatgacagtggcaatagaagacgatctccttcggacaatagcatataaatatggatatttatccttcaaggccaagttgcctagctatttatcttcccaaaatctaatttgttccccatcattaacaatacaagaacccatatctaaaaaagtactcttgactttcatgagccctgacaaaaatgataatcaccttgtttctgtattagttagaggaacaaaatagaaaacccaaaaataatactgctaatttaaattattacaactaaatttatgactcgagagccaagttaattactcttaagtatattttaacataaattcaaacggttagtagagtattgaccattttgcaagagatgtgtgcattaattatatcaaggtccttttattgtggtttttttaatagaactatctcatgatgagttgcacttaatgatgttttactacagtagtatttggtgaaaacatattatattgatttttccatgtcatgtttggagaaggactaacagaaaccttaataaggcaccaagatttattaccacgtcgtaaatttatactataatgattaatattacgaagtatcattggattagggaaatttgaccaacaccgtgtaaaatcctgccggccaaaccatttaacactctagctctaaaatctacattaacatgaactctatatgttgattgagcgttcatatgcatactccacttacacttctatcctcacttcatataaaaatgattaaatataggtattatatttaaagcgtcaagactgatttataaacagacttttatccatgtacaaaaccactaattataacaacctatggcatatatgggcctcaactacaccatcctgtaggcttcagacaagctagggagttgaatcaagggtcaccggcctgtaaggtggtgttcttctctcgtgaagatgaacgtaaattttttttacgtaaaatgaggtggtattaacgtataattgattgagtgttaattattacaaacttgaaaaatagattaatatgatattttggagcaacttttatgtaaaaagttttcacacgaaacgtaccatttagcagtttgaaaagtgtgcaacaaaattcttaatcttcatccaactcttgttggagaaaagaacatgacataagtatgaaaattctaccacatcaatgtctaaatttcatattaatcaatgtcaccacatttaagtaaatttaacaataattacaataaaaattgtggatgaccaatttggaatcactatatatcatgagaaaaagctcacgagtcattaaggaaaatagaaattcaggaaaatagaggtatatctcaaaattcatagaataattagttcaatattatctgtagatctcagctatagttttattgctcaatgtatatacatgcaatcaaaggcgtcaaattctttacgtgtaagcaagctttgaaggaccaatgactgcatgatggggggactgctatatacattgatattttacagaaactttatgtatagataaaagatattagtcatcataaaagattctaacattaatggaaaaaaagcccatggtatcgtgtgggctacctttctaatttgacttaaataattacagtagtattaactattatacatattatatcatttgacttatatttaaaaatacatttatgtgtgatactaattttaattttatagttgttagattatatataatatgaaataaattacagaaaacctacactacggcatcccgtggagacgggatcccctcctcctacctcactcctctccccaaaatcatccgaatcctgtcctcctacctaactctcctctcccaaatcacacagcactgcagccctctctctccctctcccctttctctctctctctctaaagaaggccgagcggagacgaagccggccgggaggaaggggtcgtctccggcggccgaggaggacgacgacggcactgcgtcggcgaggtcggccaaccctcggcagggtcaccctcgagctcgcctcccctcgctgcgccgctctagctcgccgccctcgtcggtcgggtgtgtgccggggagttgtcgccccgaggagggcagaagcgggagctcccctcgtccttgccctcggcctcggcgtcaccgtcgtccctgctgcggcctgtcgcttttgcgccttcggtatggacgccggcagcccgcgtcgacctgcaacaggtatggccatcaaactcctcctcggctcctcctcgagacttctcgcgctctctggctcaggcctcgctcctcacctcgctgtgcctcctcgacgccatcctccgccgttgtggccctccctctcccacgtctcctcctccttttgacagtaccctccgatacctcacaagtatcatgcttgataccttggtaccaaggtctgatacctagatatcacccggtaccttaggcaccgggcatcaggtatcggtcgatacctagttggtaccaaaggtaccaggtaccaggtaccaaccggtacctaaggtaccaggtactaggggagcacatgtccctcacctcgccgtgcctcctcgacgccatcctccgccgttgcggcgctccctctcccacgtctccctcatcgttaccctctgataccccacaagtatcatgcttgataccttggtaccaaggtctgatacctaggtaccacccggtatcttgggcaccgggcatcagttatcggtcgatacctagttggtataggttccaaccgatacctaaggtaccaggtattatgtaccaggtactaggggagcacagaggaaagaaaaagagagagtcacttaaaatattccgttgcaacggtatccgccctcaataaattaatagtcacgtacttagaatttgggcgagcagtcagcaccaatcacgctgtttctgttgacttctactcctaccagatgctacagtacctcccgtgggcccccacactcctactgcttcccagtgggcccccaaccagtccaccatctgctctgttcctgtgcaagtctgtaaccaacgctactgaccaccatggacacttggacatatcacagcacaaaacattcctcgctccatcttccgctccagtctccattccccagctcgtagtagtagctgccttcctttacactataaattcccctaccttacacacagatgtgtccaagtgctcatcaacaccgcctgactcatccagtgtgaggccgtgagggtgagtgaaccctgtagcggcagtcatgaaggtaagccagcgagcgagctagctattctactccacaggacgcatgctgcgttgtcgtcgtcttgttctactaatagtttcttgttccgttttttcttcatgataatggattgatgctgtggatgtgcacgcgtgcgtacgtgcaggagagggtgaggcggcggcgcatcccggcgttcggggagtggaactacgacggcgacggcgaccttggcggtggcggcggctgctatggctacggctaccgcgacggcgactggccggtcacacagtacttcgactccgccatgcaggcccgcggcctggtcatctccctgccgccctcaccaaaaccacccaagaaggtataaacttgtctccgcatcatcgttcattggcaacacttgcaaagaaggtaaacgtaagtgttgttctgaggcggatatacatcatgtttttttttttataaaaaacaagatttggacaaaaatcgtgcttagtttcatttaatggctatcatggatctctgacagggtaaagaagtttttcaaaaagcacgatacatggcgtttgcatgttgcaacctgacagtttttcttacggtcaaactcacgcggtaaacagatgattggacggttgtcgctgttgatctctttttttaccaggcggtgaagtggattgacagcggcgcacttggggaggaggaggtggtggacgagaagcagaggcagaggcagcacaaggtggtggtggggctggcggtggcaggaggagagcacggggcggcgaggaagcaggggaagcagagcagagtggctgacggcggggcccatgcggcgatgggctacaaggggtgcaggccggcggtggtcaaggccgtggaccgggacctctacgagatcccacccgacatgctctgcaacaagccaagggtaacgcacctagtactccgtatctcttgatctctctctcgatggtggttagtagtactccgtaggggtcgcgttgcaccagcaccactccatttgcgagcctgcactgacatttgtgcttgtctcaaaccacaacctcgctgactcgtgtgataccattacatgaatcttttctactagtagtctatccatttcacagtgctgattttgttattcctaatttttttgggcctatttagttcgcgaaaaaaaaatttttatgtgtcacattggatgtttgatcggatgtcggaagggctttttgaacacgaataaaaaaaaataatttcataacttacatgggaaccgtgagacgaatcttttgaatctaattaatccgtcattggtacacgtgggttactgtagtacttatagctaattatggactaattaggctcaatagattcatctctcattttcctccttaactgtgtaattagtttttttatttatctatatttaatatttcatatctgtatttaaagatttgatgtgatgtttttgggaaaaaaaattagtactatcattatgctgaaaaaaaaatcatgttcagtaaaaaaagtttttttatggacaacccaacacggatgcttgtgcaattatacttaatgaagagtagttcactgatgcttgtgcttttcttcgtttcatgtggtttcagaagagggtgaccaggagcctgtggatggggtgcctgggactcagctgcgttgcctagggatctcaccagatagatcgatcgatcacacataccaaacctgccttgttttgcgtgtcgttgtaaagtgaagcagaaacccatggacggaccccatcgtgatcgatgcatgctgtcaccacggtcgcacggcccaaactttcccattcatctatctccctcacctgtctcagcagcactagtgtttggttggtgtctctctgtgcgttttaggagtagtagtaaaatgagatggacatggacatgatgtgtccggcagcgtcatttcctcgtgccaaagaccactcgagtgctgcctctctctctctctctctctccccttttgatctttttccgatgtgttttttttttgtagcctctgcttggttggtgtcccatgaaattacggaggcagctcggtgaaatgtggttatatgggttggtgccttggtggacactcgacactgatgagtagcagtggaaaaaggttgatgtaatggaacgctgtagtctcagctcaggggacttgtgccgcccgtggtgaaaagaaagaaaggaagaaagctttctgttgatccatgtcttgctagtactactacaaatatgtgtttatataggccgagtttagttttaaattttttcttcaaacttttaattttttcatcacatcaaaatttttctacacacataaacttataatttttcatcacatcattccaatttcagctaaacttttaattttggcgtgaactaaacgcaccgatattccggcactgtgctgatagcacctttttctgtcattgatgtgacagtgtgattgtgcgattattatcctgggtgttaggactacttcagtgataaaggctgtgtttagtttcacctcaaaattggaagtttgactaaaattggaagtttgaagaaaaaattaaaagtttatgtgtgtagaaaagttttgatgtgatagaaaagttagagtttgaagaaaaagttgagaactaaactcagccataatcatatcttccaagttatacttctgctttcggccgtgtatttgcaagggcttcttttccctactcacttttgatttgtaacgtgcacatttaattgctatactaagtagtattgtcaagctcaaaagcaattaataccaatgctgaatacttgaaaggaaaggggtgtggcctatcagagttttccgtttaaaaaactaattcctcgctataggtggactgggatgatcgctgatatggctataaagtcgcgtcccgtatcagatacggccacggatactgatacgtatcccacatattcacgattgtaaaaaaacaaaataaaatataactgacatcggcatactgcattggttcgggatggaaggaaaaacacatgtgcatgacgtgagatacgccaacgatacgcccatggtctgtctccgtcttcgctcgcatcagggatacgccgcctgacgcgctcccaacctgatggctgatgtcttttgcctgtacccggttgttggtgatatgggccccgcggtacacaagatagagggaaagaatccttcgatccggccacgtggccgcgcggcctgtccccccgcctcccccggggagaacgagcgctcgtgaagcggccaaggggcctcggggtgccctgtcgcacccctcgggcccttggagcatgctgccccgaggccctcactcggcttccacgtggtggctgagtgggcggagggagaggcgctgccaaacgtcttaaatgagcggtgccccaaccgtccctcgtcgcgtttaatgtgacgtgggcgggcgtgaggcgccgcccgattgacgtgcgtcaatcgggcttgattggtctgtgaccggtcataggcagatgggtggcagcgcacccacgtcctgccccctgtcaggcagagtgggggtaggtatgcctgtcccatcggcacgtagccgagcgtgtccctcgtacacgaatccagaaaagtctccatggaattaagagggaatgataaggatgtctcccgtgtcagccggaggacggcgttgggacccacctgggggcgaacgaccgccttgctttcggtcgaaggcaaggacgacggcttgacccaggacatgtgggccccatccaatgatggactatgtaagacggtgcatgtggtatccccttaaactataaaaggatgaccttgtccacttaaagaaaggacgccacttgagaagcttgagcctagggttagaactcccttgtaacagcacaagcctaataccacgcacaggagtagggtgatacgcttcctagcggctcgaacatatataatcccttgtctctcattctcttgcaaacgacctggtaagctagatccatagcggagatacgctcttgattatcgcgccttatctcccggccgaactcacaaagggcctcgcgacctcccgcttgagaggatcactcctcgacaccggcgttgccgccagacgctggtagtagccgcgcgtgttgctgccgtgcgcggggccacaatgtcccctccgcgagaaggcagagccgctactgagcagaggcgtacctccttcgccgccaacctcataggccaggaccattgccgcgtgagccatttcctctgacaccgggcatagcggtggccagtggcaggctggcagcatggaagcacggaacagctttttctttgttcgcttgactgcgtggccgggtaaatccatgctcttcgaacttttcatgcttgaatgtgggatcccatgctgtttgaatagggactgcaagcttagcagttttagaccttcagtgccgttagatcaaaggatccaacgatcaggatatacgtaggccctgtttggtaggactccaaactccaaggagctggaggttatgtgaaaagtgtttggcaagcttggtctgctccagaactctagaaacagaggatatgagggaggttaacaaaagtacccttgtggttttttctgtttttgtgatgtatgactgataactgtttatttttctttacaatttcagcaacaaaatgcaaggttaaaaattaatccacaaaataattgacataattagtgaaagcaccaagtgttttcttggtttagatctgaaatttgtatagtctaccattttgttctcacttcaatttgtataaacacataatttttcacttctacatagttcttataaaacaagaatcacccatgacatacatgcaaaatcacctattgttcttttggtctagatttcaaattggaaaaaaaatgaaaaaatggtagaggggattagctcctcacagccctagccgccggccgtgcgccgccgtcggccagctggtcgcgtccgctgagccgccgccggagagccgcgacctgctgcccgcctgaacatcttgatcttgcggcgctccttctcgagctgatgcacgcctccacccccgtcgcctccttggccgccgccgctgccatccttacagcgctcttccttggccgagccgccgccagagcaccgccgtcgccctgctacccggctgtcaagccgccgccggagcaccgcggcttgctgcccgcctacgcgtcgccgagcagccgccagagcgctgcggccttctgcccgcccgcgccaagccaccgccgaagcgccctcgtcgccttgttgctcggccgcgcgctacggttggcccgccactgccgcctattcgcccgccgctgccgcctcgctcgatgggtgggacttggagagttacgggagggaggtgaggaggtgggggtaggttagtggcagtttcacgtaaatatgtcaaataattaaagggtagtgggtcctttggggttgagtggagctgtggagcagaaaaacccagctccacccccttagttcattttttaggagcaactctacaaactccactctagaaaacttaggatctggaccgtttggcacagctccggctctatataagttggagttgggagctagagctgtgccaaaccggcccagagtataccgtttgctagcatttgctacaggattaatctgctacagtaatctactccctccatcccaaaataaatctgcttctggaattcaaattttgtcctaaaataaatcaacttctacattctaatccactatcaggtcataaatcaaaaaaatttattccttcaatatcccttacctacctatcaattaacagtgaaatttggcaagccccgaagacgtcatcggcctaaaatcattatcggcttcatagtcctggaatcggccgatgggaattatcaagtcgccaatagtcagattattgctgtatttggttaaggaaattaatctactaaaggaagtttatccagaagtgactgagttcaaggaggatgcaacatgacagtttatctattagttacgaagagtctttttgtttccttttatctttaggaaggtgtgtttagtgtcccataaggactttatgtttcctttttatctttagaaaggtttctttcttggcctaaccggtttggccgaaccagggtttcggccgaacccctagtgggcctaaccggccccacttttggccgttgggttccaatggtcagtgtggtcgtggcacaataaattttcattgaaaattttatttttgtttgaaaaatcatttgaaagaatttcctcaaaaatcaatcttaaatgcaaaaatttgaaattcaaacatgcattgatgcaaaagttcaaattgttgaaaataaatatgcggatacataccaatttaccttttggcgaatatcgcgtaattttgggtccaacgtgcaagaccgtacctcccttcagttcagatcgcggattttctgcccgtctgccgagtggtggagcgggtgtctttggctcttgcttccacaccttctttagttttcgtgcgggagacggcttcttctgagccggcttctctagcttcttagccggtgtattgagttttactagcgtcttccaataacggttcctgggaatcgttgtttccttttcctagatattctgcataaattttaccagaatattcatcttgggtggctccacttcgaccacttgaatattctgcgggtttgcccgtacttaatccggaccatggagcattgttcggttctcggctagaactcaaatttctcttctttctcgttgatatggaaacggatgctatccgttcccacgtcaatgttggcttctgtggtgctaaggaatggacgccccagaatgagcggcgtttcctttttagtgtccatgtccagcaccacgaagtccaccgggatgaagaaatcccgtatcttgaccggaacatcctccgctatcctagatgtgtaatggaccgacgaatcagccaactacaggctggtgttggttccaatatcgtgaagttgagcttatcgaagacgtctttaggcacgatgctcacgcttgctcctaagtcacagagggcttggtcgaattgctgtgtcccgattgagcaggtgatcgtgggacacccggatccttcttttctaggagcttctggagtatggcattgctgcactgctccatcagcttgaccaccttagttgtcggaagcgaccttttgttattgaggatatcctcgagataacacgcgtatgttggcacttgcatagcatccaacaatggcacgttgatatggatcttctgaattacttcaacaaaatgagtgaactgctcgtccactgacggtttcctgcttctttcaggaaacggcagcaaccgggtgtcgtagtactcctgcggcatagtcttctcttgctgaacctcttcgtcagtcgtattaccggatggtgcttctctggtgatactgctagtccttgtaaggttaggatatggcggatcacgagtagacttacctcccctcgttatgatcaccttaacatttctacggaagattcgggctgccccggaatcctcgcagactcatttgcaggtactaacacagctaattgtgccagctaagtttcaatcatcttattaaagctcagctgattttggaatgcagaagcaaagccatctagcttaacatttatattctctaagtccttgtcattagcagctagctttttgctaagagcatatgttgttttagcttgcgcaaagacgagatcttcgaaggagggctggttagaaaagttaccgttgttgttacctccttggtaatatgggcatggctggttccacccctgacctccttgtggacgatacccattattgttgttgcccatgtacatcgcctcttcatgggtctccgggcagtcattcctagggtgacccgtgctgccgcggacctcacacgtgacgtgtgagtccaaggccttgacggtgccttgtggcctcttgtcatggtcgtccaagcgtttcatgaggaagtccagcttggcagcaagaatctccatctccttgatggtgtgcactcctcgctgacgggtctggagtcgttcctcgctccaacccatattggagaccattttctctattaaatcgatggcttctcgaaccgtcttagagaaaaatgctcctccagctaccatgttcaggtggtcgcgagacatgggagtgaatccaatataaaaattttgcaggataagccagtcgtccattccatgatgaggacaggcggccacatattcctgaagtcgttcccatgccttaggaatggactcgtccgtcgtctgctggaagcttgaaattcttccacgaagggcgttggatttgcccctcgggaagaacattaataagaatgccgtagagcatttgtcacaggtgttgattgtagcacagttggcataaaaccactgcttcgcgttccaaaggagggaaactggaaacagccgtagcctgatggcgtcaggactgacttccttcatagtgtacgtgttgtagatctccaggaattgttgcaggtaagcattggcatcctcgttaggcttgccgcagtacgggctagcctgcgccattgtgataaggctagacttcagatcaaaatccacgtctcccatgttgatttgcgagccaatggccacgttgtcagcagagggagcaacgaattcacggagggtcttgtcagccatagtcttgaaggttagtggcattgttatggctggtttctttatcgggagagttttttgtggagcgacgactctcggcttgacgctccgaaagaaagcttctggattttccttaaaagtttttcggcaagttgaaaccagtcatgcactaccctgtttccacaacaaaagtgataacaaccaaggttagcctacaaaggacagtgattatacagaggtaaatagaaagtattagtattggtaatctcttctataaatcttccccggcaacagcaccagaaatgcttgttggtatttcttaacgacattactagaaatataattcccagcaatggcgcagaaatactcctggtatattatggttatagagttcatccacaagcgcatggatataccattgtagcatttcacccgagagtattccaagggtatcgtatttatttaatcccgtgggaagattatagtagacagaaccttactaataattcatatgttacttgtaataatcatagtctaagcaggggttaatataattcaaagggtagcatggcacataagcataagacctctcattctcctattaagttatctaagctaagtgggaagaaaatagaaaagaatatattcctatacttctagtatacatattgttgtcgaatcaacaactgcgtcacgtcgaaggacgtggttcttttaacagtggttggaagtaaagacaattgtattgcttagtaaatttttttcaaatccccctgttacatggcggtttaggctttacagggaaatttacatggttgcccttttaatagggacatctttatgggtatacagtgtcttttgctcgtatgggttcctaatgggccaagtgacatggccttgtccctggcgaagcctctggaaggcgtgtcggcccgctgggccttctcctggcaatgttcaataattggcgaaacccatgccctttgtggcaaggctctcgcctcgcggccttcaaccattcgcccctccaacagggtccatctttggcgaagcttgtcaaattgatgctgcggctttcgcctatgttgtcccttcgaccttcgccgcttgcctccgtcccatgcctttgcctatctcctcggttttggtaggcctggtcgaaggtcctcgtggtatacctccaacaagcccctcacggcaagggtgagtagggagcttcggccgaggctgtgcaaatcgtgtggtataccatgaggcgcctccttccggccgatgttcctgccgaaacctatattttgtacttgcgaaaaagtctggcgttttgcattagcagatctggtgatcaatgttctttcctttcctcgcttattattggtgaaatggttgaatatgttgggattctcgtgaacagtaatgggctagatgagccggtctgccgttactttcggcctttcactgttcggcctgccttaacgtggcagtcccttactgggtggtaggcgaaccgtcgcacgggtgggttatatatatacttccctcccggcgtcactttcacttttacctctagtcactttttccatctcctctgtggctggtatcgctttgtttctccttgcgttcacgggcttttgtcacctacttcggccagcgtgaccttggctcttacatcgggctttccggacttttcgcccatggcccctcataaacctgctcttgctttggccattggtcctgatctggggaagattggcagagatcacaccggatatctcggcgcttcacttatcaatgagacggagttgacgaagctggttttggctagggtcgtggccgaaggacaagccttcgctcctggcaaggtggtggtgaagcttggggacaaccaaaccgtggtctttgctgcattttcgatgcggggcttcgatttctgtgcaacatcttgctgcttgagatacttcggctcttcgagatcgaattgccccaacttagcccgtgcgctctggttcgggtcgccatcttcgactgggcatgtcgaaccgcgggtttcgagccgaccgctgagctttttggggcgatcttttatgttattgtcaactcgaagacggtggtcaccctggccggcacctggaggacggtcttcgggagcacaaactttaatttccgccctgagctctccgatttgtggcccgtgaatgcatcgatgcctaagtgggatcgccattggatgccgaaaaggttttacaacagcattccttttgaggccgcatcggatgcagccaaggccatgaagtggcagcgtagggccatcgtgcgtattcggaagcccaaagtggcgatcgacagtgcaatggaggctcacttcgccccacttcggaagactgctctttggcttagctgtcgtgtcttggtggaagagttttgtatgctttagattcttcccctttcatggacatggcaagtcgaagttgacaaggaggaggaggcggatggcttgccgaggctggtgctccctgagggggtgaactgtgagttttctatttaactcgtgatatcgttattttttgatgttgttgcttttgcctatgcttccaccttgtactatgctcattccttttcccttacttcgacagtgctttcactgcctcaggctgaaatcgaggcccaaataatgatcgaggagctcatcataaacaagtttagccagctgctcacccgtcagacaggcggcaaaccgtattttttctggcgagctgccgagccgtgcaaaccctatcaaggtcgtcgtcatcgacgcagatgatgccgaaccatctaggaagggcaagcgggcaagagggaaagctgcaccgcggaaacacagaccggcatcctttgctgactctgatgctgacgaggaggaggccgaaggcgaagaagagggggaggaggatgccgtggatgagacgggtgaatatctgttctcccccagacacgacccaggccatgagcacgtcgaggcgggggcagcttcgagctcgtcccctcttcgcagaaggagctggagtgggcgaaggctttggccgcaattgcggggattgctccgttaaatgtcggagcgggtgcgaagagggctacgagggtggttgtctaagttggcaacgcgtttagagacagtgactcatcacaggacacccccacttcgccagccgggtgaagcccgagtctgccggccgccgccaccgcagctggttctgccggtgaggtgggtgggagctccgggcaggtgcttctgcttctgccgaaggcgtcgtggaagcggcctttgtggcattcgaaccccctcttcccggcccccgcctttcgccacttgaacccccatggggaaaacaggcagcgactgagaccttgggttcggacaactcgctgtccgccccccgctttgtctcgtctaacttcgagacccgggcggagcttgttccttttgtgaagggggtgttgcaccttatttcgccggtgggcggcctcgttccttttacggagctgaacgagtttgatgaaggatgcactgcggcaaaagcctgctcgttcgggtacgaacgttgattgctctgtttcctttttgttatacgtggtcccatttatcaaactacttggttgtttaagcaggctctttcggctcaatgctcaatagagtagatggcgagggtctacctggatagctacaagtcccagcttcgttcgttggagggagagctgggccgaaaagaccttgaaaaggaggcgcttgtgagttcactaaaggatgcgaacgccaagatcaaaagacttaggcttgagctcaagaggaaaaaaaagggaaactcagggccttgtggactactataatgattccgagagcaagatgaaggctcctcgccaggaattggagtcagagaggaccgccactaaggatgttaccgacgaggcgaagaccgcctgccataccctccggttggcgctaactgatttgggggccaaggttagtgaagttcctaccggggacgcctccgtccttgccttcatggagtggacccaacaggcgggcagcgccatggctgagactgccgtcgcttatggcgattgctacgctcgggtgtcggccaccttcgctttgggccttttggagcaacatagctgcgatcacattgttgacttcccaagacttgccaaaggggattggtcgatgagctctcaagacgtttcgacacctctacgttaaggctgaggttaaacgtttctatgatgctggttttattcggccttgccgatatgctgagtgggttttcaacatagttccagttatcaagaaaaacagcaaagtcagggtgtgcattgatttccgagacttaaacaaggctacacaaaaggatgagcatccaatgccggttgccaatcaattggttgatgctgcttcagggcacaagatattaagttttatggacggtaatgctggttataatcagatttttatggcagaagaagacattcataagatagcttttagatgtcctggtgcaatcggcttgtttgagtgggttatgatgacttttggcctaaaaagtgttggagctacatatcaacgggctatgaactacatatatcatgatctaatcggctggctagttgaagtctatattgatgatgtggttgttaagtcaaaggaaatagaggaccgcatagccgatttgaggaaggtttttgagagaactaggaagtatagcctgaagatgaaaccgacaaagtgtgcttttggcgtatcggctggccagtttttgggatttcttgtttatgaaagggggattgagataactcagaggaatgttaatgcaataaaaaagattcaacctccggaggacaagacagaattgcaggagatgatcggcaagataaattttgttagaaggtttatctctaatttgtctggaagattagaaccttttacaccattgttcagattgaaagccgaccaaaaatttacttggggggcagagcagcagaaggctttggataatataagaatgtcttagctctcctccagttttaatccctccacaaaaaggaataccttttagattatatttatcggccggtgagaagtcaatcggctcggtcttgattcaagagcttgaggggaaagaaaaagttgtgttctatttgagtcgtcggcttttggatgtagaaacaaagtattctcctgtggaaaagttgtgtttgtgcttatatttctcctgcacgaagttaaggcattatctattgtccaatgaatgcactgtaatatgcaaagccgatgtggttaagtacatgttatcggctctgaatctgaaaggaagggttggaaagtggatatttgctttgacgaaatttgatcttcggcatgagtcatcgaaggcgattaaggggcaggctatagccgattttattgttgatcatcgtgatgactcaatcggctcggtcgaaattgtgccttggactttgttttttgatggatcggtatgcactcatgggtgtggtatcggcttggttataatttctcctcgtggggcaagttttgagtttgcctatactgtcaagccctatgcaactaataatcaggctgagtatgaagcggtcctcaaggggttacaattgcttaaggaggttgaagccgatgctgttgaaattatgggtgattctttgttggtaatcagtcaattggccggggaatatgagtgcaagaatgatacattaatggtttacaatgaaaagtgccgagaattgatgggtgaatttctgctagtaactttgaagcatgtatctcgagaacaaaatgtcgaagctaatgatttggcccaagaggcatggggatataggccgatgataaaggatgtcaaagtagaagttgccgcaataagagccgataattggaggtatgaggtgcatcattatttacagaatccatctcaatcggcttctcggaaattacgctatgaggctttgaagtataccttattggatgatgaactatattatcggacgattgattgggtgttgcttaaatgtttgagtgccgatcaagctaaggttgcaataggcgaggtacatgaaggaatttgtggaactcatcaatcggctcataagatgaagtggttgcttcggcgggcaggatatttttagccgacaatgttggacgattgtttcaaatattacaaaggatgtcaagattgtcagaagtttggagcaattccaagagcaccagcatcggctatgaatcctatcattaagccatggccatttagaggttggggaattgatatgatcggtatgattaatccaccatcgagtaaaggacacaagtttatattggtggcaaccgattactttaccaagtgggtagaggtgattcctttgaaaaaagttgatttgggggatgctatataatttgttcaagagcatattatttatcgatttggtattcctcaaactattacaactgatcaagtctcgatttttgtgtctgaggagtttgttcaatttgccgataacatgggtatcaaattgctgaattcttcgccatattatgcacaagccaatgggcaagccgaggcatctaacaagaatttgattatactaattaagaggaagatttccgattatccttggcaatggcatactagattggccgaagcattgtggtcctatcggatggcttgtcatagttcgacccaagttcctccttataagcttgtttatggacatgaggctgtttaacatgggaagttagaatcggctgaagaagaacggagttgcaaaatgagttgatagccgatgagtattataatctcatggccgatgaaagggaagacttggttcaatcaagattgagagcccttgtaaaagttactaaggataaggaacgcgttgctcgacattacaacaagaaagtagtgcccaagtctttttctaaaggtgaacttgtttggaaattaattttgccgatagggactcgagatatcaaactcggcaagtggtcaccgaattgggaaggaccgtttcaaatccataaagtcgtatctaaaggagcttacatgttgcaaggacttgatggagaagtttatgaacgagcgttaaatggcaaatatttgaagaaatattacccaagcgtttaggttaatgcatgatgggctggtgttgccaatacatgacaaccgatgtgtttacatcgcctttagatggccgatatggttatatcgcccttagttgtttttatattgtaatcggttgtgttttgccgatgtacaattgccgatatagatatatttcccttagttgttttttattgtaatcggttgtgttttgccgatatacaattgctgatattgttatatcgccctcagttcaatttataattttgtcaatgccttcgtcattgtaaaattaggggggcacatatatacaaaagttgcaaattttttgagcaatattaatcggcatagtaattcagtcacaaaatgagtatcttagccgattacaaaatgagctatcctattacaagaccaatcatccagacaagtaacactggatagccgacacagtcccttgtctaatttgatctacttctttgatagcttgaatgtcttcggcatcggttccagagatgactttgagggacttggtcatgtcagccacatttttgatagccgatctcaatctagacttctgttcttcaatagcacttgggagattggctagcttctgccctacttgatacaactcggcattgcattcttcaagttgagctataagatcaatcttgcgagcttcaagccgatctatgttcgattgaatcggcctgacagagagctgatctaacttagctttctcttcgtgcacgagttgccgattggcttggatagtgtcttcgatatctttccggtcccgccgatcggctatccgttgcttagccttcttcaggttgaattgatgttgctcgaggtatatagctggagtaatggtgtttgccagatcgtctgggatttgggcttggatttctgcaaaccgtgcctgaaatgaaccacagtccgccaccagattatccaatgatgactctagccgaagggatatgtcttcaagtattttcttgacagtttcatccagaggggctagagccttgctggtggattcatcttctgcttcttcatcaaagtaatctttgatgtcaaaagaaaatagatcggctaaggcctgcaaaaagagaaatttgaagatagttaggtatcaattagttttagccgatctaagatcttatgtcaatgaaagacttaccgggatggcaggagcggctggttgttcttcttcttcaacatggtggcttcctgtagtcgatggggtacagtcacttgacatctgttgcacaggtggtgaaggaggaggaggttgcaaaaagacaaagtgttaagtaaatatcggctgtgataggataagtgaaaggatttatatatgacaatcttactggtggagccggtttaagcgttgttgctgctgatttcttcttttcagcgatcttctttttcggcaaatgggaaattgataagtaatcggctatgaataaaatgattgcaagaggaaattaatgtgagtgatttacccttgataagtgagccgggacagcaggagttggaggagtttgttgggcgaagccgacggtgttttttctcctgtatcactcaattcggctgctgcctgatcaacgtcctcttcaatttcttcttcatccagagcttgctgaatggatggatctaaggtgggcaagtcatcggctagcttgggtttgtgcttcttggccttcttcatgggagccaaagccgatggatcgattgccggtgccttggtctttctcttcctgccaacatcggctggttctctcatctgcccttgaagcaaacttgaggtcttgggggcatggtagccgatgacaggaggagttaatccaccaccatttcgcaaaaggcccggagcatattctatgtctttgccactgttgctcttgcgtggaggagaagattctgttgtctgtaaggtatagagagaaattagtcaagattcaagtcggctaacaatcatttaaggaaaattgacaaagtaaagatgtacctgagggactacatcgggaaataggtctgtcatatacatagaggccaattgatggaatatgtgttgcttccattctccccagcatctgtcaaagtttttgctcctaaactttgccagctctatgttatcaatgctgcccaaaggaggtcctgggatgttgagtagccaatccatcatcagggttgatgaaatctctcctcggcattggattttatcggcaaagaacaagccgattggtcgctgtcccattccaaactgtctggcagagctcatcgggtggtaaaactcataagaaacctgtatgtttcttccttgatgaatgccgacaggaaggatgcatgggtaatagcagctgagaagacttctctggatttgtcaaatttttcggagttgatatcttcaaatctgaagtcggctgggagatccaaattgactaaatcttcatatgggaaccaaacccgagcatctttctggaagccttcgtaaaagctgcagaaccaatcgttgagtaattcagccaataactttgctccagcatcggctggtgtggatgcatattcctcataggacatacacctgcggtgggtgcgctcttctccatcaccatctgtaatcggctctaatcttggaaattcagcttctgttacggctggccgattgacagctttcatggctacaaagtttatccaagtttgcagcaaccaccatggcccgcctgcactaacaactgagccaacagcaatcttagccgatgcgttgttcaacatttggtacaaatagccgagaagaattttggccaaaaggaactgcctctttgtctcaagggcttcggctaagaactgccagttggtggtagggccacaacttgatccgcagaagaggaatttctcaagccacatcagaagaaaagctgtgtgctccctaggggtaacaggtcctttgcccatgtatgctgctacataaccagaccagccacctatgctcttggttttgaagtcaaactggttcttggtgtttaaactcatggggttggctgatgaagttacatctaatccagtaatcatggtgatgtcatgcagagttggggtcatcggcccttgattgaacaaaaaggcattggaccagaaataggcagcagatgccatcaggggttcgtcattatccaaatttgccaaagtaagagcaagcgcttggctgattcctagctcatcccaatgaacatgcttgctagccgaaacacgtttataccacacagccccacttttctcaagagcggttttctcgagagaaggccaagacttgaaggtgttcttctagtgacctagattcaggttggctaatctgaaagggatcctattggtttcggcaataatgaattcagtggggttgagattgccgatcagcccaagaaaataatgatgctcgtgtgacaaactcgggattgcaaccagattggacaggtgctacatatgtgaacaagaagagagaagaataaaacaagatgaggcaaggaaaaaccaatctattgcgaaaggaggggatctagccgatgaatacttacctccgcgtattcagccgatggtgcgactgacgggctggcgtagtacgacatctctgtgggcggaagatttgaccggaaaggaaatcgctttgagatcgccttgtgcgccgaggggttcgctggagagagaaaagacaaagttggcttaagcggtgaaaacggagttaacggtgtgaaatttgtcgggatgacggttagtatttaaagcgatgcggtaacggtcggaaaaatggcaagtgcgatatcctctcggagttgagatatggaaaatccgaaacattatcaaatattccggacttggggggcatgttttaacgaccaaatttggtaatccaagtatcggagatgaagatgctatcgaggcggagtttgagatggaaatcattccgggaacagagtaaggatcggttacgactaagatcggcatagttcgagtcgggctaggttagctgattgaaccgaatccgacaatgtgacacggtacacgttgtcaggttgagttaatgtgcttcatgaggattgccacgcacggattgagtcctgagaaggcaattgtatctattaattaggatatgtttggagatatgtttgggcaaaagtcttccgcaagacttatggtgtcttagagttagttagagataagagtcgtgtccgacacggacatattttgtaatctcgggtataaatagaccccgagccttatgtaatcaatctaacactcgttcaatacatcgcccgactcccttttactttcattttgtttcaacgagttcttgctttcgggttgagctgcatcgatttcgatcttcaattagaggtaaaacttgttatggtggcttgcgttctcgggattagtgcttccatctttatgatactctaatctcatttatgtaattcgtcgagttatcatatatcctatatagtctctggcaatatcgttatctaacccccaatcggctaacatctgtcactagaaggcagccgattaggttaaatactgatgttgactttgattatataagatatttaccactgtatgaaacatccaacggcttgattgtctagatattgtccttcttttcatacttatagctgcatcagttgagtttgatcttatacgtcgtgattagaatctcaatctttagcctgcttttggttgccgattacggtagtatcagggtttcagccgatcttacctaatttaactacttcgtactctatatgcttgattgacatgttaaatctgccctttatattacgatcttgttgcatttaagtatattaggcttttgtttagtatattcaacttgctttaatatcttaatatagagtagtatcagagtattagccgatacatgctagatctatctgatcggctatgttatgaacatatatagtcttgttgtgaatatatatttcgatctaagtgatttatactgtctcggcatggcgaccgatctatcccaatcacttgatttaagtatatatcgacataagaattatatattgtaaatgtctatagccgatcgagtagatttagttctttcttacttattcatgattgccgatcgatctacatatgacatcggttcagagataaatgatacgtcatcggcaactagccgatcggctatcatttatggatttaaccgcggtttctttgtctttatttcttgttgattgtaggatcaaatcagctggcatgctcacacacctaaaggcaagcttttggacctacactggagttaagcagatctcccaggcctcgtgtttttacatcaacaccttgtagaagaaacgggagaaaggtgggatcagccctgccatggtgaaggacagaaggtgcacggaccgatccaggtaccgcggccgcggctgcggttcccttgccctcacgacggagccgtccggcatgatcttgcggatgaggctcaagtgtcgctcttccgtgatgtgcgaagacgggagaacaacattcccggcgtgttgagccatggcggccggtgagtatgagcgagaaactgagtaagcgaagcgcggtggtcggaggttgcaacgatagggcgctgaggagcgcgagtgtgagagaaagaatggcgaaaggatgtagatgaattctcctcctccctcactttttattctcgcgtcggccgcgcccgcctcctcgtttttcgtgcccactcgtcctgcttcccctactaaatccacgtcccgtgtttaatgcgcctgtcagcggcaaaatcgatgtgggacgtgcaatgattacggttgcggttgggcgggcccaccattagttccgtcccctcgcgtgcctgatagtcaggcagtcgaggtgatggcaagtaatgattccgagcgcggtctagcagacccctcggttttcctgccctacgcgtccccgtgtgtggcgcagttattagcggtcaagtcatcatcatggtaggtgctcaagctaggcaaaccgatgacggccgtttggactccccatgggacccaccatcacaaaacaggaagttatgagacaccgcgccagaccgccctggtagggttacggtcagatgtagtgctaggggctactgtcggtgatatgggcccggtggtacgcaagatagagggaaagaatcctttcatttggccacgtggctgcatggcctgttcctaccccctcaggggagaacgagcgctcgtgaagcggccaaagggcctcggggtgccctgttgcacccctcgggcccttggagcgcactgccccaaggccctcacttagctaccacgtggcggccgagtgggcagagggagaggcactgccaaacgccttaaatgagcggtgccccaaccgtccctcaccgcgtttaatgtggcgtgggcggacgtgaggcgccgcccgattgacgtgcgtcaatcgggtttgactggtctatgaccggtcacaggcgcatgggatgggtggcagcgcacccacgtcccgccccctgtcaggcggagtgggggcaggtatgccccgtcccatcggcacgcagtcgagcgtgccccccatacacgaatccacaaaagtctccatggaattaagagggaatgacagggatgtcccccgtgtcagccggaggatggcactgggacccacctgggggcgaacgaccgccttgcttccggtcgaaggcatggacggcgtcttgacctaagacatgtgggcgcccatccaatgatggactgtgtaagacggtgcatgtggtattcccttgaatttattcaaagtgcctcggccgaagatggcgttgtagttgtacgggatgtcaacaacatcgaagagtatctcttcttctctcttgttttcttgtgtgccgaaggcgactttcaagagggcttgacccaaaacttgcactgcttcgcctccgaacacccaagcgaatttggtacttgagacaacgccagggtcggtagtcccatcttggcatacgttctggcgaaaatgacatcagctgagctacccccatcgatcaagatacgccaaacttcaaaaccgcccatttgtaccgataccaccagctggtctttgtgtgggaacagaactacttcggcatcctctggtccgaaagatatctactgcgtcaagtaccttggaaccccttcgcctgccgaagcaatgttgtgcattgctcggagttgcatctttttctagcatttcgacgcctacgaagggcgatcagatcttgtgatgacttggatcactcttcattgtgcatcttggcgctgttcggcctggggtgcttggacatgaacagcttcgcgaggcacctcttcggctctgactgtctgcttccttggagcttgagtgttgccttgctatcggatatttggacattgctcaattgtgtgtgaagagcaaccgtgaaaggcattgtacaaatctttcttgactttcttgcgaaaaggttgttgctggcagactacttgctgtgcgtctaactccttgcggagggcttgcacttctttgacagccatcactacctttccggcgcgatctattctgaactttttctaggtcatcggaacttggttcagccttggaggctgcccttgattcgccggaggtgaagggcgaaccatcacaggtgtcgaactaatggcttgcttgagcttgggcctaagcttgagcttgtgcggtggcggttgcggtggcagctgccttgtcgtatttggcttggatttcttgccgccacttggtatcttcttcacctcgagcataaccatcgattatgcgaaagatgtgttcgatcgtccttgtttccttgcgagcgatttttcttgtgagttcacccttaagcaagctggccaaagctgcgttgatgacagatgcttccgttatatcttgcacttggcaacgcgcctgcgagaaccggcgcatgtaatccctcgtcgatttccctggcctttggtgaatgccaaggtcttgttgggtcttcggctcctcacaggtaccacgaaaattaaggacaaagacatcgcacaattgctcccatgagcaagtgctattaacaagcaagttaaagtaccaagatttggctatgccgtcgagcgcgagttgaattacctttgccttgatattctcatcaccatgagcagattcaattgcggattcgtagatggaaaggaactcttttgggtccgtttctcccgagtaacttgggacgggagggtacttgaattgggtggggaaatgggatgactcttgattccccagcttagtggcaaacccttttcgccacacggctttatcactgcacgatactgggaggaccagcttatctgttggtatggaagtgcgaatggcgaagttacggcttgcacatggggttggctgcgggtgttgattgatgccccgtgccgaacaccaacgcctgggtctgctgaaccgtcgaagcggcttgcgccgccatagttgggtcgatcatggctcggttccaggcttggttcggcggtggaactgttccaaacccgggaggcacgacatgcatgaaggtcatgggtgcttgaatcgtggcgctggggttgaactgtggtagttggcttcgaggcgtagcaccttgagctagctggttcgcctgacttggcatggtgaactggcctaacagttgcccggccggagcaccctgacttggacttccctcgacttggaccggaggcaaagttcttggtacattgttgttgggttgattgagctgctgtagaaaatgcttgaaactaggcttgcaaggccaaagctgcctccatcattgcttggggcgtatgagtaggcttcaagtactgtacttgaggtgctaccaggcgaaccggcaccgaagtcatgtgaggggtagggcgcgcggccatagccagagcggtcttggcgaagtacattggagcctgtacaacttgtgcaacatgcggagggaaagcttggggctgtgtgtagactgtcgaaaactgctaggcattagccttggcttgtcttgccgcttcgtacgcctgctgctgatcttgcatttggcgaagcgtgtcctacaacttggccatgttctgccgcatagcccccatgtcggcttcggcttgggcttcaaggttagcgttggcttgtgaggcggtgagtgcggtcgaagtggtagcatgctgcgacgaggcggcggcttgagacgcccctagcacttgagatgaaaggattacgtccctaatctggagcgccttcgccgcggccgctgctttcaccgtctcctggtctgtcgaagtggtcggcgccgaagatgggagagaaggcgctgccaccggaagcagcgcagctcctgcttcggcgtccgaagccgaaggctctgctccctcttcgccaaccatctccccctcgctgtttccttcctttcgcttggctactctctccttagcgatcttcttcggtggcatcagtggtttcgctcttactctcaatggttgtgctcggaggtccccacggacggcgccagctgttgtcgaatcgacaactgcctcatgtcgaaggacgtggttcgtttaacagttgttggaagtaaagacaattgtattgctttgtaaaaattactcagatccccctgttatatggccctagggggctacttatagccctattacagactctccctttagggtttaggctttacaggagaatttacatggttgcctttatgatagggacatcttcatgggcgtacagtgtcttttgctcgaagggctcctaatgggccaagtgactcggcccagtccttggttaagcctctgaaaggcgtgtcggctcgctgggccttcacctggcaaggttcgatacttggcgaaacccatgcccttcgtggcaaggctttcgcctcatggcctttgaccgtacgcccctccggcagggtccttctttggcaaagcttgtcaacttgatgccacggcttttttcatttggctttctcctatgttgtcccttcgaccttcacctcttgcctccagcaagtgcctttgcctatgtccttggcttcggtaggcctggccgaaggtgtcacgcccagaaattcccaaatagaatttcaagcagaatgtgcattaaacccctgtccaggactggccagggtacacaaacgacaaagttaacatatagatccacgtcttacaaacattataaaagtcttacataaatgcagcggaaattaaaagataactggagctaagccttgacttggatagtagcaggaacaccactccacaggcatcctcgacgggacggacgaagcctactccttggagaaaccaccatcggacgcatactcgaactctaagggttgggagatagagcaacactgagtactacacactgtactcagcaagtcataccggaaaggagggtatgatgcaatatataaccaaaggaaggcttaaggggatcatgtgcataaagctagcatttataaacggtagttgaaagcagaaaaacaattgtaattattaatcaatattaaatcaatcactgctcaatgctagaccacgttgagacaggcccacaccaccacctgcactaatcagttccattaactaactagggatgagactaatcacggtgaatctggttgaccgcccataaccgcgggcacggctattcgaatagttttactttgatcagaggtgtacaactgtacccacaagacacatccccacgacacgttctcgtgcgcccacatgccaccacgacataccggaaaaaggccatgacaggacccttcgcataaccccctctaaccaaaaacaccacacctcaggtttcaccaccactcctcgcaaggcagcgggcagtcccctctcgtgcctaggtgaattcggaagcgacaaaggccatcgcagggcccatcccgctccatcacgcccacccttgcctggatgcgtcagctagaggaaagctacactacaagcccagccgttgcccacgctggcttgtggtaagttagaggaattcttccatggtttcccgcgaacctgtccttaattgccatgggtgcgccatcaaaactatgcacccacaacccaccatttaatatattttaattagccaacaccagagcggtggcactaatccaacatcagtacaagaatctgaagtctatgcattaatgtaaatcccccattgtgtactagtagaactaagcatcgctaagcaacccctaatccaacatctagtcatgttacatccccaagctaacaacggaacatgataacgaatgataaggctgagacagtaggtaaacaacccatagtaacattataaaacaatgcaatatttaaaggaaaacaatagagcatttgcaatatgggatcaacatgttcaagagacaagcatgacttgccttgctttgcagctggagggacctcggcgactatctcaaagtacaccggagcgtcgggagattcgaaatctatgcgacatacaaagcaaacaatgcaaacaggctataagactattgaaacagagaacaaaacaatttttaatggactctttgcatttttcagatgcgctggtccatggtggaccgagtccacgggaccggggatgggagtaccacgcggcgtcgacgtggcaccgacgtggcggccacgcgggcgtcggatggacggccccgatctacctgagaacggcaaagacggcgtgcggccgggtgcacacgcgggcagcttaagccggcccggtggcctggcgcgcggcggcgcggcgccgatggaggcggcgcaaggcggcagccgacggcggcgagcggcggcagcgcggctaggcggggacactaggcggcgatgcgggagagagagaagaaggagggaggcctaacagacgatgacgagcgacaacgagtggcggataacggcggcgacgatgggacgggctccaggacgacctgaggaacgaaccggaagggattagagagggagaaacggagtgagacgggcagagacgccggtcgaaggcggcgacaatgtcgagctcaccggcgcgcgatttaaggagggctccggcggcgaaattggacaggggaggggtggacggcgtggcccttgggctcgtgaacccgacggaggcaatggcgtcgcttggcggcggctctaatggcggcgagcggtggccggaggcagttaaaccggcggcggcgggtggtgcgtggcgctaggacggagaagagctcgggagcgggcgattgcaatgcgaaaaagagagaggaggggccggggatggtttataggctcgggggggcgagtcgtggccgggaggcgtgggaatcggccggcgacgtgggggaggtggggaggagagaggcgggattcgaaaatcgaatcccggccgtctcgagcgcgggcgcgggtgcgggcggggaagtggggcagtggttgcggggcatgtgggaggtggcgtgggaggcgggcgacgtgggcggggatgcgcaggagaggtgggagcggcggttatgggcgcggacggcgccggccgaaggtaggggacgggtccaacaggtgggccccacctgtcggtgacccggagaggggaggggcgtgggcggctgctggatgggcctcggcctcgggctagcccagctggcgcgcgggagggggaggggatgtgggccggtggcccaaaaggaaaaaggagggggaaaaagaaaaggaaactgaaaaagggttttttccagggatttaaataatgcttgttctcgatgttaattggttaaatttatttctagagctctgaaaattccactaaaaatcctgttagcatattttgacgctaagaacccaagaaaatttccacatgccatttccgattattatttgtgttaattaaattaaggtttgtctcttgcttttacacaggtaatttcttcagaccatttattactttgatttaggcttgggaaaagaacttcagggtgtgacaaacctaccctccttaaacgggatctcgacccatagattgggaggagctggcgaagaggtacggatgggcggcctttaactcatcttccctttccgatgttgctttttcctcggagtggtggctccactgaaccctgcagaacctgatcaccttgtttctagatctcctctcgctggtttcaagaatgcgaactggcttcaccacataagtcggatcttcttgaatatcgatgtgctccgaattggcttgctcttctggtacccttaacacttttttaaccgcgatacatggaacacgtggtggatgccagccatgttgagtggaagctcttgctgatatgcgacttttcctcttcgttctaagatcttgtatgttgcacgaagcgtggtgccaacttacctttcgtctggaacacgaagatacacataatcccttgcttcaaaggtgagctcccttcagcggttattagcggcactttcgaccatacaatacttcaaacggtgccatttgcaaattgttctgatagctgttgttgtaagagaattcagcataaggcagacttttgtcccaggctccgccaaaatcaagtgcacaagctcttagcatatcttccaaaatttgattgaccctctcggtctggccatctgtctatggatggtaggctgtgctgaaattcaaatgggtccccaattctacttgcagcttctgccaaaactttgaagtgaactaacttcctcgatcagatacaatcttcttaggtaccccatgcagacacatgattcttcctaagtacagctctgccaatttcttccccgtatacgtggtgttaactgggatgaagtgagcaaccttggtgaggcgatcaaccaccacccatattgaatcgtgtcctgacgatgtcctaggcaaaccagtgatgaaatccattccgatttcttcccatttccattccggaatctgaaggggctgaagcagtccatcgggtctctaatgttctgccttaactcgctgacaaacatcacagactgcgacgaactccgccatttccctcctcatgctggcccaccaaaatttttctttgagatcctggtacatcttggtactgccgggatgaatggagtattgggtctgatgagcctcggtgagtatcaggtctttcaactccttgtcttcaggtacgcaaaatctttctcccaaccagattgtgccatgctcatcctcatggaaatcacgggcttttccgaacctcatattctttttcagttcagctatttcaggatcatttacctgaggtgctcggacttgatccacgagcgtgggtcgtgcttttagggcagccacgtacctatgttccacgattcccaaattgagatgttcaagctcttgttgcaatttgacgctcatgtcttcaaacccaaggcgttgcagtagttcttcctgctcaaagcgtctgctaccacattagctttgcctagatggtagtgtatccccatgtcataatcttttatcaactctaaccatcttcgttgtctgagattcatgtcaggctgggtgaagatatactgcaaactcttgtggtccgtgtaaacttcacaacggttaccgatgaggtaatgccgccagatttttagagcgtgaaccactgctaccaactctagatcatgagtaggataattgctttcatgtggacgcacctgctgcgaggcgtgtgcgaccacttggccttcttgcatcagaacacatcctagcccttggcggaatgcatcacagtagacttagaaatctttcgattgatcgggcagaatcagaacttgagcagacactaatttcctcttgagttcctcaaaactcttatcacactcagctgtccacttaaatttctcatctttcttaagcaactgagtcataggcctggcaatcctggagaaattctcaatgaaccgacggtaataacccataagtccatggaaacttcgaatctgggtcactgtcttaggtggggtccactttgtaactggctccacattcgatgggtccactgccactccttgagcagtaatgacgtgaccaagaaatttgacttccgacaaccagaagtcacacttactgaacttggcatagagctggtactcttgcaacttctcgagtaccagacgaagatgttgctcatgctcttctcccgacttggaataaataagaatgtcgtcaatgaataccacaacaaacttgtctaaaaattccgtgaacactttgttcatcaggttcatgaagaaagtcggtgcattggtaagtccaaaggacataacagtgcactcaaacaaccttgggaatatcctcttcccggattctcaactggtgatagcctgatcgcaggtctatcttggaaaacactttagctcctttcaactgatcgaataggtcatcaattctcggcaacggatacttgttcttgatcgtgacctcattaagtgcgcgataatcgacgaacatcctcttcgtcatgtccttcttctccacaaaaatgatcggagcaccccaaggtgaagtactcggtcggatgtatcgtttctgctgctgttcgtcgacttggttcttcacctctgctagctcattggctgccattctatacggcctcttgtagattggagcagttcccagtgcaaaatcaatccggaactcaatctctctcttgggtggcatggtagtgaggtcctcggggaacacttctggatattgatagacgataggaatatcttccaatttcgtcgaactcttctcctctgcggtcacagaacttttcgcctcaaccagattcaatgaggctccttgcttgggtgaggctggagacttgtacaccactgtttctcctttctcattgaccaaggtgaccgtgcgattcacacaatcaatgacgcccttgaacatggtcagccaatccatcccacgaatgacatctaggtctttggattaaaaaagaatgaagttggctagaaattgtgatctctggatttctattaccacggaggggctataatagacagaggttgaactatttcccggggtatgaaccctcattggtgtactaagttcttcccttcttatcccattcaccccaacaaacttcttggaaatgaatgagtgggttgcaccagaatcggaaagtactgtagcagggattgagttaacaggaaacgtacctagtacaacctctggtgctgtttgtgcctcctctgcagacgcatggttgacgcgggctagaacaaaccttggcccggcacggcacggctttgggcacttgtcagcaaagtggccatgctcgccacagttgtagcagggccctggctttgccccggtctcctttgcttgagctggtggagctggctgtgctggtgccattagcgggcgcggagctatgctgcggttaagctgacctccctggtggttctggctgccactggcgccttggtggaagttgtcgaaagggtaggggtggtgttgtcaaacaatcatggtggtgggtccaccttgctgtccggaagtgaaacgcggcctctggtgacttccctgatgtgccctgaactaagcggccttcctattcctgtccatcttgttgagctgatcctcctggcagattgccttgtccaccagcttctcgaagtcagcgtaatccttggagatcagctggttggttagctcgtcatccaggcctgccaggaatttctcctgtttccccgcgtcggtgcggacatcttccggtgcgtatcacgctaggtggttgaactcatgcaggtactcagtcacggtcttgcttccctggttgagtgccgggaattccctctttttctgtgccacgaccccgtctggcacctgcgccttcctgaagctgcgacagaattccgcccaagtgacttctatgcctggtggacgggtagccatgtggttgtcccaccaagctgacgcaggaccctggagctggtgtgtggcaaaggcaaccttcccctgatcattgcactgcagaaggttgagtttcttctctatggcatggagctagtcttttgcctccaaggggttggtggtgctagagaatataggtggcctgactcgtagaaactctagcagcttggactgaggggtagggggaccaaactgctgctgctgatcggcctgctgttgcatcctctggtgcatctgctggtgccgctgctgcatcatggccgccatcatctgggtctgatgggccatcacttgtgcaagcgtcgggttctcggggagcggtggcggaccattgctagaggggctgttggggtgcccaccatcggtgcgttctttgctgctgctgccctcacctgctgcacgactgccattcctggtgttgaccatctgaaggaagaacagacggagcggatggaaaagaagaaaaataggggctcaggaactaagctttattatataggaatttaaattgcaattgctcggaatgcagtcgacaaacaactactaaggcgtcctcctgcttgtcgcctggtccctctgagtggctcctggagtactctagctggtaggtgtcgccgctgcatgcctctgagctagaactgctgatgcacgaccaccactgggagaagctagcagccatactccactgccacctactggacccctgtaagctgaagctggcacaaaggagagggcatatgctggagttggcgctggagcaggagcttggactggagctggagctgcgggaggaggtggaggcgggttcctgggcgcgagctggatgcgcacgggagctgtggccaacttccttggcatggtgcggatgcgggctcctcctggcggtgggcacccctgcagcctggctacctgcttcttgaggcaactgttctcatcctgcagctcggcgatcctcacaagcttcttgtcgttgagcctcttggtcgcccggtgaagcatagcgtgcagcttgttgtagccttccatcacctcactcatgtggccgaaggtgacgtcgttctctcgccaagctgacttgaaggtgccggtgttggagctggaaccgcgacaagggtggaagcagtaggcggtggtgttcagggtgtcgtcgtgcagctccctcaaatgggccatcatcctgagggcggcctcctcacaagcatgctcaaatgtgccccggcaagctgtcacctccatgttgggtaggtaggaggggatgccgtgaagctccaagcggacctggtgtgggaactcgccactgagagggtggatgctgctgtgctgcggctcccatggaaaaccgatcacaaacgccatgcgggacagctctgcgatgaatcctcccatagtctgaccttggtgtgttaggggacagccggccatctatagaagacaaaggatggagagtcaatgcatgctcaaacccaattataaaattaacggtaaaggactcaaataaaataagcgaataagagcggaattttgtgcatagatcatttttgcatgagagcaaataaataagactgacatacatagcaacaaaataatgaggaattagatacataataataataatagtaataataataataataataataataataataataataataataataataataataataataataataataataataataataataataataataataacaagagcataaataacctgcaacccatattccttagttaggacctaaggcatacctcccattaaatcccgatatgtcccagataattttactaaaaccataggctgacctcatttgaacaaatttcaatgaaacgagcgatcatgaatttttccatgaacccaaggaacaaatccaaattttcccgaaacaaatccaattgcaaagaacatatgccaatgaaaaggattgggagggctcttagggtttctatttggcttatcctactgtaaaggtcggctctgataccaacttgtcatgcccagaaattcccaaatagaatttcaagcagaatgtgcattaaacacctgttcaggaccggccagggtacacaaacgacaaagttgatatacagatccacgtcttacaaacattataaaagtcttacataaatgcagcggaaattaaaagataactggagctaagccttgacttggatagcagcgggaacaacactccacaggcatcctcgacggcacagacgaagcctactccttggagaaaccaccatcgaacacatactcgaactctgagggttgggagatacagcaagactgagtactacccactatactcagcaagtcataccggaacagagggtatgatgtaatatataaccaaaggaaggctaaaggggatcatttggataaagctagcatttataaacggtagttgaaagcagaaaaaaaagttgtaataattaatcaatattaaaccaatcactgctcaacgctagaccacgttgagacaggcccaaaccaccacttgcactaatcagttccattaactaactaggggtgagactaatcaaggtgaatctggttgaccgaccataaccgcgggcacggctattcgaatagttttactctgatcagaggtgtacaactatagccacaagacacagccccaccacatgttcccgtgcgccgacatgccaccacgacataccggatagaggctgtgacaggacccttggcataaccccctctaaccaaacacaccacaccttaggtttcacccccactcctcgcaaggcagcgggaagtcccctctcgtgcctaggtgaatccagaagcgacaaaggccgtcgcagggcccatcccgctccatcacgcccacccttgcctggatgtgtcagctagaggaaagctacactacaagcccagccgttgcccacgatggcttgtggtaaatacgaggaattcttccagggtttcccgcgaaccggtccttaattgccatgggtgtgaccatcaaaaccatacacccacagcccaccatttaatatattttaattaaccaacactagagcggtggcactaatccaacatcaatactagaatctgaagtctatgcattaatgtaaatcccccattgtgtactagtagaactaagcatggctaagcaacccctaatctaacaaatgataaggctaacatgttacatccccaagctaacaacggaacaggataacaaatgataaggctgagacagtaggtaaacatcccatagtaacattataaaacagtgcaacatttaaaggaaaacaatagagcatttgcaatatgggatcaacatgttcaagagacaagcatgacttgccttgctctgcggattatctcaaagtacaccggagcgtcgggagagccgaattctgtgcgacatacaaagcaaacaatgcaaacaggctataagactactgaaacagagaacaaaaccatttctaatggattctttgcatttttctggatttactgagacttgaatgggcttaaacggagcacagatgaattttctatgaattttagaagattcactttgtttttacaataaaagaaaaaaccttaattggattattgcgcattaattaaccccggatgacgtcagcgaaggggggggggggggggcggcgccggcatgcgggccgcacatgtcatcggctcggatgtgccggtccatggtggactgagtcgacgggacaggggatgggagtaccacgcggcgctgacgtggcaccgacgtgccggccacgcgggcggtggatggacggccccgatctaccctcacgtagttcggacagcagaggcggcgcgcggcatgcagcggtgcggctctagcagcggcggcgctagcggtggcgcaaggcggcagctgacgatggtgaccggcggcaacgcgacggcgacgcggctaggcggcggcgctaggcggcagctgacgatggtgaccggcggcaacgcgacggcgacgcggctaggcggcggcgctaggcggtggcacaggacacagagagagagagaaagagagaggaaggagggaggccgcaccgacaacgacgagcggcggcaagtggcggataacggaggcgacggcgtggctcggcggcggctctaacggcggcgagcggcggccggaggtagttaaagcggcggcggtgggtggtgcgtggcgctagggcagatgagagcttgggagcgggcgattgcaatgcgaaaaagagagaggagggtccggggatggtttatataggctcgaggggccggtgactgttggcggctgctaaatgtcaattctataccgccaacatctgcataaaattcagataataaaacatccaacacagtgataaggtcttaaatctcacatattccacattattggtgtatatttatatgggaggaaacctagacttaaagtgaggagtatcatgtatccatataaggatgggttgtggacttcataggaacaccagagaaccagcccaaaacaccgaagaatggatagaggaggaccaggagaggagccaggccaaaggccaggcaaggggggccagcccaggttcggctaaaccccctggttcagctgaaccctgatgatcaccgttgatcccaggttttggcatggacactccagatgcattgctgatggcggttaaggtgcacttcggactatatcccttcctataactgtcatacatgtcctataaatagacctcacttcattcactctcacacacactttcaagctttagctgaattataagaggctctattgtactatattgtatactagaataggaaaagagtatagtagaagaagtcggaagaattctagagttgtcggtaatcttcttatatttcttttattctgtttattactctgaattcaatataatattcttgttgagtattttagatttatcttgtgagaattatctcttggttagttcctaagtagcatacgggattattgttcactataatcaactaaaatatagtgattgctttcgtgttttataaacactaaagtagatattaatttcatagacgtggtgtttaggtagttgttatccagtaattgctgcatatcccacagtacgtttgaggtaggtgtagacgtggtgacagccctcaagatcacttaagtcctccctgtccgggtacgtagtagagcgacatctgggaacagcgggttgccagtgcctgaagtattgcattaggattaaagttaagctttccctagacactatttctcactagtaaatcctctctatcctggcctatcattcgcttggtgtccttggatgaaccggaggatgatctgatcacacacgttcccttggatttgacacatttggaatactccgtaggggaagtgctaaatcgcggtatatccgtgcacttgcggattttatctatgatcgtaagattaccaacagcgacatgggggaggtggggaggagagaggcgtgattcgaaaatcgaatcccggccgtctccagcgcgggcgcgggcgcgggcgggcaggtggggcagcggttgtggggcgtgtgggaggtggcgcgggaggtaggcgatgtgggcggggacgcacgggagaggcgggagcggcgattgcgggcacgccagccggaggtagggaatgggcccaacaggtgggccccacctgtcggtgactcggagaggggagggcgcgggcagccactggctgggcctcggcctcgatccgccccagctagcgcgcgggagggggaggggaagtgggccggtggcccaaaaggaaaaaggaggggaaaaagaaaaggaaaaagaaaaagtttttttccagggatttaaataatgcttttgctcgattttaattggttaaaattatttctagagctctgaaaattccattaaaaatcctgttagcatattttgacttgaggaacccaagaaaaattccacatgccattttcgattattatttgtgttaattaaattaaggtttctctcttgcttttacagaggtaatttcttgagaccaattattactttgatttaggcttgggaaaagaacttcagggtgtgacagaaggtcctcatggtatacctccaatacatattatacatatatcctagttatatgattaaccttctaataccctctttctgatgccctcctggtactttgagaagccacccctgactgccgagttccttacgacagcccgtcatgaccatacaaccgaggctaaatacgtaggagtccccttcccagaaaattaatttaggactatatacacgcgcggaggaatacccgtattgggctgtcaccattagtggcccacctctcatccacatcatataaccccaaattatattaccctataatctagacatcatgcctaaactaccagatactactctaatgtcattgtcatgacgtagagtaattgcaattgcaagcattataattgtacctatgcatctcccagataagctagcagtataatcagtataacttgaacataaagtaaagctggcattcatatactcggaaagtatttcaataccagaattgtataaagaagaatattctaaataaagtacaaatcttatgaaagaagaaaggagagcaactagagccatacccgaactcttccgaagacttccagactctgatttctattctattcctactccactagcttgagactagtaaactaaacttgagagaatatgagagagctcttgcttgaagtgtgtgaagatagtgaggatgagagctctttaaataggcaggtatgatggttgtagagcatgtgaattgtcggaaatgtgtatattttctttttgtatcctcaccaaggcaaaatgtgccagaatttacccctattctaaggctgatatgtggagttcggtagggataaattgtgacatacctgcaacatatatattgcaaagccaaagatatggactcaagaagatcatcagtcatacccctagatcaagggtctttatttgtggtagaaaatggaaaagtaaaatattttgtggaatggtggaataaagaaataattctccccttttgctagactttctctccattttgttttcttggcatgaatatagaaggggcatggctatattttgttttcatcatgctcaatgttttaagagcaaactttatttcctttttctctcttttttttcacagccatgtctttccctccttttatcattttctttttgccaagaatttttctaggagaagaaagcatggtctaaagttggagtttatttgaatggaatttttgttggaaggcaacttccagtgtagaagattagcttaattatatatgtggaaatgaaaatggaaatgactccttgatcatgagtgtatgaaagatatctaagacgagtcacataaatttgacaaaactcaatataatgtcaagcagtcatacgcataataaggtttatcaaagatgcacttgcatatggccttggtaggaataaagaatgaagtcaattggaggaatgagcttttaaaacaattttattttgaaaacaaattcccaagagtcatgacaaaagttgcaagaattcctttcatctttattcacctcacataaagcaattacttagatgcataaggttccctaaacatggatggctgttcacaagcacaagttcagctgagaataatgaatatacaagatcaatcatctgaagaatttcattagttgaaaattttatcttttacttatgcttgaaccaattgttttctgattttcagctctagtactataccatggtggagatatacagataaaagacgtgctcacatgctcacctgtgaaaattgagagggattggggccagctctggttcggccgcatctggtagttcggccgaaccactctggtgcccatttcctctgcaattttctgcagagttcagtgccttccaggtgttcagagattcaacaatattcagagtatgtgcacgttagaagctgcgatatctgccccacacttattcaaaaacctgaattttattaaacaaaaacaaacttcagcaaacattggggttaacaccaatgagccacattatttatagcaagtgcttacatgattggaaaaataaaaccaagcacctactattactttatttatgggagaggagacatctaattagcataatatttattctccttccccatctctacgaatgcatgctttattttagcacacaaaccgcgactaagggtatcaacattatttctaagttcagcgagttctacccctagttccgtgttgcaagctctaagctctatgttctccttgcggagttccctcacttgcgaggcgagcttatagaccgagggctccggtgacttcacttcatctccttggtattggccggccgcccttacaattggagggggcgtcaaatgacgcttcacctttataggtggagggatacgggattctgctgccccctccttttttgacaccgtcaaaggccggagcaagcccttaccatacccaccgccaggagttcgcactccctgaatgcggaaccgatcctcctttggagtggatggagtagtagtagatgtggtgtacttgtggagcacctcatctcctgccttagtgaacagggtgcccacatatcgctcggcggaggcggaacggccttctcatcatcttgacaatggcgtcgtgccttcaagagaccgagcttgcctgttgtcagccgtcgcgcaggtgaatcccccctgaattttggtcttcgtaacatggcgaggggacagggatcacgctgccgaagagggggccgaacgtggccgaggagggttcggccgaaccagggtattcgccgaagtgctccaaattcgcaggggagcccgacactgtcacaaggggctgcgcccacagtgcattcaccccttccatggtgtagtgttccaccgggatcaattgattcgcccatgtcggctctccgtcaaggttgtatgtggagttggaggaagagccgatgaatgggatcaatgatttgccagccattagtgatttggaggtgatggagcaatagaattgagatgagaatgagaggaggcttgttaaagtgggagagaggaggaagaacagagctctgggtctgatacgactgatctacctccgaatgcgcatcacaacggattatagacgagcggggagattgaggttccaaattggggctgatcaggcgccgccctggttcggccgaaccctggtgggtcccgttaggtgccaattttttttctaggtccactaaaccctaagctaagcataaaaatgacaactatacaatgttttaagcatgcattagatgagatcatcatggttaataatcgattaattcaataacatccacttcttcatctacagtttcatttggctcaaggaaaatctttaagcgttgatcatttaccttgaatatatttcctgagtcgtcgcggggtgtgattgccccgtgcgaagaggtgtcgattacgacgagctgtccttcccatttactacccaattttccgtggccgaagaggcttaaccctgtagttgaacatcagtattttgtctcctagcttgaattgcttgatctttatccttttatcatgctagtgctttgtcctttctttatatatctttgcgttggggtaagccttctctctccattcttcaagtttagcaatttgcatttttctccattctcctgctccttcaaagttcatattccagttcctgatggcccaacatgctctgtgctcaagttctacagggagtcagcaagattttccgtagactatctgtaggggcacattccaatgggtgtcttgtatgctatccggtatgcccacagtgcgtctggcaatctatccttccatcctattcccattctgttgaccgtcttttgtagaatattcttgatcttggtatacccacaggaatacttctctaggatagcaggggtaaaggtagaatagaaaagtaaaaaggatacgaggatgagcaaggtttgggaatgatcagcaactgttccccagcaacagcgccagaaatgcttgttggtatttcttacgatcatagatagaatccgcaagcgcacggatataccgatgtagcacttcccctacggagtattccaggggtatcgaatccaagggaacgtgtgtggtcagatcttcctccggttcatccaaggacaccaagcagatgataggctaggatagagaggatttactagtgagaaacagtgtctagggaaagcttaactttaatcctaatgcaatacttcaggcactggcaacccgctgttcctaaatatcgctctactacgtacacggacagggaggacttaagtactcttgagggctgtcaccacctctacacctaccttaaacgtgctatgggatacgcagcaaccactagaaattaattacccagacaccgcgtctacgcaattaataactactctagtgcagatcaaacactaaagcaatcactataaataaatgacaatgatcccgtatgctatttaggaactaaccaagagataattctcacgagataaatctaactcaagaagaatattatattgaatttagactaatgaacagaataaaagaaatgagagaagattaccgacaactctggaattcttccgaattcttctactctactctcttcctattttagatacaatatagtacaatagagcctcttataattcagctgaaacttggaagtgtgtatgtgaagtaaaagagtaatgtcgttatatagaggtaggtatgacgtttggtgaaggggaaaggtccgaagtgcccctcaaccgccatcaggaatgcatctggagcgtccatgccaaaacatgggatcaacggtgatctccagggtttcgccgaaccagggggttcggctgaacctgggctgggaccccctggtctggcccttggcctggctcctcctagtcctcctttatccattcttcagtattttgggctgattctctagtatttgatgaagttcacaacccatccttgtatggatacatattccttctcactttagtctgattttcctcccaacgtagggtttatcaggcaatgaattcttataggtctacgcactttgtggagaaaattctttatgcagcctggaatatttggaaacagaggaactctctgattttccagaatttagcaccctcaatttcttcttggaaagctctctttaagagtgatctttcccttttggtttttggattaaatgtttctgagagacaatcccttttgaattggttaaatcttttgtaatttatattctttaataaagtattactgtgggggcttcccctatagtgctttccctcaaaaaaacgtagggtctatcatctgcatacaaatatgcaccaacacttgtgaaatatgtgaaattaagtacctatcactatgttggatattttattatctaaaatttatgcggatgttggcggtatagaattggcatttaacagccgccaacaagcgctaacgaccgtcaagaattagctaagatatccaccaccctgaaaattagtcaagggcttgattgtctatatattatgtttcttttcgtacttagtactgcatcagttgagtttgatctattaagtagtgcttagaaccaaaatccctagcctgctcttgattgccaataaggatttaattcgggttccagccgatgagttatctggacgttgcatcgacttacaaagattgcatatgactttgattgacctgatcgtgacaaagttttcaccgtttatctaatcgcttgcattatgacattggacctccggccgatatatgctttatccttcggattagtgcttattctatcttatcgttgttagccgattggtttctactggattatattgttgttttatcacattatcatcagtcgattgtctttatttacatcaagtgtcatattctacatcaaccatatagccgatagctcaaaatccattcactatcggccggtatcggcatcggcttgaattactccattggcttgtcagcgtgttgatgtgaaaaacacgaggcctggaagatctgcttaacttcggtgcagttccaaaaaatcttgcctttaggttcgtgagtgtgccagttgatttgatcctacaatcaacaagaaataaagacaggaaaatagcagttaaatctataaaagatagccgatcagctagtcgctgatgacgtatcatttatctttgagccgatgtcatattagaatcgatcggcaatcataaataagcaagaaagaactaaatcttttcgatcggctgtagatattaatggtatataatacttccatcaatatatacttaaatcaagtgattaggatagatcggtcgccatgctgagactgtataaatcacttagatcaaaatatatatattaacaagaagattataagcattcatagcatagccgatcagatagatctagcatgtatcggctagtactccgataccactctatattaagatattaaagcaagcaaaatatatcaaacaggaagcttaatatacctaaatgcaacaagatcttaacataaagtagttaaattaggtaagatcggctgaaacccggatgaaaccctaatcggcaaccaaaaagcaggctagagattgagattctaatcatgacttataaggtcaaactcaactgatgcagctataagtatgaaaagaaggacaatatctagacaatcaagccgttcagtgtttcatagggtggtggatatcttatataatctaggtcaacgttggtatttaacctaatcggctgccttccaatgatagatgttagccgattgaaggttaaataacaaaattgtcaaagattatataagatatatgacaactcgacgaattacataaacaagattagagtatcataaagttggaagcactaatcccaagaacgcaagccgccataacaagttttacctgtagctgaagatcgaaaccgatgcagctcaacttgaaagcaataactcgtgaaaagtaaatgaaagtaagagggtggtgatgcgccgagattgtattgaacatgtgttatttgattacatgggtccgggacatatttatacccgagatacaaaatatgtccttatcggacacgactcttatctctaacaaactctaagattccataagtctttgcggcagacttttgcccaaacttatctctaaggaaattacataaaatgtcctaactaatagatacaattgccttttcaggacttaatccgtgcgtggcaatccatatgaagcacattaactcaacccgacaacgtgtaccgagtcacattgtcgaaatcggctcaatcggctaaccttgtccgactcgaactctaccaattctggtcgtggccgattcggactttagctgattcttgctctgtttccagaacgatctccatcttggattccgcttcggttccatctccgatacttgaattaccaaatttggtcgataacacatgccccccaagtccggaatatttggtaatgtttcggatttgccatttctgcttctccaagaatatcgctcattgccgtttttctgactgtaaccgtaggctttaaatactaaccgtcaccccagagaaatttcacaccgttacctccgttttcaccgcttaagcaaactttttcttctctttccccagtgatcccctcagtgcgcaaggtgatctcaaggcgattctccctccggccaagcttccacccgcagcgatgtcgacttccgccagcccgttcgcagcgccatcagccgagtatgcagaggtacgtgtccatcggctagatcttcttctttatgcaatagattggtttttccttgtctcatcttgttttcttcttctctatttttatccgtagcatctttccaatctggttgcgattcctagcctatcacatgagcatcagattggccaacccaaatctaggtcactggaaagatactttcaagtcttggccttcgcttgagaaaagttctcctgagaaaagttagcccgtatggtacaagcgtgtgttggctagcaagcaaggtcactgggatgaactcggaatcagccaagcccttgctcttactttagcaaattcagctaaggacgaacccctgatggcttctgcaacatatttctggtccaacaccctcaatgccttcctattcaatcaagggccgatgaccccccactctgcttgatgtcatcatgatcactggtttagatgtcacctattcggccaatctgatgaccctaaattccaagaaccagtttgaatttaaaacaaaaacaataggtggctggtctggctatatcgccgcaaacatgggcataggatctgtcaccccccaagagcacacagcctttctactaatgtggcttgagaaatttcttttctgtggatcaagttgtggccctactaccaactggcaattcctagcagaagcccttgaagcaaagaagcaaatccctttgggcaaaatcctcctcggctatctgtatcagatgttgaacaacgcatcggccaagatagccgcaggctcagtagtaggtgcaggtggaccatcgtggttactgcaaacatggcttaacttagttgccaagaaagctgtgaatcggccagctctgttagagtcccaatttccaagactagaactgatcacaagtgacgatggggaagtactaacccatcgcagatgcatgtcatatggagaagctgcatcaacaccagccgattctggagcaaagctatcggctgaactgctcaaagactggttctgcagattctatgagggcttccagaaagatgctcgagtttggtttgcatatgaagactcaatgagctttgaactgccatcagactttagatttgaagaaatcaattctgaaagatatgataagtctagagaggtcttcttggctgctatcagtccatgtattcttcctgttggcatccatcaaggatgaaacatacaagtgtcttacgagttctaccatccaatgagctcggccaggcagtttgggatgggacagctgccaatcggcttttattttgccgataaaattcaatttagaggcgaaatctcatcaacattgatgatggatcggctgttgaacatcccaggaccccctttgggcagcatcaaaaatgtagaactagcaaagttcaggagcaggaactttgacagatggtggggtgaatggaagcagcacttgttccaccaatcagcttccatgtacatgacagatctattcccagatgttatccctcaggtaaatccttactttgtcaatcctgtaaaataattgtcagccgatttgtacctttactagtctcatcttctgtcttgcagacaatagaatcttcccatcctcgcaaaagcaacagcggcaaggacatcgagtatgcttcaggcctcttaccaaatggaggtggactaactcccccgtcatcggctaccatgcccccaggacctcaagtctactccaagggcagctaagagaactagctgatgccagtaggaataggaaaactaaggcatcagccgctaatccatcggctctggctccaaagagaaaggccaagaagaagaaatccaagccaaccgatgacttgcctgccttagatccatccatagaacaagccctagatgaagaagagattaaggaagatgtcgaccaagctgcagccgaactgagtgacttaggagaaaaaacatcatcggcttcacgcaaatagactcctccaactcctgctgctccagctcacttctcaaggggaaataacccatcttgatcatctcctgaaaaaacttgcagagttgattggttatcaattttgtatttgtagaaaaaaaaaactgtcgtcaagaaaaaatagcaccagcaccatctaaaccagctccaccggtaaggtttcctctataaaatcctttaaatatgatcataactgatgttaattaacacttgtctttttttcagccttctcctcctccttcgcctcctgtgcagtcgacgcccagtgatcgtactccatcggctgcaggcagccacaatattgaggaggaagaacaacgagctgctcctgccataccagtaagtctttcattgtcataaatcttagatcggctatataattcgctttgaaatttaactgtcttcaattttccttttgtaggctttagccgatctgttcttgtttgacatcaaggattactttgatgaagaggtagaagaaaaaataacaagcaaaactctagtccctctagatgacgatgtcaaaagaactcttgaagacatatctcatcggctagagacatcattagacaacttggtggttgactgcggtacaatccgggcaagatttgcagagattcaatccctaatcccgaatgatctggcaaataccatttctccagctgtatacctcgagcaacatcaattcaaggtagaaaaggccaagcaaaggatagccgatcggcgagagcgaagggatattgaagccactattcaaaccaatcggcaaaccgttcatgaagagaaagctaagctagatcaactcttggttgggccaattcaaactaaaatagatcggcttgaggctcgcagaatagatctcatagctcaactagaggaatgcaacgccgaaatggctcttgagcagaagaagttaactgatatcccaaaggctgtcgaagaacaaaagtccagactaaaattggctatcaggaacgtggccgatttgaccaagtctctcaaggtcattcctggaaccgacgcccaagatatccaagctattgaagaagtagatcaaattagccaacgggctgtatcggcaatccagcgtaacttgtctagatgattatctttgtaataggacttagaaaatttttgtaatcggctaagaaactttggtactccttttgattatcactgaacctttctgccgataattctcaacttttgtatatatgtgcccccctaattttgcaatgatgaaggcatcgataaaattataatttggactaagggcgatatattaaatatcgaccatcatacatcggcagaacacaaccgattatgataataaaacaactaagggcgatataactatatcggccgtcatacattggcaaaacacaaccgattatgatagtaaaacaactaagggcgatataactatatcggccatctcaaggcgatgtaaacacatcggctatcatgcatcggcaacacccaaccgatcatgcattaacccaaacacttgggtaatatctcttcaagtacttgccattaagtgctcgtccataaacttttccatcaagtccttgtaacatataaactcctttggacacaaccttatggatttgaaacggtccttcccaattcggtgactgtcgcgcccggaaaaataccttttccagaacgctagtgtattaatccccgtcccaggaaaagctggggtacaccaaacaaacatgatacaaaaggcacatctttattatatcgataatatttacattattacaaaggcacttaaggcctgacaaacagaaataatcagcagcggactagcgggccgacggttccatcttcacaggcgctcaactagggtataagccaggactccacctacgacttcttctccaaagcttctcttactgaagggggtaaagatagagcaagaatgagtacaaccacaatactcagcaagccacaccggcagatgcatgattaatgcaagggggtacaaggggataataataggggttaagttttgcagtaaacaacatttaaaagttacttcattgcccaaagctattttgtaaagatgattctagagctacacaatgttattaatcaaggctgtgaacccacacgaacctgccttaacccaaggcctacgatgattcagaccgaactagccaccagacccaggtcccagctcgtcccaagccaacccagcccaaccatttcacattttagttgttaagcggttttaagaattaaaacactaacttgagtacattgctaggcttgcccataaccgagggcgcggctattcgcatagattatactctgatcagaggtgtacatcattacccacaagacacgtcttcctcacgtgtaaccacgtgccacataccaccacggcatacggacggacgatgtgacatagttcccaacccatcctagccatagacaagagtaccgacccaaccccgcctacggctggaacccccgagacaggtaggtaggattgagcccctagcagcagaacaccggccctgtgccatgacatctcaactaccgagccgcagctcgtgtagccttcatttgtcctagagatgtccatcgagccccgacttcgtccatctccatccgtgtacctttgtttatgaccaaactgagccacaaacttagccttacccactagacatgtggaagtatggtagtgctttgcaatagaggcctgagcttaatccttatagtacccgaggtacgactaacaaaacccaaccacgcacctcgagcccaggctaaaaccattttgggggttttgaatagagggggaggtgtgtgtccaattccaacataaggcaaccagtccatagtgtctaaatgatatgagaattcccaaagtctaaagttataaaaccacctaatgttgcctaattaatcagcgaagcatctacctaagttcatactagtggaaccataaatagagtacccactagttggggttttgtttatcctagggtgaacaaggtaataataacaatagaaataataataaggtcataacaaaggtaaataggcatggctaaataaaacagtgataacgcaggaatttaaataaagagataatgcattaatttaaatcaaaataattttataaactgggattcaatatgctcaaggatgatgtgacttgccttgctcagagagaatggccttccgaacattcggcgacgaccacgaaccacgcttcaggaacctctggaacgacagaagctacacgaagcacacaagcaaagctacaagcctataaagaagcagtaacaatacataaaaaggaagcacatggttctttagtttaatgctgttatctggagatttgcggattattataattaggttttgcaattataaaacatgtgtaagcgctagcctagaaaagacgagaaggctgcgctgttgacatgcggaccccacatgtcaacctaagggaccatggcaaaccgggtacacagagacagtccacgggtcgatggaagcggatcccgtgtgtcaaccgagacgagtggctgacatacggactccactagacaccatgcgggctgcacatgtggaaaccacgcggctaccaagcgggcacacaaacacggtcaccacacgcacacacaaacgactaccgacaccggtacacgggtagcgggatcgacaaccgcacaacgggcaggggcgacatcgaaaggacgagggcggggcagcgagaggagagacccttaccaccatgcgacgaggtgtggcacgatgatgacgaacgggcacggcggagacggctcagggacgacggaggcgaacagcgagggaacgacttcggcggcgatccttgcacgaaggcaagacgcggccggtgcaatgcttgacgacgcggaggcgaggacgaagatgacgacggggctgtggcacttgatggagcgaggatgacgaacgagaatggcttgacagagggacgaacaccacgacgaccgggaacgacgagaggacgacggtgggaaccggtgaggaggcgacgacaaacgccggcgggttcggccgaaggggaggcgatgccgaggacgacatcaccgctgcaatgccggagtaggggacggcgtggaacacgccattgcgatgttggagaaggtggtggtgcagcggggcgacgagccggcaaggaggaacgggcggttggcgcggcggcggcgtttcagcgaacttcgggcgacgccgcagccgggccggagaagaggatggcgctgcagcaccgacagaggtggcagcgacgtcggcctgcactcaggcgaggtggcagggatggttggagatggtatagtagcggcaatgccactgcaagccggcggggacgcgtctccggcgatttccccacgaatcggaggcggcgccagggaagatgatgcacctgtgaggccgagcgagaacacggcgcggccggccggcgcacaggcactgcggcaggggcggccggagttgaccgtcagcacaggagagagaggaaggtgatggggaggtggctatggttcgggagagggacagagcggaacggccggctagaggaggaagactaccgcgcgtgggcccctcctgccagcgcgtgggcccctcctgctagcacgcggtcagcgcacacagcgcacgtgcgcgggagggactcggcctggcttgggccgggcggatgggcggaggcggcccgggagggggaggggaggggagttgggccaaggggaaggagggcggggcggcccttgagagacagagtgtcacgccctaaagtttcaaccttttccttgctttaaaaatttgttaagtaaatcgtccggagaaattgttctaattaacctagagttgaatccctaattaataaatgcaattattaattggaaatggcattgtgggatttttcttggattctagatgtcacaatcgattaacaggatttttagtggaattttcagagccctataaataattttaaccaactaaaaatccccaaagtgcaattttaaatcccaggaaaatcctttttctctatttcttttcttttccttcctttttctcttgatgggccgtcggcccatcactctcccgcgcgccccttgctgggctggcccgctcctcccttcccctccccgaagccctccctcactccctctctctctgggacgccgacaggtgggccccacctgtcggggtcatccccttcctccagccgcccgccccacgtcggcaaccgtcgccgaaaccgccgcgcacacctcctccgctcctcccgcgcccacgccgtgccgctcccgcgtcctccccacgttgccgccctctctcccgcgtctcccggcccgcgcgcgcgcttgcaaggggcgggattcgaatttgaatcccccccattctctctctctccaccccacatcgccggcaaaatcggaggctttcccggccacgtccgcttccccctccacctataaattgctcccccgagcctcctcttcccctttccgctctcgccgccccctcccgtgcctcctaccgagcccgcgccgctcgccgctagcgccgccacttgccgccgcctccggccgcacgccgccatcgcaagagccgtcgcctcgccgcgcaatcaccgccgctagcttcgccgccgtgagagctacctcggccgccgctcgctttccgttcgccaccgccgtaccgctcttcccacgcgccgccgcctactaccgcctctggccgcgcgccaccaccgctaaagccgccgccgcgctcgccagtgtcgcccgcacctcggtcccactcgattgccatccgccaccgccggaacccgattccctcgcatcgccggtgaggacacctttcctcctttccttccccttcccgcgagcgccgagccacgccgctgttccggccgtgcgccgtcgccttcacgccggccgccgccgcctcgccgtccgccggtcgtcgtcggaggccgcctgcggccgctgccgccttgccatggtcggccggcttgagccgtgccgaaccaccatccactcccctcccgccttgtgctgctgcccggtgggccccaccagctggtggaccacccctccccttgagccaccagccggcgccccctccctctccccttgtgccactgacatgcggaccccgcttgccggcgccccccccttgggtgacgtcagcccttgggatttattacgcaataaataattaaggactttttctttattagtaattcatccgagctccgtttaagtccattcaagtctcagtaaattcataaaaatccctagaatccattaaaaatggttttgtttcctgtttcagtagtcttatagcatgttttgcttgtgtgctttgtttgtcgcgtagatttcggccgtttcgtcgatccgcagtttctcgaagacgttgctgtggtctcatcagtgcgagagtaaggcaagtcatgcattacaattgatcatattgtacccaatctacaaatgtcccgcatttctattaaatgtcgcattcttttacaatgtcatctgggatgggtcctattactcagccatttattgtttaccatatgccattgataacctgggtatcaaaatgattagatgttggtttaggaaatgcttagccatgcttagctcaactagcacacaaatagggatcacattattacatagactttaactatgagcatagctttggattggtgccaccgcaatggtgttagctaattaaaatacactggacggtgggctgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtcaggttgtccagctgccggattcaccgcggcgcagtaggggaccgcccactgccttttgacgggtgggggtgaaaacttagcgtggtgtggatggttaggggagggttatgtggagggtcttgtcacgatttccccctttgcagtatcatggtgatacttcggggcatggcgacatgtgtggaatcgtgtcttgtgggtacagttgtacaactctgatcagagtaaaactattcgaagaaccgtgcccgcagttatgggcgatcaaccaaattcaccgtggttagtctcacccctagtttagcttaatgaactggtgtagtttaggtggttggttgggcctgttgcaacgtggtgtagcgttggacagtgtttggttaatattgattaattactacaactgttttactgctttcaactattatttttaaatgcctgctttgtgcaaaagaacctttagcctccttcggttatatcctgcatcatacctcctcttccggtatgacttgctgagtacagtgggtagtactcagtcttgctctcttttcccctataccagagctgaagatcttcctagtgggagctgtcttgtcgaagttggtttgtcgctgccgtcaaggattgcctgtggagtcgagtcgcctcgctgcagaagtcaagtttccaagtctagctcgttttatcttttccgctgcatttgtaatcttttctatttttgtaagacgtggatctgtatgtcaacaattgtcgtttgtgtaccctggctggtcctggacagggatttaatgcacattcagcttagaaattctggttcgtgaatttctgggcgtgacatagagggggagaaaaaagagagggagaaggacttcgggtgcgggacgagagagagagagggaggcttggcccaaatgaaaaggaggattatttttagttttctttttaataaactttgttaattgttgttgttgcttaataaatattttcggtgctctgaaaattcaagtaaaatttgagggctccttttagaccaaggagaatttaacaaaaattctccggaccacattcgaatttttcttgtacgtattttagtgtttgccaatttcttttcgaattttaattaattctattattccatttagagaatgatttttattttgggatgaatttatcaggacgtgacagtgaccacttgccgaatttgttatcacgagttcctatcgccaagatcaacttccaaacaagctctccctcagaaaaagacttagatattatcttcttgttataatgccgagcaaccctttccttatccttagtaacttttgtgagagctctcaatctggattgaaccaaatcctccttcacatcggacatgagattataatattcatcggctgacaacgcattctgcaaatctgttctcctcgagccgattctaatgtccataaacaagcttataaggaggaacttggatcgatccatggcaacccatccgataggaccagaatgcttcagccaacctagtatgccattgccgaggataatgagaaatctttctctgaaacaacttgatcaaactcttgttagatgcctcggattgcccattagcttatgcatagtatggcgaagaattcaacaatttgatacccatgctatcggaaaactgaacaaactcatcagacacaaagatagacacttgatcagtcgtaatagtatgaggaatcctaaattggtaaataatatgctcttgaacaaattgtatagcatcccctgaatcaaccttcttcaaaagaatcgcccctacccacttggtaaagtaatcggttgccaccaatatgaacttgtgtcccttgctcgagggtggattaatcataccaatgatatcaattccccaacctctgaatgaccatggcttgatgataggtttcatagtcgacgctggtgctctctgaattgctccaaacttctgacaatcctgacaccttttgtaatatctaaaacaatcttccaacattttcggccaaaaatatcctgcacgcctatcgagggaagtccctcgatagcgggaggttgtgagacgcccctttcgtgagttcggccgggggaagaagctcgcctcttagaaatcacgtatccgccccctaggctgctagctaccttgcacacaatcgagttatacaggttcgggccgctgtggagcgtaataccctactcctgtgtttgggattatggatgagtattacaagggttcctttactccggagagcactctcgcccttcttctcctagagttcaggttttctgagagtcgtccttctcggtggggaaggtcctccttttatatctcaaggggataccacatgcaccgcctctacctactcttctttcgggtggggacccaccctatcttgaccggaacttgacccgtgcatttgcctggaagctaagccactgcttgttcttgagtggggcccagcgccgtccctcgcctgacacgggggacagccctatcattcccccattaatggatgaagacttgtggtggccgccgtccgaatgaccctccgatgggacgggtcatacctacccccactcaaccgggagcagacgcgacgtgggagtacggttgtcggtctagtcagacgtgaccggtgtcatgaccggtcatagaccggtcattcttgattatggcgcgtcagattcgcacgccgcacgtctgcctcactgcattaaatgtgacacggggcagttggggcgttgcgcgtattaatggaagctcagcctgggccccctcctcgctcgctccccccgccaaatggtggctaggcgagggcctcggggcgaagcagtgcaagggcccgaggggcatgacgtggcaccccgaggccccgaccccccccggctgctccagcggttcgcgtgctcgggggcagggccaggctgtacggacacgcagcaggataggaaggtagattccccacacttcgcaaatccccggacccatatctccgacaacgccaaagcagccacttcatcttatcagccgattgatgagtaccacaaattccttcatgtacctcacccatcacaaccatggcttgatcggcactcagacatttaagcaacaccccatcaatcatccgataatacaactcatcatccaataatgtgtacttcaaagctttataatgcaatttctgagaagccgattgagatagattctgcaaatattgatacacatcatacctccaatcatcggctgttatcgtggcaacttctactttgatatccctcatcatcggcttgtaccctgatgccccttgagccaaattattagcttcaacattttgctcccgagatacatgctttaaaatcaccagccgaaatccatccatcaactctcggcacttctcattgtataccattaatgtatcatttttgcattcatattctcctgccaattgactgatcactaataacgaatcacccataatttcgacagcatcggcctcaacttccttaagcaactgcaaccccttgagaactgcttcatactcagcctgattgttagttgcatatggcataatagtataggcaaactcgaaactttcccccgaggggaaattataactaagccgataccacaaccatgagtgcacactgatccatcaaaaaacaaagtccaaggcacaatatcgactgagccgattgagtcatcacgatgatccacaataaaatcggctatagcttgtcccttaatcgcctttgttgactcataccgaagatcaaattccgttaaagcaaatatccactttccaaccttacctttcaaaatcggagccgatagcatgtacttaaccacatcggctttacatatcacaatgcattcattggacaatagataatgccttaactttgtgtaagaaaaatacaaacacaaacacaacttttccacaggagaataccttgtttctgtgtccaagagcctgtggctcaaataaaatacagccctctccttcccttcaagctcctgaatcaaaacttagccgattgacttctcaccggccgagagatataatctgaaaggaatcccctcatgtggagggattaaaactggaggagaactaagatatttctttaatattattcaaagccttctactcttctgccccccaggtgaattcttgatcggctttcaatctcaagaaaggtgtaaaacgctctaatcttccagataagttagagataaagcttctaacaaaatttatcttgccgatcaactcctgcaacttcttcttgtcctccagaggttgaatcttcttgattgaattaatactcttttgagttacctcaatccccctctcatgaacaagaaatcccaaaaactgaccagccgatacgccaaaagcacactttgttgggttcatctttaagccatactttctagttctctcaaaaaccttcctcaaatcggctatgtggtcttctacttcttttgacttaacaaccacatcatcaatataaacttcaacgaaccagctgatcagatcatgaaatatgtagttcatggccctctgatatatacctctagcgctcttttaaccaaaagtcatcacaccccactcaaacaagccaattgcactaggacatctgaaagctatcttaaaaatgttttcttctgccataaagatctgattgtaacctgcattgccatccataaaccttaatatcttatgccatgaagcagcatcaaccaattgatcgacaaccggcattgggtactcgtcctttggggtagcgttgtttagatcccgaaaatcaatgcacactctgaccttgccatttttcttgataacaggaactatattgaaaacccactcagcatatcggcatggtcagatgaaaccagcatcgtacaaatgtgtaacctcagccttgatagcatcgagcatatcggctttgcatctcctcggcggctgctggtatggtctaacccctggtttaataggaagccgatgttcgacaatcgatcggctgagttctagcatctcataatactcccaagcgaagcaatctctatattcttttaaaagctctatcaatttggttctgaattttagagataaattcttactgaggaatgtcggcctgggtctatcacctggacctatatcaatttcttccaaatcatcagccgacatgaaaccctgtccttgcttgtcattgagatcatctactgtatccttggtgtagacgtttgaaccctccacgactccctcaaaataataatttgggctctccatcttcaattggctgtatatcacaatcggacacttttagaaaatctcaatcccaaactttttcagacaggcaatcaatatcattcatctcccaaagagctaaatcggcactagcaatgttaactgatctgtcagctggcacaatatcaatcttgtcgccttgccattgaatcaagcactagtgcatggtcgaatgaatacaaaaattagcatgaatccaatcccttcctagcaacaggctataggaacccttcccatcgatgacaaaaaatattgtaggaacggtcttgctgctgactgtcagctccacattcaaaactcctttagtttccgatggattgccaccaaaatccttgagaaccatgttagtcttaatgagatcgtctgaatttctatccaactttctgaatgtagtgtatggcatcaaattcacagcggctcccccatcaaccatcatcttggacatcggcttccctttgacaaatccattgatatacaacggcttgagatgccgattctctgtcccctctggcttctcgaaaatcgcttgttccggtgacaaaaccaatctcgcagaaacctcttcaacatcatccacatcggcttgcctcggttcaaattttgctggtagcataaaaaccatgtttaccgatgcaggcgcagttgccttgcccttgagcaatatttttgctttatcggcttcaacttcatcggctgctgtgaccgtgcacttaatgcgctactcctgcttggtatttgttttcttcagtcgatggttaatctcatgttctacttcttgaaagcgctccttgttcctcattctttgaacccttctcttctgattcttggtgaaaattcctgtatcacaccattgtgttttcctatcttcatcttcatcatggtgataatcttggtttactagacccaacctctaatgaacaggtaccctcttttgactcagccgattacctctattataggatcggcctgaactccctgcagtgtcactgcatccaggataatcttcgatcgatggcagcatcataccttcattccagcagaatcttctttgatatttgttgataatcctggttgtattcaactgagaaccccgagttttcccttcatcagcagatcgtccagctatatgcaccatattaacagggaaaggattaccatcaaccttcattggcttctttgaatcatcaaacttaatctcccccccttcaatggccacctagacctgctgtctgaaaactttgcaatcattggtattgtgagaaccagaatcatgccacctgcaatacctcctcttacctagttcctcagccgatggaattacatgaccagcaggaagttgaatttgtttttcttagcaacaaatcgaaaatcttatcagccatggtgatatcaaaatcaaatctttcctctttcccagaacttctcacccatgggcatggctgtcacgtcccaaaacgacgctaaaactatatccttaaaattatgcctagaataattaaaatccaagtgaaagcctccaaaattaaaatgtgcaaacttaaaagtcaaataaggcttggaggatttttgtatatttcctaaaagccgaaaaggtgtaaataaattttagtggaattttcagagcacaaataataattatcaagaaataaacaaagtcgaaaaggttttataaaaagaaaaccctaaaaagcctcctccccacaagcgcgccgctgacggacgggcccgcccgccaccctcactgatgagtggggcccacccgtcatccccctcctcccgccgctcccgccgctctttccgcccgcgcctagcgccgccgccaccaaatccgccgcccccgactgttctggcgtgcaattaagaggggggaaatgttccccgtgattccctctccctttccccctattttcccctccccctcccacattcaaacggccggatttgctcctgcaaatcacaccggcgccattgatgccgaccataacccccgcgccggtttccttcccctccggtcgccctctttcactcccaaccctatataaaccctcctcgtacctccctcgtccatttccgccgtttgccgcccctcctccttgtcggattcgcgcccgcgccgttgtcctctctctccgccgtcgccttcgactttcggccgggcctagtcgcttcccgggaccgtcccccgcctcggcgtcatctcctccagcttcgccgcaccaccaccaaccccgtccatcgcctcgccgagctcgccgaccgccggaacgccgccgtccccgcgaacccgagccgcgccaccgtctccctccactccgatcgcctcctccgtcgctgtcgtcgcccggggtgagccgtggaccgctgcctcctttcacccttcccttcctctctctcggccgccgctccgccatgcctatggctgccgccggcgaccatagggacgcgggcgccgcctccctgcacgccgtgtggctactgcgtggggccccgccgtcagccgcccgtgccctcgggtgcggctgacgcgtggggcccacggcgccggctggtgagcccgcgggtgcacccggttcaccgtgaaccgaggggctgccgcgtggggcccaccactcctgtgaacccagcctgcgcgccccctcccctcggctgacgcaataaatcgttttaactaaaaaattaaatgaagaaattcacaaatattgacttaaagagcaataaacttcaagtggccataacttggtcgtttgtactcggaattggactgttcaagtctctaatttttccttaagaagtcaaggacccatttttgtgctttgtttttgtttgttatatggagtttattagagtaaaagcctttttccatttcattggtcgtgtagacgctgcagcttcagaagatccgctctacgtggaggttgaagccgacttttgggaaagcgagcaaggcaagtcacatcatccttgagcatattgaatcccagtttataaaattatttaggtttaaattattgcattattgctttatttaaattcccgcgttatcactgtttatttagccatgcctatttacctttgttatgacctcctcattattgctaatgttattattaccttgttcaccctaggataaacaaaaccccaactaataggtactctattcatggttccactagtatgaatttaggtagatgcttcgctgataaattaggcaacattaggtggttttattactttagacttttgaaatgcacatatcatttggacaatatggaatggttggcttatgtggaaatggacacaccccttctcctccattcaaaaccccaaaaatggttttaggctgggctcgaggtgtattgttttgatagtagcacctcggccactataaggaccggtcttcgggcctctattgcaaagcactaccgtacttccacatgtctagtgggtaaggcttagtttgtgtctcagtcttgtcatgggcaaaagtacacggatagggatggttgaagtcggggctcgatggacatctctaggacaaatgaaggctacacgagccgcgcccaggtagtcgagatgtcatggcacatggccggtgtcttactgctagggtctcaaccttggttacctgtctcgggaatcccagccgtagctagggttgggttggtactcttgttaatggctaggatgggttaggaactatgtcacgtcttccgtccgtatgccgtggtggtatgtggcgcgtggttacatatgaggaagacgtgtcttgtgggtatagatgtacacctctgattagagtataatctattcgaatagccgcgccctcggttatgggcaagcctagcaacgtacccatgttagtggtttaattcttaaaacttgcttaacaacaaaaatgtggaatggttggcctgggttggcctaggacgagttgggacccaggtcgggttgccagttcggtctgaatcatcgtaggccgtgggttaaggcagattcgtgcgtgttcatggccttgattaataacactgtgtagctctaggatcgtctttacaaaatgaccctaagcaactaaaagtcttgttaatgctgtttactgcaaaccctaacccctttattataacccccttgtactcctttgcatttattctgcattcgtgggtgtcttgttgagtacggtggttgtactcaatcttgctcatttttttccccaatccagaagaggagttcctggaggatgaaggctttggtgtctagctcgtgcctaccgtgaagtgcctgtggtcgtcgccctagtcttccattgtttttcgtttctcttcatgtgtgctaggccttcgtcgcccatgtaataaattaactatttacgcttccgcttgttaaactctgaattgtatcaacttttggtgtaccttgcctcctgggacaaggataatacccgcatgtatggaatgcctgttgggttaattctgatcgtgcaagttggtatcagagcctccttgaccctaggacgagccttagaccccaagccttattcgtattttgaaataaaaaaccaccccttatttgcgaaaatcctttagtctttctctgtcttgctgctttatttctcatcaaaagctgatctctaaaatttttcttttgcctttgtttatagatggccaacaacctcaaccggtgtggtcttgatctgactggcttcgctttggagctgcggggcatgtgcgttgtccagggatatccgcatggagtggactaccagggcaagaagctttcacagcaggatggtgacgatgcacagccccgtgccgcttgggaggtcactactgtgatcctcaccagctcccccgagagcaattcgctggcagtcaccgcgggtggagactccttccccgccgcttggcagaacgccgtgctcctcgccatcggcactcttcaccagtctatccggacgagttgcagcactcgccctaccactaccaccctcgtcatggaggaacccgcgactacgccgccttcagggatgctagcgcggaggatgacgctaccatcatgcatttggcgtgcatagtggaggcgtatgacacggcccgtatcgatttccatcgatatggtgcgccgtggtttggtcgagaacaacatgaagatcctggagctgcgtcaggagaatttctagctgaagaaggagttggacgccgtggaagcgcagctgtgtcagcttaagattgcttaaggacaggtctgccaccccaagcaccgccgtgtctgttgcagtcagaagatcaccgcccgcaagagtacctccaggcctgagcttgttcgtcagtccttggcgtggacctgcttcgtggagactcctt

SEQ ID NO: 65754 - DNA, 1811 bp, Oryza sativa
ttttttagaatttgtaattcattggattgatttgtgatgtatttcgtttagaatttgtgatgttttttttttagaatttgtgatgccaatttgatttgggtatataattgaggatatctaaggagcaactcgatttggaaaatcaaaatgtagtgagcaaaggaacaatgaaaaaaaagaaaaaaataggaaaaaaaatagtgaccaactgagtctgctgctaccatcactaagatggatttttagtcccgattatttcacccgggactaaagacgggtatctaaccgggactaaagggggttgtgaaccgtgggtaaaaaccctttctccagcagtgtttactcattttatgcatgcttatttataatttagttgcactataataattatagttataacgcgattgtagtgtactccccctcaaaatctaaggcagttttttacattaagacacagaaaaattaactcatctctatataacaaaaccaagaaactatatgtatacatgcattattaagatgattgattagatttcgatcaaaaatttaatttagtacatggacacaacaaatatgaccatctcatttagaaaaacaaaaaataaaatgtacttaaaactattggactaagggagtatgtaaatatatatgatgtaactatagtcattataattccattatagttatactaacaaagtacccctgctttgttactgtaaaatgttcatactaattatttgaatatatgttatacatttgatttaaaaaatattagactattatataatatcagaaaatatcaggtgctaatttgaaaattgtgaaaattgtagtaatagtgagctggtgacagaaccagcaacattactattatcttatacattagtatagactatagattataatttcatcttagttacagtgcacgtaaggatctgattgaatctcgaacttgatttagttcttctgcggcatgtacaacgagttgagccattaacacttgaataattgaatattaataattacaaaattttaaaatgggtttatttgatttttaaagaaacttttgtataatttcttttgcaaaaaattcaccatctaacaatttaaaaagcatgctaatgaaaaacggggaaattatagtttggggttgatcgaaaaaagaactcgcctaagtaggatgtaactatggcatataaactagtagtatatataatttgtctgtttccccccacttcatgttaaacaaaatgaatcaactgggggttcactgcattgggcagagagaaacgactatcctttgctaattgctagtaggcctaaaatctgagggatcaagtggcccaataatcggtctgtatactgctggatatgttcattaagcagtctgtatcccacgttactcctgtataaatctcgaagatgatagagtggcctaaaaatcgactcaaactaggcaaagaaaaatgttgatagaattttagcaaaactgtaaagcttttgtcaacttttctctaaaatctcaattgaattgttcattctatatgaatttcaaaggaaacgacactggtggagaaagaggctttactcccggttggaaacccctctatagtcccggttatacaaccagtactacgaatccgggactaaaaatacacatctttagtcccgggtgaaataaccgggactaaagatccatctttagtcctggttggtgtaaagatggttgagccacgtgactgacgcagacatctttagtcccggttgatcttaccaaccgggactaaagacttttttttcctccttcggtt

SEQ ID NO: 65755 - DNA, 2572 bp, Oryza sativa
tttattgtgaacaaagctgacaaatgtgtgtactatcgttatggtgggggagagggagtgatcttctgtctatatgtcgatgacatattgatctttgggaccagcctaaatgtgattgaggaggtcaaggactttctgtccaaaagctttgaaatgaaggatttgggagtggctgatgttacacttgtgcaatcccactatgtggacaaggttttgagtcgctttggctatagtgactgtaagccagctactactccttatgaccccaatgtgctattaaggaaaaaccgaagaatagcaaggcatcaattgagatactcccaaatcattggttcattgatgtacttggctagtgcaacgaggcctgacatctcatgtgatgtaagcaagctgagccggtttgtttcaaatccgagagatgatcactggcaagctctggaaagagtaatgcgctatctaaagggcactatgagctatggaattcactatactgggtacccaaaagtactggaagggtatagtggctcaaactggatatctgatgctgatgagataaaagccacaagtggatatgtgttcacacttggagttggcgctgtttcctggaagtcttgcaagcagactatcttaacgaggtcaacaatggaagcagaactcacagcactagatactacgacagttgaggccaagtggctttgtgaactcctgatggatttgccggtggttgaaaaaccagtgccagctatcctgatgaactgtgataatcaaattgtgattattaaagtgaacagttcgaaggacaacatgaagtcatctaggcatgtaaagagaagactgaaatctgttagaaagcagaaaaactccggagtgataacactggactatgtccagacagctaaaaatctggcagatcagtttaccaaggggctaccacgtaatgtgatagacagtgcatcgagggaaatgggcttgagacccacttagagatgcacaatagtggaaacctgtccattgtgatcggagatcccgtgaatttggatggtgaaacaaactactgtgtaaccgagagaagagacccttaaatgggctcattttcatgatgtacttctcttctattttgtatggtaggatggcttatgcctcaatgtgttctgagtggctttcattaagcagagatgttaacctgcagaacatcttagaaggaatacacctatatgagttcgactactagtcacagtctatgagatatgggtaatctctagatactcatgaaaggcctagagtatgacttataagctccaaaccgagggaatactaacggttgcctagtatcagttatggaattgagtgaaacctaactgcacaagactgacaattcaaggcatagtccattgttcagttgtggttaggtgcagctccttttctaggtggaagttcaacttaactatcacgcccggaaattcacaagtaatttccaaactaatttgtgcattaaatcatcgtccaggaatcagccgaggtacacaaactcacaatttaatatacagattcatcaaattaactaaaacgataaatacttacttaagaggcacttagtcctcaccatgaagaaaactgcagcgaaaaataaaatctagcgaagctccggctccactcccacaggcagctcaactggggtataagccaaacgtcttctcctttgcgacttttcttcaactgaggtttgattgattattgtaaggtgagcatatgacatactccgcaagccacacagcaagtatgcaagtgcacaaggataccaaagaatggcataatataggactcatttgcaaaagcagcatttagcaaagagttgagaatttgtaaaacaatagagtaattaatcatcaatattaatcaacactgaacagcatacccatgctgcataggcccaaccatcctaaacaaccatacccggctgtacagatctatctccaaaccaagaatgtaccattccaaaccaggagctaatcaaattattaccagttatagcatcatttattatggtgagaagtgtgagactaatcacgaaagacattgttagacccgcccataaccgcgggcacggctattcgaatagtttactctggccagaggtgtaccactgtacccacaagacacagccccacaatatgtcaccatgcgccgcaataccaccacggtacctcggaaaggagctgtgacagtacccctcgcataacacaatccaccacaacgcaccattccttgatcataatcacccccttataaacaaggcatggactccccagcgacccccgtgggcttatctccgccacttctcagtctggtgccccgcaatgaaccatgctatacaaaaggtaaaaccgttgcccatgcgggcatgtggttggcacggttaatgtttcacaaccgaaactcgtgaaccggtccttaattgtcatgagcatgaccatcaaaaccatgtgctcacaacccaccattatcaagttttagttggcaaattaattaattaaccaatcactattaaccaccgtgagctacaattaaatat

SEQ ID NO: 65756 - DNA, 8807 bp, Oryza sativa
aaccttcagggattttctatgttattggggtcttcgtagtaatagtcataagggtcctcctcttgacccagatctgaaaaagggtttataagagcaagggtgagtatttacaatacttagcaagttatcacgggaatatgttatgcattgacatataatagggttctttgcaaaaagcagtattagacaatctaaaaaagttatagcaggaatttataaaacatataaactttagatttctaaccagggtaccatatgattcccggtactcaactccatgagtacagctattcgaatagtttcaaagatattctactgcagcagatgtacgctttacccgcagtccacgacttgctgataatcattggctttagtcatggcccagtattaagtcattacaaattatggcacctgttccatgaacttatatcctcatatgctctgaacgtaatgttaatagcagcaagaggagttctggcgttcccgaggtatttaaggggaactgatcgtttgacaccacgtcatctcgatcagggtttagaaatataccatatagtttatactcgagtatcacaaaccattttacctgtacatggtaatggttaaagttgcccttcgcggctatagttgcctcctgcgcgaggacttaaaaataagaaccactatacagaggtgccatattgccaattaacctaataactaggtctgtccccattctagaaactgcggtcgtacccgttcgttcgacataagtacctggtaaaacttatatcgattgagacaatactagccacccggaaatcaaccaaatcttacatattgtcccaatctaagtatgaggtattttaaccatattgtaagcaaaaataagcaatactaaattatctgggtttctatgaatgatttatgcatagaaaaatagaatattgaatagaaggctataaataaataatttgtaaaatataggcttaaatgatcaacaggtatatggtaacttgccttgctcgatgtcttgagattgattgatattatctagggtgtcagaggaatcctcaagacctagggttagacatataaaattcaaattcaaaaggagtttaaataaaatccaaaaataagaaaaaatatagaaaataaaataaaaaacaaaaatagcaaaaaggggcccaatagatagaggatgattttagaagaatattggtccaagtttcattgaaattggatctatattttaaaagatatgggcttctaaagtttgaaaatcaaataaatgtgaaatggcactatgtacaggtcccacctgtcagtctctctctctcttctcttcttctacctccagccgatccccaaaagcgggctagccacgctagggtttgggattgcagtggcgctagagggagaaagtggttgcgaccgaggaggtgagggagctagggatctccggcgacggggagcggcggcggtggaattaatttgatgtgtggacggcctaatggctagggcggcggtgacacggttagactgagatggcgatcaaggtgataagagttagacatggctacgggaggggttctagagcatctacgaggtgtctagagggattccggcagctagccaacctttggcaaggcgcggagcatagttgccgacgagcgcctccataggcggcggccgtgctcacgtcggcagctcagagggtggcatgatagtgcaaagggattgctaaaatggaatctaggtagtatgtagatggttgaaacggaagaactcaccgagatcggttgaaacgacggattgcggccggaaaaacttcgcggcggcgaagaacagagcagcgcgggggcggctgtgctcggcttggtgcgacgaggtaaaactcgacgcagagcttcggttagggcttactatgctagaacatggtagaatataggtgttctaaaggatatttagggcggaggatggatggagaggggtggagtcgatcgcgcacaaggtgttcgaccgacggatgatggtggttgatgagatggattggtgaagcagagcttctgggttgtggggctatggttgttgatgatcgatgatggacagggaaggaattggggtcctatttatagggctaggaggagcggatgagctccggcaccgtcatcgccatggatgagctcgggatttggatgaggcaaaggtggcaggggctgagagagggcggataaaatcaaattgagtggcgggaggccacgtttgaatacttaccggccaagtattgacttgaccgcggttggaatcggctggcgacttgttggcgccaatccgggtgcgacgagggtgaaaacggctggctcgggggtgaatggtttgaattgtgagaggggataccaccatctatgtccaatccaactgtgcggcgagaattggcgcgattcacccagggtagaagcgaaatcgcactcggtggtggcttggacgggagcgcacggcgtcgagcagcgattccttgcggtagtcgtcgtcccggctttgtcgtcatcaagattggtgcggcggcggtgggctgagatcgtccaacgggcgacggcgcgccaaggcggtcgggcacacgtaagcggctccgaggccgacgcgcggcgacacggcgcgcagcaaagtcggctgccagagagcacgcgtgaaggggaggagaaggccaactaaaccacggtttttgagtggggtgtggtcccctaggatcaaatctaaactttgtgcaagattggatagagttgggctgctctagttgggctaggcattctgtcgagcaccttgggtgcaatgaacagtaaaattcaggaattttggatattttccctagaaagatttgaatttaaactatggttttgaaaagctttcactaaggtttgaagtatagcaaatctccactaatattaaggtaagttaagaaaataatctatggtttgaattttgagagaatttgctcaaattcactaaggtttggaataaagggaataattagagtaaattggtagggctctaatacttgaaccaatttttaaataaaaaacaaatagatttttgaaccaaacaactttaatcaaaagccagcatgatgcagtcaaattttagtttaaaatttaaggatgttacacaaaggaataagttcacaccacctgatgacattcaaaaataaatgcacaattgaaataaatagagaatttaaatataggatcaacatgctcaaaggaattgtgtttgggatctgtgtgacttaccttgcaataattggtcttcaataagtcttcttgaacacttccgacgcactcacgatccttcaaaacgacgaaaacgacaagctaacacgcaaaacgaggaaaaagactaataaaaaccaaataaatagtacatttaaagtaaacaaacatgtagatcataattttaaatgactttagagacttgaacggcctcattctgatttcatatgaattagttacgaattgtacaagatttaattccaattaaacctattaaagataagactattccaaattaattaaacaatttacaaatgatttataaccaagataaaagattaaaacaatctccggaaaagattagattatattggtagatgacatatgataaaaaggactaatatgccattgaaaagagagaacagatttatattgattttagatggctgagattaatcttgaccgagtcgaccaagatcgaatggcttggattgatctggcaagcgaacctcacgagataccgactcaacgagtcaattctacgtgacatgagatcacccaaatgatcaaccgaaaccggcgaacggaaccggcggctctgaactaaaggacgactcaacacggatgaacgaacgaagcacgaggaacacctcattcgaacgaacgagtgaatgactcaacaacggctgtggctaaaccggtgggctagacacgattcacggtaaagccccggtacgacaaacgataggccggtaggaacctagggttgcacctacggctagacaactcaactaccgagcaacgggctaaagcggcggctaggtttaagcggcacatagttgcgacacggcacaacagcagcaacacagcaatgactaggcaattagcggcggcacagcggcggctactcgatgacacaaacgagagattaaaacctaaaccaagggaacagagatagaagtctcaccgaaccaaacgattggagagggagagatgacgacggcgacccggcggcaacacacggagacgacgacgatgctagacaaacaacggattagattgaatttgatctagggtttaggtagacgtggcaatgataagacagccaagcgagatcatcggataacggacacaggaacgacgatcaccggcgaactacggagcgacgataaaagggaggacaccgggaaaaagagcgcaaggcgacggtccttaccaacacttacgcgacgacagacggcgacggaagatggccagtgacaagcttcgaagggcggcaaggtactgtccacggcggctggagcggcggccggaggtggagagagagggagctcgcggggagagcgattccggcgatggcggaagacgggacttgagaggataggtagaggacgactagggggtcatttatatagccatgggagcccgggatcgagtccacatcgacgggaaaaactctggaaagtttgggatcttcgccggaaaaaggaaagattgaaccgtgaaattggaaaggatttccatagaaacttttggggatttcttggggaaattgtagaggagattgagaggattccgttctcgcaactaatttggaaaaaggagcaacggggaggccagattcggaaggggatcggcacggctgcagcttgggacggctcgggctctgtccagatgttgaagacaacaatgtagcgagagggaggacaaacagacttctatgcgggctgagaggaagggagagagaagagaagggaatgggctgaaaagggcccaagcggaggaggaagattttattacttttccaaataaattaaccaatgagatgatctttcaattgttaaaaatatttccaatgctcaaatagttccaagaaaattcttgaacatacttggacactcaaagtatttaacaaaactgtaaccagctcatttaatgattaatttaatatgtgaataattactgaaatgttctttgtattattaaaattagtaattgagctccgaaaaatccgagaaaattccagagagtataattaatcatggagaatttaataaaaattaaatccaaccatgatttatatttaggagtttttacttcccacatttaacttcacttgtaaattaatgaacatttaatataaattctaatattaatttactaaataatttataaatcctgagacagaaattcaggctgtgacattaacagtcttgaccgaaacactggtatataaaagctgctatggaatagagagcattctcatgagccttaaaatttggtggggattgttagatttaattggttaattgatccatttaaatcaattaaattaaataaattccaaggctcattatgctaggaattcatgtgtattcattctctaatgggatatcaatgggacgaggagttttgagaattaatccatttgattagtgaattggtaacttatatcaattactcctaattgatggatggttgatggttgtatagtggaggatggttcatcactagttgatgataattagttgctctattcctctttctgttctattggtaacctacatcaattactcctaattgatggttggttgatggttgtgtagtggaggatggttcatggctaattgatgagaattagttactctattcctctttctattccatgactcttactcttcatcttccatttctcatataaaatgagaatggatttgatctccctaagaagaagtgagacacactttcatccatttccaaggctgttgctgctacggtaatcccatcccgacgagtgtgtgctcacgcgttgggagagtaggcctccgaaaccacgtactgctgtgacgtttgcacggacaggcgggcgattaggtttttggggagcgcaatgcgcgactactcactattcgtcaacgtctacttcgtcttcaccaatatgtcgaacactggagacaacggcaacactggagacaagtagaaggaggttcctgtcaacaacaatagaggcaatacttcctcaaactccagcggaggaccattcttggggtataaccttcttacattatttcaattagaagttttactactaatgttcatcgcagtgtcaacattgcgttattatgtgattgttgatgcttcttctacgttaagcatgctcatgttgattacattcaccactatcactggatcaaatcccattgtaaatatcatggtaattatcttgttattttggattaaaatatgccgaattatgaccaaatttccaataaaccaaaaacctaattggtcattttcggtagttggctttgctacaacactgaaaccacatgcttttgatggttctaattataagagatggaaagcacatgcactactgtgtttgacagcgatgcaatgcttctatgtttcacggggcaaacgaagtgaaccacctctctctcctgaggaggaggctaagttcgaggcttcggattgtctgttccgtagagcattgatcagtgtactcgctgacaatatagtggacgtgtacatgcacatgccttcaaggaaggacatgtgggatgcgcttgaggccaagttcgaagtttccgacaccggcagcgagctgtatgtcatggagcagttctatgactacaagatggtcgatgaccgttctgtagtggaataggctcatgagattcagatgctggcaaaggaacttgagaacaacaactgtgagttgccagacaagtttgtggcgggtggcattattgccaaattgccaccttcttggtcggactttgccacttctctaaaacacaagagacaagagttcagtgttaccgatctcgttagctctttgggtgttgaggagaaggcgagggcaaaggacaactggggcaaaaatatcgagggaggttctactgccaatttggtgcagaagaagaaccctcacgcttctcacaacaacaagaaagtcaagtctgatgtcaaacccaaggctacaaccaattttaagaagaaaggcaagggaaaggcaaagggagattgctttgtgtgtggtaagcctgggcattgagccaaggattgtcctgagcgcaaggaccagaagtctgccaacatggtcattagcgagggcggacgaatatcgtggtacggtaaatttttacctacagttctctctgtttttcattcacctgattggtgggtttatactggtgctaatattcatgtgtgtgctgatatttccctgttttcttcttatgaggtcgggagaggttcctccatgttgatgggaaacgggtcgcttgcggctgttcatagtgttggtacggttgatctaaagtttactttgggaaagaccgtgcagctgaagaatgtgcagcatgtcccttcaataacggctctctactgtgtagagatggttttagacttgtgtttgaatccaataaatgtgtcgtatctaaatatggaacttttattgggaaaggttatgacagcggaggcttgttccgcttttctttggatgacatgtgtaataataataatgttgtgaaccatattagcgagaatgatgagtccaatgtgtggcattcgcaactttgtcatgtgaatttcggttgtatgacgcgcttggctaacatgagtttaattccaaaattcactttggtcaaaggttccaagtgtcatacttgtgttcaatcgaaacaacctcgcaagcctcacaaggcatctgaggcgaggaatttggcacctctagaacttgctcattccgatctgtgcgaaatgaacggcgtgttgactaaagggggaaagaaatatttcatgacactgatagatgattgcactagattttgctatgtgtatctattgaaaacaaatgataaagcattgcattattttaagacctataaagctgaggtagaaaaccaacttgaaaggaaaatcaagcggttgaggtctgatggggtggagagtatttttccaatgagtttacatctttttgcgaagagtttggaattattcatgagatgacgcctccctattcaccccaatcaaatggggtagctgaaagaaaaaaccgcactctaactgagatggtgaatgccatgttagacactgcgggagtttccaaggaatggtggggtgaggcaattttgactgcttgtcatgtcctgaataaaattccaatgaagcataaggaagtatcaaaattcgaggaataggaaaggaagaaattaaatctctcatacctacgcacatggggctgtttggccaaggtaaatgtacctatagccaaaaagcgtaaacttggaccaaagactgttgattgtgtgttccttggttatgctatccacagcatgagttatagattcttaatagtaaactctggagtacccgacatgcgagttggtacaattactgagtccaaagatgtcacattctttgagagtgaatttcccatgaaaaatacacctagcacttctagtcaagaatttgttttaccccatgagcactttgcaccgatagaacacaatgatcaaacgccttaggaaaatcctgagaaggataacatta

SEQ ID NO: 65757 - DNA, 512 bp, Oryza sativa
cactagcataatatcttcaaatcttggcctcctgtgtcacaccctgaagttcttttcccaagcctaaattgaatttataattgttctcgagaaaataccggtgtaaaagcaagagtgaaaccctaataaattaatgcaaataataatcagaattggcatgtggaatttttcttgagttctacatgtcgaaatgtgctaacaagatttttagtggaattttcagagctctagaaataattttaaccaattaaaattgagcacaagcaatatttaatccctggaaattcatttctgtctttttctttttctttttcccccttttcttttcgaatgggccgccggcccattctcctccccctcccgccagccggccgccttctccctcctcccttcgagtcgccgacaggtggggcccacctgtcaggcccgtcttccaccttaagccggcgccggcgcattccgcaaccgccgccccgctcgctcccgcgtttccaggccacgtctccacatag

SEQ ID NO: 65758 - DNA, 719 bp, Oryza sativa
aatttaattattgcgcaataaatcaattaaggatttttctgtttatagtaaaaacatagtgaatcttctaaaattcatatctaattcatccgagctccgtttaagcccattcaagtctcagtaaatcaagaaaaatgcatagaatccattaaaaatggttttgttctctgtttcagtagtcttatagcctgtttgtattgttaactttgtatgttgcttagattccggctctcttgtcgctccagtgtactttgaaatagtcgccgaggttcctcctgcaacagagcaaggcaagtcatgcttgtcacttaaacatgttgatcctatattgcaaatgctctattgttttcctttaaatactgcattgttttataatgttactatgggatgtttacctactgttacagccatgctatttttgtaccatgctcctttgctagcttgggatataacatgactagatattggactagggattgcttagccatgcttagttcaactagcacacaatgggggaatcacattaatgcatagacttcaggttctagtgttagtgttggattaaagccaccgtcttggtgttagtcaattaaaatataccatatggtgggctgtggatgcatggttttgatggtcgcacccatggaatttaaggaggaccgattcgcgggatgccctgggagaacttatcgtacttaccacaagccagcgtgggcaac

SEQ ID NO: 65759 - DNA, 901 bp, Oryza sativa
tggttgatggttgtgtagtggaggatggttcatggctaattgatgagaattagttactctattcctctttctattccatgactcttactcttcatcttccatttctcatataaaatgagaatggatttgatctccctaagaagaagtgagacacactttcatccatttccaaggctgttgctgctacggtaatcccatcccgacgagtgtgtgcacacacgttgggagagtaggcctccgaaacgacgtactgctgtgacgtttgcacggacgggcgggcaattaggtttttggggagcgcaaggcgcgactactcactgttcgtcaacgtctacttcgtcttcaccaatatgtcgaacactggacacaacagcaacactggaaacaaggacaaggatgttcctgccaacaacaacggaggcaatactgcctcaaactccagcggaagaccattcttggggtataaccttcttacattatttcaattagaagttttacggttaatgttcatcgcaatgtcaacattgcgttattatgtgattgttgatgcttattctacgttaagcatgctcaagttgattacattcaccactatcactggatcaaatcccattgtaaatatcatgctgattatcttgttattttggattaaaatatgccgaattatgaccaaatttccaataaacagtagggttgttactacaaatcaaagtaaaagaaattcctgtggtactgactgaaagtaggaacatttttttgggtaccgagctatgtgctatcgtatggataaaaaattttccatcataggaagcagtgtcttacgtcacagatgtgagcatctcccctatcaggcacgctatggaaatctatcaacctggcaatcaagaggcaagaaatagct

SEQ ID NO: 65760 - DNA, 4247 bp, Oryza sativa
ggtattggtacatctatctccagtcaaacagttgcccatttctgtttgctttctcaagtagtagatcctaaattcgttggagccttggaggacggatgcccacactgagatttcagtcctggtccagatggtatactaaaaggaaaccgatcaacattataatgggtaaaagatcatttttctcctcatcagttcgaatttgcagatttagctgaactcgttggatgttggacagggcatggtgccagcaggtaggagaactattttgggggctcgttttattgtggaagattaaacgaaaaatactttacggcctgtttggttggagggagtttttaaggagggattgggagtttagagagatgaggctattaactgctttgtttggttgggatacatgagaattttggtggaatggggatggggaattgaggaagaaactccctctttttagtacctgggtagtaggtggtaattaggagggaattcctcctttaatttgcctaaacaattctcagccatccgttttcgttaatgacttaatcttcaactaaactccctatcaatttccaccacctctaccaaacaagatactgggattaaaaatcaaattctcaccttaatctcaccgtcaattccctcgtgtaaactctcaaccccttccctcgagttgccaaacaagccgtacatacggttacggcttcgggtgcggtaatcagtaggtaaagaaatagggctaggtatttgtttttttgtcactaccacacaatcgatttttccagatgagaccccctctatgttacaggtggaccataactactcccacatgtgaaaatcccttccgcgagggcggttcaagaatcgcatgcgataataaacatatttcttaggcccgcgtgcaattttttcacccaactctatttttcccatctctctccgtctccatcataccctttcctctcttttgtctgagtctctttctcctcccatttcctctcattcctcataccacctctcctcaccctcacacatgacaggagaggccccctgcgggtgacgatgacaggggagactaccggcctcgagcaaatccgccaatgccagcctccctctccctcatagatccggttgcgatgttaggagaggtgcggatccgtcgtcgccagcctcaccctcctcatggattcagtagcagcagcacggggacgcgccgatatagtgacaacaacaatgacgacgatgggatgcgcagtcctccctcgcagatctggtgatgacaacaatgatagcaagccatcgggcggcggatctggtgagcccggccctaggagggatggatccgcctacgtcggcctctggtgcagccgggtctcgacgacgatggtggcggcggctaggacggatttgggttagggtttcgactttttgttttatttttttcactaaaattttgtttgcaagtgatcggcataggtgactgtatgcgaaaatcctatttttgcttgctgttgcgctgccagcatagaaagatgttgattttcgcatatacctaggtgcatgcgggccacccagccgacaacaaaaacctgttttagccatttgcaaaaattattttttactagcgtgttgggctagaattagctgcccgtttaagtgtacagtgatgatgatgtgtagataactttatcgtgacgttttaaattattatatttattgaactcgaagtatatgaagcaactagttaagtgtttgttggtatcaacatttgttgagcattgtaacacactcaaaaattaattttagaaaaaaaaacatgttaaaagttttatatttaaatgaacgtttggctttctatcatgtgttgtaaggcttcctttcattttttttgtttggtgtatgagaaaatattgaattaagcctaaaggagccaaaagccgctacagaaaaatgcagtaataatgatgatttcgccagtgtttggggtggggaattcctcaccaaaggcggaacaccaacagatgatctcctggaaaggaaaaatgttgtcttgctccatctctagcaggtccttctccgcattagacatgtcggggatttctctctcctctgtcagttggaaaggaaaggggaagctccgatctaggttttttgggtgaagattgacgtgggagctaaaggagtatggaatgaggtgctgcgccgcgcgatttgtgtgaggtttcggaggtggaggcaaaccctatgattttggtttcagcaactgaatgcaggcggtgaacaagagtgcggaaggggaaattttcggagagaagatgaagcggtggagaaaacggagatttatacacgtgtcaaggtttcggctgttgtactggaccaaggcttggtgcgtttgcatcacattcaatgaacaggtgcggtagagctgcatccttattgggccttggtggttattgcttcggcgatacatgtgcagtatgagcttgataccttaaagaattccttattccctgcaaagtggttttctatcaaggtcaatgcaatgtgatttttgagggaccaaaatcctttttctataaagttcggtgctgattgatgatatttcttttatataagcgatagttgccgactgctacgcgtattttatgcacggttggcctagcgctacatgatttttttctgttaattaagtcgtagttgactttgaactatgcacggttggcctagtgttatgcgtgtcaaattattaataggagaatggtatatcactcgagcaatagcactcagtgattggcaccacatatgctttaatgcaatatgaaaccactcgaatggttatctctttaggattttttactatatgtttagttgagtttcaactaatcatatagtcggagctatacctattaggtgcatctatttagagctagtatgggtaactatgctttaaaagaatctagggagatactttaaaattaagggcctgtttagttcgcgaaataaaaacttttgggtgtcacatcggatgtttgaccggatatcgaaaggggttttccgacacgaatgataaaactaatttcataactcgcctggaaaccgcgagacgaatcttttgagtctaattaatccgacattagcacatgtaagttactatagcacctatagctaatcatggactaattaatctcaaagattcatctcgtgatttcctccctaacttgcaattagtttttcttttaatctatatttaataatctatgcatgtatccaaagatttaatatgatgtttttggaaaaaaacttttaggaactaaacggtcgtaataacctacgttggacaggggcttggaaggcatcaggagcattcgatatgccaagtctttattatgcgcggaagggcgagactcaacgctgtcatggggcagcgagctcagagtgctcatgagagcaagtttaatactatagccaattattagctctaaattatctatagctaatataatagccaattcatacaatagtttcttactatactattaatatctggtcctacctgtcactggtggagaagtgctttttagtcccggttcgtaacccccctatagtcccggttttcaaaccgggactaccaatccgggactaaagatcgctatctttagtcccgggtgaaaaaaccgggactaaagatcgatctttagtcccggttgatgacagcggcagtctatcagctagtccttttttcttttttattttctcccgaatcgagtggtatgcatatcatcaaatcaaaccccaaatccacatcacaactccacagcacgattcacagattcaccacaaattcattcacaatatccattcacatattcattcacaacatcacaaatatattcacaatattgattcaaaggttcattgacaacatcgagtcacatactcattcacaacatcacagattcattcacaatatcgattcatagattcattcacagatcaaaacatccaaaccacaaattaaaaaaaatcaaaaaaaaaaatcgactcactggccggcctcccatcccgccgtcggccggccacccatctcgccgcttcccctccggccggatctgggggaggggagggcgaggccgccggcgaccggcctccatcccgccggcccgcgccgggccgccgccggccgtcctccatcccgccgcttcccctttggccggatctggaggaggggaggacgaggctgccggcgaccg

SEQ ID NO: 65761 - DNA, 7523 bp, Oryza sativa
  unsure (1)..(7523): unsure at all n locations
ggggctgtcttgtgggtacagttgggcacctctgatcaaagtaaaactattcgaatagccgtgcccgcagttacgggcgggctaccagactcaccgtgattagactcaccctagcttagtctaatggaattgaatagttcagatcgatggttgggcctgttgcaacgaggggtagcgttgaacagtggatagttaatattgatgaattattacaactgttttactgctttcaactaccgttttaaatgctcgctttatgcaaatgaaccgctctagctatcctttgattataccctgcatcatacccctattccggtatgacttgctgagtacggttgttgtactcagtcttgctccattttccccaaaacccccagagtttgagtacgtgtcagatggtggtttctccgaggagtaggctttgtccgtgtcgtcgaggatgcctgtggagtggcgttcccgctgcagttcaagtcaaggcttagctccatttatcttttattttttccgctgcatttatgtaagatttttatgatgtttgtaagacgtggatctgtatgtcaactttgtcgtttgtgtaccccggctggtcctggatgggggttttaatgcacattctacttggaattctattcgggaatttctgggtgtgacattctgccactgtcaaaacttggcctgattggtacaaaagggtattggctagtaaacaaacccactgagaagaattagggatttcacaatgcttagcccttactctagctaacatggattaggatgagccaatgatctcagctgctacttatttctggtccaataccttgaatgcattcttgttcaatcaaggaccgatgacctcatctgctaatcatgatcactggcttggacatcacctcatctgctaatccaatcagcatgaataccaagaacaaatttaccttaagaactagatccatcggaggttggtcaggtttcattgcccttaatatggggactggccctgtttctgctaaagagcttacaacttttctaatcatgtggctggaaaaatttctgttctgtgggccaagctatggtccaaccaccaactagcagcatatagccgaaactcttgtggataagagacgatttccccttgggaaatatttgctagggtatttgtaccaaactctaaatgctgcatcggctaggatagctgtcgattctgttgttggtgctggtggcccctggtggcttttacatgtttggctaaatccccataccatcaaagtatcacacatatcagacttagccgaagcagatttcccagctctagaaccaactgaagatgatgaaggaaatgaaatcacaactcgccgatgcatgtcttttgggaaagcagcctctacctatagtgaatgagattaatcggctgaattcttctccaattggttcggcaacttctatgatggatttccaagggattctaggatttggtttgcctatgaacactccaacaactttgaacatctagccgatttcagattcgatgagatcaactctgaaaaatatgataaatccagagaagtctttactatggctatttctccttgcatcctttctgtcggcatacatcaaggcaggaatatccaagtatcctatgagttataccatccaataagtgctgcaagacaacttgtaatgggccaactgccgatcggattattgtttgcagacaagatccagactagaggagagattacttcagcccttatgatggacagacttctaaatatcccagggccccctctaggcagcattgaagacattcaacttgccctagtcagaagtgcaaccttcgaccgatggtggattgagtggagaaaacatctctttcatcaatcggcttccatgtacctgaccaacatccatccagaatagattcctcaagtaagcatcttaaccgatcttctttctgcaaactgaaaattcttcaacttcttaaccatcttttcatcttattttgcagaccatagaatcttcgcctccacatgtcagtcaaagtggaatagatatcagatatgctgcaggacttttgcctaacagcggcagattcgctccttcaatcatcggctataatgctcccaagacgtctacactgctccacggacaatctcgcgagccaattccttctgaagctggcaagaggaagaggactaaatcatcggctgttgttccatcattcacaaagaagaaatacaaaaagcaaaaggctgcagctgctgatgatctgcccaatatcgaccctgatgtggagaagtttttaaacgatgaagaaatagaagaggctgttgatgatgcagctgctgatatcagtgaggcaagagaacaaatgccaccagccgatagtcatgctcctcaaagaactccaccgactccaacacacccagctcgtcatctgaaggtatgtacctatttggcatgttgttcttatcttgttctattagaattatgagtgccaatttctaactttgcagaaaaaactggctaccaagaagaaaccaccaactccgccaccattggtaactttgatctttctttatacctttacttgcctatgttaaactaattccatccttttcagcctcctcgttctccaactcctcctcgtcatgaatcaagcgagcatactccatcggctgtgggcagccaccatatcgaagaagaggcagcaccagctcctgctatccctataagaaccctttctaaaaatctataactcatatcagatgttatacaatttttcctaatcagcaatcccaatattgtcctttttaggttttagccgatatgttctcctttgacataaaacaattctttgatcaggaagaagaaatcaccagcctgcccttagctcttttaattgatgatgtcaaaacaacactcttggacattgcacatcggctagggagttctcttgattctcgagttgttgactgtggacctataagagcaaggttcgaggagatccatgatcaaattcctgacgatcaagctagaatcatttcccctgctgtatatcttgaccatcatcggttcaagctggaaaaagcaagacaaaggattgtcgataggcgtgaacgaaaagaacttgaagccacaattcaagctaatcggcaaaccatcaataaagacaaatcgaagcttgataagatgaccgtcgattccatacaaatctacattgatcggctgaagtctcgtagagcagaactcttagctgagctaggaaagaagccgagatcaaagttaaggaattccatcaagcatctgtcagatctgagcaaatccttaaaagtgatccctggaaccgatgctaccgatgcccaagccatagacgatatagaacaaattaggcaatgggccatatcggctattaacaagcttgtatcaagttagaaaccaactgtgcaatacttgtaatgcagacaaaaacatagtttgttctgatattttgctttagaaacccatcattgatattttgcttttgaaatccgtcattttacatatatgtatgcccccttaattttgccatgctgaggacacattgataaaattataattgtgctaagggcgatatgacaaatatcggctatcacatatcggcacgacaccaccgatataacttatatcggccatcatacattggtaaaacacaaccaactatgataaaaacaatgctaagggtgatataacttatatcggccatctaaaggcgatgttaacacatcggctaacatgtatcgacaaaactcagccggtcacgcattaatccaaacacttggataatatttcttcaagtatttcccattgagagctcgtccaaaaacttctccatcaagcccttgcaacatatcagctcccttcaacacaaccttgtatactcgaatcggtcctcccaattcggagaccacttgccgattttgttgtcacgagttcctatcagcagaatcatttccaaaccagctcaccttctgaaaatgacttaggcacaactttcttattgtaatggagagcaactcgttccttatccctcgttactttttccaaagcacgtaatctagattggaccagatcttccgtttcatctaccataagattgtaataatcatcggctgtcaatttatcttgtaaatctattatcctcgagccggtgacactttcccatggtaaaactgcttcatgcccataaacaagtttgtaaggaggaacttgaatcgatccatgacatgccatccgataggatgataacgcttcagctaattttgtatgccattgccgagggaaatcagaaatcttcctcttgatcaatttaatcaaactcttattagatgcttcagcctgtccattagcttgcgcatagtatggtgaagaatttaacaatttaatgcccatgatgtctacaaattggacaaactcatcggacagaaagattgatacctgatctgttgtgataatttgaggaacaccgaatcggtaaacaatatattctttaacaagttgaatcgcatctccagaatcaaccttcttcaatggaactgcctccacccattttgtgaaataatctgttgcgaccaatataaacttatgtccattgcttgaaggtgtattgatctgaccgatcatatcaattccccaacctctgaatgaccatggcttaattataggattcatagccgatgctggtgctctctgaattacttctaatttctggcaatcttgccaacccttatagtatcggaaacaaccttctaacatcgtcggccaaaaatatccaacacgcagaagcaaccacttcattttatgagccgattgatgagtaccacatataccttcatgcacctctcccaacacaaccttagcttgattggcactgaaacatttaagtaacacctcatcaattgtttgataatataattcatcatccaaaaaggcatatttcaaagctttataccgcaactttcctaaagccgattgagaaggatctttcaaatactgaaacacgtcatacctccagtcatcggttgtaatcatagcaatgtcgacctcaatatctttcaccatctgtttatatcctgatgccccctgagccaaatcgttagcttcaacattctgctcctaggagacatgcttcaaattcaccaaccgaaaaccattcatcaattctcggcacttgtcattgtaagtcattaatatatcattcttgcactcatactcccctgctaactgattgatcaccaacaaggagtcacccataatctcaacagcatcggcttcaacctctttcaatagttgaaatcccttgagaactgcctcatactcagcttaattattggtaacatagggcttaatagtataagcaaactcaaaactcgccccccattgttgatataataacaagccgaatgccacaacaatgggtgcaacggaagccataaaaaaataatgtccaaggtattatatcaccggagccgagtgaatcatcaggatgttcacaattgaaatgggctatagcttgtcccttacccgctttagcngattcatatctaagatcaaactctgtcaatgcatatatccacctcccaactctccctttcagaactggagccgatagcatgtatttgacaacattggctttataaactatggtgcactcattggaaaacaaataatgccttaactttctgcaagaaaaatatagacacaaacacaatttttccaccgacgtataccttgtctctgcatccagaagccttcgacttaaataaaagattttcctttccttaccttccaactcatggacaaaaactaaaccgattgacttctcatcggctgacaagtataacttgaaaggtactcctttcagtggagggattagaacaggaggggaactcacatattccttaatactatccaaagcttcctgctgctctgcctcccaagtaaattcctgatcggctttcaatctgagcagaggtgtaaaaggttctaacattccaaataaattagaaataaaccttctaacaaaattaaccttgccgatcaatgacagtaattgtttcttgtcctccagacgttgaatcttatttatagcattaatgctcctctgagatacctcaattcccctcttatgaacaagaaaaccgaagaattgtccagtcgacacaccgaaagcacattttgtgggattcatctttaaaccatacttccttgttctttcaaaaacttccctcaaaccgtctatatgatcgtccacttcctttgattttactaccacatcatcaatatagatttcgaccaattagccaatcagatcatgaaatatataattcatggctctctgatatgtagctccaacactcttcgtaccgaaagtcattacaacccactcatataaacttcctgaaagcagtcttatgaatatcttcctctgccataaaaatctgattgtacccagtattaccatccataaaacatataattttatgtcctgaagcggcatcaaccaactgatcggcaaacggcattaggtattcatccttaggggtagccttatttaaattccaaaaatcaatacaaaccctaagcttaccattcttttttattaccggaactatattagaaatccattcaacatatcggcatggccgaataaaaccagcatcatacaaacgagtaatttcaactttgatatcatcatacatatcagcttgacatctcctaggcggttgttgatatggccgataccctagtttaataggaagccgatgttaaacaatcgatcggctaagacctggcatctcgaaatattcccaagcaaagcaatctctatattccttcaaaagctctattaacttggttctaaattcatatgataaactcttactgatgaaagtcggccttggtctatctcccggacctatatcaacttcttctaaatcatcggctgacataaaaccctgtcctaaaatgccatcgagatcatctatagtatcttttttgtagaaatttgaaccctccacaacgccctcaaagcaataatttgggctctccatcttcaattggctgtatatcacaatcagacacttttagataatatccttcccaaacttttccagacaagcaatcaattccaactatttcccaaacatttaaatcgacactagcaacagtaactgacctgtcggctagcacgatttcaatcttgtcaccttgccattggatcaaactttggtgcatggtcgaaggaatacaacaatttgcatgaatccaatctcttccaagcaacatgctataggagcccttcccatcgatgacaaagaacgtagtaggatcagttttgctgccgatggttagttccacattcagcacccctttattttctgaagggttgccaccaaaatcattaagaaccacgttagtcttgataagatcatctgcattcttccctaattttctgaatgtagcataaggcatcagattcacag

SEQ ID NO: 65762 - DNA, 1711 bp, Oryza sativa
tcttccaagcaacatgctataggagcctttcccatcgatgacaaagaacgtagtaggatcagttttgctgccgatggttagttccacattcagcacccctttattttctgaagggttgccaccaaaatcattaagaaccacgttagtcttgataagatcatctgcattcttccctaattttctgaatgtagcataaggcatcagattcacagcagccccaccatcaaccatcatcttggacatcggcttaccattaacaaaccccttaacgtacaacggtttgagatgccgattctctaccacctctggtttctcaaaaattgctcgctcgggtgacaaaaccaacttggcggaagcttcttccatatcagcagcatcggcttgattagcttcaaattcagcaagtaatatgaaaaccatatttaccgatgaagatgcaacagctttacccttcattaacctttttgctttgtcggcttcaacttcatcggctgttagaaccttactcttaacacgccactcttgccttgttttcttcagttgatggttgatttcctactgtacttcctgaaaacgctccctgttccttatcctctggacccttctcttctgattcttggtgaaaatgccataagggcaccattgcgaattcctgccctcatccttattctgaaagcaatcctgatgtatccgacccaatctctgatgaacaggcaactttttctatcttagccgactttcccttttataagatcggctcaaactccctgcagaatccctgttagattcactacatcctggacagtcttctattgacggtagtctcatctcttcattccaacaaaacctaaaaaattcgtagtcccaatgcggatcaaaaccaccatcatcttcacaatatttttcttcctgtctctcatacctcctctgatatttgttgataatcctaactgagttaagctgtgaattccgatgactcctcccatcggctgctgtcccagatgtatggaccatgttaacaggaaaaggatgatcatcaaccttcatcggcctctttgaatcatcaaactttatcttcccttgttcaatagccgactggatctgctgcctgaaaaccttgcagtcattggtagtatgagacccagtgttatgccaattacaatattttcttttctctaattcatcaaccgatgggattgagtggccagtaggaagttggatctgctttccccgaagtagtagattaaatattttatcagccttggtgatgtcaaaatcatctctcatctttccccgaattcttgaccgactaacatgttaaaaccttcttgtttctcgcccattcggctgctgctgctacttcggagacatcatcttcttcagattcagaaacataaggatattgttaacaccaaaatttggtaagcccgaagtcatcatcggcctagagtcagtatcggtttcagagtcttggaatcgaccgatgggaattatcaagttgctagcagtcggattcttggaggattcggttaaggaaattaatctattcaaggaagcttatccataagggaccgagttcaaggaggatgcggcatggcaatttatctattaattaggcagtatttgttagtttccttttatctttaggaaagtatgtttagtgtccaataaggacattatgttttccttttatctttagaaaagtttcttt

SEQ ID NO: 65763 - DNA, 7347 bp, Oryza sativa
catccgcgacctctaccgctgccgcgccgcgctcgtcaagctccgctgccgccgcccatctccggccgcgcgccgtcgccgctagggccgttgccgtgccaagccgccaccgctgttagcttcgcctccgcaagagctttaccggccaccgcctcgcgttgctggaatcccaccagagtgcctctcttctcacacgccggtgagtcgcgccatcctccccatcttcggcgctgccgtcaagggttgcctgtggagtagagtcgcccgctgcagaagtcaagcttccaagttttagctcgttttatcttttccgctgcatttgtaatcttttatatttttgtatgatgtggatctgtatgtcaagaattgttgtttgtgtaccctggctggtcctagatagggatttaatgcacattcagcttcaaaattctggttcgtgaatttctgggcatgacatctccactgctgctctggttgaggaggagtgcgagcagcttgtcggggctagcggacacctcgcagtagggggcatctccaccatcgccaaaggtcgtagacgcgcgagctccgccaccggtggatacatgggtccggctccgtcccactcggctttgctttgtcaaaacggcgagaagatggacagaactacacgagggaagagagaataatggaggaagaaaggggttattaggtccaaaaaaattagaaaatagagtgaaggggtaagtagtggtatatgtcaaataaccagtaaattgtaatggcatgtctccaaatagatgaatagtaagggtatatttcaaaacagtgaaagttataatggcatggttccaattaacccataatatattatagatgccagtttcttaaagaaaaccggcacctatccagcgagccgagctgatcgagacagagaacccgagggtgtgaccaatcaagtggataaacatgtccttatccactcacccggtgccctccactcactcgtccctctctctccttctcctcccccattctcttctgcatccacaaaggcggcggcgttggagctgcggggggtggaacacaactaggtcggatataaccatgactaccttatgtattaatgaaccaaatgtacatatgttctacattaaatttacttgttatatatttgaacaaacattgtacacaatgagttttgtgtgttttcgtctgcagaggtacttgcttgggcggaggaaaagagaccaagcgtaacaaatgcatgtatgatcaaagaaattgattgtggaccaaaccaagaccttctccaagtctacttctacctcaccacgtcacttttggtccatagaagacaagagataaagttctacacgttttggattcgaattcgggcctcctagcagcatcaacatcaaacggacctagccgctgatctagaagtaattcagggcccatgagtacttgttcgaaagattatggagtctactttcagatgggtttggtcccacgtcaaaattcctatcgagctgccagcaataggcaaaacaagccacatatctcatccagtccgaatctgatttgggttttgggctttataattgtgtcgtgggcttagcccaagggggtgtgcaccctagggcaaccctaggacatccctaatcatattagtcaatagccgcaatcgtttaaagtcgggttttgcttagattaatctgtcaagaacagtttcgccgctatatcggtttgtggaatcccaaattcgagtgcttaatcattcatatgcaattatgttgcaatctatcttgttcttgcttgtgttcttcgattcgcatatagggattatccttctcggcgaggtctaccgggtttcagcatggtttataaccagaggagacgtggtgctgtgactgcggggctcagtagcatgttcgttcagaagaaggatcgaatttcgtcacgactccgtccaaatcgtctgtttatcaatacatatcggaagatcaggacctaacatcctcatcatttgttcagtcgcgtgactaccgtgggggaaaggccgccatcatcacgatccggcctcctcccctctagatctggttaagaaatcggtcggatatatctatttagtaacctccgcttagggttgaaagtgattcggataatttccatccgaccggaccttttttcggattcggatagtttcggtcagatatatccggaaatttttgaattcggaaacgaatttggatatgaaaacgaatatgatataggtgatatccatcggaatcggatatccgtcggatattatccggtaatttccatcggatatccaacttacacataaggctgccatagcccataagctagcccaacccgtgaggaggcaaatcagacttattggcaaaaatgaatttcgtgatactaaatgaactcatatgaaaaagttgtcaaaaacaaagttgtagaactcattaagatctgccaattttatttttttcatttctccatttgagtttcattgaactatataaaatctgaattttaaaatataagaaatttaaagaattcttcgggtagtaaatgatttcaaatggaaaaattgtcaaaaacttataaagatctacaacttttatgttggccatttttctatatgactttctttgaacagtttgaatttgaatttaaaaatatgagaacttcaaacaacattttcaaatactaaatgttttcaactgaaaaagtcatcaacaagaaagttgtataactcatcaagatctataactttatccaacaaaatgacagttttgccccttctcttcttccccttctgcttagtgcgccggcgcctgccgcatctgcgtcagtagtagtagtagcactgccagcatcgttggtcactcctccatgttctcgctcgactcagccgccaccgccacgttccaacgattggtggtggtcagcgtcaccgcctggtacaaggaagtgtccatgcatgaagtgcgggtgcaggatgaagaagtgcccatatggtggaatcggcctcacgttggctgatctctctagcggcggtggcggcggtggtggtggcatcgggctagcggctgggctcaccggggaggtggcggcagccttagacgaggaggtgggcgggcacttccgcatggcagacatcgcctgggggcccatccgcgccactcggcccgcgggacttcaccttcgtctgccacatcgtgtaccgcatgtccagcagccgctccggcgactacagcttcgatggcggtcggtgagcccggcggcaacggcttcgatggcggcggcggtggtggaggctacgacttcaacagtggccagctgcagagcaacaagttcgatggtggttggtgagtagcacgacgaagcgagcgggcggcggtggcgatggaggtggttgcggccaggcagtggcgagcagcagcggtgccgtcgacgacggtcggtgagcgcggcggcagcagctttacggcggcagatggtgagcggcgctgagaagcgggtgccggcagtggggattagatagtgctgagggcaatttggtctttttgaaatttctctcccatgttttgatcagaaatgataaaatattgtctcgggtgtcctatagcaaattacatgaattttgtggtgtccattagcaacgacacgattttacagtgtcttacagccaattacacaatttttaggtgtcccagggcaaattttgccaattatttattgcttcaaaatatcatttgaagttttgaaattcaaatttttaattgataaaacaaagtcacaagaaaaatggccaaaataatagcagtaaaaacacaaaaacaaggttgagcatgatttgagaaacatttaggacaaagaatcatccaatttggagtccatacgagtgagataaatgtaacatcctgaaaattcaagacaataaaaatcactaaaattttgaactttttaaaatttttgcgtcatgctggttgttatgattgctattgcttgccaaaccgtaaatggtcacaaagaaagtaaagtaaggatctaaaatttaagtaatagataaatttacgagaatataatatttaattgttaaccctacaaataattacgcacaagaaaacaaagccagacaaacggaaggttaataactaatttagattatgtattaattactaaatacttgaaccatgtgttgcgtgccatgacatctaaatacacatgaaatgatgaccatttataatggaactctatctataacatagtttcattaggagtaattaatgggatattactaaactataatggtctatataaaggtaaaccaattcacatgaaataatggtcatataattaaattaagctttataaaattatgtgaggttttaattaaacaattagattaatactgtgccgagtctcaatttactatttatagaataaatagattgaacctatccgtgtaaaatatattgctatacaactaaactcgaccaatctgctaatgtattaatcatgacaagtcgttatattaaattcaatattaccccaaagtcttcaaaaatatataagttcgccttagggccaataactcaaattaatctaaaaagaattcatttgtgcgataaataaataaatatgggtaataattttggataaattttgatgagtattcagtgcttaagtttagttaacatttaactaagtaaatttagagtttataggattaaaattgtatcggagataggctaaataggggtttaattaaggatagcactattcattgcacatgaggtgtttgatggagttcctagccaccctagccctcttcctccccactgccacgcctcgcactttccctagccctgacgcgccgctgccttgcaccccacgccgccgcacgccgtcgtgtcgccgtcgctgtcgccatcgctcagacgcgccgcgcgccgtcgcttcgctctgcgcgtgccgctgccgcgccccctcgcacgccgtcgtgccgtgcgccgtcgccgtctccggtcgcatcgcctcgagccccacccctccgcgcgtcacgtcgccgtcgcgtcgtcatcattaccgcgccgcgtgccgtcgccatcgccgtcccgccgactccactgccgcgccgtgcaccgtcctgtcgccgcgccgcgctccatcgcgacgccgtcgcccttgagccccgcgccgctgccacgccatcgcgtcaccgccgttgccatcaccgcctcgagccccgcccgcgccatcgtgctcgccgtcccaatgctgcgccgcgccgttccatcgccgcgcgtcgccatcgccccgagccccgcgccgccgcgccatcccgtcgacgattaaaagccggccacccctcccccgagccctataaatgccccctcccctttcccttccctccccacgccatttcccactcttctcccctttttcccctttcttcacctccaccgacgccgcattccgccgccgcgccgccgctgccgtgccccggcgcctcgcccccgctgcgccgcaccctgccgccgcgtccccgtcgaccccgccgtcggtccggtgagccttcccctcccccaccgcttgacgccgcgccgcgccgcccgccggttccagcagagccgtgtgaagagagagaggaagcagagaggtagcagagagagagaaaagagaaaggagaggagagattagagtgggccccacgtgtttagtgaatagtaatccccttcttaatctttattagttgagtctattacaagtgggttcgggttgttaaaaatctaattatagaggttttataatctcgagtctatgacatgcgggccctaccgggtttaatggccggtttgaccctagtcaaaggaatcgggcccacctgtcatttgcccatatgattcctttagaaagaaaaataaaataaaagaaaagaaaataggaagaccccacctgtcagtcactatagcctgtggataaggttgtattaaaaataactgaattaggaacagtaccatttcgcaattattagaattaattcaaatttgaatctttacactagcataacttattcattttagctccgatttgagtgaaacttgaacctaaattcatctaaattcacaagctttccaatggtatataattcactatttaataaaatatatttataattattcataattaatatcaagatgatgcataatagttaacttaaaaatgtgctaataataaaattgatattgtactttaagtagatgtcaaataattgtctttaacatgctttctcactataaaacctatgtaaactaactaggagcattgtttcaaattaattaaagcataggaaatattagtgacatttattagtctatgtccaaatataactaaacctatgacttataaattatttacataagtttagcctcatactttgtaactaaaatataaacacacttagatgaaccttcaacttgtctaaggagaataataactgagctagttgtaattggaccacttaaaagttagtcggtataatgtcatgtgaagtggaatatatatagttcggttgacatccattagttaacaaaacagagccatcttaatcacatatatcgtatagcttctagtaaatagcaactattcagtaaaggatccaatgattaaatattgttgcacacacatacattgtacatcccaatttagatgtacggcatatcaaaaacctacccttttgtgtatagtaaactaatgagtctatgacaaacatctatagtggataaaatactagttataaatcttgacctaatataattgtaaattaggattattcattgtaaaattatgtgatgggatagtccgtaaccataatatgattaacctaaacaattctaacatacaaagcatgggtaattgttaacctttataatttattttgacaagtaaaatatgtacataattaaaataaagcctccatcaataaaataataatacaaatgattcacagtaattatttgaccgatccaaatccatccggcaacagaacctctagtgtataaccgttctatttagatagatgcatgaatagccatttgctagactaaaccacatagtagccagatacgtatctcattcatactacattggttagctcctatatagaccatcatgacaacataaagattaagaaactttagcccttagcatgttggaatccattagcaagcgcgaataatatgagcaaccttaggttcgacctcaacaaatatattttgtttgtgcatatttgattgttgcttgaatattggtttttttttctcgcgtattctagactgtgtatcg

SEQ ID NO: 65764 - DNA, 8445 bp, Oryza sativa
tgctcttaatcccctaaccaagccaaaacaaccacaccaccgagcgcttcctgcagaatctcctaggacaagtaaggttgcagttctttcctgctgcagggaagagagggagggggaagagaatagatagatgagagatggagtcctcttctcctgctgctattgttgttcttgtgctgttgcagtagaaggaggtgggaagcaatctgacaacaagaaggaaggaagaagaaatccatggctttaaattgtttgtttgattcagaatggttgcaccaagaaagtgggaaatctgggtgttgtgctgaactgatcttagtttgtgaacttactgtagtaaatcgttgagtaatcctctgtttattttgtggtttcttcggtgctgtgagtgtaaaaaacttcactgcagcatacgaaagaatgctatgcagaaacaaatgttcattttttcctattccttgtcttgctaaattataaagtatatgcacaatcggtaccaaaggtgctaacgtcagtcaacaaggtgttgtattgtcttcgcaggtccacagtgaccatggattgaggcaggtaatatacgaatgtaaataatgaatcattaccaagtattacgcctgtttgttttgaatttgaaatctgaatgtggtgagacccggagatgagacgtgtcctgctggaattatgttatttcattggtgcatcaagcattcatactgttgcattctatgtcatgagcatttcatccttgtatcatgcaagtgttttctatttcggtctggaggattaataggtaaggtgcccaggctccagtacgtgcagcaatacaatttgtacatcatatcataacttgcttgaaggttgggacatcaccagactttcactgctacaacaaatccacagttccacacagatatgctacatcacacatcgaagaaaacacttcccatgttagctactcatagtcagaatgagaatgggtatcaagtttcaaagagaggtgaatgctcataaatcccttcttttataaggttatgacctactaactacaatcaagaccctaaatctcaaaccttaatgttccacatcatcataaattcttagccattggatcattggattagatcacttctcagacattggatgaacaaaatgcagcagccaccacatgaggcccatctagtaattttgatcctagcccaattcagcagagaaggatttaaggtttcttcttggatcggtggggtttcctcctagagtcggagtggggtctcctccctagcatgccccacacgcgtggcgcggcacggcaatagcttggtgaaaacaacaacactcagtaccttattaccaacaggcggtagccatgcttgtcgatgctgagcttcggacaccaccacctccatagaccctttcctccttaatttgcggtgctcatgtgtgtttcttttgtttaaactgtttgattttatcattggtttgttgaaagttaggtgttccatatgctgccggatgattcaattttctggtatgtttgttcgatggaaatattttcagatttgcatgtcatatgtttggcacaatacctgaacgaggatcatactacgttagtatcttctcactgcaagtttatgatttttatattgtggtttcttaacctaattgcaccatgtgcacactaccatctcactatatcaaacaatttgtgtcatctaatcctaacatatttgattctagaaggtcacccatggtcaattaatggtagaccagttgtttgcagtttgcattgtgtatgggtggtttagcttcagcacaattgtctttttaaacatttctggacagatattgaatggttgaggcagctcaccgccctgaacagtagttctcttttatttcatacaactgcagatcctatttaagtgtaagaattaccatcataattttattttcctgctattattcacaacttacaacatggatttaacatgaaaagaaagctagctaccaaagttacgcccttgcagatagcacgacgagaaggatatgttttttttaaagatttaaaggtaaccgtatgatccatccatgaatatttggaagaagagatgcatgtgcttccaatagctacatatttgacgagaacagagtgtgcagtaatgcatactgttggacaaaatatagctgaagctcatacaagtctgatatgttgtattacaaaatattctttgaccttctatggatcacattttaattcacagtttgttgtctttgcttactttgaagccgataccaaaatatcttattgaagcacacagattccagccttgcatatatataaagttattttagtgtacccgctgcaacatgcagggaatcaaccagtactcttgtgtacatacgcatgcaaagaaaatagaccatggatgcatatgctctctgttccgtaagttggtgtgcacgatctcctcccccaacaatatatacacgttgtagctagtgcgcatggtaggcactaacatatatagttgttgacaaaatgacaagttaacttgccagctgaactcaaccctgtgacatctgtcaatctaggcttgggaggcaccaggaagtgtcgatgtgagaacagacgttgaaacatgtcatgtccattcacatccgttatcaggcatacacggcggtgtgcagccgccaccgggcaccctgcctccggcgactcttccacggcttgagacgatgagaagccgtggcgagcggcgacactttggagatggacagcagctaagcgtagggtgaacagtccgttgtcaagtactatcatatttgcctgaccacacgaatgctaactataatatactagttaagtgcccgtgcgttgcaagggaaaaaaataatacatcaatttcaaattattgaataaaattgtgctgaatagttattgagtgtttcttaataaaaagtagtaatgcaataaaatcctaattcagtccggggatatacgtatttagctgtatttacactcatgacatcaaatcaagtaactaattgcaacaagtatatacagatggcattatgtatttcataacatggcaagtgaatgcaagagaagtaattttgcgagtataggggacaaaaccaaacaatacagcataggacaacacgtccgcaattcaaacccagagcaatactataatgttcgcactgccaggacatcatagcttcaacgattgattgagaacacgcacaagtatcttttgtcatgaggcacatattctctatgcctgcaatatattcaatataaaaatctaatgaaccacaacacataaagcatcaatatgtcctccagaatcacacaccacaggtgcaccacaagctagcttgtttggtcatattcatagcaggtgatattccaatgggagaggaatggaggaaggttaacttgctggagatcagagagtgacttagtttggtttgcctggataagaggaaaataggtcagtccttatttgccagtatatagtaatagttatatatgtatgttataccattcccgtataactattttctctatacgataatactatgtgttttcttctaatatactggagcataacatgtaatttgtgcaaagatgaaaacatcagccacagtaaaatctttaaaaaagaagggaaaatagttgcataaaagagaagctttgaaatctggatcaagaaatgacattgacccatgaactatttctcaaaaggacaaatccgcattcttaaaagtattatttcttaattttctccacaagttcttcaacaacaaagacatttcatgggtcaattacagaaaatacagacctaaaaacaaaggataaagcctcttctttataagagagaagagggggaactttttggtggatattttagaacagtcgctatggttcaaggaaatagctaatcctcaagtgggtaatggacaatcaattctatgcttggatgatacataagccaaaaaaattgaattgaattgcatatgtgcacagaggtagccgttcagggctcctggacccactaaattgatactttgctgaaaaaagggaacaaatcaatccaaaagtcagctctaaacaaatgacattgatctgttgatgtagcataagcagtgcaattaaaagctatggaatatgagtacacagatggaaggtttcgtacagaaaaccccaatttctgatagcctaaccagaaccaattcagggagccttataaagctttctacaaaatgcaggccacacaggaaatgctatctacttacatcaaaaggaatctagttttgttcttctgaaaacagatttgtaggcactcctatttgtaagttaaatatttctttaacttactgttaaaaaaaacatgttcagcatccttgagtctagcttgcatatatctatatcaacactggctacttcaatcccatgtaaacatatgaatatgacaggcaacatgataaagtttaagagaaaaatatagagcaaaaggtatgtagttgcatcctcaatcccatataaatgtttaaaagcttgacagcctaatgtaagattttttttggttttccaccgctggttgtacgattttgggtagcaatcgattgggtgggctggacagctgcagccaaaaatgccgcaacaatcagaactgatcagcctcaatatgttgttttttagataatggaagctttatttagactcatttaattacatcaagatgatagaatcaaactgagtcacccccggcctctgcataaaatgcacatagccaaaaaagaagaaagaaacaactagaacatctcccaagcacaaaagtttaacagaaacatatatcttagtggctatcaatccgtaggctagaccgtcacccatgctcctgggtaaaaaaactcctgtgccacctggtccaactgtcgagataccaccgtatatcttagtgactatcaatccgtagactagaccgccaccatgctcctgggtaaaaaactcctgtgccacctgctccaaacgtcgagataccaccataatagtatcccgcagtcccggttggtggaggatagcccatgtacgtagccaccgggtaactaaggtgataacctgcaaaggagaagacaccatcttgttatcaaaaattactccattcctacttaaccaaatggacccacacagagctgttgcacccatcaaaagtagattcctcatttctttggggacacatgatagccaaatcccaaacatataaccaacattgcgaggaggtttcagattagaaaccaaatgaattacagaccacaccaagcgagataagcggcactgaaagaataaatgttggatagtttcatccttgtggcagaaacaacatgtcttgctgcctttccaatttctcttagcaaggttgtccttggtgagaattacgccccgacgtaaataccaaaggaagattttaacttttaggggtactttcaccttccaaatccgtctaatgatattcggaaccccggtatgtgttagagctagataatgagatttgactgagaagaccccattcggggtgaggttccagtgaaactcatcttgctcctgtaccagaaccaaatcagctatgcgaggcaataggttatgccaagcagctatttttgcaccaattaaatcccgtcgccatgaaaagcatggaggattggtttggaaaatctgtgcgatagtcgactgtttatgcctaactatgttatagagacaaggatactgttctcttaacaaggcattacccaaccatttgtcttcccagaacctaacttgggagccgtccctaatcttgaaggatccaaaacggaaaaagtcatgtttgaccttcataagactagcccaaaaatgtgaatcccccgctttccaataggcttgagataaaggttgtgatcccaaatatttattgcgtagcagttgttgccatattccatcggtgataagtagtttgtataaccacttactaatcaacgctttattctttatctcgaagtcatgaattcctagccccccttgttctttgggacgacaaataatgtcccacttagcaagccggtatttcttcttatgtccatccccttgccaataaaacctagatcgaaggtaatcaagttttttaagtaccccactaggaattgcaaggaatgacatcatatacattgggagactgctaagtactgagttaatcaaagtaagttgtcctcccaacaaaagaagttttcctttccagctactcaatttcttctcaaatctctcgaccacttctttccattccgcatttcttaacttcctataatggatcggaatgcccagataatggaatgggaagttgccgacctggcagccaaagagctggttgtattgatcactaaaatcgctctgactcgagaatttaatgcattaagaaaaatagagcagcacttaatcagaagttatgtgcaattgatctgaagatagcattatatagtttaggaaggatatggcatcgaggtggggaacaaaagtgtgaaaatccccaatgatggagcagaactcgatagtgaagcattacctggtcatcgaacatcagtttcttatgccaacaagatctcaactaaattgcaagctcaataaacaaaagaatcaatatcatctcttgttctttacactatacaaagaccatttcgtttgacctaacccatccatcctgcccaagtttttcaagtctaagccattggggggagttcctttagttggtttgctcagtgtttcacaaccactattttcgcaaatttgcatttgaattgtaatggttgaaagaacgagatctagcaatgcttaccttgtccacagcgtggtggagagagttctggtggcatcggaatggagagcgtatctgttaggtagcctcctagtcttgctcacttggaaaagcagataaatcaaccataagagatggtggaatatcattcccgttgtgtttcaaagccctagaataacaggtaatcaagcatgcatatcacacattttatcctataaatgatggacctcatgcatgatttcaagatagagtgaattcacattgaaaacctaaaaacgggccagtgcaatttacggatactaaaggaatgtccactcttacgtgagtgaaaatgtcaccaaatggatgactcccagagaagtcatctgggccaccacctgacgcttggcgctcagaaaatccagtagaacaatcgatcgcaaatcgaaaaagacaaatcacatattcactatttatgtcagtagtaaggaaggcaccatttggcattgaggcagattatcatagtcctgtttggtgcaactgcttttaaatattattttgttgtttggataactcttttccttcgtttgatttataaaacaaactaccaggaagatagatttatgtctctgcggaaacttaaaaagcacatgcatagtcacagaaaatagttaataacccggtcgtatgtttcacgcttatcttcatccttcaaaacctgagataagcatgacaaaacgcaccctttagaataagaatgtccaatggttaatgtaggacaagctaagatggtgcccaaacaaagaaaccaaaaacatgttcaatgtaggacaaactaaaaatactctgttacttccttgtttcaggcttccattctaatttatgagtttccaaatggatgttacatgcagcttgcactcatgcggttgggtcagcctagcgatggaactccacccgccagatctacgctgagatgacagcgaggaaagaagccgctgaggcgctgacatggcccattctcctcccgcatacggcccctggtcatgggcgtggaccgtggggaagggatcccgaagacgaagataggagcgtggaatgttggaggtgaggaaatattgcaaaatcagtatgcaaaaaacatcttaatggactgaataatatgcacataaataaatcgataaaaaaaactcacatgatcttgttaacgatgttggtgtgatgcccccaatattgttatccatatcttaatttagtgttagccagctgaacaatcctaacagcatacttcacatcgagagttaaaacttgtttctgtaaatcagaagaaaaattcaaaagtaaactaatgagagtgaaaataaattattctgaacttaactctgaaaacagcttagaatgatattcgcaacatcatgttccttttgaataaaaagtatgaactccaagcagctattatatctgtttattccatcgattaaagatactttccattaggaaaaagatatattagctgcacatttcgtagaacacatgaatgcttggaggtatatattagctgcacatttcgtagaactcatgaatgcttggaggaactctccatgcattggttatgtatatgtgtgtt

SEQ ID NO: 65765 - DNA, 25262 bp, Oryza sativa
atacactgtgagaggtctttcttgaaaggaagattactatgatctcattaagaacaacaatagtagtgcggcatacacattttttctcaagtttctagtttgcatgaaataaatatcagttatcaatgttgataattcgaaaccacaaacaaaactacatacttattatgccgtaaggctgcactatcaggtcacttcttgctattttttgggttttaaagaaaaaatcatcatacacatggagggtctatattcttattactatgtgaatttggaatgtgagtcttatcctataaattattggaagcatacactaataaaccattttattttatttgcactgtacctcaactctgtagccaagttaaacacagaagtatttaatacagtaatgaccttttcaattcagagcttcgaggcaacattctgccgcggcagggtgatcggttgctgctcggcgcggggtcgtgtcgtcgggggccagctcccatgatccggtggcaactgcagagggcgaggagggaggagagccagtgtggggtcgtgtcgtcgagggccggctgctgcgatccggtggtaggagaggagggtggtaggagaggagggagggaggcgcagagggccggctgccacgatccggtggtaggagaggagggagggaggcgcaggcggcgatgggggtgggggcgcggtcggagagaggcggcagcggggtgaccgtctgctgctcggcgcaaggtcgcgtcgtcgggggccagctcccgcaatccgacggcagttgcggatggcgaggagggacgcatcgtcggggcccggtgtctcgatccagtggtaggcgaggagggagggaggcgtcggcggcgctggggccacgggcggaggggcggcgcaaggggtgggtgtgggcgcgattgcgctgggaatcgggagcgagcgggggcagcagcgaagggagcggggagcgtggttgggaagaggggcgcgatagagggagccaaaaggggagatggcgcgcgtttgaagcgttgattttgcgggaggatcctaaaagcaatcttaccccttgaattacctaggactcaccatcaccactacagaatttttaaaagtagtagagatactctctctctatttcaaaatgtataaagccgttgatttgtcgtacaatgtttgataatttatactatctaaaaattttgtataaatattatttatatattttattgtgatttattttatcatcaaataaaatatagtctcaacttataccttaacatatttatactaaattttttaattaaacaaacagtcaaacattataagaaaaatcaatagcgaaatatactttaaaatggagggagtatatagttgcttctttggatcaagaaaatgcacagctcgtcaccatgctccgtttagattgctaagtagtactccctccgtttcgttttatttgacaccgttgactttttagcacatgtttaaccgttcgtcttattcaaaaacttttatgaaatatgtaaaactatacatatgcataaaagtatattaaataatgaatcaaataataggaaaataattaataattatttaaattttttgaataagacaagcagttaaacaacatgtgctaaaaagtcaatggtttcaaataaaatgaaacggagggaatagcagtggacagcagcatctgttaactttggcgttcgccgccgtatgctcatctgttcaccagcacgcactatcgatctgcgttcttgccggtggattatcaatttatcatccggggatgagaaaaacgactgtagtttaataaaatttcagaggcttcaaatacagatactcctataccaaattagtgaatccagctgaaactaagctctgttcttttctcatgaagatatagattttacctcggtttccgttagcacgcttttcaaactactaaacggtatgttttgtcaaaaacattctttataaaagttgctttaaacactactacaaaacatcaaataggtgtcggcactataggtaccggaagtgctaaaacaggcacctataggccttttcacacttccgcgggttgaaatcgtaaaaaaccggcacctctaagcaattatagataccgattctatatagaataggtgtcggtttttatttaaaaaaattacctatgtattataggtgtcggttaattaaaaacggacacctataatatattataggtaccagtttttttaaaaaataccgacacccacgtaaatcgagccgagccagcgggccaggtttgctcgctagtcgcttcttgatctctctctcgcccctctctctctctatctcgtcccctccttctccccgcatacggcgtcgtcggtgacggcttcgcggatacggcgatgcgcgaggcggccttggcggcggccggggtggcgacagcggacagagacttctcccgtgggctccggtggcaacggcgactcccgcgatggaactcggcggcggccggggtcggcgtcggcggcgaaggcttctcctgcggacagagctgtggcgacggcggcttccacgacggatccggcatcggcggcggccggggtggcgacggcgggctcccacggacggagtggtggcggcggcggctcccgcaatagatccaaccctcggcggcggcccggggtgcaggacgacgggcggaagactgcatccctgggtcggccatcggcgggttggagctggtggtggtggccggctccccccaacaaatcccggccacggatcggcaacggtaatttggttctatgaaattgttgagggatttgtggtctgtgcttttttcatctgtgatttgtgtgaaatttctgtgatttgtgctttaagggatatgtcttggatggatcaatggttacagtgtgtgaaacttctgtgatttagtttggatagatggtggtctcgtgtgtgaaacttctgtgaattgctttggattgacggtggtctaagggtgacgaggaatggctcgatgcatcgtgccgatgcattgagccctttttttttattcttgagacctcaaaggtaactttgaatattcacattagtaccgcgcctcaatggtgccggttgggaaaaccaaccggctcctatatgtggggttcctaactggcactatggtagtgaaaatatcaaatatatccatttatcaagtttgtaataattaaaacttaattaatcatatgctaatagctttttcgttttacgtgcgctaacttagaccctgtttgttttagcttaagattattataatatgtatttgtcgacgtttgatgtcgtgattccggcatttacatagtatggggatcgttggtactaggatatatgcgagattatagtaaaaaagatggagacggggatttttatacaggttcgggcacctgaattgtcaggtaataaccctactcctgttggccgaagccggtcgttgctcttatttaccataatcacaccagtacaatatttggggtagcctatctatcttttgtcgacatggcggtctgaagtgctgacacgtagtcgacaacagagtagtatttctcctcgaatccgtgtccggcgagatcagagacagcgttagatccttcttgatggtagtcgtaggtaccgtatggggactactaggcttatctccaatgttgatatccggcggcttgtcttggcgtatgttggcttgtatgttgatctattgttttatgtcccctcttcttctaggggccttgtatttatacccataggtatccccttatcaaaatagaactagggaaaccaatatggatacaatccgagtagtccttatcattttcatgtagaaccctagttgtctttccttatccggaactcatcctatatctgaaaactatttccgtataatacatggtatgtggtgggtcctgccgagatttagtcaactactatcaggtatgtggtatctataaccctgacagtattatttggagtaatttgaaacaaacaagtatcaattattataatctacaagctagattagtacaatctagtaatccactttagaggtgcaatttttatattattggatggctaaaaatccactgcccgtatatattttaaaaactcacccacctttgctatggaacggaacaaatcaggctccatccttcccactcaacacgcacattgaccttctctaccctccagctgcacgcgcattggctcctcttctattccgcgtgtcatctctcatcctctcggcacatccatctccatctccaagccacgccgccgaagccgtctccttctcatcctcctccgtgacttaacgattcctcgttcatggaagttttatttattaatatatgacattaatttttagctatttcaaattatgtatttattgtatacaatgacaaatggatgaacaatacatccaaaatagttgaggacattatagacattaacatttcaaatccagtaatctatgcctccaataatccagagaaacaaaccatcatagcttattttatattaacttattataatccaagctcccaacggatggcctattcagccaaagaaaaagccaaattttaaattttcaaacttaattttgatattgattttaagatattttcaacatagtttctttttcaaaattgacttttaagtcaccgagaaaacatatgtaaaagttttacctacaaattcatttatattccctaataagccgttttggcttattatagaaaaagccaaatgatggggcctccagatttcagtaatctcgctcaataatctagattgcaataatctaagctgaaagaaacaaggccttaatctttatcttcatgacgccatcctcaacccaaaaactatcaattagttttcgtactcgccaactgtatatctaagggatgatgtcttcaaattaaattctcatctaatcacctctcttccttttccttttatctatatatacttttgttttcattcttggttattgtgttgaggcagtttcttgaatgagaaattattcctccatctttttatctctcttctcattaactctttttccacattagatttttacttatgtgataatgtatttaatgctataggcgtatactagatgttacggaggattgatgacaatgagggctgggaatggcctgatcttcaaacaccacccaagtgagtcatatgtgtcccatcatttcagttgggccggaacagatatccagtgagcctgcgggccatatcggtgtgcgcatagcagctagcacacatactccctcccctccgttccaaaaaaaaaaaaaaagcaaacactgggtttctatgtccaactctttccgtcttatatgaaatttttttataattcgtattttcattgttgttagatgataaaacatgattaatattttatgcgtgacttgtctttttaatttttttataatttttttaaataagacggatggtcaaacattgaacacggaaaccagggtttgccttcttttttttttttgacggagggagtacactgcatcgatggtatacagtgtacgtgcaacattgaacagtttctcgtcccctttctccttgagattaaaagatgtcagggtcctgaatctgcgtagtccaggctttctaaatataaatacatttttgtaactttgatttgtgaacgagtacttccacaaaattgaacagccacatggaaatgaatatgttaaaaagagctttaatctccgactaggaagaaagcccgtgccagatacgtgggcttcttattaaatgttttatataaacaatgctaaaagaagttacatcccgccatttccatttaaatgttattaaacaagaagaatatctctcaaactaaaaaaaacattttgaccgagtaacatataaattctcctattgtcaccattacttattatgctttaaaagctaagtgaactgcatatgtaccaataatataaaactaatgtatcattaatacactaaaatatccactacttaagcttcatgtcttactatagaatatagacattgtaaaaatactaccgcttctatccattaatgggatagcaccattaaagttaaatagaaatgctactctaatatgggtgaagcccatcatagcctcaagactttctttctctattgccttgaaacatgtagccatgctccttaagaccagcttgcagcataattttaatgcctaatttgttatcgcacgattatggagtattacatcggtaagtatgaagttgaggactattagcgatggtggcctccattggggccaccttcatttagccatatgtttcatgctatacttatgacaccgtagtaaacactatttttcatgtttggtaccctttagtgaaggacaaagagaaggtggaggtgatcaaagtagtttttctaaatgttttaagtagatttgtggtatagagtagacacaatttgtttatggtgttgatcattactactcaaatttttagatatagatagagtattctcttttgaaaatgagcgaggttaatcactctatgatattaaaaaaaattatagctagagtcatactaccatgataatatccagagcaccatattattctttatattttgacaatatgtatagtttagcgcctagtttgttttcaacaccaattgttcatagccatatgagacacttttactaatttgaagaatgtatttattttctaaacttatttacaacaactaatcagttggagtacgcttatagtcatgccagtggattttcttatatatatccatcagttatgtctaacatattgaaaatccttaagtataagaaattatatcatgattattttattgcgcatgctacttcattgtttatttatgtcaaaactatttggcaaaggaataaaagtatgatcataaatctcatgatggattaagaggttgcattatagaaagttcattggctggaaatatttttgatattttttttcatatctactaccttcgtcccagaatataagttcttgagttggacatggctattaataaagtagatagaattaaatagggagaggtttttattggttgaaagtgaatgtatgtggaaaaaatgaatagtagagggttgtgattatttgggaagagaatattgatgaagaagttatcatatttgggataatttatgcatgttagaaattgatatatttggggatggaaggagtatgtactatgtatgctaatcagttttcaaatactaatcaaacagttctgaaaatataaaaaaaaacatttgagaattttagtctcaaacatattataatttaatcagatctactttgaaaacacaattaaattttgttgttttcattttttactttgtagatttaaattagtgttgtatatttgagaagtgatattccaacccctaaaatatgatgcaaatgttttgaaaattatcatacaactatctattatatattagccccatatgtcgtgatgtatttaggaccacaatacaacttctatagttgaactaaagtaatacaacgggatcacaaattagatttatttaaaaataaattttcttaaagaatattgattggatattttatattttttattatagatcttagtttaactatatatacttatatttgtgaagtaaaatatttttatctaaaatcatattttaaaggccgtcgttttttatggatgtacattttttttggctgtctgttttatcttagttcctatggttctcttggtgaacaataggttagctttattgtttggttttcaatcgtacgtacgtacaagagtatagtagtagtgtgtatcgtataaatagggggaagttattactttgtaataattgaactgatctaatggtataaaataacggatccaccaatttaagtgaaaattaatggtgagattagatagtaacatgtggcgacttaggaacatttataagagtgccccagtcgatgacactatcacctcaaagtccgacgtgcctcaagtggtcagaagccacgactccaagtataaggacaaggaaaaaggagaagtagatggtttccattttcagaggtggtaaaaaagtcccaaggagagaaaagatgatgagaagaaggccgctcaacttgcgagcccaaaatactttccaacagttgattgcccggatatatatgaaaatggcaaagctttttggccggattatgcacttgaagaaggtccatgggagataagaaggctacacaaatggtacatggacaccagcaagaaaggactagtatcattaaccgttcgaccaccgcccgatgctttcatggccaaagatggtctcttgtggcttgatttcggtgatcttcgtggcatctatcatcaggaaaagatggacgtgaactttgttgctgcgtggtacctttgaggctgtgagtaacgatatttttatacacaaataaataattacactagaaaagtttttgattattaataacaagcttttttggtaggatgtaatacatggatgttgagaaaaccaaggaacccatcgattatctagatccaacaaggatctgccaaacccagcatacggtgacattatcaaccgtgactaactgcaacatcgttactatttagcgatcgttatatatgtttcttgctctacccaatgtatgggagcgttgtggtcctggacccccttgattatgaacacaagacgtacagacaatttctaaccatcttacaatagtaggtgattctaatcgatgcgtgtctacttttcatgaattataattgaacctccaccttcatactaactaatatcgaaatcctacggtgcgtacaattactgcaaggtaaagggtggagaacaactgcaaacaagggagaagttgctagtgcatacatactggccggcaatactccgcacacttaatatatttaaattcttttacttacaatgtttaacgaattcatcctatgtgtatgccatgaagtgtcacaagcgacctcgaggcagtatcctctacggttattacacctgcgattacctcagggttaatgggaggtacatgactaagtaaagtaagaggatgtaagtatttcaactcaaacatataagtccaatggaaaactacacatctaaatgatatactaatatattcttgtttcattcgtggatgcagttgcctagaatcgagctccaaataaactttgaagacatagagatctctgccactttatccactgcgagtcctgtcataaagatgacagttcttcgacccagaaggaaacctagcgacaagtgatgattacaagtttcttccagagtggaacaactcgatgctataaaattgtaaatgtgcatttgaaatgacaattgtaaaaaatattgtaaatacatgacgacacttttcactaatgcaatatatgcatttatgactaacaatattaatgtattaataaagtaatcagttgtaccgttattgattaagcattaataaaaaaattggcgggagattttaaattttggtgccaatttttttccaggaagccccctaattatcgcaggcggctagctgtttgcgaaaaatttcttcccagacggaccggttgcctttgcctacaagtgggccgagcatccgcataggaagaccttttttgccgccacagaaatgttttttttagtaccaaacaaaactgtttgatccagattctaaaaaaatatagttacagaatccagaaaatgaattagaggtagaagctgagaaactcagcttttctaatttttaaaagctaactaccaatcagctgctttttataaaatcttctcttaaaatatgcttttataatgtgggagggagttctacacaaatagaaaaataataagcggtggtaggaaggaaattctgccttttatccatcggctgccacggcagctgcttttctactactttccggcggcgccgctctcctgtagaaaaaatgcgaaaccactgccctcacgcgtggcatcagcagcagcaccgcggccgcatgtgggccgcctcaccggccttccgcaggcgcctcttcctcctccgttccctttccccctccccctgcgccgccctccccggcaacgccgcctgctcctcctccccctcgccgtcgacctccattcgggtcaacgcgatgtcggcatcgggccccgtgtacgaggcggacgctgaggcggtggtccgccggatcaccccgccgctcgaccgcgcgcgccacaagggccaggcaggtgagccagcgcgacccctatccctctcgtgcgcgctccggggtggtggatttcgggttgtggtgttgctgatgatgcgctctctgtgtttgcgggattgcctccgtagggagccattggtgggatatatagataatactcgaagaagagggattttattcggattgttggggctagagaggccgtgcgggggacttcttgagactggggttgctaactaaggcgaactcgagcactacacagtcattgcttcacaatgaaccgtgtactgaaacaggacagaaattggtggatattcagggttagcattgctgttctgtctgataggacagtgttttgcataagggtgttttgatcggcgacgagtttggtgatacgttcgcagtgttcgttgtttctccgtatgatttgaagttcctgtatgttatgtgaaactataaataaaggaatattttacaatggcgtgaaaggattttgctgaggtgtagaattcacttataaaaaggtttgcgctcttgtagagttaagatttttctgtgatatgatttgctacgaaagaccatccagtaagattgcacagatacaagaattttgatccaacctctaagcatgtgtcgtcttcatatttctagtgcataatctacaagaaaaatgtaatactgtccgtgtctaggaacttttctactggtgtatacagtcagaaacatatcaaatcctgtatggacatacacatgttgttatgaagatgtgagctgtattttccagtttgttattgtttcatgttcccaaaaaattagtttcctgttgattccttaagtttacttacatatcaaattatcgatacatttcccagggaaaattgctgtaattggtggatgtcgtgagtacactggtgctccctattttgcagcgatttctgccttgaaagttgtcagtatcatctaaatgtatcattccataaattacgcaacagtacaaatagttcacatgatgttattcagggtgcagatctctcacatgttttctgcacaagagatgctgcaacggtaataaagagttatagccctgagctgattgtacatccaatactagaggaatcttacagtgtaaggtaacattcatggtatttatctttgccgtttatactataatcacaacatcatcttcgagaatctgactttataattactgcacagcgatggtgagagagaatctgtttcttctagaattctcacagaagtagcaaagtggatggagcgctttgattgcatcgttgttggtcctggccttggaagggactcatttcttctggtcagcttacatacctaacatcttctggagtataaacactatctctgtcctgttgaggtcttcttcattagtcttatttgttgctacctttgcgttttatacagtttaagatagttaattatattgattgacagttgaaaacatctttgctgtcataattcttgttttctcttcctttgaaactaaccatatttcgaatatattttattttcagtttgcacctttggtcaagcattgttgcaactgtgtctacctccattcctaattgcattagtagctcccagggccaaggatagaccagattggtgttgataactcatcctgtatttctgaagatctacagtttgaaattataaagttccttgatagtaaggaccttgtgtttcatatggttaatgctctatgtagatgacaacctcagtcctgaaactttttccatgctagaaatggtagcttcattttgaaggtgtggaggagttttaaccatgcatgacttttttcaattggaactgaaatttctcttttgtattaatgtcccatgtcatctatttgtctaatctcctatatggagatcatgccatcttgccctaagtacttacgatagtattcaaatttgtcagcttatgtttgttttgacatatcttacttgtaggactgtgtaagtaatatcatgagacatgcacggcaggcaaatattccaacagtcgttgacggggtaccatttgacttttttttaaaaaaaaaacatacttgaaattataaattatgaacaggacttgatattttttagtgatctgcaggatggccttttccttataaccaataaccttagtcttgttgagggtaacttgcttgccatcctaacaccaaatgtatacgagtacaaacgtcttgtccagaaggttcttaactgtgaagtaaatgaggaaaacgcttctgaacaacttactgcactatgccaaaagtatgatcataaccattgcaatcatttattcttcactggtcatctgtgatgttttctgattctgttgaacagaatcggtggcataaccatcatgcggaaaggaaaagcaatataatcagtgatggcaaaactggtatactagaaacattctttggctacttcaaattttggtgaaactataattggtttcaccagattttatatctcttaactatttggtatgttgttttattcagtaacacaagtaagtacctttggttccccaaggagatgtggtggtcaaggtgacattctttcaggaaggtttgttgccaatgtggtgctgagtgtttccttctgtagttatttctgctccttttctttggaatttttttcccatgctgctttctacgcttcatatcaaacatatgccccaacataacctttacctccatgttttgctactgccaaaaccagtgcttaaatcgaaagtactcagttttggatcgactcatttattttccttccgttcgtcataaacaaataacaaagaaacttttctaggaatacagttttagtttgttctttgatgatttgaaaaccacatgctatggtaacatgaaaactagctatgtgaacttcaattttgaagataacattgaacttaaacaatgagataatgaccagaactttgttctaacaagaactgattatcccgccctcaaaataaataaaggtcctgcagttgcactaactgctaccacttttgtaatgtgtgcttcagtcacagcacactgcataattacccagtatgcaataagtatgcaatgggttcttgggaatctgataattgtgttcaatcatctttgtgtttctgtaaatattggctattcaattatttatcatcctcaaataccatataactattgcatactcgttgctcaatgctaacaatcttctattgaatgtgagctaaaatcacgttcatatgcaagcatatgtgctggtcatgaacttacctatgagaactctgcttgatgtaatagtttagttccattcttaagcaatgccatggtagctcaaaattctggcattagtacttcaaaagtgtgttttattcaacgttcatttttgctggtttcttaccttatccggtttactgttggtggtagtgttgcagtatttgcatcatgggcacgtcactttctcctgacgaatgagtaccctacagagaagaggttatgatcaatcactgtttcccaccactcttgactaccatgatattaaataatatttgcgttggcattggtgcggtacagcgtgaatccgatgatgcttgggtgcattgctggctctctactacttaggaaagctgcatcacatgcttttgagaagaacaagagatcaactgtcaccactgacatcattgagttactgggcaaaaggtccgcgtgcgctctcactagattttttgtttcaacttgtatcgtatttcttcattttttttacaccttgcacttttcctcttgcagcttggaagatatatgccctgctggtcattagtttagatctttaccatcattggtggtacggcgccttagcacctgtaataatggtaatccatatgttcggataccagtctctccctgcttaatgtacatgtttcttgactgaaaagatggtgttacaatgcttggttttgtttagcctccgttttgctcagaagaattctacagaatgaataatgaattgccccataaatggggctttgattttggaaaaaaatagcccaaatttgctggagtatggattaggcccgtttgagctccggggtggtgatccccgcaaggatcaaagtgcagctgcaagaagaaaaggaatggaggggaaactgtaccaaacagaattctggcacagctcaaatgtctcatgatatgcctatgcaaattccagttgtgtacagttttgagcacacgtcattggagccaaaggttcttcactccttcactgtcttgtcgcatctacactgaaggaagctgtttgcgtcacgctgtattctgagattcgaaattgtttctcaacaagtcaagcagagctgtgtgcctgtgacatctgttgtcaattttttcatgcatgattggaagcatccttctatccgtcatgttccattgtcatctgtgagttccatatcttgtttaactccttttaagaaattactgctgatggtgagtttattaatctatccttgctgcagcacaacacatgcttattttttctctctagggtgtaacagaaatatccttattggtcaacagacatgttgaacacgaagattcacaatggtctcatgataatggataacaggtcttctttcatccacctcaaagatcatcctgaatgaaatgccgggggaggcaatcaagcaagaaagggcttcggaagggtgaccccctatcccctctcctctttattctagcaatcaaccccctttaacgccagcgacacaaggccactaagcttggggcgataagcaaattacgaagagagcggtacgtttctgcacatccatgtatgctgatgacgcgactgtcttcataaacccgaataaagaagatgtgtgagctttcactgatctccttggtcgctttggacatcaagtatcataatattgcctactaaatacgtgcaacatccaccgcggctaggatagccctgttccccccatatatagaagataaatgatccctcacagcgatgcattacccttgaagaacagacataagaaagaactgaaacgaagagattattatgagatgaattcatggggacaggatgtcacgcccagaaattcacaaaccagaatttctaagctgaatgtgcattaaacccctgttcaggaccagccagagtacacaaacgacaattgttgacatacagatccacgtcttacaaaaatacaaaagattacaaatgcaacggaaaaggataaaagcgagctaagcctgaagactttactcctgcagcgaggcgactccattccacaggcatccttgacggcagcgacgaaaccaactccttcgagacatctccaactgagaagaactttaactctggggtgggggaaaagagagcaagactgagtactacccactctactcagcaagtcataccggaagagaaggtatgatgcagagtataaccaaaggaggctagaggttcatttgcataaagctagcatttaaaagcagtagttgaaagcagtaaaacagttgtagcaattaatcaatattaaccaatcactgtccaacgctacaccacgttgcaacaggcccaaccaaccacctgaactacaccagttcattaagctaaactaggggtgagactaatcacggtgaatctggtcgaccgcccataaccgcgggcacggctattcgaatagttttactctgatcagaggtgtacaactgtacgcacaagacacagccccacgacacgttaccgtgcgccgacatgccaccacgacataccggaaagaggccgtgacaggacccttcgcataacccactctaaccgatcgcaccacaccttagggttcacccccgtcctcagcaggcaacgggcagcccccctttcgtgccgcggtgaattaggaagccgatcaaccggacaccccggccaacccaactccatcatgcccaccctcgcctaggtacgtcggctagaggaaagctacactacaagcccagccgttgcccacgctggcttgtggtaagtatgataagttcttccagggcatcccgcgaatcggtccttaattgccatgagcacgactagcaaaaccatgcacccacagcccaccatgtagtgtattttgattaactaacaccattgcggtggcactaatccaaagctatgccaataatcaaagtctatacattaatgtgattccccttttgtgtactagttgaactaagcatggctaagcatttcctaagccaacatctaatcattttgatacccaagttatcaatgacataaggtaaacaatatatggctgagtagtaggacccatcccacatgatattgtaaaacgatgcaacatttaatagaaatgcgggacatttgtaaattgggtacaatataatcaatcgtaatgcatgacttgccttgctctcgcactgatgagaccacaacaacgtcttcgagaaaccgtggagcgacgaaacggccgagatctacacgacaaacaaaacacacacgcaaaacatgctataagactactgaaacatgaaacaaaaccatttttaatagattctatgcatttttatgaatttactgagacttcaatgaacttaatcggagctcgaatgaattagatatgaattttagaagattaaatgtgtttttactataaaagaaaaggccttaatggattttattgcgcaataaaggtccctgctgacatcatcaaaggggaggggtggcgccgacagatgggccccacttgtcatagactcaaaggcaccggtttactgtggactgagtccacgggaccgcggagaggagcaccacgtggcgcacatgtggcgccgacgtggcggccacgtggacggccacgcgggcggcaggcgaacggccccgatctactgagcgatagatcggacggctgcagcggctcgcggctgggcagtgcacgggtggctcaagccggcccgggcatggcgtgcagcggcgcggcacggacatcggcggtgactggcggcgcaagacggcgagcggcggtatgcggcgacgcggcggtgcgacaaagagagagagagggagaggaagggagggaaaccgatcctcaccgaggggctcggccggcgcgggggaggagcgacggcgaacggcgacgacgagcgacgggaggacgacggcgacgggcggacgagctccgggaccacctaaggaacaaaatgggagggattagagggagaagggtggtccacggcgagcggattcgccggccaaaggcggaggcaatggtggtgctcaccggcgcgcgagaagaacggagctacggctaccatttgtgtcaaccgagcgttggacggggtagccctcgcaacggcgaagctagtggcggtggttgcgcggcgtggtaacgacgctagcggcggcggcgtgcggccggagagtggcggcggcggcggcgctaggggagagcggcgcggcggcgatagagggctcgggagagtgcggcgtcaaaaggaaaaagagagagggaggtgcggaggtacttaaataggagcgggggaggcgagtcgtggccgggaggggctcgattttgctggagttagtggggatgtgggggaggagagagagagagagaggcgggattcaaatttgaatcccggccatctcgcgggcgcgggtgtgagcgggtgtggggcgtgggcgcggggaaggcgtggcgcgtgggggagtgggcaacgtggcccggggcggcggttgaggagggaggccgcccctccggctggaggttaggggcgaacccgacaggtgggccccacctgtcggcgcccgggaggaggtggggaggccggatggacttcggggagggggaggaaaaggaatgggccggcggcccaaaaggaagaaaagagggggggaaaaggaaaaagggaaaaaggaaaataaaaggatttccagggattctttaatgcttgtgctcaattttaattggttaaaattatttccaaggctctgaaaattccactacaaatctcgttagcatattttgacatgtagaatccaagaaaaattccacatgccgattccgattattatttgcatttattaatttgaggagttagctctaggttaaattaaatcatttcttcggacgatttattttatgaattttaaagcaaggaggggaacttcagggcgtgacacaggaggagatgctgggaactacagcatcagatgttaacagttaacttgaggaatggtagacatcaagaaaggagaggcgtggatcaatcgtcaggagagtgtggggtcacccaaacaaggatgcgaggtgtcaaacttcagtgctgcaacatcctattgtctctctgtctcttgtacccacctcctcttcttcctgcgtcctgcaccatcctcctatgagttgttcagtgccgtaaaaatatatacattatcctcctgtttgtcacaatttcagatttaggttctctgtgttatagaagatctgtgtaataataataagtgtaatataatgtgtgtgcccttttttgcctattgttcttgtatactctataacctttcacccgtctcatgtagctaaaaaaagcttcattcctccacgaagttaatacacatattgacgcgttcaacacaggtgcaaactattagttgtttgataaatgattccatcgtccattatgcccaaaacatgatttatacatcatgtttcgtggttatgaacgaactgtaagcaggggcgttcctacactaaactactcgggatcaggtacccggggtcaccggaccagtagaatttccatctctaatcgttttagcctatattaactatattgatacttaaaatttaaaaattagagtattatatgtattatgatatgtaaggaacctccgataattttcattgtgagtttcgccactaactgtaagggcatagccttgacatataattgggatttagtaatatcatgttttttctctagtagtgtcatgccctctcactaaatggcgaaaccatatggtatttccaacaaaattttgcctctaaaagtagtcacattacactattggttatgagaaattttactgttagacacattatctcgaggtacctgttgtatttcccaggaaagctcaccatttctacctacgtgctggatgcacctactcatgcttctgttagctaacagccagagcaaaccaacaggtcaccgtgtaggccgccatgggcttgtggacgcggatacagcctgcatgcacgtgtaattgtggccgtattttccagctatacgcgtgagtgctttcaccagaacaagtaacaaccaacgagagcatgattatataattccatctatacatttaaattattgaagcggcagggcatggcaattgggttttagggatttttgtccccagtggtattttgatcattagaaaaagataaacagtacaaactgaggataactgacgatgatagaagttaagcaaaaagtgatggcatatattatagaacagtggcatactgttaaactagactaaagtcagtggtatgtggtatgtagtagattctctctaaaatttttgatatctctaatacaactaccatgataccttcggatgccttcttaagaatggtaagagaaaacaaaaaccccttttggttaaatgggatctcgcgacatacttgcctcctctatcaaatctggcatcataagactttagtattcaactcgctagctcaacttaatatttttctatgatcgccttagtgctctctttctctccaccagtatatataacatactctgttgcctcttctcttcagccctccgccaggcgcccttccacctcatttacaaactactgggtcatacttatcgaacaaattcacggaacgaaagggaaactttgcatagcaaaactcatgtagatgcaaacaaatattatttttctgaagcataaaaattcgtaacaactcccaggaaatctggactccaacaactattgccacaaaaaactggtatctcctgttctctccttctcttcatcccttcaaaagctcaaggtcacataagttgcaaaataaaaaggaacacaattagtaagcaacaagaccaaatgtcatgccactagtacactgtaataattgtcatgcacttgaaacaaaaatctgcactccacggaattctgttcgtaatcaaacaaataaaagaattggggtaatcaaggaggcaatatcagcctgatcatttgtttcttgcaactgaagaacaagttcacagaaatcacaaaagtcataacccatgagtattcttgtgagcatctgcctacaaaattgaatactattgatcagtacctcacatgcattgcatcaagttaagaatgtgccatgttgacacatgttttatagtggaattgctagctacaactgatgatttactgtatacatagcacatgtatacagctcaataataccgaaactgaaagtaaccccgcaggggctctaccaattttcatgccctttagcccttacaatatttctgacaaatcctctaaaagaatatgaccaataaactgcaatagtctgctaggccactacatttgtaaagttctgtacgactgtagatgtgcatctgaaaagcgtacatagctagcacaacagtctgaacttatataaattcaagacataatccgaactagtctgaccaaatatttctgaacatttcagaactaatctgaaagaaaatttctggaaatttctaaattgctagctagcacaacattgctgaacatttctaaaccaatctgaacaaatacagttttctttgatgcaggaaatccacatccagatcaactcaatggaaagcaatgcagcttagaatgcaatccagtatgttaaatctttcggcctcaaaagccaaggttcagaccaagattattcaatgattattctcattctcaatctcaggcactttctactgataatcatatgctaactgcaaatgaaagttattgattgctcaccgatgagggagaatgttggggatgcggcaaagatggactacctcgattcggcgcaggtgcattggacgagggaccctgatgcggcgatcgatgaggtgagggctacgacctacgacctcgatgcgacttgggtgctgcggacgagcgagcgaccccgatgctggaacggtgcagcggacaaacccgatatggcggtgcgaagaggccgaaggaggttgacgaggccggcagcccggcctggagcaagctccgatgcagtgcccagggaagcagcagcaggctagttggccgtggaggccttggcgggtggtggattcggagagagcgaggagatgagaggatccacgagattgcgtgatggccaattttctcctgcgctggctctattgggagtgtggaacggtgccaaaatttggctcgatttggcacctggattaggaatgcggcaaaattgggaacctgttggaggcctggtttttatcttaatttctaaatgaagttttgggactgctgttagccatctgttggagatgctctaactgccattcttcaatgcaaaatacatttcaagttcagtttcatattcttgccatttccaacttaaatcattatcataatacacgataaagccatgcatgttgtgctcgttgtgtgtttgaataccacctattacaaatgctttgtcactacatatcttccacactcacttagaacattaaactaattgatcaatcgcactacagcaccactgatcctggcagacttaataataatacctaaaatgccttaagaatggttcaaaaatgttttaaaatatcgagaagatggcactgatagttttttgagaaacataattgctgcactcaaagcgaatataagaaaaaaagaaccaaaacatcatccaaaagattcatgtcctttaaaatacccttcatgtattatgcctccaaattttaagaccttttaaacacatccaagcatggctatactaaaacacgcacacgaaaaaataactagtatgtttatttcaaaacagaacctagattcctttggagacaaaattcaaccacattacagttctcttctagtgtcaaaaaaaactcaaccagtttgctcaaatgatcatatgttcaattattttagcaagcgtgcacatactagaagtcctaaaaattatatggttttcaaggctgtgctctgtaaatcagaataggcaggtgaaaaataaccacattttattattgtattgaaacagtactgaaaaaacagtgcacttcatttggtaatcatggccgattcttttgttcagtcctcactaattcaggacttatttacatataggtatttcatagcaaacaatttaagttctgatgaaatcaggtaaaaagttgatatgttttaaagaagccttatatactgtctttgaaaagagacaaaataatgttagtgaataccaaattcaattgtattttcttcaaacatacatttgaccaaaaagataaaataattatgcgatacatcctacaataaagtacaaatggtactaatatgtaaaaagcacaacagcaaaaatcaaagaacatgtaccttgtagatgtgctccaagagcaaagttgtcacagggaagctagggtgtctttcatttcattcactgaaattactgtttcactgggatatattttggaaatcaatttgaggaaggttgcatatttgtcaagaaactccttctgtaagagcaaacaaaatatttttgttatatgcaggaattaacatccatttgcttgaacagtaccagtgactgtatgctgttcatgattaggtgtttgattcgattagacataagaaatatttaagataagaagttagagaaaggatttgtcctattaatattttagataagttgttgtatgctaatctgcttgaagttgaacaatgaattaatctaatcaactcccaacattctccatctctcaactatcaagtctcaactatattttttcccttaacaagacggcattgaatttcatttcctttgcattgtaaacagaatgcaaatagtttacccatgtagtttactatttcaagtgacatgagaacataccttgcatttatcccatagagaaggaagtaattcttcagccgtaatattcttctgtagttttctatacattgcattgattgtcttgtcaagctgttgtgaaatgaaacagggacgtgcagagacagatatgaggctgtagtaaaagaaaatttcaaaaaaaaaaaaaaacatgagaaaggggaaaaatgattatattgtttacttacaccacttaagctggacttcaacatcttacggaagtctaccttcgacattccaacttggaaaggtatctgtataataatgtaatatgaagcatccataaaaaaattaggcatcacagtatgctaatataacaaaaatcatggagaactagtcccctgttttttaaatttcaatgcataaaactatgaaaaatgtatgtaattaatggaatagaagtgtatctggccaaacaaatctaaggggcattttgcacatatgagtgttcatcctattatagatcttgaaaaaataaaaataagaaattcatatgttcatcaccatcaatatttcggtggtattatttcaacaaaagacggcttaagtatttggtcatctcatctaattatcttgaatcctctgccagaacaggtatctgcttcaaacttcaagaaatggaccatagtccgaaaaaggatcaatattgtggtgcactgtcccgaagaagataataactcaatgatatcgcctttgaaactgaaatgcacaaccaaatgtgatgggttacctcctcagggctcatgttgtacattagttcctcaattttccgagcaaactggaataatttttcgaagtgctgtaaaagaaatattttagtggtgacagaataaaataaatggcactaccaaaaatctgaaccatgaggatatacagatgacttacgatatatatgactaaattgatgtggcgtgagcaagcttgttcataagcttcactagcttggtgataatacttagcaagtgttggtacaacatttgctaaatcgtacagactgcatatcatacaacatgtaccaagttaatgtgagtagtacaggccactaggtcctcgtaagtatagcaaattctgttgggtagagttttttttcggccttcaaaaaacattcatcaaagtcgaagtttcaccctaaactacaaagtaggtaatttttcaccctaaactttaaaaaccagacaaacttcgtcccgtgatggtttttttgtggtggttttagcaatcttaagagtagcattgctattttttcctaacttgatattgcatcacatatcatatgttctgtatcatttttcctctttgcatctccctctttcaacactgtactgtgtgaggaaatgagaggaaaaaatgtggcatgtggagtcacagtcagtggccacgatagcattaaatcgtgttgccactttagacatagttcaaaccaccattaaaattagtctccaggtgaagtttgcggtattgaaagtttagggtgacatataagtgtttcatagatgagggtgaaaattagacttcactgagagttcgagggtaaaagatgaagtttacccaactctggtaaactacacctgaaacaggagaacaaagagaataagaaatagaataaacctgtgctggaaagctgcataattctccaatagtacaatgtcaacatatttaggttccacttgagcaattttctcgagggtcacaaacataatggtcacctgttcagaaaaaaaaatttaatgactaaaatagggttatgattatatttaactttcataaaaaaaaagtcacagaacactgagatctgcg

SEQ ID NO: 65766 - DNA, 1910 bp, Oryza sativa
caggtttatgcatatcttgaatttggattgtttttagatcatttttctgatgcatttcgaatactcagttctgcagaaggatagattgatgataattagttaattgctgtatatataccaagcaatacataattagccaggatatacagtagtgccagccagacaaaactgtgataaaccaatactctgaaaaggattatttgcaattgacggaaaaaagactgaatttgctacagaatctgaacgcctaaagagatagcaaatacaaatcggatgcaattcaatacgaatctgtgtggtttgtgatatactggcaagatttaatccaggaatgctgagatcatgagctagaaatttgaaggcatacaatttacaaggcttctagtcgatgatgatttactacaaatctttcaaccaccttgccttctaaatttatcaaaagggactcctgccaagatatccaaagaagttggatggaaattctgatgcaaattgatacccgagacagaagaaaacgagaaagcgtcagtatgaagccacaaactcaccatctcaagaaggttgactatatgcaggaggaaaccatctgagcttgtaaggtcatcagggctgggatttccaatatacagcattgaattgtcttgacggaagtaaccacaatgacctcccgtgctaatatatgcattctgtatcatataggaatcaattacatgctatatcatcaatgtgaagctctaagatcatcagcaaaaagtgaagggaatgggagttaccacttaccactccatattttgcaaaaatacgctgaagaggctcatacaactttgttgtttccagtgtgtgcgcctcagcacaaacaaagaatggatcatatccaacaactattttcctgtcttaaagtacactgttgttactgttacgacccattgaaaccagcatatatgcttaagaggtcctaggtgtgaagcatgatgtcaaggctaacattctaatactataaagataccacaatataaacatgatgtcgcttatgtatgctactaaacaattcatttgtatagtatatatgcatgttgggagtttgcatttccattccagaaaattttacgctaaaattttacgctgcagatccgttagaaacagcttcaacaataacacacaaaattgtataaccagtagtgaacactcaccagttactgctggttgccgctattgattgctctagccatttaatttgttccctactagaagctcttattttcccatcatgaataggttcctaaaacatatgcagttacgaacagaatcaaatttataactacagtcatattgtttatagctaaatgcccatgctttgctacgggaaaatatacattatattgcctaaaatacataaaaataaatatatttatcatgaagtgttatgatgttacccatcatttttctatagggaataatagtaaccttaatttgatcttatatatggctatacatttagatttgattgtttcttaacattaagaagttcaaagggtagtttgcaaaatttacaatgggagtaggtggggtagcagattcactgccaccaccactatcttcttttaaaggagtatagattgtgtccaagttatttacaaagttctaaacacaaataaaaacaacgctagtaaagaatattagaaaaatggaaagaactagtaggcgcgtttgcaaggaggtgttgaaatagttagtacattggacttacaatcggggatgtaaattagaggccattaagaaaagatagaataatcagttaaccactattgctcttgatgctaacataattagtgaatagtattgtttgtcagataaggctgcctagcataagaaactaaaaaatgttgagaaataaaaataatacctgtaaa

SEQ ID NO: 65767 - DNA, 11946 bp, Oryza sativa
cttcgaagacatcatcttcttcggattcaaaaacataaggatattgttaggaccaaaatttggtaagccccgaagtcatcatcggcctagagtcagtatcggtttcagagtcttggaatcgaccgatgggaattatcaagttgctagcagtcggattcttggaggattcggttaaggaaattaatctattcaaggaagcttatccataagggaccgagttcaaggaggatgcggcatggcaatttatctattaattaggcagtatttgttagtttccttttatctttaggaaagtatgtttagtgtccaataaggacattatgttttccttttatctttagaaaagtttctttcttgtccgacaaggactagtatttccccatgggtataaatatgtacacctggagtcattgtaaaatatatctctcgatcaatacaactactctcagagcatcgccaccctctttaccgaggtttttactaatcttctcatggaatttggcacctgacgcggggctgcatcggttcagtttgatctccggcgaaggggtaagtcctacgttccgctggccctggtgaatctaccggctacgttggtattgttctaggctgcaatgcttcgatctcttggatcgctctgttttggttgatatatttgcctatctgatatctcatttctatctctaattacactgtgtttagatacacatcggtttagttgggactgtctcagttaggtctgacctcctgtcttagccaatatatctcaacaatcacaatgctgatgtaaatagatttgttatatccatcacattagacaaatctgtcggctcatcgagcattagattatcatatacaatctcatgctgcatcggttaggcttaacctactagattgttgttgataatataagtcttgttaagccgattggttcatcctagtgttttatcagggtgctagctgataagttatctggacgttgcatcggcctataaggattacatacaagttgggtttagccgatcgcaacaaaggttttactgtttaatctaatcttgtggattttatgacatcagacctctagccgacgtatgctttaaccttcggatcagtccttattctattatgtcattgctagccaattggtttctactggattatattattgtcatattatatcatcatcagccgattgcctttatattgttatttagatcaagtgtcagatcctacattggacgtatagcggatagctcaaaatcgtatcgctatcggctggtatctgcatcggctggaattactccatcagcttgtcagccgatcggctgttttgtctactatttacagatcttgtcagttacagggtcaatctaattggcacgcctgcatctcaccaagatttagacctgcactggagctaagcagatctcccagggcagtgtgtgtttttcgcatcaacagatatacatgattaaccttcttgaagttctttttggcttctgcaaatctttgttcatgtagtgttaccttttgagccaagtgggccaaactctcaaaatcttgagcagagaatctctccttaattggggttgccaaaccttggaaagcaagatcggctaactgagaatctgtcaaagccaagctataacatctattcctcatgtccctaaacctctgaatataatctcgaacagatccatcatgcctctgtctaattgctgccagatcagaaagtttcatctcatgatttccactgtagaaatatttatgaaattgtttttccatatcggcccaactttgaacagaactatcaggcaatgaagaaaaccatgtgaatgccgatccagataaacacaaagggaataatctaactctcaaagcatcaatagccgatgcctcaccacactgggccaaaaatcggctgacatgctcataagtcgacacattattttgctctgagaactttgaaaaatctggaaccttgtaccgattcggcaatggaaccccctcaaaatattctggatatcggggttgatacaagttcccaatattctttggtttaagaccaaattgctccctcatcacatctgcaatcatatcagcccaaggcttctgttgaggcattccttgcatctgttgttgaatgtggtcaagctgattataccgaggcaagatgtggggctgaggtgatccccctggctgatactgtatctggggtgaataaggctgatactgaaagttcatattaccaccagcataatgttgaggagattgatgcacattatgaacttgctgatcaggaataaactgagcaccaataggctgatgttgctgtacaataggtgtttgctgcccaattggtatttgctgaatcgggtcaacaactgattgcttccccttaaacatagaagcattctattctggggatacttgaggtatattctgccccatgtgctgaggttaaggtctaaccagtacatgaggattaaaccctagctgtccttgtgctgacgttgatgcgcactgtttcccaaaagccgaagttgatgccatcggctgctccggtgctataccagaaacgggttgttgtttgccggtcactagattcctatatggaggaaacacgccatcaggaagaaaagtcggactcttagcttgatgtttggcaattgaaccatcaatcacagacttaatcatgttagttaaagtgttgacaagcacccctgactggttgataaatgcatgataaacaacataatcaatctgatcctgcaagttcttgaactcttgaggctcttcttcttccggtttttcatccttgggtttgtcatgtttgggcttgccatctttggtggtacttgattctaagtcatcattggatggcactttcaatttatacctttggataaccgtacctaaatgagtttgcacaaatgaatgtaaaaactgattctgcaagttgttcatcatctgctcatactctgccttttgttctggtgtaagttgatccattgttattgggatgatattctcagggtcaacctcagtttgcttaatgtcaaccatggtgaaagcgttacaactcgtgtccctctgggcgtgccaaaagtgtgttgatgcgaaaaacacacactggcctaggagatctgcttcactccagtgcaggtcctaaatcttgcttttgggttcaaaggcatgccagttgatttgatcctacaatcaacaagaaagaaaaccaagaaaaacaaagttaaatccataaacgatagccgttcgacaaagggccaatcacatatcgttaaccgctgagctgatgttattggcattagatcagcaatgaagagtaaaacgaaataaagtcaatgctcgatcgactgtagatatcaatgatatgtaatttccttctcaagatataattaaaccaagtgattgggatagatcgaccagctagtcgagacagtataaatcacttatgcttaaaagtactttgagatgaagattatatgtatattcatagcatagccgatcaaacatatctaacatgtatcggctaatactccgataccactctatatcaagatattaaaacaagcaaaatataccaactagtaagccgaatatactttaatgcgataagatcttaatataaagggcaggtttagcatatcaagtaaacatgtagggaataatgtagctaaatcaggtaagatcgggtaaaaccccgatactatccctatcgataatcataaaacaggttagatattgtatttatggatattaattaatagatcgaacttaaacgatgcagcattaagcacaatgataatcacaagatctaggccagttgatgaaaatctatatgagatggtagatatgttatataatctagatcaataacgatatctaactctatctgctgcctctaactctatctgctgcctccgagtaacagatgctggccgatttagggttagattataataccgatagagattatgtagcatatatgataactcaacaatttacataaccaagattagagtgtcactaatcccgagaacgcaagctgccataacaagttttttacgtcttgttgaagatcgaaaccgatgcagctcaacccgaacgcaagaactcgtcgaaacaatgaaaaaaaggatggcgatgcgccgaaagtgttattgaactgtcgtttgatgtttacatggtctcggtcatatttatacccaaagtacataatgtattcttgccggacgagaatctaaaactattacaaccattaagatgcgaacaagtctcttaggtagactcttgccgataaatatctctaaagaaagtattcaaaatatcctaattaatagatacaattgcctatccgtgagcttatctcaatcgtggcaatgcttgcgcagcacgttgatcaatcccggagatgattatataaccaccttggcgagatcggctgcatcggctgtcttctgtccgatccatcattagccgatgctatcttcagccgatgcccctgtagccgatgcatactctgttttcgagaacatctcctttgccaaatccgcttcaatcttaaccttgaatctgatacttgctctaaccaaatttggttgtcaacacacatttgttttcctttttaggaatcctaatcctattcggccaccgcccctctctcctgttcacgcgctccccgcctccccttggcccatccgagtcggtctcccctccctccccctgccgactctctcccctccggcccaacctcttttatcttcacccatatataagtcaccctacccctgtttttcctattttctttttgttggagttctagcctagctgccacctcaacatgccgccgtcgcccttgcactgtccacggctgccgtgtcacgcccagaaatttagcccgaaatttccagactattttgtgtattaaatccctgtctaggaccagctagggtacgcaaaatgacaagtaatatacagttccaaacgtaaataaagcgtaaaatacttacagaagaggcacttagtcctcacaccgaaaagaaagcagcggcagtggaaaaaaggcgatcctagtgtggcttcagctccactccacaggcaaaacttaactggggtctgagccttggtcctctaacttcgtcttcagctcaaaagcactacacttctaaaaagggggaaataatagcaaggctgagtacaaccaccgtactcagcaagccacaccaacgatgcagacgtgcaaggggaacacaaggacggtttgcggctatttgcataaaggcggttgtaaaacattttattgagcaaaacagtaaaactgttgagtgattatagtaatattaaatctccactgatcaatgctacaccacgttgaacaggcccaaccaacccacctgaactacagtgcattgggtcgatttattaagtgtgagactaatcacggtgaatctggtcgatcgcccataaccgcgggcgcggctactcgaatagttttactctggccagaggtgcacaactgtacccacaagacacaatccaccgacatgtcaccacgtcatcatgtacctatgatgaacacgtcaccacgtcgagtgattgtgacaagacccttcatataactcttccgtaaccatccacaccacgctaaggtttcacccccaccccctgccccggaggtgggcagtcccctcgtgtgccgtggtgaatccgacagctggacaaccggacaccccgcccaacccaactccatcatgccccccctcgccacctatgcctaggaaagggtctagctatacttcagatcaggcagttacccactcctgcttgtggtaagcactgtaagtcttccagggtttcccgtgaaccggtccttaattgccatgggtccgactcgcaaaactatgcacccatagcccaccattcagtcgcattttagttggataattatgaccatgaaacatggccagatgtctcaagcatgtagctcattttgatactaaaaaggtctaatactgcaattataccatcaactgagctagtggtaattaagcatggctaagcatatagttctagctaggtcacataagtaacatgatgtcacatcctgattttcgttttaggatttataaattatctaataaattattattagaatttatattaaatgttcattaatttacaagtgaagttaaatgtgggaaataaaatttcctaaatttaaagcatggatggatttaatttttattaaattctccatgattaattgcactctctgaaattttctcggatttttcagagctcaattcctaaatgatacaaagaacagttcagtaattatttgatcaataatgatctaattataattgttaagagtttttccttgtttaaaaaaatccttaaattataaattgttgtttaaaaggaattattagaaatgatcttaaaagcctaaaagagaagatctaattttaatttgttaaatctcaatataaaattgggctagataaaattttgttaaatactttgcttaattctataattcctagatttttctgggatttatttgagctaaggaagtatttttaataaatggaattgcatttaatgaataatttaaattgaaaaaggtttttaaaagtctcttttggctttgggccgaaagtcggcctaaaacctctctctttctctctctcctccccgacccaagccggcccgcatccgaggcgcgccccttcctcctttttctcagtcgctgacaggtggaccccacctgtcagtcttgtcttcctcctcgcgccgccgccggccgaaccctagccgagccgcgccgccgccgctttccaattcgctcgcccctttcccgatccggtgaaatcaatagtggggaaatgatcatctcgatctcctcttccttttctcttttggaaacatcgcctaattcggtttggaaactcgtggattcgatctcgaatcggattcatctctctctccgaaccctaacctttccttctcgccgccggtcgccgtgggccttcgtcgccgctcgctagcccctttataagcacccccgagctctcctctatccgccgccacctttgccttagcccgccgtcgcgtctagcgccgcctccgcgtagccctagccgtcgccgttgttgccgtcggttcagccgcgccgcgccgccgttgcagcagccgtcgtcggtcgccgtcgccaacatcgggttcgcgaggtcgtcgccgtccccgtccaccgcttcgctgccgccgaagaccgccggagcaccgccgtcgtcgtcgacccgaagactgtcgccgcttcttcctcatcgccgccgccgtccgttgctcttccgccgtggttttggtcaccggtgagttcgccgcgtcgccctctacccgttggtgccctccgttcgcgtcctcgcgccgtcgttcgccggcgagcatgcgttgccgagccgccgtcggtgctgacgtcatcgctgacgtcatcgtcgctgtccccgtagacccgacgtgaaccgatcgatctcggctgtccgttttggatagggtcgatctctgtcgcgtctcaaaacgactctaaaatacatcctcgaaattatgcctagaataattaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatggttttataaaaagaaaagttctaaaaagtcctttttcccccctccccctcttgggccggctcggcccatctctttccctctctctcctcttccccgcagcccattcggcctcctccccgcgcgcgcgccgctgacgggcgggcccgcccgccaccctcgctgacgggtggggcccacccgtcatccccttcctccgccgctcccgccaccccggcagcgccctagcgccggcgccggcgccgggaatcccgcccgccccgtccggcccgcgtgcaatcaagaggggggaaatattccccgggatcccctccccctttccccccatttttccctctctctctccctcggattcgtttggaaactttccccctaacctcgccggcgccattaatggcggccgggactcccgcgcccgtttcccccctcctccggccaccccttccctctcttaaccctatataaatcctccccgtgcctccctccaccgtttccgccactcgccgctctctctccccaccggaatcgagctcgcgccgtcgctctctctctccgccgtcgccgccgagctccggtccgccgccgttgttgccccggaccacctctcccctcggcgccgcctccttcggcttcgccgcatcctcgccgacctcgtccacccctccgtttcgcacgccgaccgccggagcaccgtcgaccccgtccacccgagccgcgccgccgccttcctccgctccggtcgccgttcccgtcgtcgccatcgacccggggtgagccgtggaccgccgattcgattcccccttccctcccctctctcggccgccgctccgccgtacctatggccgccgccggcgaccataggggcgcgggcgcgccgcctcccgttggctgtgccggcgtggccgccttcgggcgcgccccgcggctgccgtgtggggcccggctgtcagccgcccgcgcccttaggtgcagcagacgcgtgggacccacggcgccggccggtgcgagcccgggtgcgcccggtccaccgtgggccgtggggctgccgcgtgggccccactcccgtggacccagtccgtgcgcccctcccctcggctgacgcaataaatccattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatacggagtttattagagtaaaagccttttcttttccgttggtcgtgtagacgctgcagcttcggaagatccgctcttcgtggaggttgaagccgacgtttgggaaagcgagcaaggcaagtcacatcatctttgaacatattgaatcctagtttataaaattatgttgctttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatgataccactagtatgattttaggtagattcttcgctatttaattaggtaacattaggtggtttttcaactctatactttgggaatattcatatcacctggacactatggaatggtttgattattgtggaattggattcacacctccccctctattcaaaaccctcaaaatggttttaggctgggttcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggataaatgaaggctacacgagctgcggcccggtagtcgagatgtcatggcacagggccggtgtcctgttgctaggggctcagtcctgcctacctgtcccgggggttccggccgtaggtgggattgggtcggtactcttttctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttattggcaagccgagcaatgtacccaagttagtgttttaattcttaaaacctgcttaacaactaaaaggaggaatggttggcctgggttggcttgggacgagctgggacccaaggtcgggttgccggttcggtctgaatcatcgtaggccttgggttaaggcaggttcgtgtgggttcacggccttgataaataatattgtatagttctagaatcgtgtttacaaaatagctttgagcaactaagtgtcttttaatgctgtttactgcaaccctaaccctttatattataactcccttgtactcccttgcatttattatgcacttgtgggtgtgtcttgttgagtacggtggttgtactcagtcttgctcaatttttcccaaacccagaagaggagtttccggaagatgaagattttggtgtctagctcgtgcctgccgtcaagcgcctgtggtcgtcgccctagtcttccgctgtttctcgtttgtctttgtgtgtgctgggccttcgctgcccatgtaataaattaactatttacgcttccgcttgttgaactctgagctgtatcaacttttggtgtaccttgcctcctgggacaaggaataatgcacgcacgtaaggaacgcccgttgggttatttccggttgtgacaagttggtatcagagcccccttgaccctaggacgagccttagatcccaagccttagcaatattttcaaaactaaaaatcctgtcttaattgtgaaaaccctctagtctctctctgtcctgctgcttcatttatcgccaaaatctgacttttaaatgttgcttttctttttgtttttgtttgtagatggccggcagcatcagccgtcgtggtctggacctgactggtttcgtcttggagctgcggggcatgtgcgttgtcctggggtatccgcatggagtggactaccagggcaggccgctcccggagcaggagggtgacgatgcagagccccacgctgcttgggaggttactgcagtgatcctcactggctcacccgagaggacttcgttggcagtcaccgcgggtggagattctttctccgccgcttgccagaacgccactctcctcgccatcggcactcttcaccagcgctacccggacgagttgcagcactcgcccttccgctaccaccctcgccgcggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcgagaacaacatgaagatcctggagctgcgtcaggagaatctgcagctgaagaaggacctagacgcagtggaggcgcagctgcatcagctcaagatcgcccagggagaggtctgtcgccccaagcgtcgccgcgtctgccgcagccagaagatcaccgcccgcaagagcacctccaggcccaagcttgttcgtcagtccctggcgtggacttgcttcgttgagacccctcgtgccgagcccgcgcctgtggttcctcaggagggggaagcctccggcgttggtagcacggaggatgcgctgttgctcaccttccgtcctggcccgtcgcagcggtagacgagcagttagtaggcttgcgcgtgtgttctttctcgtttgtcctcttgttggagtcgtgtggggcatggttatgccggtgtgtggcataactgtgtcggagcctgtctttattttatttgcttaagcaacttgaactttaatgaaccaatttaatagcagtaataaattcaagaattatagtagtcgtggatggttagctttagggtaccgagctcga

SEQ ID NO: 65768 - DNA, 562 bp, Oryza sativa
agatacaagaggttgcgcgacgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcgaatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgat

SEQ ID NO: 65769 - DNA, 4831 bp, Oryza sativa
gtgtgggtccgggctttgataaataatattgtatagttctagaatcatgttacaaaatagctttgagcaattaagtgtctttaaatgcttgtttactgcaaccctaaccctttatattataactcccttgtactcccttgcatttattatgcacttgtgggtgtgtcttgttgagtacggtggttgtactcagtcttgctcaatttttcccaaacccagaagaggagtctccggaagatgaagattttggtgcctagctcgtgcctgccgtcaagcgcctgtggtcgtcgccctagtcttccgctgtttctcgtttgtctttgtgtgtgctgggccttcgctgcccatgtaataaattaactatttacgcttccgcttgttgaactctgaactgtatcaacttttggtgtaccttgcctcctgggacaaggaataatgcacgcacgtaaggaacgcccgttgggttatttccggtcgtgacaatctcggccgttcgtttccgtgagccactgccgtgcacccggtccaccgcaaaccctagccgctgacgcaataattcccttttccttttcaaaaataattcattattgcgtcataattcaattaaaatctatataagtgttttaatccgatttaatctttaaaaattcataactaattctttgtaactcagtttaatgtggttcaagttgcaaaaattatataaaataaagatgtacatattaaaattatccataaattgaattaaatttatttaattctttttaaatgggctttaaatagatttaatctcgtaaaattcataataaattcatttgaagtcagaatgaggccgttcaagtctcataattcatctaaaattatgatctacatgtttgtttactttatatgtattgtttatttgatttttattagtctttttcctcattttgcatgttagcttgtcgtttccgtcgttgcgaaggttcgcgagtgcgtcggaagtgttcaagaagattaattgaagaccgattattgcaaggcaagtcacacagatcctaaacacaattcctttgagcatgttgatcctatatttaaattctctatttatttcaactgtgcatttattttcgaatgtcaccgggtggtgtgaacttattcctttgttatggccaatttatattgattactttattccttgataccttgggttattataacttgactagttgagctttatatattggttcagctagatattagatatgattgcttagccatgcttagaaacattagcacactattgggataacttatgactcattattatttaatgatggcttaatgatagttcacgatggtcaatcgtgattggttaattaattacttgccaactaaaacctgataatggtgggttgtgagcacatggttttgagagtcgtgctcatggcaattaaggaccggttcgcgagctactgttgtgaaacattaaccgtgccaaccacaagccagcgtgggcaacggctttatcttttgtataacatgattcattgcggagcaccagactgagaagtggcggagataagcccacgggggtcgctggggagtccatgccttgttttataagggggtgattatgatccaggaatggtgcgctgtggtgagttgtgttgtgcagagggtattgtcacagcctctattcgggtactttccagtatcgcgacgcatggtagacatgatgttgaggctgtgtcttgtgggtacagtggtacacctctggccagagtaaaactatttgaatagccgtgcccgcggttatgggcgggttaagcaatgttttccgtgattagtctcacacctctcacaataattatggatgttattcctggtaataatttgcttagctcctggtttggagttagatctgtccacccgggtatggttattcaggatggttgggcctgtgcagcatgggtgtgttgctcagtgttgattaaaatttctgattaattactccactgttttacttctcttaaatgttttgctaaaggctacttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagattttattttccgctgcagttttcttcatgaagaggactaagtgcctcataagtaagtatttatcgttatagttaatttgatggatctgtatattaaattgtcagtttgtgtacctcggctgattcctggacgaggattttatgcacaaataagttcggaaattactagtgaatttccgggcgtgacacatgagctagtcgatttatcacccaaggttgacaaaggacagatatcaagtaaacatggcacaagcgagcagattggtaaaccctgatcccatgtaattagcaaaacatgcatatttatttgcaaacgggaaaacatttaaaaaataggctcaatatgctcaaggggaatgtgtgacttgccttgcttcttcactttgatcttccgaactcttttcctcgcgaccgcgatcttccgaaacgacagatactacacgctgccacgcaaaacgaggaaaaacactaataaaaaccaagcaaacagtacataaaaagtaaacaaacatgtagagctcaattttatatgaattttgcaagttgaatggctcaatttggagttcaaatgaattaaatgaatttcaagaattattaatgatttattgcacaattattaaatattttctcaaaggaaaagacaatcgctgacattagcaaggggcggccggtgccgacacgcgggaacggcagcgagcggcggctggaggcacggcggcgagcggcggagcatggggtcacgcggggagcacgagagagggcgcgaggagctcgggtaaatgggggaaacgagcgaggggaatgcggggaggagttttatagcgctcaggggcgacggggaggccgggcgagatggatttggggcggcaaccgctggcgacgtgggcgacattgtgggcgaagtggagctcgatcctggcgcgatttttgggggaaacgtcgggagagtgtagaggccgatttcactcggtttgggcgcgagggtgtgagcgggagaggcctgaatcgggggcgacgtgggcggcaacggccggccatggtggcttatgctctggagaccgaaggtagaggaagggcctgacaggtggggtcgccgggcccacctgtcggggagggagagagggaggagccccaaggggaggggttaagcagacttaggggtggaggggagccgagctgggccggcccaagagaaggaatggggcgcgctggccgcgggagagaaggaaggcttgggccgaaaaaggcccaaagagaggaaggaggattttatttgtttttctttttaattaattgattaaatgatctttgtgcttattaaaattatttctcgagctccgaaaattcacggaaaaatccggagagtgtattagggcacaaagaatattacaaaatattcttggccaatgatttttaaaggaaattttaattccctcaatatttcacttgattaaattgctttaacttttatttaactagtgagcgtgcacgtgcaaggcacgttattacataaaattgaagaaaatataattagtgtacatcattaaagaatcgtagtaggaaccaagtaaaaataatattattgtaagcgatacattggtaattcatgaactaaaccttaattgtttattcattacatgataaccaaatgcaaaaaaaagtaatatttgtttgtcattatcgatttcagttcacttccaaatcaatccctctcaggagatgaggtagtgccagcttcgctcggttctaggttgattgccctacatattaaggcaatcttcacctgatcatggaggacgatatcgtttattaggtcgtctcgaacatctggatatacatgtatataatatgatgcatttagtattatgttagtctgtacattgagcagaagaaatgaaatacgtgtatgtacctagaagaggaccgtacatcccattgtctggccagtttattttaggcattataaaaatccaaagagctaatgcaatagaggttaattgacgacaattgtaaaatgtaaaaaagatacttgtatgatgacgcactgtagaacttgtgctgaccaaaagtcgtagaatcaaaaaaaatatatataataagcaagaatcatctcttctaaaaaatctttgcatgtaattattcttcatgccatcgttacatcttatctaacattgtatcatatagctttccaaaggccattttgacctgggcttagataatagggacatactcacatacacatatgaattagctaccatgcctgatactatagttgacattgaagatagcgctgcattatccagttttcgacaagattgtaatagtcgaattagactcggttttctgagctagagaattggtccggaactcaaggaaagaagctgcaatcaaaattcattcccattttccttgactggaatttaacaatgggcacaaacacaagaatgcctatggacaataaagatataagctggaaggagataacttctgttgtctaaaccagaagctaacaatgcaaagtaccacgtatgaagttttgtatcatattttacacgagaaaactggtttcataaccgaaatcctttccttccaaa

SEQ ID NO: 65770 - DNA, 5776 bp, Oryza sativa
ggtgacactatagaatactcaagcttgacctcctcaggaaacacttggatgacgacaagaaacgaccacaagtaaccgttaaggccttggactcacacgttacatacgaggtatgcagcaacatgggtcattctgggaatgactgcccagaaactcgtgaggaggcgatgtacatgggcaacaacaacaacgggcatcatccacaaggaggtcaggggtggaaccagccacgcccagattattaggaggtaacaacaatggtaacttctctaaccaacccttcttgaaggatctcgtttctgcgcacaccaaaactactgatgctttaagcaaaaagctagctgctaatgacaagatcctagagaacataaatgcttagttagatggctttgcctccgctttccaaaaccagctgagattccataaaatgatagaaacccaactagatcagttagcttccttagtccctgcaaatgaaactaggaggattctagggcaacccgactcctccgtagaaaatgtcaaggcgatcacgacgaggggaggtaagtccactcgtgattcgccatatcctaaccctgcaggaactaatgggatagccaaagaagcgccatctaatgactcagctgacaaagaggttcagccagaaaagaccgtgccgcagatatactgcgacacacgattgctgccatttcctcaacggagtaggaaaccgttagcggatgagcagcttgctcgttttgttgaagtaatccagaagatccacatcaatgtgccattgttggatgctatgcaagtaccaacatatgcccgttatctcaaggatatactcaacaacaagagactgctcccaacaacggaagtggttaaactgacggagcaatgcaacgacgtcatactccacaagctcccggaaaagaagaaggatccaaggtgtcctacaatcacctgttcgatcagggcacatcagtttgaccgggccttgtgcgatcttggagccagtgttagcgtcatgccaaaggacgtctttgacaagctcaacttcacggtgttggcatccacaccgatgcgcctacaactggctaattcgtcagtccgttacccggcagggatagcggaggaggtgccatttaagatacgggacttcttcatcccgtttgacttcgtggtgttggatatggatacaggaaaagagacgccactcattctggggcgttcgttccttagcaccacgggagccaacattgacgtgggaacgggaagtatccttttccatattaacgggaaggaagagaagtttgagtttcaatcaagtacgggccaaacccgtagaatatacaagtggtcgaagtggagccacccaagatggatagcctggtgaaatttatgcagaactttctggagaaggaaacaacgatgcccaggaacggttattggaagacaccggtaaaaccaagtacactggccaaaaagtcagagcagtcgactcacaagaagccgtcttccgcatctaaaccaaagaaggtatggaaggaaaagctaaagatgcccactccatcacctctagagtcggctggaaaattcgtgcactaaactaaaaggaggtacagtcctgcacgtcggacttaaaatgacgtgaccttcgccaacaggtaaaatggtatgtatccgcatatttgttttcaccaatttgaatttttgcatcaacacatgtttgaatttcaaaattacatttaggatttttgaattttgaggaaattcttcaaatgaatttttcagagcaaaccaaaataaaattttcaacgaaaattcacaatgccacgaccgcgctgaccgttggaatccaacggccaaaagtggggccggttgggcataccaggggtttggctgaacccactggtgggttcggccgaaccagccaggcaacgactatttgccatttttggtagggtaacatctagtggtcccacatgtcatttttaaccgttgtgggtaccctataaaaaccagtcggccaagagagggaaatccaccccatttcagcaagctttgatagtttccctcaaattcaaatactagttgcatacatacaagtgctttgctgaaactaatcggcaggtgaaactcttgtcatttctaaaccctgccgagttaatccgttcttgctccattgtgcagaatgaggaggcgattgtctcgtctgttcaaggggtccggctcttcatcaagtcatcatgacgagtctagcactcattcatcagctgatgtctcgatggaagacgccgaagctccgcgacgactcctgaacgataccgacctcgacctcgtcggtgatcgggaaagacaagcctactacatgctgagtgactaggaatatgctcacacgcgagaatactctccagagctgctgaaaaagataggtatggatgttgaatttcgtgctatttagaaagttgtttgatggcagagatttcctgtggtagataaacctggttctcgtttgcttactttgcaaattctgtgcactttgaaagaaatagaagatggaatttattttcgcttcttccataaggagtatacacttacatggaaaggcttaagtacacttcttggttttcacgattcctgtaaaatcgatctctagaaaggaatttctgggttcgagaaaaaataggtttcgggaagatatttctggtgctccaatttgcaagaaacctaggacgaatgacattcataatcctacactttggctcatgcacaaatggattgctataactttgtttcctagaggtgatcttagacccattaggggggatgaattgattatcatgtttaccatggtttgaaagatcaaaattgctcatgtgaaatgtatgataagacaatgattagagaatataagattttcttctcctgttgactgcacttctctaattactcggatagcaaaagggctcggggttgttaacaaccaaattgcttttatgtcagccgctcgtccgtgtattgatgagacttatctagtgcaagggcatattctgaaacatggagtagatggatctttgttatactttttctccagttgtacaaatgaaatcccgttgccaaatgcgaggaatcatttgtacaactgccatgaactaaccattcccctgcagaccatagaagaatctcgtgtaggtggagcaaacagggagacgcgcaacatgacaaggaacgaacaggaaagttcaccatcctcaacacccgtgcagatgtatgaggcaggttgggaaccaactggggatgcacccggatggacccaagctccatgtcacaacatcagagtctcaagatgggcaagtgccagtgaggaccgatggcatgcgtctcatgacatacattcgggggacaaccaacctcccagatcaagtggtgtgcctccatctcgaagtgaatagcgctcgagatcctctcgttgggacttgggtgaaattactaggagaatggatacccttgatatgcagacgggggagatccagtacaacctcatggaacatgtagcacaaacgcaagaatggcaacaatctgctgatgctcagttcgccagcatcaacgacatgatgcagcaacagcatgatgaccttcaagcatagttccgcttccaggggttcaatccttatcaaggaccctgagcgaaagccaagcttggggggagacatttcttcccccactaaggtaacttgtatcacattgcatatttccctttccaaattgcatatttgctttccaattgcatcttataaactgaaaacaacataaaaatttgcaaaatagaaaataccaaaaagataggataggtttgagtcatgctaggtaagacaagctagttctctttgttgaaatgatgaatagttgctctgttttatatctcttatatatgggttcataggtaagtgctctctcaaagattaaatataagtagccaacaattatctgggaacctgaggtaaatgagctgcacttgctaatctgagtctaagttattgcaagatacgagatagtaaataagagttactatgatcctaatcctagtttgacttaaatttgaaagttcctcatttgatataaattcctaccggagccaaaaatgtactatcatggttaaaccttatacattttggttactcgccattccattgaactttgtcaaactcttgtgacttgtatagatactcctcatgcactatgatcaatatcatacacccacatatatgcacatgctaaactcctaccaagtattaacattatattaacattggacttgggagcagtatattgatacaccctggccaaggccattcacacataatgtgattattgcacatcaatgcaaggttaaggctatgctcaactccaaatcttactgtattcattaggaaaggctgctgcatggcttgtatgattgtaggttaaagcatatatttgtgtttaaagagagagacttgactcagatcgattaccaccagtacaccaaggcaaagtaatcgtgcaagacacttgctattatatgaacttaaactatcaattggactagtgctaccatctcaaggaccgactacgccaagtcatgttgttattccatcactaagagattgtgccaagcatagatggagtactcaacatcattaaatcaaaagaagacaaaaggttaactcgtttcttgctgaattgaactttactaatgatgaaaattttataatatctaaatggtgtacatttgcatttttaagttttatgtcaaaggatcatttcactgctacaacaacgaacgactgcatcgaggatgtgatgtattgcacagaagatgaagtgacacttgctcaaattgagatggttcacaacaacgagcagaccggttacgcgcagatgctccaatttccattggatgtgtgatccagccagtcgtcttcctccatgcatgatatatatgattggaaatataatcaagtctacttttatctctaacaaacggctcgtcatttcgagttcccataagagaataatgtctattttagtggatactgcacagaagctgaaagggcccagcgaacctgctcgggaatgactcatggagacccttgagctagctcacttactttgaatttcagcagtcatgtttatccccatctagtagggttgttcgtaatataaatatcccctatgttttatcatttgaaaaacttttgacgatgagaatatgcttgtttagctatgtgctaacaaattcagagagatatctacccctttgctgttgtgatttccttgtgggattacaaaagtggtgttcgatgccccctaattggtgtttctggtccctttgaggatttttccttgattggttctaggttgtgttggttggtaacttagagtgtggttgggtgaactctcaatttaggttgccataatagagacggtggtttgcttcgagtatgatcgtcaggaaccacggttatcttggctgcttgtagctagttttcttggtctatttgaggctttatcggttcttgatcctatgccgtgaagatcgggacatcactgtacacacacacatacacacacacacacacacacacacacacacacacacacacacacacatatatatatatatatatatatgtatgtatatatatatatatatatatatatgtatgtatgtatgtatgtatgtatgtatgtatgtatgttgatcagtcaataaggattgcacttcgttgtgaagggctgcaggaat

SEQ ID NO: 65771 - DNA, 1034 bp, Oryza sativa
cccaaaagaattggagagagaaacacctatttaagtacaattctacccttcaatttttttcttttttctttattgttccttatcttttctctctctcattctttctctatttctatttgctccttattcaagcgagctcgaggatggcagtgcagcgaggtgcgggccggtgcggtgccttgactagggagacccagcgcggttgtgcgcgggggatggggcctacttggtgcggcggaggtggcgctagagtaggaggggaggtggtgccgacgcggttagcgttgtcggcctaatgctagggcagctgtggctgcgaggagagcagctttggcctagcgggcacagggcaactgcgatgaggagtccttccctgtcgaggaccctccccctgttggtggtgttgcagcagccggtggtgcccatgacggcgggtgtggcctggatggtgtgcacggaggagatcgcggtagcggacgccgtggtacgtctccctgtgctacatcttcctgtggcgcaggatgtgccgcgccgatttgctgaccagcgacgacgctgccgtggctagacatgacgtgccgtaagagctcctcggcggctacctctggccggccgccggcatcgccgcatcgcgccgcgctctcctagcgccgccgcactagtgccgatgcctggccgagctcttcctccgttcggccgcgcccccatcacaccggcgctgccaccgctcgttgcgcccctccggcctaccactctttcatcgtcaccatcctaatggagattttttttttggtgtgtggtgatgcgcaggggcaatcttggtattttgaaaaaaattctcaccactttaagcaaggaaataataaaataatacgtccagtgtcctacggcaaatttcacagtttttgtagtgccttgggcagtgtcacgttttcgcggtgtcgctcagctaattacacaatttttacgtgtcctgtagcaaattttgcgtatattgaaggtccatctatttggattgatttttaatatattct

SEQ ID NO: 65772 - DNA, 1840 bp, Oryza sativa
atatatatatatatatatatatatatatatatatatatatatatatatatatatatatatatgtatatatgtatatatatatatatatgtatatatgtatatatatatatatgtatatatatatatatatatgtatatatatatgtgtatatatatgtatatatatgtatatatatgtatatatatatgtatatatgttacttcgcatttatcctaatacatttttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactagggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttaatcttagcttgtaatattatttgagttttaatataagattattttatttgtaattagatttagtatataattatttactagctagggttgtataatatacgtcacctagacttagcttatatcacgattcgtaattagacttagcacgtaaggttgtgtagggttctaatgtacgacatttacacttagcatacatgacttagattgttaaaacataaatgtctcatgacttagcatatacgcacgaaacacttagcatatacatgactattttagtcttagcatgtaatattatttgagttttaatataagattattttatttgtaattagatttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggacgggggatccactagttctagagcggccgccaccgcggtggag

SEQ ID NO: 65773 - DNA, 37689 bp, Oryza sativa
  unsure (1)..(37689): unsure at all n locations
ttttttggcttttattattatagctgccggttatttgcaggaaccgacacctatagtaccatataggtcttggttcttggggtacaaccagcacctataaaattataggtgccagttctggaatcggcaccaatgaatttgatcgtaggtgccgaccaaaaggtgtcgggcccaaaaccggcatctattaggccttaagaaccagcactaatgggtatttctgtagtagtgaacatgattcattaactagctaactactagctctgttcagtgctcccattcgccttagcaacccactctcaagaagacccccacggcctctctagccccaacaatccgaaaaatccctgttcgagtttgatctatatataccatatcaattagttctttgtggagcattcccacaaacacagagcgtgcatcaacaacaattgctcaaaatccatctcggacactcatcctgctcatccccacgcgtgagagagagagagatatagagatagagagagagagagcaagaagtgctcttgccatactcacccgcctggcccttgtgccacgtgcggtcgagtagcggggtgatcagctggacctccgcctcagcgtcagcctagtacactggccctgccagcgccaagcccgaggccaccatcgtgtggcactgaatagaggtcgatgatcaggtgtaggaggaggagatgcatgctgaagcagaagcacccactgcaactggcggcggtagggaggagaacagcggcgcagggaggaggggttgaggagaggaagcggagcaggaagaggtgtttgcagaagaccggtgaggcaacccacaagcagacgtggtgctattgccacacgtgagggcatacgcccaagggctcaccatgggtcatcgcctctgttggcgatatggcatgaggcccttcgaccaaacctgccgaaagtatgtgaccgatggggattcaagcccgagacgtcatggctagtcaaggcgaactcccccatggcgaagactatggagcaaggacggcgagaggcagggaatcccagccaagctagaggcctcctgggcgaagagcgcaaagcgaagggcatatgccgaagggggacgacttcgccgtagctaagggcccatggaccacaattatgctatgtacccatgtaaatgtccctttcataaaggcaaccatgtaaattcccctgtataaccaaagccctagtagtaagacctgtaatgggggctataaatagccccatagggccatgtaatagggggatcccaagtaaaaattctcaaattaatacactttacttcttttccaaccactgttgagtgaccacgtctttcgacgtatgcggttgtcgtttcgacaacagctggcgccgaccgtggggacctccaagcgaaaccactcagagcgaatgccaccaaaggtcgtgaaggagaaggttacaaggcgaaaggaaagcgaagccagggcggttatggccgccgaagagggagcagagccttcggcgcccatcgccgaagatggaggagcgccatctgcttccgcacctgcgccatcactaccgccatcggctcctggcccctccacacaggtgccgaacgcggctgacatggcgaaggcggctgcggtggcaagggcactccagaccaaggcagagatcctttcgacaagccagctgctggtgccccaagccgctccgtcgcagtcggcagcggccccaactgcgctctccgctgtgcaagcccaagtcaaccctgaccccgaaacacaaaccgaagccgacatggaagccatgcgacagaacatgacatgactccaagacatgcttcgccaaatgcaagaacagcagtaggcataagagacggcaaggcggtccaaggtcactttggccccaatcctccagtattggcaggctatgtcccaccccaagtctatccacaagtatcgacccagccccttccgccacaagtcgcgcaaagcaccaatgtacatcgccgggtagccatcgaccgcagcagcacatccggcccctcacgtgcaactgcaagctcaaccggtcgctgcccaagtacactctcaaccgcctggccaagtgccacaaacaatggcagaaggggcttcggctttgcaggcgcagctccaagctttccttcagcagctcagccaaccccacaacatttcaggaacagccccttcggcccacccgaaggggaatacaagtcagggtgcgcctagttggttgccgtcgaatcagccaggtctgggggcttcaccgtggagtcaaggaccgcagttcgacttcatcaatgctgctcaggcaccaaccgttcagccgcaagcatgtaacgccccgattttcgttcgggaataaaaatcaattaataatacattttctagaaattatattaaaagttaaatcaatttaatcaagtgaaattatagaggaaattaaaatttcctttaaaaaaatcttgggccgggaatattttgtaatattctttgtgccctaatgtactctccggaattttccgtgaattttcggagctcgagaaatagttttaatagcacaaagttcatttaatcaattaaaataaaaagaaaacaaacaaaattccccctctttgtctttgggccgctttcggcccaagatcttttccccctccttggcccgctcgcccctctccccttccccctccccctctcgggctctctctctccctcggcccagctcgccgctcggccctctcctccccgaagtctactttgcctccccagccggcctccctctcctctttggccgacagatgggacccatgggcccacctgtcatccccaacctcaggccggcaactgccgttgccgccatggccgccgaaaaccgcccacgtcgccgccattcccggcctcctcgagccctctctcgtgtgggaccggaagccacccctctcctccacctcctcccccgtttttccccaaaaaccggcgccagtttggcccccatgatcccacgatgcctcgccacttcgccggccgttgccgccccactcggccacgatatccccctccggggcgtataaaagtgtaccccggcctcccctcatccatttccccaactcgccgccccctcccgcgcgctctctcgagctccctacgccactctcgtgcgccgccgcacgccggcgaccatccagccgcgcgccgtcaccgcttccgtcgcccccgcactgcgccgcggccacctatagctttgcatcgtcctaccgcaccccggcatccgctccatttcccctccccgcctccgaagcaccgccgccacgcgcaccatctcttcctccaccatcgccaactccagccgcacaccaccgccaccatagccgtcgccgcttcgcgccgccaacatcgccagcttctccgccgcgcgggctagctcggccaccgctccgttttcccctttccctaccgaaaccaccatttcaccgtgcacccgaggtcgccgacatattcaccacctcttgccgccgtccccatctacctcacgccgtgccaccgcctccaccgcattcgctgcatcccaccgcccctcggccgcggctctgccgtggtcgggcgtcgtcggaacgccgttctcgtcgcctcccgtgccgaccgccgccatcctttccgccgccggtcgcctctccgtggtcgtctcgctgtcgctgccctcggtgagcactcctctccccttccctctttctccccttggccggccgcctcccgtgcttgcgcgcgccgtgccgccgccgccggtggcctcccggcccgtgtgccgccgtcactttggtcccggccgccgccgccgccagccttgtgtgcgcgctggccaggccgcgccgcccggccatccccagcagtccgatcggccttggccgatctggaccgtcgggtgcgcggccgcgtggccgatcgccaccgtggactcggtccacggtgggccgtgccgctgacgtgtggggcccgccccctttgtggacgtggtccgcgcctcaccccttgctgacgtcagcgaggtccatttcctttgtaaaaataaataataattgcgcaataaatcgagtttaattctagaagttcatttaaatggctcaaaacttctaaaattcatatctaattcattcgaactccgaattgagccattcaacttgcaaaattcatctaaaattgagctctacaggtttgtttactttttatatactgtttccttggtttttattagagtttttcgtcgttttgcgtgccagcgtgtagttcccgtcgtttcggaagatcgcgttcgcaaggataagagttcagaagatccaagtgaagaagcaaggcaagtcacacattccccttgagcatgttgatcccaatttataaatgttttaccgtttacaaagaaatatgcatgttttgctaattacatgggatccgggtattacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataattacagtattagaccttttctagtatcttgttgagctgcgtgctcgagacatctggccatgcttcatggtcgtaattatccaactaaaacgcgactgaatggtgggctgtgggtgcatggttttgttggtcgcacccatggcagttaaggaccggttcgcgggatgccctggaagaacttatcgtacttaccacaagccagcgtgggcaacgactgggcttgtaacgtagctttcctctagccgacgcaatcaggcaagggtgggcgtgatggagtttggatgggccctgcgaaggcctatgcggcttccggattcacctaggcatgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtcccatcttaataaatcgacccaatacactgtagttcaggtgggttggttgggcctgttcaacgtggtgtagcgttgatcagtggagattaaatgttactttaattactcaacagttttactgttttgctcaataaaatgttttacaaccgcctttatgcaaatagccacaaacccctccttgtatccccttgcatgtctgcatcgttggtgtggcttgctgagtacggtggttgtactcagtcttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttccgtaagtattttacgctttatttacgtttggaactgtatattacttgtcgttttgtgtaccctggctggtcctggacagggatttaatacgcaaaatagtctggaaatttgggttaaatttctggacgtgacaaagcaccaacgccaggcttcagagcaaaccaagcaccaaaccaggtcgccatgacatggccacagccaactttcgacccatccatggcggctcagcaagcatcaccaatcgaagccgggcagccgaatgccatggcccaacctcacgcgcaagccgtgatttcgcccttcaccacgctgtacccgcagcaaggtgctgtgaatagggcagggggcgaaaaggggctactgctgagtcggggaatcaagacccgtccgatcccaccccagttcaagttcccacccttcccacgctactcaggtgaaactgacccaaaggaattcctctccatttatgagtctgcgatcgaagcggctcatggcgatgaaaataccaaggcaaaggtaatacatctcgctctagactgcatcgcccgttcttgatatttcaatttgccagctaatagcatttactcatgggagcaattgcgcgatgtctttgtccttaactttcgaggcacctatgaggagccgaagacgcaacaacatctactcggcattcgccagaggccgggggagtcgataagggagtacatgcgtcacttctcgcaagcccggtgctaagtccaagacataaccgaggcgtctgtcataaacgccgctgcggccggtttactcgagggcgaactcacaaggaaaatcgccaacaatgagccacagacgcttgagcacctacttcgcatcattgatgggtacgcaaggggcgaagaggattccaagcgacggcaagcaatacaagctgagtatgataaggctttcatcactgctgcccaagcccaagcacaatcccaggttgccgaaccaccttctctcgctgttcgccaacctcagccggtgatccaaggacaatcaccaaggctaggccaagcccccatgacctggaggaagttcagaattgaccgtgcgggcaaggctgtgatggctgtcgaagaagtgcaagccctccgcaaggagttcgacgcccaacaagcaagcaatcatcagcagccggtccgcaagaaggtctgaaaagacctctactgccccttccacggacgctcttcgcacaccacggagcaatgccgaaacattaggcaacgtggcaacgcgcaagatccaaggccgcagcagggagcaactgtcgaagcaagtcgtgaagtagttcaagaacaagcacccctagccgaacagcgccaagatgcgtagcgaagagtaatccaagtgattacaagggccgacccgccaagccagttgtccaaacggcagaataagatgcagatccgaacggtccacaacatcacttcggcgggtgcaggggccccgcagtatctaaactagctaatttcttttgggccaaaagacgccgaaggagtaatgttcccgcatcaagatcctttagtgatctcagccgagatagctggcttcgagatccgacgaatcctggttgacagagggagttcggccgatgttatcttcgccgaagcatatgccaagatgggattgcccaccctagcccttaccccagcaccggcctcgctccgtggtttcggtggagaagcagttcaagttctacgccaagcacatttgctggtagccttcggaacgggcgaaaatagacgcgaagagcaagtattgttcgacgttgtcgacatcccatacaactacaatgccatattcggctgggcaaccttgaacaagtttgaaaccatttcccatcacaattatctcaaactcaagatgccgggcccagcaggagtgatcgtggtcaaggggcttcagccttcggttgcctcaaaaggcgatctggccataatcaacagagcagtgcacaatgttgaggccgaaccgcatgaccgggcgaagcacgcggcaaagcccacccctcacggtaggataatcaagatacagattgatgatgccgaccccacaaagctcgtatcgctggagggcgacatgggcaaagaagaagctgagatcatcctagaggtactcaagaagaacattgatatcttcgcctagggccttgatgaagtgggaggtgtttcgacagatctcatcatgcatcacctggcagtcaagccggatgccaagccaaggaaatagaagctacgcaagatgtccgccgatcgccaagaggcagcaaaagccgaagtccaaaaattgctcaaggctggggttattcaagagatcgaccatcctgagtggctggcaaatctagtgctggtgcggaagtcaaacggcaaatggcgcatgtgtgtcgatttcacagacctaaacaaagcatgtccgaaggacgattttcccttgccacggatcgaccagctcgtggattcaacagctggctgcgaactcatgagcttcctggatgcatattccggctatcatcagatccacatgaacccggccgacatccccaagacagccttcatcacactatttggcaccttttgtcacctcaggatgcctttcggcctgaggaatgccggagcaaccttcaccaggctggtgtgcaaggtcctttacaagcagttggggcaaaacgtggaggcttatgtcgacgatatcatcgtaaaaagccgtaaggctttcaaccacgcgtccgacttgcaggagacctttgacaacttgcacgcagcgggtatgaaactgaatcctgagaagtgcgttttcagcgttcgcgcaggcaagttgttgggcttccttctttctaaaagaggcatcgaggcgaatcccgagaaaatcgatgccattcagcaaatgaagcctccgtcgagcgtacgtgaagtacaaaagctcgcaggccgaattgtggcactcagtcgattcctctcaaaggcagccgaaagaggtttgcccttcttcaagaccctccggggcgcgggaaaattcaattggacacccgaatgccaagcagcgttcgacgagctaaagcaatacctgcaaaacccgccaactttgatcagcccagcaccaggaaacgaactgctactatacctggcagcttcgccggtgccagttagtgctgccctcgtccaagaaagagattcaggccaaaaatcaatctatttcgtctccgaagcattgcaaggagcgaagacaaggtacattgaaatggaaaagctcgcttaagccctggtgatggcttcgcgcaagcttaagcattacttccaggcacacaaagtcatagtgccatcgcagtaccctttgggcaaaatactctggggcaaagaagttactggccggcttagcaagtgggcagcagagctatcccctttcaacttgcattttgttgcccgcactgctgtcaagtcccaagtgctagctgactttgtggccgaatggacaccggcactcgcccccgagcccgaacctgtcgaacagccctgggtgatgcattccgatggttcgtcttcgcacaagggggcgagcattgcggcagtactcacttcgccaattggtgtgctgattcagtatgccgcaaggctgcagttcgacacaaccaacaacgcagcagaatatgaagccattcttctaggcctaagaaaggtgaaagcattgtggattcggctctagctaatccgaaccgactctaagctggtggcgggccatgttgacaagtcctttgaggcaaaagaagaaggaatgaagtggtttttggaggccgttcggtctatggaaaagtgcttcaccggcataacggtcgaacatttacttagaagccagaacgaggaggcagatgccttggtgaaatctgctgcttgtggtggcccacattcgcctggcatcttttttgaagtcctatatgcaccaagtgtgcccatggacagcttggaggtcatgacaattgaccaggtgaaattaggcaaagacccatacgactggcgaaccccgtttgtgaaacatcttgaaactggttggcttctggaagacgaagcagaagcaaagcgcttgcaactcagagccacgaagtataagatggtctcgggccagctctatcgctccggggtacttcaacccttgcttcgctgcatccctttcgccgaaggggaggaaatggcgagggagatacaccaggggctatgtggcgtgcaccaagccgcaagaacagttgcctccaaagtgtttagacaaggagtttactggcccactgtgttgaaagtctgtgttgagcaagtcaagaagtgcgaaagttgctagcgtcatggccgaagccaaaccgcacccagtatgagttgcagcccatcgcatcaatctggaccttcgctagatggggactggacatcattgggccgttcctggtggcacgaaacgggtacaagttcgcaattgtggccgtcgaatacttctctcgatggattgaggccgaacccctcggagcgatcacttcggcagcagtatagaagtttgtatggaaaaacattgtttgccgtttcggagtgccaaaagagttcatcactgacaacggcaagcagttcgactctgacaagttcagagaaatgtgcgaagggcttaacctggaaatcaggtttgcgtcggtcgcgcacccgcagtcaaatagggtggccgaacgcacaaatggtaagatcctagaagcactaaagaaaaggcttgagggggcagtgaagggcaaatggccagaggaaatgctatctgttctatgggccctttggacgacccccacaagaccaaccatgttcagcccattcattcttctttatggcgatgaggcaatgaccccgacaaagttatgggctaactcaccaagggtgacattctctgggggcgaagaggggcgcgagttatcgctcgaactcttggagggggtaagagtcgaagcactcgagcacatgcgcaagtatgccacagtcacttcggcaacttacaacaaaaaagttcgaccgacggagctgttgcctggtcatcttgtcctaaggaagaaggtgaacccgatagccgttggcaagcttgaatcgaattgggtaggaccgtacctcatcaaacacaagtccaggacggggtcctttcgactagcgacagtggaaggtgtcacgcccggaatttctatccaaaattccaaacgcttacatgtgtgtaaaccctcgtccaggaatcagccgaggcacacaataacaaattgataatagagtaccattattactctaattaataagcgaataaaatgtcattacagaggtggatagttcctctcaatcaataaagatctaagcagcggaaaataaaataaacggcgcagacgactccactccacaggcaacttgaccagcgctacacctaatcctccacaccatcagcatcattgtagaactcttcctctgatgaatgattgcaaggtgagtatatgacatactcagcaagtcacgcagcaaatatgcaagtgcacaaggataccaaagaatggcatagtatagggctcatttgcaaaagcagcctttagcaaatatttgagaattataaaacagttaagtgataattaaacaatattaatccaacgctatacaacataccctgttgcataggcccaaccattctggacaaccatacccggctgtacagatctatctccaaaccaggaatattccattccaaaccaggagctaaacaaattattaccaattaaagcatcatttactatggtgagaagtgtgagactaatcacgaaagacattgttagacccgcccataaccgcgggcacggctattcgaatagttttactctgatcagaggcgtaccactgtacccacaagacacagccccacatcatgtcaccatgtgcctcaataccaccacggtacctcggaaaggagctgtgacaataccccttgcctaacacaatccaccacagcgcaccatttctggatcataatcacccccttataaacaaggcatggactccccagcgacccccccgtgggcttatctccgccacttctcagtctggtgctccgcaatgaaccatgctatacaaaagataaagccgttgcccacgctggcttgtggttggcacgattaatgtttcacaaccgaaactcgtgaaccggtccttaattgccatgagcacgaccttcaaaaccatgtgctcacaacccaccattgacaagttttaattatcaattaattatcataacacgattaaccatcgtgagctaccattaaatataaccataaataataatatagtatgattcatcccattagtgagctaatgtttctaagcatggctaagcaattatatatatagcatttagctgaaccaaaccaatatataaggttctagctaatcaaattataacccacaggaaaataaagtcatcttcggccattaattaattgggaaaggctcaccacccgatgacattcgaaaataatgcataagttgaaataaaacaatagctttaaacaggttcaacatgctcaaagggttgtttgggatctgtgtgacttgccttgctggccttggaactcttcaaattcttctcctgcgaaaacggactctccggaaacgtcggaatctaaacagaaaagagcaaaaataccaaaacagcacataaacaagcatgaacagtacatgtagatatttttaacatgtagatctcaattttagaaaaatttagagacttgaaccaactaaatccgagctaagatgaattagttatgaatttttgaagatttaatctattagaaaaacaggaaaaagaaaaacgatgatgacgtcatgatgacctaatcaatggccggaccaagatggcgacctcgccggagattggatggtcggctgcgactttagaggacatgtacacgtagaggacgacgagacgaacccaacggtactcaccctcgaaccaaacgacgaacgacgacggccggcgacgaggtctagcggcggcgcggcttcggtcgacggtggcgacggggctccggcgatcggcggcttcgggggtcaggcggccgggcttctctaccctcccgcgcaccttacggcggtgacggcgaccggcggcgacggcagaggcggcggcacgacgcggatggagctcggccggcgacgacggcggggtggagcacgtggcggcggcgctacgaggcacgggagaccacgggatagggggcaaacgaaagaggaggactagggggtcctatttatagccttggattgaagagataggactcctcccgcaagaaatcgatccgggaaatcaaaaactcggttttggagataaactcgaaaacgagttcgatccggataagatactcaacgattaactccgatttttgggggtaaagatagaggaggataagaggaatatttcccctcaactaattttagaaaaacacaagagaaaaggccggatttggtggaggaagcggcggctgcacaggtacaggacggcagctcgggcttctgtccaagcttgaagatgaacagtacatggggatgcaaattagactttctgctgggcttctacttccaaggactgattaaaggagggacaaaaagcagactttgggaaagagagggaaagggctgtaggctaagaggagattgggccgagaatgagaggacttttcctaattcggcccgaaaaggaaaaggtgaattttaattacttttccaattaaattaatcactgaaatgatctttgaattgttaaaaataattctattgctcaaataattccaagaaaaatcttgaacatacttggacactcaaagtatttaatgaaattttatctggccctattttatattggaatttattaattaaaattagatcttctcttctaggcttttaaaatcatttctaaaaattccaattaaacaacaatttatatatttaggatttttagggtgtgacagaaggcgaagagttcgaccattcctagaacgctgcctctctcaagcgttttatgtctagaacgagtggcacccaaatcgccaacttgtaaaaatgtatatatcactatgtaaacccttcggcactatgtaagcctttcggcaagaaaaaaagaagaaaaaaagaggaaaatgaaaaaagacaaaaaactggatgtagggctattatccaccacggaagcccgaaccagtataaaatctctgtgtcctccgccttctttttgtttgtctatgtgactgataatttgtggaaaaaaacccaaggcaaacgcctgatcagcgaaaaaggccagggggcgaaacgaatcggcggaagcatcgctcaccgaacgttgaaaccgcaacagcttatttcggggaacaactagccgaacaccgttacactcgatcaaaaggaaagcacgagtgcttcctacaacgtagaacaaaactgatcgaaaacggaagccgaaagctgaaaagtcaaaacctatttcgctaatatacgcaaaggggccgacacgtttcgacccaatgaaagcacgtgaggtgacaatgcaaaaatagcgaaaaggaaataaaacacacctttattgattttaaataaaaatgtatcaaagaatacaaacccgacaaacatggtacaagtgaaaagaaaagagcaatggcactacagcccagcttacagataaattacattttcacccccgggatcaatatctctctctaaggaaaggtcaggcgaactaggttcgtcatcactactaatatcatacacgaccctaagaggagaaggaggcgaaatacggactagactgtaacgacgctgggagattaactcatgccgatcagtcttctgatggtttcgccaaaagcgaaccatatcctctagtcgtcttgtatgaacaaggtcctagtcttctaaggttcgcccggggtgcgcccacatccagccggcgaccttaaacaccttatagctgcggtcgtttatcaccatttcatgataaacatgccgaaatggacatcgcaccttcggcaaacccttcaacgccatgaacttctcgttgctgtttcgccaattttcagcgggaggtcgaacgcaaacctttcggccgcacgcctgctagcaaagtgccaaaaaaggagaaatacaagaaagaggaggggacgaagatcagccccgatttcaaacagaacaattaaataagcgaaagggttatactttgccagtagaacagagactatattaaatacaaggcgaatgcggcttaaagtcgaacagacaaaaagtctatatacaaaaacataggctactagaaggtcagaaaggattaaggaaaaaataaaaataataaaaagacacgagggcgaagggcctcacacctcagggtggtcttggcctccgtcaccttcgcccttgtgcccagtggaccgttccgacggcccgggatccttttcgaagttggcggcagcagcctcctcattcctcgcgatcctttcaaggttctcgcggagtcgaatctttgcacaatcccggccgccatcctcccaaaaccccttccgaaaggcccttaatgcagctccagagcactatgtgttgctaggccattcttccttcacgaaatcgggaaaattcccgatgtggtcgtagctgtgcgtgtgcaaaaggctgagaacgaaccccgccgaaacacgagcgcaacagtcctcgtaggcgcctgccacttcgacaaccaagccggccgcgtcctgcgtccattcggagaaatcgagtgcagtcccgccttcgcccggagcactttccgcccgcgccccaaggtcgttaagggccagccggagagtgtaataggcctccttggcagactctgaggctggtaccagggtcgcggcagtagcatcggtgacgcaagacgggcttcgagggatttaatcttctcctcggccgaagcaagttgttggtctcattcggtgtcccgcttgcgtgctgcttcaaggtcagagcggagagacctgttttcagcattcgccttcttcaaagtctccgccaccacgcgtctttcgtcttccttgtggcgaatatcttcttcggatttacaaagataaaggcggtacccatctagtcgctctaaggcggacttcttggcacttaggtgcacggcaaggccctggtaaaaaaagacatacattacgttagagaactagcgaaagaggaaaattcagcacacaaaaataaaagtcatacccgcacaaataggctctccacagccgcgcagctttcgccgaactcgttcagttcggtgaagagcccaaggccttcggtcggtgctatgacctggcacaccccgtccactcgttcagcggggacgaaatgtggggcggtaagcgtcactgtcacgtcccaaaacgactctaaaatacatcctctaaattatgcctagcataattaaaatccgtgtgaaagcctccaacaattaaaatgtgcaaagttaaaagtcaaataaggcttggaggatttttgtatatttcctaaaagcctaaaatgcgtaaataaattttagtagaattttcagagcacaaataataattattaagaaataaacaaagttaaaatggttttataaaaagaaaagctctaaaaagtcccctttccctccctctccctcttgggccggctcggcccatctccctccccctccctctcctttccccgcagcccatccggccttcccccgcgcgcgcgccgctgacgggtggggcccacccgtcatccccttcctcccgccgctcccgccgcctcgcccgcgccctagcgtcgccgtcgccgcgaatcccgccgcctcccgccgtccccgcgtgcaatcaataggggggaattattccccgtgattccctctccctttccccccacttttccctctctctttcgtgttcaaacgggcggatttgcccccgcaaatctcgccggcgccattgatggcggccggacctcccgcgcctattcctcccccgccggccgccctctcccccttccaaccctatataaacgctccccgcgcctcctccgtccgtttccgcctctcgccgcccttctcctncgacggattcaagctcgcgccgtcgctctctctctccgccgtcgccgtcgagctccggtctgccgtcgtcgtcaccccggaccatctcccaccccggcgtcgcctccttcggcttcgccacatcctcggcgacctcgtccacccctccgtttcgctcgccgaccgccggaaagccgccgtccccgtcgacccgagccgcgccgccgccttcctccgctccggctacctttccgtcgtcgccgtcgaccaagggtgagccgtggaccgccgcttcttttcccccttcccttcccctctctcggccgccgctccgccgtgcctatggccaccgccggcgaccataggggcgcgggcgcgccgcctcccgccggctgtgccggcgtggccgccttcgggcgcaccgtgcggctgccgcgtggggcgcggctgtcagccgcccgcgcccttgggtgcggctgacgcgtgggacccacggcgccggccggtgtgagcccgggtgcgcccggtccatcgtggaccgtgaggctgccgcgtgggccccactcccgtggacccggtccgcgcgcccctctcctcggctgacgcaataaacctttttttaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttcagcttgttatatggagtttattagaataaaagccttttcttttccgttggttgtgtagacgctgcagcttcggaagatccgctcttcgtggaagttgaagccgacgtttgggaaagcgagtaaggcaagtcacatcatccttgaacatattgaatcccagtttataaaattattttgatttaaattattgcattatcgctttacttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggatattcatatcacctggacactatggaatggtttgattattgtggaattggattcacacctccccctctattcaaaaccctcaaaatggttttaggctgggctcggagtgcatggttttgatagtagcacctcagccatataaggaccggtcttcgggcctctgttgcaaagcactaccgtacttccacatgtctagtgggtaaggcttagtttgtggctcagtctggttataaacaaaagtacacggatggagatggacgaagtcaggggtcgatggacatctctaggacaaatgaaggctacacgagctgcggcccggtagtcgagatgtcatggcacagggccggtgtcctgctgctaggggctcagtcttgcctacctgtcccgggggtcccggccgtaggtggggttgggtcggtactcttgtctatggctaggatgggttggaaattatgtcacgtcttccgtccgtataccgtggtggtatgtggcctgtggttacacgtgaggaagatgtgtcttgtgggtaaagttgtacacctctgatcagagtattatctattcgaatagccacgccctcggttatgggcaagccgagcaatgtacccaagttagtgttttaattcttaaaccctgcttaacaactaaaatgtggaatggttggcctgggttggcttgggacgagctaggacctagggtcgggttgccagttcggtctgaatcatcgtaggccttgggttaaggcaggttcatgtgggttcacggccttgtttaataatattgtatagctctggaatcgtgtttacaaaatagctttgagcaactaagtgtcttttaatgctgtttactgcaaaacctaaccctttatatcttaacccccttgtactcccttgcatttatcctgcacttgtgggtgtgtcttgttgagtacggtggttgtactcagtcttgctcaatttttcccaaacccagaagaggagcccttagaagatgaaggctttggtgtctagctcttgcctgccgtcaagcgcctgtggtcgtcgccctagtcttccgttgtttctcgtttgtctttgtgtgtgctgggccttcgctgcccatgtaataaattaactatttacgcttccgcttgataaactctgaaatgtatcaacttttggtgtaccttgcctcctgggacaaggaataatacacgcacgtaaggaacgcccgttgggttaattccggtcgtgacagtcacgtccgaaacgctcgcttcaactgccggggccttccactcctgttgacgaataggtgaggggaccgcatcaacccattcgtcttcagcaacgttggccccagcgtccggggctgaggcactcctgcccgtcgccgcttcggcatcgctagcgggtggcagagacatgcgcctgccacgggaagttgcgcgccgcaacaccggcgatgtagtagtcccgtcggatccttcgctgtcggaaaagccatggccgacctgcacaaccttccctttcttctttttccttttaacagtcatcaccggttttcgcggctgtgctggagatcaccaagagggtgttcgccacgacgatatcttgcggtcgcgtaagtgaaacatgagatcttgccccagatttcgcaggggtagggctgggggtataaccatgagagccatcctcctcagaaccggcctccgcattcttctcttcttcctcctccccatcactttcgacggcggccttgcgctacggcgagttcggacttggccgcctttcgcgaccgcacgcttgcgctttttcgaagtgccagcctcgtcatcaccggcccgagaggggttcgatcggcttggcaattcgccggtatagacatggttcattcggccgtcggcttggcgctggagcaagcgggcgaactcggccgtggttagagctccgatcatcttcaacgcctcaatctcagcgtcttccaaagtccgcactgtgaaaagagaagaacacaaccgtttagcctaaaaagcgcttccatgaaggaagtacgcggcctaaataaaaaaaaaaccttactttcggccccggcggggagaacaaggcggggaagcccaagaacttcttcgccctcgttcacggaaacgtcccacacacgggcgagaggggaaatccgaaggagacaaaactccttgcagagatcccgggtgcttagccgccgggcaaccttgcgaaggagaatgagccgggactcgacagtcccgttgatctccacgtttggcttcgcgttgatggagacagcaaaacgctcaaaaagcagcctgttcgcctgagcatctttggcagagtaggggttgctgatatagaaccatttctgcatccagttcctgtcccatttcgccatcgaagcaagcactggccaagcatctgaacgctccggccgcagcatgaagttcacgcagctgaaaattgttttcctcggacccgccggcgtctgcacgtctttggttgaggcacatgcagtaaacagagcggcgaatagctcggcggtaggggcgaacccacaggtccgacacatccaagcgaaaagcgccagcttcgggaacgccaacgggctaagctggggaagcctaacctcatacatcgaaagcaccgaaggcaagaagttgtcgcatgggaggcgaagcccagtagcgaagtatgcggcgaagacaaccgttcgcccatccctaggcaagggaacaacggcctcgcccccgcacgatccttggccctctgtgagagaactggataataccagttcgccaaagtcggcctctttgacaagtgacttgccaaggaagcacgaccatccttcgccaaggctcctaggatcttcaccagttgacccggccttggtaggcttgcggggagccattgggctcgtagaacaggaaagagaggtaaaaagccgaaaggctaggagcacgacgatggcgaaaaagataaaaaataggagagcgaagagagcacggagcgtgtcaagtggtaaaacggggagagcacggggagagtgaaaaatggcaggccggtttgggggtatatataaccccgtagcgagaccgttcgcctgccaaccaattgtcataccttaaaaattcaaaatatataaattgttgtttaaatggaatttttagattttattttaaaagccttgaagagaagatctaatttttaattaataaattccaatataaaatggggccaaataaaatttcattaaatactttgcttaattctataattcctagatttttctgggatttatttgagctaaggaagtattttttaataaatggaattgcatttaagaaataatttaaattgaaaaaggttttaaaaagtcttcttttggctttgggccgaaagtcggcccaaaacctctcttctctctctcctcggcccagccggcccagtccgcagccgcagccgcccgcgcgagcgcgctgtcgctgacaggtggggcccacctgtcaggcccgtcgtcttcctccgcccgaaaccctagcgcgccgccgccgccgtttccttccaaatccggccgctcctttccatttccggccgaattgatagaggggaaatgatcctcgggatctcctctaccttttctcttttggaaacatcggctaatttgttttggaagttcgtggaatcgagttcgattcggatcggtctctttcctccgaaccccgaagtttccttctcgtcgccggtcgccgtgggccttcgccgccgcctcttagcccctttaaaagcttccccggtttctcctctacccgccgccaccctcgccttcgcctctcgtcgtcgaaaacgccctagcgccgtgtgccgtgcgctgccgccgttccagtcatcgtcgtcgctcgggaagatcaccgtcgtgatcgccaagtcgccgccgtcctcgtccgctccttcgccgtcgccgaagatcaccggagcaccgccgtcaccgtcgacctgaagaccgccgccgtttcttcctcgtcgtcgtcgccgtccgttggtcttccgccgtcgttttggtcaccggtgagttcgccgcgtcgctttacccgttggtgtcctccgttcgtgccgaagcgccgccgttcgccggcgacgtgcgccgtccgagccgtccgagccgccgagccgccgccgccggtggtgacgtcatcgccgacgtcatcggggccgttcgctgtgagccggtcgtggaccgatcgatctcggccgtccgttttggatcaaatcgatctcggccgtccgttcgcgtgaaccgtcgcccgtgcgcccggtccaccgaaaccctagcccgctgacgcaataaatccttttttccttttcaaaaataattcattattgcatcataattcaattaaaatcaatttaagtgttttaatccagtttaatctttaaaaattcataactaattcatcttagctcggatttagttcgttcaagtctctaaatttttctaaaattgagatctacatattaaaaatatccacatgtacttttcatgcttgtttatgtgctgttttggtgattttgctcttttctgcttagattccgtcgtttccggagagtccgttttcgccggagaagagtttgaagagttccaagaccagcaaggcaagtcacacagatcccaaacaaccctttgaacatgttgatcccatttaaagctatggtttctattcaactattgcatttattttcgaatgtcattgggtggaattaacctattgtttgttatagccctttttgatcttgattactttgttccttgataccttgggttattataacttgactagttgggctgtgtatactggttcaactagatattaggtataattgcttagccctgcttagaaacattagcacactattgggataacttatgactcactattatctaatgatggcttaatgatagttcacgatggtcaatcgtgattgattaattaattaatgtgccaactaaaacctgataatggtgggttgtgagcacatggttttgatggtcgtgctcatgacaattaaggaccagttcacgagtttcggttgtgaaatattaaccgtgccaaccacaagccagcgtgggcaacggctttatcttttgtatagcatggttcattgcggagcaccagactgagaagtggcagagataagcccacgggggtcgctggggagtccatgccttgtttataagggggtgattatgatccaggaaaggtgcgctgtaatggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttaagggcgggtctaacaaagtctttcgtgattagtctcacccttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgtttaatacttaactgttttattaaattctcaaatgtttgttaaatgctgcttttgcaaatgcaaccctactatgccatcctttgttattctgtgcacttgcatatttgctgcgtgacttgctgagtatgtcatatactcaccttgcaatcattcatcagaggaagagttctacaatgaggctgatggtgtggaggattaggtgtagccttggtcaagctgcctgtggagtggagccgtctgcgccgtttatcttatttttccgctgcttagatctttattgtttgagaggaactatctacctctgtaatgacattatattcgcttattaattagagtaataatggtactctattatcgatttattattgtgtgcctcggctgattcctggacgagggtttacacacatgtaagcgtttggaattttggatagaaattccgggcgtgacaccaatcgagctctgacacgtgtcaaagggcagacgaaacggtaaattcccatcggaacggtgctgaacagtaaaaagcccgattacggagaaggaaaagcccatagggcccattactattcatagtaataaaagagactaaataaccccccttcgacgttttgcaacgaatgcgaagacgagatttctctcaaagaaattttttctaagcatagaaacaaacaaactttacttgcaggaatgatattggtttcggcaggagcaccggtcgaaagggggcgccacataccataccacatagtttgcacggtctcggctgaagctcctatctcaccattgcccctgaggggcttgttggcgatatggcatgaggcccttcgaccaaacctgccgaaagcatgcgactgatggggattcaatcctgagacgtcatggctagtcaaggtgaaacccccccctcccatggcgaagactatggagcaaggacggcaagaggcagggaatcgcagccaaactagaggcctcctgggcgaagggcgcaaggcaaagggcatatgccgaagggggacgacttcgccgtagcaggttcggccccgggagggccgaagaagctatcctggcccatcaagcctaggggtcaattgggtcgacaataacccgtcggcctgctaagggcccatggaccgcaattacgctatgtacccatgtaaatgtccctttcacaagggcaaccatgtaaattcccctgtataaccaaagccctagtagtaagacctgtaatgggggctataaatagccgcatagggccatgtaatagggggatcccaagtaaaaattctcaaattaatacactttacttcttttccaaccactgttgagtgaccacgtctttcgacgtatgcggttgtcgtttcgacaacagcctcctcacccggttttgcttatttctatagaacagaggtgttggcgactatgaacgccaaatttacgctgtcaatatctacataaatctaaaaagataaaacatccaacatagtgatagggtttaactctaatgatgtccactagcgttggtgtatatttggatgcaggtaacaaatcatcaaagttgagacaaaagatatataaagacagaggagaattaaacatccatggatgcttaggatctccatattcctaaggcatctctaggcctttaaataccgctcctcttcctcattcacaacacactaagcatgagctgaattacaagaggcactattgcgctttattataaactagattagggagcgagtaaggtagaagaactcagaggaattccggagttgtcagtaatcttctcttactttatgtaccttgttaattactctaatttaatagaaatattcttttgagtaatcaagatttactttgtgagaattatatcttagctagttcctattagcatattggattaccgtcactagtaatagtgttactttagtgtctagctaacattacagtagtacttgacattgtagatgtggtgtctatagtatttgagtacctgtagttgctgcgtatcccaaagttcgttagaggttggtgcagaggtagtgatagccctcaagagcaccgcaatcctccctgttcaagtacgaagtagagcgcgttctggtagcaatgagcaagtcagtgcctgaagtagtgctataggattaaacaagctttctgtagacacagtttctcactaggaaatcctctctatcatttgcctatcattgctttgtgtccttggatgaacctggagaatagctcagcacacacgttcctcatggaaatcgataccttggaatactcccgggtgaagtactacatcggtatattcgtgagcctgcggattctatctgtaacattaagaaataccaacaagcatttctggcgccgttgccggggaacggttgttgtttatctccgaaccttgttcatcctcgtatctttttagttttcttttttctacctctacccctgctacccctagagaagttttcctataaacaacttctttaccttggagcaacaacctatctttagattgtctgctcccacgggcgaattctataagccgcctccgtcttaggaaccaattccatccaccagctatttattccgccttggcttaatagccataggttaggaacgatccctgtcggacattctcgagcgtgagtcattcgagaaggtgatgttaggtatctctgttcgtttcatctaaaccttttttccatcttcctgaaaccaaacggccttcatcgccctcgatcgagcctaagccttgtcactctggccatcggaatgttgttcttattaatcatcaagaaacaacccgaatcttgcacaatacatctcttggaaaggagaaccttcaggtcacggacaagcttgagacatcgactcttgaggatgaaacaaaacattccacaaatgagtatgaaaatttctttcaaaattcccaaagattcacgctcgcataaggaatcctcagagtcctgtttgattagtaccgcttatctgtgcgaggaccacatccaccttacagtcctcatttctaacatgtttagatgggtggttgttgatatttctcaacgttacagatagaatccacaagcgcatggaagataccgatgtagcacttcacccgggagtattccaaggtatcgatttccacaagaaacgtgtgtgtcagctcttcaccgagttcatcgaaggacacgaagctaagataggctaagggtatagaggatttactagtaagagacagtgtctacaaaaagctcaatttaatcctaatgcaatactttaggtgctagctagcccgctgctactagatatggctctacaacatacccggacagggaggactttagtgttttgagggctatcaccagctctacacccacctcaaacctactgtggttatacgaagcaaacaccggaaattaactacccagacaccatgtctatgcagcttaataactactttagtgttagctaaatactaaagcaaccactatattttactgtattatagtgatcagtgatcccgtatgttgattaggaacgaactaagaggtaactctcacaaaataaatcttaattactccaaatgatatttcaattaaaatagagtaattaacatagtaaaagaaaaaagaagaggattaccgacaactccggaattcttccgacatcctttactctactctctccctaattctagtgtacaataaagtacaatagagtctcttataattcagctcaagcttggagtgtatgttgaagtgaaggaagtgaagcctttatataagtaggtaatgacggttaaaaaggtcggtaatacactccaaccgtcattggggataaatctccaccgtcctccaaaagccctggatccaactgcgagcaacaaggttcggccgaacctaggctaggccaggcagcctccagccttagcgatgggcctattctctgataattcgatgaagttcaaggcccactcttggatagataaaagtattccttcactgaagtctggttttcatcccaactttgatggtttattacctgcatccaaatatacaccaacacttatggaatatgttagaattaaaccctaccactatgttggatgtgtcagttatgatgtgttatgaatgtattcgcagcatagaattggcatttaacggccgccaacagtggttgtgaatgcttatgtttatcctaaatactacaaaatctcgtttttattcgtggcactaatcttgcagcatgatgtctccgtggtcaagcttgtgaccataaacaaagcgctgccgggagatagcccggattaccgtggtaagtttcctttcgaatagaagcaagacccagttcttaggatagtacgcacctttgggtattcttggttcctaactatttcaggttgagattaagatagagggccatgcgatgcctaagaacacggtagctacatcaactgtacactttgatgttccttggtattagaacacactctatagaagacttcgacatcatgcacttgatttttgatgtcttgcgacacaaaagtctaagtgtgggggtgttggctgctgttaaatgccaattctatgccgccaatacctacataaaacataattaataatacatccaacatattggtagggtttaattctaacgtatttcatgagtgttggtgtatatttggatccagttaatcaaccgttaaagttgggatgaaatccagtctaaagtgaaggaagaattctatccatacaagagtgggccttaaactttatcgaaacatcaaaaaatggatccaactacctgagaaatggataaggcaggctgagggagagacacaggccatgttctacgccttttggaccaagccagggttcgaccgaaccccagtttctgccattcgagctagggtttggcatggatgctccagatgctctccggatggcggttgcggggcattttcgacaattcgcatagcagtaaccgtcatacctgtctataaaaggagttcatcacttcacttgtcacacacactccaagcttgagctgaattataagaggctctattgtactttatttaatactagaattaggtagagagtagagtagaagaagtcggaggaattccagagttgtcagtaatcctcttctatttcttatactttgttcattactccgtattaatagaaatatcattctaagtaattaagatttgctcggtgagatttaattcttggttagttcctaagtagcgtgcgggatcattgtttgctaaagtagttattaattgtgtagacgcggtgtctgggtaattaatttctggtggtagcttcatatcccacagtaggtttgaggtgggtgtagaggtggtgacagccctcaaatacattaaagtcctccatgtccaggtacacagtagagcgacatctgggagcagcgggctggccaatgcctgaagtatcacgttaggattaaactgagcttttcatagacactgtttctcactacgaaatcctctctaccctttgcctacttttggttcgtgtccttggatgaacttgaagaggagctgaacacacacgttccctaaggaaatcgataccttggaatactcccagttgaagtgctacatcggtattatccgtgcgcttgcggtatctgtgatgttcataaataccaacagggggaaggccaacgagcttggcatgacgagttccatcaaccaaggccatcttggtttcaagttggtgttagtcttaccatgctaaaataaaaagaaaaaaaagagagatggaagaaaagaataaaaaggatgagagaagaagaaaagagcaagagacctgacgagctacatttagatcaaagaccgcattatgtgagtgcctttaaaatatggctatacacctgactagtagtgatcatgctacctggcttcacccaacccctctcttgagctcatgtgccgctttggtttagccttcatctactcctacccgtgcacaacttcttgctcccgtagcaccaatactgcaggaggagatgccctcttcttttctggtgtttgctgctccactccagttggcacttgcacattgcctaaaaagataagcatgctatatctctacagtattgtgccaacggttcgtgccttcaaggcacaaggttcttgcacctgaggtgcgtggataaccaaactgctcgcctaagttggcatggtcatgtgccttcctccgctacaatccgcatcaagatggaggagagatccataatcatatgtgaccatgtcactgcccgagagattccaatatatccatcatgctggcaggtaagtacactcaagtatacaaagataaaacaaggttcgccaaacctttactcaatagtacaaccatgtgaatatctcttgatcatacatggttatgcttcctttgtctattttcgtatgctctggtttgagtgtgctacaggcattcataggcttttcaagttaaccatgatgcttaggttaaatagtccgccttaatcaattttgacgtggtgtcaatgcaccgtagagcgggtacttttatggacttcggatgtatgtccttcgtggactaacccctatagaaaatttttcaaattgacgggtcagtgctcaagttcaagtcacactagaggtaggtcagggtcgggaacaaatcaattgctaaggagaaacctatcacctctcaaggtgaacgggaataaagtgacaactaaggagcagtgtacaataactccaacaccaataccacgcttcttggtcttataggaaaatagatgctcagggaaccaagcagaacaaatgcaaaactttgttgcattaacccttgcatttggttcaaagcttgataagacctatcaggtaagaaccccaaacactttatgcatcctctatctctacccttctaagttacccataacctccattgttgccatgagataaaaaggcaaaataaaatgaaataaaagtaaatttaggcacttcttgtgcgtagagttacttaataaaataaaggcgtgcctgtgtttcaccccggtggaagccattttgctttctatgtttttgttgaataaagaccaagtacaaaacaagtgtgggggagtcttttcggaagtctcgacgcgcaatggcatcaacttaacatgtcaatatgatgaacacaggtccacgaccgcacacaaaatttagtagccagaaccgagtccttgatgggacggctgaaccaagtgttcgcttcatccctgcctggcccggctctgccaccacatcgtcgtgtggtcaggtctgcgcgtctccttccttatcctcccttgtttgtgagttaaactttggtagaaaaatggaatacaatttagtttgactccaaatgaaaattgaaaacaacaactctcaagaaataaaattttcctatgattgatcatgtataccttttattctttgctaacactggtcacttgtgaacacacttctatcataaggaaccttgctcatctatataatttataattgtgatatggttatgacaaaagaaattctggtccaactatcatgatacttgagattttatctttgtgaaaattaaaatttttcgagcaatacttcaatgactacattatttcctaccaaggcgatatatgattttcattgaaaaactttatatatatctaggctgcttgtcattacattgagctttgtcaaagtattatgacccgcgtgagatgtttttcatattttcatgatcaagatcacacacacactccacatgcacacacttatgctaaacttctacattggaaactagcatccctcatccatcatttattatatccgttatccataaaataaatactccatcttatttatgcctcttgctccaaaattctttcaaggaaaaaaaagagagaggcatggctatgcaaaagaaggaaaaataaagtcttgctcatacaaatatggagcattgataaaaaaaaagagaaaacacaatcttgctcatacaaataaagatagccatgtactttcccaattttctaaagagagaaatatgaaggaggatgtataccgaaatgagttgttatatttttctttttccatccacatacacatatacatataccctgattgatccctaccgagctccacatatatagccttttagaatatggacgattcaacaaaatatgcctcggtgaggatccacagatcaaaccacgttagtgatttgagagaaagtcatgatcaagactgaaaaaagagccgaaccgcgatcgagagcgcgtcttcctttatctctatctctctctccctcaatccccggcattatccgccgcctcctctctccctctcgccacttcctctctccctctctccgcctctctacgcctcctcctctctcctctccttctactggcgatggaagcgcgcgacggtggcgggcggctattctctctgcccctcaacggtgggggccggagcgcgtggaagcggtcgtctgccgacggcgccgtgtcgcgcgccaagctcgaagccggcggcgccaggggaagaggccggagcgtgcagaagcagtcgtctgtgaaggccacatcacggaggttggggcagcacggggaggggagcgggagcgggaggagcaggtccaaggggaagcagttatcgagcaccttgccgacgatgaggtcaatgtgaatttggaatttggaatttggagatctttgaatttggataaggtccattcgaatttggaatttgtagatctttgaatttataatttggaatttggattagagagagagcaaatgtattgctgtcggtgtgaagtttgactgaatattgttgttcagtttgcaaattaaaatgcttcattgcagcgtatagttttgtatgatgatgagtggacctttccggagcaacttaaaaaccagcagcgaaaagtaagaaaaaaaataactctagtccctgttagtgttaccaaccgggactaaagatgggtatcttttggtcccggattctgggtcccggttagtaacccgggactaaaagcgttgcaaatcgggactaaagttctcttttgcagcagtgtatggtagtaatttttaaagttctcttttgcagcagtgtatggtagtaatttttaggaacaagaaaacaatataaatcctaggtggcacttattttggaccaaaacgcacatggcagtcatgttgtttcgttcgtatgctcattttttcaagttattgtaatgcattgtatccacatatatatcaatttgttatactcgaaacacaatttattatatattaattatggtattttagtaaagaacaagttttactggtctaacagattgcaaactactatatatgccttgtatttttatacggagggagtacgtagttctgcaacagtactaacatagcaagaaataaaacctgaatatgttggagacaaattgtatgcatatggatgaaagtccgctttagggatgaaagtcagccacttgcgatcgatatatcttagctactgctggtgttgcttgatagagataagtgctttgaagataccgacgagcacaccgataacagagaacaccgtgacgatggctttgaagttgttgtagacgaacttgtgtactgggatcaacagccgcctcttacgcctgtaggcctcaagctccgctaagatgcggaagtagtcaagtccgacgaagagctgcttgacgaggttcttgaagaactcgagcgtctcaagatcagagaacccgccgcgtacgagtcccttggctcgcagctcgtgtacgtcctcctcacggttcatgagcatcgcgagcagaagaacgtaggagctgagatatcttcatcacccaagccagtggtgatggaggcctcaagagccaccatgttgacaagccagcacgccttgaggtcatcgatgaccagtggcgctaggaaaattcccccgaacaggcgaggggctccttcgtagatgcccatgtccttgagctgtgacgtgtcgttggccacaagctggatgccgatctctgcaagctcgatggcactgctagactgtggcagtgacgtgacgccttcagggaggtggaggtccgtccttccgatagggatgctcccacattggtagtaacggaggagaccgaggagatgcgctggtgtgtagctgccgttgaggacgagaggccttttaactaggtctaaccgggcctcgaatcccaaacctgctcgagcgataaaatcctccacgtccagcgctggcttgaaggacatgagggtctgaagcaccagccatgggatctggttctccatcagaaagatgtcccgcaggatgctggctagtttggagttgaaccaaccttgcaatgacggagcaactagcccacctggactgctacggatgaaaatcataaactgcagcaagaaacagccatcccggaacatcatagctgcaaagtcggcctcacagctcatacctgccgccgtgtcaccaacatagcagcttcgcacgttgcctgcaacggagaggattttctcgtaggccgcctcagccgactgcggcggatcagccccctgagccgagtccccccagtccctccagaagtagtaggcagccgctcgcttcacctcctccgcctcctgcaggtgcggtaaatcgtggtggtaagggccgatggctactgcgctcggtaccaaatatcggccttctttggtaacgccgcgcaggtttgctgggaacctgtggatcttggtcttgttctcggtgaagttagcctcaaccttttcggctgctctcttcaactcctcttcgaccggaattactactgcttctgcagtgcccatggccatgcccgtcatcgtcgtttgattggcggccaccagctgactctgctgcccgcacctaggaaatgagcgatagagggatcgccgtctatggtcgtggagctggccctgcttagagcaagtttaatagtatagtcaactcactactggaaaactgatctttgctcggtcgccccaaaaccacaatagttatggttaaaaaagaaccgggactaagtcccggtttaaaatccacagccattctacgatctttagtcccgggaataaagtgatctttagtcccggtttatatcctgtcagtcccttgtcagaggggcgggaatctttagtcccggttgatgtcacaaaccgggactaaagatcaccactttagttccggttggtaccaatcgggactaaagatctcctagatctttactcccacgcgtagtatattatccctattccctatcatcacccctacaaccggcctcaatctccttaacaaccggcctctcctctgctcagatccatctccctctcctccccctcctccccttcctcctcccatcccggccctctcctccccctcctcccttcccatccgatgcccagctagggccgcctcctccccctcctcccttcccgcacgcgtcaggcggctgacggggccatgctcgccaaggctgcgcctggcggggccgcacgcagcaggcggccgcacacgggccgagtagcgagcggcggtaggcggcgctaccggtatctattcttttttcttttttttttacaatttgtgattcactgagatgtataattttgtgatttgttgtatggatctgagatgtataatatgtgatgtatttggtttgtgtgtatttttttaagatttgtgatgtatttgatttgtgtgtacaagtaacttaagatttgtgatgtgaatgttttgggatgtttgtttgatttgggagtatgcatctcactcgatttgtgagaaaatacagggattaaactccgcctaaaaaaacaatgaaaaaaaaaagaaaaaggagacctaacgggactgccgctaccctctcatctttagtcctggttggtgttaccaactagatctttagtcccggttatttcaactgggactaaagtcccggagtgctagtcccggttccatctttagtctggatctttagtcctggttatttcaacggggactaaagatggattgctagtcccggtttcatctttaggcctggttggaaaaccgggactaaagggggttaccaaccgggagtataaatggtttctccaccggtgactactaaccccaaatcatttatagtcaatttaatagccaattcatataatagttacttactgcactactaatatctgatatcacctgtcatatatacattgcatcttgaagtctgtgctgcacctggctagaaatctctagccactgctcttatctcttctcttttatcttcttaaaatatgtttatagctgacttatagtctgctattgtacctgctcttacaagctaatgctacttcacatgggtactagtatattttagcttaggattggctcaaaagtattatccgaaaaaaaacaaacatattatcccctctatctctctctcatatcataacacattttggcttttattttaactcaaactttcttaagtttgactatactgatggaaaaagtagcatcatctataacaccaaattattatttttcagctatgagcatcttctaagactaggccatcatatcttaagactcacaacatcatcatagatgcctcaatatcgagggatacgtcgcttatcattaaaagaataattagctataaataatagtatccataccaaatccaggatatgcagtcgggtagacatgtttcaccataaggaatctaaccagttgcgttacacgcactttgccaaattagtgttagtagatctaatttcaagtttattttgataatgtatttatttttgtaaaaaaagtattgaaaatgttgctatgtttcttctcaacccatgatgttgtccttcgtagcctaatgctgattataaagctgtacaacttatcaacaacaataatctaatttacgagtaaaaaaatttatatacgtacccttagcgattgaaaaagctaaagttgaaaaataaggtacaatgaagaaaatcttaaaatcaactccataattatgttgaaatttaaattttgatagcagcttataagttgtagagcaaacgacggcaaagtatcagggatctattatatactaaaagtccattaagcatcctataaacgcttcgaagccgccacatggcgcttttacaagcgttcctaggccaccatgtggcattctataatcccaccatcgatttccatttaaatcggtggacccattattttataccgtcggattagatctatttaaaaagtttatgctttctatatccgcgagcaatttatcgaaaatactgtatacatgaaaataattacgtactatggaaatacttacatacgtgtacgtatgaaagtacttacatacgtatatgaaactttaggtactgtaaattaaaaaacaaacaaagaacgtacgtgtgtacgataaaaaaacctatagagaaaaaacaaacattgataaactgctcacttgatggaaaaatacaaaggaacatgctataaagccctaatggaaaatatatgtacgatgttataaccatcggaaaaaaaatagacggttttttaaaatatcatcttctatactataaacaataaaatttattactctacaaatatagccatgtggtgcttcgataagcgctcttaggccatcacgtggcactgtataatctcacgtagcactatatttaaatttatggatatgttattttataccttagcccgcttcctgttaatatcatctattatatattgatagtccattaaacatcctacaaacgtactcaggacaccacgtatcactcctacaaatgctcctacgtcgccacatgacattttaataaattagaaaaatcacaaaaaatttgagaataaataaaacatttggccatcgattttctgtaatatacgatggacccattgttttctactattaaattatttgtccaagtaaaaaaggaataccacctatttcctttctctcctattttcctcttttagaaaggtggaaaatatattttttaccaattattttttggcattggatttatttagccaaaaagaaaaggaca

SEQ ID NO: 65774 - DNA, 17192 bp, Oryza sativa
  unsure (1)..(17192): unsure at all n locations
gcgatgctgctgctggtgctggtggtggtgcgacggtcgcgtccggcgcacggaaagacgccgccggtgggcggtggcttcctcctcactcactcgctgcgctgccgagcccatgccgcggcagcagcagatgcactcattcatttacgccgctgcctgcctgcctgccatcgtgacatgccaattgaaacatgctgcagcgagaggtacaggggcagcagcagcagcttcagcttcagctcgtgtgggtgtgggtgtgggcggcgctggctgctgtgacgtgctttccctttctcgcctccgttaggaacgatcggcagataaacgatgaataacaacagattaatcacataagatacgagatttaacatgaaaaaccattctaagataggaaagagagagccatggataccagccagcaaatcttcactatatcagatgagattacaacgttgaacggcgacttacaatatatatatatatatataaaggtaaaacctctaaaagtatgacgatacatactgccgtgtgaaaatgaatttggatcctgactcaacagcctcgcagaagatatcgagaacgtacgtacgagtctacgtaggtacagcgaccgagcgagcgcgagtggcgagcaaagcaggcaagcggcagcgttggtggtgttggtggtggtggtgtgtctgcctgcctgccgcgtctgctggcgccgggccggccgacagcctcgtgccaacgcctgcagacgcgctcgtcgcgcgatcgccgattcgctttcccggtttcaaaccaaccatcatacgcgcgcgcgcgcgtacgtacgcgtacgtgaagtggtgtgggtttgctgctgctgctgctgcggcagcgcgtggccgcgcgcgcccgtgttcgaacagtggaggaggaggggagggctccaatgatctgtcagtttggtcggcacgacgacagtggggagaggaggggaaatcacggaggagctagctaatctctcgtctcgtttcttttgcagtcgtcgtcgtcacggtcacatgcggattcaggnnggtnggggggggggtgaagtgaaaggaaggacaggatcacaggaatttactgggggatgattcatgaagcccatgaggagggtccgacaaagctgaaagggcattgggcttccggcctacaatgtccccatgggcctacatgtaggggaaccacgttccttttcatttttatggtatactcctatcttttaaacacagttttttttggcaaaattttataaactatcacaattatcactctagtttgaattttttttctttgaagcagatctcttgtgtttaggcgatccatgaagagtagccagagaaatacttcaagttttgcagtacatttactctttcagatgtgtgtcattggtatttctggctgtagatgagcgaagaggagggaacggaccttctttgatatttttttcgtattgctccaattgtatacccattgatcgtgattgctggttagagaggtgttcggtatgatgcaatgtaactcagaccactaatgtgcagcatgagttgagagagggaggtgaaagagctcagatatgtcgtgtgagttaaagagtgcagacatgtcgtcttcttttgcaaaatagaataagatttgaaattgatcttgtggaatatgtccatgccatttgtttttccaaagtgtatcttttacaagcaagaggctaaaacctataattatgtgataagggagatactcaatctatagtttcgtgagataagtttgttttgtgatagatttgtgcaaaatacatgtaattttatgaaatttattctttttatgattacatttgaaagtttcttttaaaagaatttatggtagctttataagatagtcgcatagtttttgagagagaccaaaagggagatatttaactatttatcactcctacaagtggcaattaataatttgtcactggattcacatgttataggcatataggaacccacatttcataaactatgaatggcaaattcttaattgccagtttgccacatcttaaaagtggtaaaaagttaaatgccccaccgaaagagcctccgcgttggggtgagtctactatgtaagtattcgcggacgacgaacggtttcaacagccacgtttgggctttcctatcctaattgatcattccaaaaagggacatttaacttcttgccgcttttaagatgtagcaattaattatttgtcactcactgtctatgatatgtgagccctcatgtgtctatgacatgtggatccagtggtaaataatttagcaccaagtggcaaatagttaattattcttccaaaagcacagaaacaaaagcagtcgacaagttcagatataacaacagccagtcagcaatggacgtacaatgcctgtcacactgtgtagatcgagctctaccatctctctgactctctactctctaaactctacaggccgccgtcgcagcagggaggcagcggggcaccacacaggcacctgttgcgagcgtagcaatccgcaccgtgcgccgccatgaacctccccgccggaatctcgccgcagagctcgttgtcgctgacgttgaggtgctccagcctgacgtccatcagcgacttggccaccttcccggtgatccggttgtggctgaggtcgaggtacctgaggtggtgcgggaacctcaccccggtcatgtcgaacgccagctcgttccacgacaggtcgatcttggccgccggcgccgcgatcccgaacaggtgcggcgacgggtcgccggtgaggcggttgtgcgagaggtcgacggtgtccacgtcgccgtagcagcgcggtatctcgccggtgagctggttgtgggagaggatcaagaacctgaagctgccgtgcaccagccccggcgggatggcgccggtgaggaagttgccgctgaggtcgaggtaccggaggttggggtggtcgccggcgagggacggcgggatcggcccggcgagcctgctgtcggcgatgacgagggtacggaggttggtggcgccggcgaggtaggacgccggcaccgggccggagatggaggtgccggtgatgtcgaggtcctcgagcagcgagaggttggcgaaggagggcgggatgggccccgacatgccccggacggacgcgatctggaggacggcgagccccgtcagctcgccgagcgccggcggcacgggcgcggcgacgccggcgagggagaagagcgccagcccggtgacgcggccgggctcgccggagcagaacacggcgggctcccacgcgcagcagttggtcgacggccgccacgacgacagcctgacggggtcgcccagctgcgccttcaccctcagcagcgcggcgcggtcgtcgccgttgcactccaccgccgacgagacggcggtgcaggcggacaggacgacgacgacgaggcagagcagtggaatccacgacgaggctactactgttgcattggccattttcttgggtttttagggttttttttggcagcaatgcaagctactgtgatgatctgcactgaacttgaccacctgcatatatctatagaaatcgccatgaaattcgtgtgctagcttctgcatcagattctcgtttattcacttcatgtaaaggacgttcttgtgttctgcattcaacatgcatgtgttagcagcaataaaaccgctcaaatccgtgcaggattctgcagagattgcctcaacatgtgcctcaaggtacacaaaccagaattcagttagcgatcagttactgccatccagagatcaattggattcatcagataataagcagtgcaagaacaaaattcttttctcaataagatacagattttggtggtgtttaaaacttatgtaggtgagatgaagatgaagattaagtgttatacacaaaatgaggtggatctcacccaatccaaatgtgggtgagatcgaaaaggccaagaaactttcgcaagtgagttggcttgtctgttgttatgcagttttctacagaattatgtatgatggagaaaagctccttatagatatccttcgtctgagagttgtgaggtcaaatggttgtccttgtaggaccaggagcagtcattactcgatgctatagccagacttgacgatgcatcagatagtgaaagtggtaagttactggcagactctacttgcactgttaacagtatctttgaagggtgatgagtattagccacattagtatatttggttttataatgcacaaccaaataattagaaagagtgaaacctggaacttcaaattctgcccaaacattgagaaattttggatgtgactcagtatgttttgatcgaaaatttgtcagtctttcgtagtactggccacccacttgtgtcgtccttgtctgatgcctcaaatttgttacagctatcaactattattctaactagtcattgtatatgacagaagatatggctgtcggggcccaaatggtttctgctggtgatcacatgggcaggaacggcgttgcttgttggtaacaactggcaaagtgttggattttgaagattgtgtttgtgaagcgcctgtgtagatcaccggtcaaaggaaaatcatcgatggggcattggcaatttggcatgccaaaagtggatgtactgaacatgtccctgatagggcctcttctttaggctgcgaaaagttcaggtcacaaggcgcagagcgcttttccttcggtgataacggtggctgtatttgccccctaacagacttgaaggaactctaatctgactattaacattccaaaactgttaaaccctttgccaccatctccaatcttcttgtctctctagtgcaggatttgtaaactccacctgaatgcaacgtgaaaacgaagactgtatcttgctttccagtgatcaggttgtgataggtaaacaactatagagaccatatttaatgcttagggcacatgaatgcggggatagctcagttgggagagcgtcagactgaagatctgaaggtcgcgtgttcgatccacgctcaccgcatttaactttcttttccttttcagcattgcattttttttctttcttttccttttcagcattgcattttcttttctgcattgtgcatagaactttcttttccttttcagcgttgcatttttttttctgaattgtgttctttgaatgcaccatttatttttttttccttctcttttcctctcatcttgatttcaacgttgcattttttttaactgcattcattcaatgcaccattttgtgtttttccttctctcatttaaagaaggataacgaattgcattctcaaggtgtgaatatattctcctttataagataactaaaaattatcttccagtaataaataaaaaaagtaggtcgactttcacaccaacaaaaccgttagcctactcccatccctgcgtgggcgcagttgtccccgatcccctcccgcgaacagtaacaccttcggagagcgggcacgcctaacttgtggagagctgagaagcatggggttatggatttcaattttaaatttcttcatagggtaactgttggagccgatctttaaaaaaatttctaaaatttagcaccttgagattgatggagtgggagggagcaaccatgactaaactcgtagagagcgagaaatatgaatgtggttgtggatttcaattttgggcatacggaactgttgaagccgatttgtttttctttcaaaaaaaaaacccaaaattttgagattgagaagggaataaaccaaacgatgtgagagtgagaccctggtgatgggtaacgatcaattcaaaccatcaatttgtaagtgatcaatggtgttgcttcaaacacatggtgatggggaacgacaaattcaaacagcaatttgcaagtgatcaatggtgttgctacaaagacagacgatcagttagtcgactacggaatgcaatacattagcctccaaatgctgcagacgcaaaactacgtaatttactcataccttgaactatccacctttgctacttgctacaggtcacatctgttctactagcttacactacactgcccccaaattggcaaatttctacctcctcccaccccgcttcgccgccgtcgccgtcgccgccgtcttctccgaccggttcaccttggccctcttcgacggcggcggcgtcgttgcggcggcggcacctcgcttcgacggtggccgccccacgcttctcttcggcgtggcgctcttgccgcccttcttggagccgccgcggccggcatccttcctgccgggccccttacgcgtcttctgcggctgctccggcgacgtcgccgccgcagcacgcttccgtgtccccattggtgagcctttcttcttcttcttcgacggcgacgagccctggtttagccgtttgaggaagtccacggcgttccgcttcttggcgggcgtggctgcgtcggcggcgatcttcttgtcgggcttcttgcttccgtcggtcgctgcctccgtcgcttccgagagcttggccattttccggccaccgacgctggccgagttcttgccggggccgcggcctttcttcgtcctcaacccccacgccttgtccttgctcgctgacgccgacacggagaccttcttctcgccgtcgtcgctcccctccccttcctcggcggcctcacccttctccgcgctctcctccttcttcgccgccgccgcggccttcgcgatgggagctccgcttccggcaaacgatgagcggtttccctcctttctcgatcagcgacccgacgatgccagcgccgccgccgccgccaccggccggcgacgcgtccagcctccgccgcaccatctcgatgtccacgtggcgcctgatcgcgccacggtacgcgtcgctctcctgcaagtggattttaaaaaaaatgaaaaaaaagaaaaagaaaaaggaaaaaaaaaggagaaaatatctgtgggggcatctggctggaaggcaccccacccgcccaactgattgctacgctgcacccaaccaaccacgcagaatgattcaaaccaaaaatcgaacaaaaaactaggaactttcaaattcaccatgagctaatccgatttgaaactttcgcgttcgttcgaaggacacaaaaaatatgaggtgtgcacatgcgtctcacctacctaccacacaacaaaccaacccgaattcataagcaagcgatgacgcacacgaatttttctggtcacgtaattcggattagtgctagtgctatgtcatcatgccacatgcgtggccctaatctaatccataataatctagaggacccccgttaattacggatgggtcccaccctctgacatatcgtttgaaattcccctctttacccctcccctaacttttgaccggcggcggtaaaaaacaaagggtaaaaagggtaaattgtaaatgagcggtaaaattcatttttacctggctttcgtgcagccgctcgagcaggggaccgaacctggcggcgaacgtgtcgagcagcgcggcgagcggctgcgacgacgacgacgacgacggcgactgcgagggcggccgcagcgcggaggcctcctcgccgtcggcgtcctcgtcggcgccgggcttgtacgagcggcggcggcgcagtctgaccgagctccgcaggtcgctgctctccttggacgcggccaccgactcgccggaggcctgctgcttcgccgccgccgcgtcctcgtcttcctcctccgccttgacgctatggtcaccggcgcgcgccgcgggtttcagatctgtggaattggactccctgcacgaccggccgggctcctcgctcgacagccgctcgtcgccgttcgccgtctccggcttcccctcgccgccgccgccgccgtggatgctttgttctctctcctctctcagccgcttcactttcgtctgtagcgttctgagacatgaaaataataataataaaatagttatttatttatttaataagaattcaataattggagaccgagagatcagcatcagacggctcatgaaacgcgcggtttagaggctttttgaaagagaatttggtgattagattttttttttcttctggtgttttagtgttttttacccgatggagagatcgcatcgctcgacctcgcggcggagctcggcgacgcggaggcggcggagctcgtccatccacccgtccgcggcggaggcgtcggggccaccctcctccgcctcctcgtcgtcgtcgtcctcctccgccgccccgccgacggagaagcggcggtggaggtggcggaaccggaggcggcagctggtgggcgtgaggcccgggcgcgcggcgagggggctccgcgtctgcacctccatggcgacggagtcccagctccccgtgccgtgcctgctcacggcgcaggccaagagcagctcctccaacgtcccccagatctcacctccacctcctcctcccgccgccgccgccgccgccggagacacgtcggggccgtccgatccgtccgccatgtgctctcgtcgtcggcggctgcttcccccctttttcttctctctcgctcgcgcacgcttctttgttcgatttttatctcggagagatggatgggatggatagatagcctctgcctctgtgattcgagcgcgcggcggcctcgcgcacccaaaagacaatttcgcgtttctcaggggggtgttttggagaaggcgagcgtgctgttttcaaactggggcccaccttctgcctttctttttattgtacgatccccatattgcccctgattgcgcatactattatcccgtactatatatgagacgcaaatgtcgcaacaaaccgtgtttatttgttaggccttgttccattaatccctataagtaagggattagaggagatttatttcacatctattgtggcgtgaaattattctccctcaatctcctacaatcctattcaatcccctctaaattgaacaaggccttataggagaaaattcttgctctaattccaaaccgcaaatttgatacgcagtactctctctataaaaaaaaactcagcatatccagatttgttgtactataattccatcccaaaataaactcgttatgtacaaattcgttatactaggatatatctctatatccaattcgttgtaatatgtccaattctagtacgaggtttattattattttttttacagagggagtaagttttttttagaaaaaaattgattcacagtaaacgtgtaaacgatctaagcaaagtcagaccgtgcactttctttcttttttgacacggacggcaacaaaatgcttgatcctgaaggtgcatgatcctataaagtatgccaagaattcatcaggatgcggattagcccgtgagctgacacgtgggatctgaataattttggcccggattatcggctgcgttggattggtacgggtgaactgtttgactgggcctccttgatgattcgccaatgaacctgtccttgcttccgtgctgaacccgtgtcttcactgtgcggttacaagaaaaagatttgaacgaacagggcatgccactcgtcagaattcatagtttcaaactagtattccctaaattctcaaattcattcatgccgaatgcaaaagctggcactctgtttatcatcaattttttgtttaggaactttgatcaaaggtacaagcacagagataatgatcatatggattgaaattgtaataaggatgatctggaaaactaaagcgtttcatacatctcaatggagctgaaacttcaactaacaaaagagcgagtttatacatggcgaattggagataaataatactactagtagcagtctagcacaagcaacggcctggaaaataaggcgagattattacatcaccttatgagaattccatttgcttccctggggaagcaaactgcacctaccaaatgtattattgagcgcaaaattttaaccaagcagccatgtcaagttgcagtattgcagggggttgcaatttcagcaaattctgatacttcttcacttccggcgagcctccagtgccttcttcaactcctcgctcgcctcattcgacaccggcttcggtccactgtccaccatctccttgccgttcccgtggcgatctggcttcgccaggaatggttgtggtggtggtggtgccagggacgacggcatccttcgggcgtcgcctttaccgggcattgaggcggctctatttccaccgatctcggcacgcaggtcctccacggtacgccgcagcatgatgctctctgcattgagcacctcgagctgcctcttgacgagcgagaacccttcagtctgaaattccggcgcatccttcttcttccccttgtcggcatcggaatgtggaggattccgcagcgtgtgctcaattgtgatcttgttcatgaccagcagcggcaacttgttgatggccaggttacccgccttgcggccgtacccgtcgtcggcgagggcggccttcagctcgggcggcacgcgcagcccccactggaaccgcaggctcgccttgctccacagcggcagcacgctcctggtcgtgaggcgcatcccggacagcagcgcgccgaccccgccgccgctcttccccgcggcggccacgttcgcggcgaacccgttcccgctgaacgagaacgccctgtggtcgtcgccgccgttggcgaggtcggtcagcttgtgcgacggcggcggcggcggcagcggcggggccggggacgcggacgcgggcggggagatgacggagttggcgagcgagaagtcgccgatgcggggcttgaagaggagggagaaggccggcgggctggaggagaggaggttgaactcggcggatatggcgaacggcgcgcgggcgggggacccgagcgggccgaggccggtacggacggagagcgcgaagggctggagcgggtcgttggggcggtacgagaggcggagcgccgggccggaggcgaaggcggtggagaggtcgaagcggagatcccgcgagtcgccgccgccgccggccgagacgccggtgaggaacggcagcccgaggacgccgacgggcaccttggcgcgcaccagcggccggtcgtcgtcccggaacttgatcgacgccttcatggccggccacctagggttagggtttggtcgatgggggaattcgccggatttggtgaggttgcgggaggatagcggcagtggaggtggggaattttgaagtgcggaggtgagggatttgggggatggggcggaggtcgtcacgccatttcggaggagggggcgtcggcggcgggattgaattgtggggaggaagcggaaatggaagggggacggaattgggttggatggctctctagctggatggaccgtttttactctccttccttactccctttcctacctgtaataagtttatttttagctcctatgtttatttaaaataaatttatttttaaagcaattattgctctttacatttatttaaaataaacttattttaaagtaattattgttcgttacatttatttcaaaataaatttatttttaaaataactattgcattggagtttaggaaagtatgaagttattaaaattgaaaataggtaaaatgagaacatgttgtattgggatttgataaaattgactgcccaaactactcactctagtgcaggtttattataatataattcgtccgtttcatataagggtttttatgtttgtttaagttaaactattttaagtttgattaaatttagaaaataacaataatatttatgttattaaatgaaaataattattgtgaaatatatttcataatttacttttttatatagcatatgataatatttttctcaacaaaacctggtagcacttataatagtttgatttataaaaagagaaaatccaagaaatgttagtgataagcacccaatttcaagaaaatgtaatcgataagtatgagttctgtaaaatatcattgtataagcgacttttctcagaaatgtcatcgtcgaccatccgcgttgttaaatacatcattcatcctatagcacttaacggagggctaccaacggaatcctaatgatgatggtatttatagaacaagttgtttgtacgatgacatttcatgacactcacactcgtcgatatcatttcttgaaattgaatgattgtcaatgacatttcttagacttttttttctatgaaaaagatatagaatcttttatattttagaaacatatatgttcataatccaccgtttgcgaagcaaattcttgttttctcagaagattattttcgtaataatccacatgtgcataagttaattgtttagtttgttgttttggactctaccgtgcacatcaccaccttcttagttcgtgagtacatccctccatgatggtctaagaaagcctaatgacaggtccagtcattaattcctgatatggcctttaggcccaaaattgtactctcaaatagtcaaatctaaatctcattattatttttttccctataaaccatccatttttcaaaccttggccatccaactgaattttttttcttgggtgaaaaactgaaaatgcattacacggtgcagtcaaaactggcctaacatcctccaggaaatcaatcctaaacaaattatccaattgctaagcataagctacatttacaaagggatcaacaattcagagttcaaattatccaattgctaagcataagctacagttacagagggatcaacaattcagagttcactgggcatggcacgatcgcggcgtgcctgcacgccgccaacgacgacgacgccaccgccgccgccgccgccccggcgctccagaccacgccctcctccgccttccacaccccgtcgtcaaagttgcgcgcgtagctgtccgagtcgtactcgtacctcgccggcgcggcgagcctcctcctcgctgcgcgccgccgccgccccgccgcgcagtacagccccgcggccgccgcccgcctcaccgccgcccaccacgccctcgccgcggcggcggccgccgccaccgccaccgccaccgccaccgccgtgccgtcccctcctcctcgccgccggctctcgcacgccgtcagcctccggtacgcgatcgcacccatctccaaaaacgcgcctctcctcttccgactcgtgcgcgcgtgttttccattttataaactcttcacatcatcataaatgtgtttttccggaccagctggcatgtgggacccacccgtcggggaggaggacctgttcggtgctactccagctgccaggtgggtccaccaccagaggcagtttaataattttattgtgagctctaatccgtgttagtactactgctaaaacaaaagatttgggttgagtttagttcacatcaaaattagaagtttggttaaaattagaacgatgtgatggaaaagttaaaagtttatgcgtgtagaaaaattttgacgtgatgaaaaagttgaaagtttgaataattattttggaactaaacacggcgttgttatccgagatgggaggcatattggcattgtttccggatgcgtataatcaagctgggaaagagcagaagtacaggctgtttgattgcatttggtgacctgatcaaatcaaacctattagtgtgccagttgctgggcttgatctttgttaggaacaaaaaaggctgggagatgaataataataataataataataataatatagtatcagaacaagttcttccaaatcattggttatgaacggcaatgctttggatttcagaagttggcatctggtaatgaggggccatgacagcttcttaacagcagccaggattccagactacagagtgctggaataccgacacagtatcacaagactagttctatgttctggccaattagacaattagtacccataaacggatatatagctgctctaattggcaatcacctgttaacaacatagtagctgggatttagtagtaggcatcaactggcaaagcaagcttccatgatcttaacctgattgcagctgttaagggaactacccccaaaatgcatacaaatatgaaagtatgaaaggcatgtagccaaactactatggatattttactgagtttacgcacgtttcagaattccctgtacaaaagaatccaatttgaaacaaaataaggttttaccattaccatgaatctgtcttacacaactacttctcgatgcctaagttcatatctcatttctttgccttagagaaacgaaggcacctgtacttttcaccgctaacagtgatctcgagggcaccgtcttggttgtcctgattcgaagcagtgcccatgagcacgctcttttccttctctaagttctccttttccatcttcagccttgcctcttgccgcgcaatctcagcctgtgaaacatgcaattggatcaagtcatgctgcaggtcaagcatagttcactctatctgtcaaaacaagtttgtcatttcatttgcgaataaataaatatgagtaaaatcatcaagcatagttcactcttatatgtgaaaacaagtttgttcaagcttcaaaccatctgaaagaggaatgtgttctcaacttattatttctactaatctggcaaagatataatggtaacaggtcactctgcactaatacagggtccaaaatcactcggcatgacaaattgacaattaaccagaatggaaccaagtgattgttttggataggcaagaatcaagtgactgggagtttaaatttcccctatcaaataggattaccttattacagtcagaacaacaacatttaacaaatctcttaaccaacaacatagccttccatacgcaaaacatttatccaaatgaattaagatcagaatccgccaacacagccatattgcttatatctcaatagtagtctctgaatggaactatgaaaggattcagccatttttgggacttgctgacacaccataatcgatggacaggaggagggtaacatactgactactgagacaaaacgacatgataataggaacgccaacaaaacatgtaaagaagaaacaagccaaaatgtatgcaataaacttcggttgacataatataattcatgtaactgtacatgtcatgtgatgaagcaggtatgactattgaggaaagatcccaaatgtaccacgaactaacccacaggtctagattatctaggaaagattttgttctctcacaacatgattcaaacctattcatccttaaaaattgaaaccttgagaaggtattcataaataatacggcaatcctactcatacactctagtctacatatgcatattcttcacatttggcagcagttccaccaaatgaaattcttcaccattagcagtgtagtcagattcctatcggcataggagctaaactactgaaaaaaaaaatctaataaggcattacatccttgtccgcttagttgtttgacttgtttttaagccaaaaactgagaaaagaaaaaaaaacaaagaagaaagaacaggggcggatttggagtgatgggggaagcaaaggaaggggatcatcaacatcagatcatcaccgacctcgcggcgggagagctcggccttccaggcggcctcccgctcggcgacctcgcgctcccgctcctggatgtagctctgcatctcccgctccttcatgacgcgatcctggatgtccgcgtccagcgcctcctgcagctccttcacgaacctgtccaccaccgccttgatccgcaccgacatctccctcccccgcacttcgccgcctcgccgccgctggcgccggactccggcggctgggctagggctccgatgcggccgcggcgcggcgaaattttcgtgggccgctcgtttcgtcgtgggagagagcccagcctctgctgagtcagcaactctcctgggtccgtacgctttcgactgcgaaagcccgcagaaaacgtattccagaaaaccgtaatcatcaagtgaacacgtactctttgtaaacttgcaacaagccagcaggatgaaaacggttgggaaaacatcttcgtccttcgaccattttagtaaccatacttttctcggaaacagaaatggtttagaaaaatagaaaatatcaaaaaatcaaaatcacatatttaatttaacatggctatataatataaccacataaattcatttctatttttaccattttcattttcctttttcttttaccgtttccgacggtttggtaggtacaaataagaaacgggctttagtcggtcggttgagaattttcgtgactattttcatcctacctatgacctcctttgaaaattttcatttttgaggattttggtagaaattgagctaatttctaatgttccaaagaatccaaagtatcagcatctgagatgcggcataaaagagatgcctcttctgttggcatgtccttgccaaccgaaaacacatgatctcccaacttcacagacagtcacacaatgcaagacatacagtgacaaatgggttagcatcagcaacagagaaaaatgaaaaatgtgcagaacatttttcagcttcacacagagagagcataccagaaggtaaaagaactgagccacaagctaaccgcaacatgccaacatagttacatagaagcaatgagctttttcatcggtgtctggaagataaaaaaacaatttaaccacctaaataacacattgagtctagtctccaatagtaacagcacctacaccagaagagctagctagagatgcaacggctacagttttcttccctgattcaggttcagacattacactagataggggggctagttaggatccatggcgtcgcaccggagtacctcgagtaccaccgccacgacatttcctttcgcaagttctacggcggtcagacgggaccaaggtctggtcactgatgatgatgaggaggaggagctcacttccaggataagctgggtagccctggctggccatggttgctggccgtgacaccttggttcagcgggctccccgggccgcccgatgattcactcaatgtgccccttgatggcgggctgcttggccccgtcccgctcatcggcaccatctttagcggtgcagacattgggtctgaaggagcatgcagctttggcccctttttcccttcggtgttg

SEQ ID NO: 65775 - DNA, 698 bp, Oryza sativa
atcatttttaacttggataatatttagtgtgaagtaatttaaactactcccaaaactttgaatttagtgattttcatcaatctagcaattttttttatttcagtcattatagtgaaggggtatatataatactgaacactaccatctaggtgtattcccgtagaaactagaaagtaagcaaaataattatttttattatataagtttgtgttactcttaatttccctgttctattctcacacaatctatgatacatgttctgcctatgttccaaaaaaattgtgaaacagtttgccttttttttccttgccaattcgtggtggtattctgtaggacttgacattgtaaaatcaccattgcttgatgacacctttttgatttttctgtgtactggcctgacagattattggaccgtgaccaagctgacggggaagagcctgtggaagatgaagaagaagacgaatttctaaaaggattcaaggtactgtgcatgaggagctcattttagttattcttacgagatgcctgctgtcacttctattttggcagtaatctgtatatttatgagataatgaaggatcatcatgcatgttgctttttccttggaaaaaaccaaaagtaaacataaatttggactagcctcttgttttaaggttgatgctaagccaatacatttggtggttgtcagttgtcatata

SEQ ID NO: 65776 - DNA, 1462 bp, Oryza sativa
ggcttagctggttatcacgacgctgtcatttcttctctgaacgatgacgtactcatttagatgggattcagctctgaacttgtgcagtttttaccacacaatgtttgctggagtagcttttctggccacaaattgaagtttggaattctttggagtatatgatgctccttctgataatgttcagaaggaattttggattagctcaaatcagatgcacatgagttctgttctgtgaaaatgatgagcactatagatgggtgaacaactggacattagaggttgaattgtcatgcttgtggtaaattgatatattcacagacaaacaagatgcagttacatgattttcttgttgtttccaaaaaggaacctgtcatggtttgtgaacctgttgtgtgacatggcttcttgatcttctgatgaggctgaccatccaaaactactccattttctgttagtgttagttacccacttgtgtggctgacaacataccatccacattttgtattcttgaaaatggattgatgtttcattcgtaaggctgaaatgttcctatcactattgctgttggaaatgtccacctactcctattggacatggtttgaatctttatgataactatactgtttatagtagaattgatattgctcccagtttcacctttcttatgctgactactggttacttctttacttttcagtgtttaaccactgcttctccacggatttctttgaagaagatgagctgaaaccgtacatcggaggcatcttgaaacagctaattggccgctattccattgactcattcatggtgttcaattttgagggaagcaagaaggacaaccaaattgcctgcattttctcggactttgatatgagtgtgatgggttacccacgaaactatgagggatgccccttgctcaccatggagatgattcaccatttcgtgaggtctagtgaaagttggctctcattaggccaggacaacttcttgcttatacattcagaacaggggggatggccagtccttgctttcgcattggcagccctactgctttacctccgaagatataataatgagaggaaagcattggaaatggtctacaaacaggcaccacctgggctagtagagcacttctcaccactgaacccggctccttctcagatgagatacttgaagtatgtgtcaagacggcacatgtcaccagaacaatggcctccagctgatagaatgataaatttgaattgtgtaatcatcagaggggtgccaaattttgatggaaaaggaggatgtagaccaatattgcagatttatggtccagatccttttgctcctaatgacaaaagtactaaagttctcttttcaaccccaaagacaagtgattctgtccagctctacacacaggtatacttttgttatatttactaatttatcatgaataatataacctttattacagtaagct

SEQ ID NO: 65777 - DNA, 5458 bp, Oryza sativa
  unsure (1)..(5458): unsure at all n locations
acacattccttgccagaaacttactcacttgcactagaatctcaagagcacaaactctttgaagattcatctccaagggagctaccaaaattggataccaccaagaacaaccccaactccgacctgccttcggcgaattcacgagactcagaagctgctggtgatgctgctgttgctgaatggtcagacaccaacacggacacgttcctgtcagatacaccttcaagcagctctccatcaagcccgcagaagttcgatgaagattccatggaggctggaattgttgagatccagacacaaacagcagaacctcaaagatgttgaagctgcaaaattcttcctcctgtaaattggggcaacactgatcactggagctgcccagaatgtagtcacatatgtcgatacatatacacctgcacagtacattggtaaaaaagagtggtttatccagaccacgaagcatgtatagctgttctcttcggtaatggtaaacatgtacaaaaatttcagattgcctccaaattttggagaatatgagttcttgccgcgatgcaacttggaaacaaagtcttttatcattttcctcgcaaaaaaaatgttctttatcatttgggatgtgaactacaatattgatgatggtcgaagttcatgagaaccaccattgcgccattacatagtgtggcctaagggcatgtacgaccacaattaactgactgtcttgtgtcaatgacggttgggctccacaatagggcggtatgacaaactatttgtcacttttaaaatgcggcaattaagaatttgtcactcgcaatatatgacatgtgaatccagtggcaaatagtaagagtgacatagttatatatctctaagattggagcggaaccccatctcgagcaagtttaagtacccagaagcgaaaggacctgtagcctagtggttagaagagcctcagtaacactttaggtcctgagtttctccataggagcgattttttcaggatttaacggctttgtgctttcagtggtaggtgacgtacctgtcgagtgtgcatgttcgaagatgctcataggtggtatgcgacgtactcatcgagtgtgcgtgttcgaagatgctcataggggtaagatttgcgtgcgtgcgttcatagagggtaggtgtgcgtgcgttgtgagtatctgcgttgtactatgtaattcttaaaaaaaaaagtttaagtaggcagaagcccatcatagtcagggctaatctccatggccccaagtatcggcccaaattgaacaaggcctcgtagcttgtaggtatcgggtttcggtccgggccggaaatgtcctgcactgacaggtgacgaatctcacagccctaaataacaattttgccccatatgatttccatgacacagaagaaaacctaccctcgccgccgccgccgtgatcgtcgaacggcaagagatacggctctccgtattgtgccggcgctcggacggcggccgacggcaagatgtcgtcgccggcggcggcggcagcaaatcagccagtatccgggtctgcactgagcatcggtggtagtaactagtaaaccctccattctcttgctgttaaaatacatttcatcccttaataatcatcatggaatcgttgctctgattagcgtgaaactctcctgaaagtacattcgaatttcaaacaaggaaaaaaagggggggttacaaattagcgtgaaacttcgctgaaatggttcgattctttgccaccaaacagaacggtcaaaaggattaatttgcacagattatcaccaagctaagcgtagttggaacaaaaaccaggggattactcttttgtctcagatgacagaatttctagctgcatcctgtttttgctcgagcgagtctgaaattctgaacagattcttcagagatgcgagacgattatcactactactctagctcatcgccattgctgatggaccaagctctctctctcctttcccctgtacacatgcaatgcaatgccagcgcgctagctagactacgagacggagtagcgccgattcctcgacgacgagctcgacgacttggacgccggcggcttcgccgacgacctcgggctctgcgagctccccgacgtgtcggagctcttgctgaccacctcgccgccgggcggcttcccgccggcccacagcctgtcgaacatccgccgcgaccgcgacgacagcgacagcctgctgctctggttcgccacgctgctcaccctcgccagctgccgcccgtcgtcgccgccgccgccctcgtcgccggcggcggcgagcttcaggctcccgagctgcttcttgagcagcgacggcgtcggcgtcggcagcgcgcgggacttgctccagtccccaccgcctccgccgccgacatcgtcgtcgtcatcgtcctcctcctccaccagaagccgcgcaatgccgccgctcgccgccgccgccgccgccgccgggttgttgccccccgccgcggcgcgcagctgctcgaagaagagcacctgcacgacgacgcggagcgggaggcgatcgttctgcgccgcgtggatgcatgcctccttggacagcttcttcacgtccatcaagctcgagatcttcctcttctccgccttcggcaaattcggatgcaactgacaaagtgacaacagattgcaacatgttcatgtcaaaaataatagtttagaaatcatatagttaacttggaggatgaaaatatgcatcaacatgcaaaataaatcaaattcaagaacaaaaaaaaagatggaaaatgatcactgtttgcatcatgattcttgtcaagcaaatataccttgagaaagacatcaatggcggtgtacagtccatcatgggttgctcttgctgcatcaggcatggaggtcgccactgcaacgaagctcgagaccgacaggtttggatcagaggcgacctcagccaagtatccatcaacaatcttggacagtgcgagcaaagattcatcgtcgacgtcggtctcgaacatctcttgatcaaggttgttgaggaagatcccatcttcagtcactccggctcgcctcatgaacctgccgacgagcgtcagcaccagctgtatgtcgtaggtggtcaacgccggtggccttgccgggatcaggaggtcacagacagaggccttgtgcagctgaaggatcaccctgtccatgagctcctccttcagcatctcaccggagccgatcaggacggcgaccttcagaagcttgaggaagaaccggcatgagcagcacgatgaccccttgtctgacggcagcagccagacgatcgtctcgagcagatggttgtacgccatggagtaggcgtcgtcatcgattgccgcggtgtcgaagcattcaggaagccaccttgaagcataggccttgagagcttccccaacaacatcagaagtgatccttcctctggacttgacagcaaccatgacacgcttgtagaggtctacatccagctcacacagatcctcaacccaccagtctttcggaaccggctgcgagttcttcctcgcttccacaatctcatcggacgacgccgatttccggttgtatgtgtatgaccacaccacattgcaggggttggaggtagccttggaagcaatggagtcaatgcatcttgcagccagcttcagctgctctgaccatggtagcaatgcatcagtggtttgcagcgctatgatcgagtctttccagcttctgaagatgccggagttgaggaacacctcgatcttgaacaccaggttgctcttgtcaacatcttcagtcatcccaagtaactcggctgcacatcttgcggcgacgacattgtacgcgttgagggtcacaaccatgccatagcagaactttgcacagatctcaaatattttcactccaccagggatgtcatggatgtaactttcatcagtgccattctggctggcttcaatgatcagcctctgtagaaggctactcttggatagtaaggggaactgaaaatgaattgtgaagtggtcanagttacagagtgtcatgtgtcataacagagggtttttttaacaggaaaatggccatgattgagcatcaaacattttgttggtttgctgtagcattctatctgtcaaacttgtttaacaaattgatgatatcttccatcgcattgcacgagcattgctgtcacctaccattgagaaggcttatggaaatggaggaatgatttaaggagaatgctgggaaagattctgaatgcaacatggttccaaattacaagtggctcttgacaaaatatggcactgtagcagcatcttctgatgtgctcatagctgtacattggcgcatgcattgttctaactcaatttcaagacttgccttaagacacaacagtataatctagctttgctcatgcagcagtgacagtgaaaaaaatggtttaagggattattaccttgtgcaggtagaaccttgcctcctccacatggatgacaatgtctgatggaagttcagacaacacatatctgcatcataagaatgatgtgttcagagcttagtggctgactaccacataataatagcatctcctagcaatgtacagcagtaagatgttcagattaacttcactaatcaaatgctctaaagaacacatctttcttggctgcaagctgcatgcctgaatattcttgcttaggtccagacatgcacatagccacatatacttcaaccaaaattaaaaaattaacaaatgcattttgctgttttaattatgtcactctctgcaagatccagtgggcgtggccaggttggttggttctatgcaaagggagaggagagcagaaagcaagaaacatttttatcaaggcccaaggattgcaagttagttataaaaaaagagattattttgatcttatcgcaacaacaactactactactactactactatgcctgccatgttttgtttgtacagccaaaagggaaacaccagcttttttcagagcaaaagtgaggtcgccttggtcaaaatgccgtgcagagaaacccacgtagctcacgagcactttgagcagtagttagccccacatctcaagatcacagtagaactgcttcgatgacttgaaaaataaaattcatttttggtgggtacactaatcatgaaaatgcaaagcaaagcacacagcaaagaaaatatttttcacttgaaaagcaaacctcttctactatcatcagataaacaacacttgaatctttatttctttcctgtttgtacaacacaagaacctgcaatgcaagagcagacgccaaggaaacaaaaaaccaagaacacgtctggagcaagctcaagaacacaagagcaggctaagccatttcgtcagagtaaccagaacagagaagaaacagagcgagaggaagaagaagaaacaaatccccaggagaacctctccatttgatcaca

SEQ ID NO: 65778 - DNA, 4566 bp, Oryza sativa
aattcagaggaaaagtaaacaggagcattaagggaaaccactacggcgtgtctgggtacacacattgaacattgaaggagtcgattgaaaaagccagacgttagctagctataccatgcagggatcagtatgtttggtgactgacatctcaaaaacggatttgaatccggtgcagtacctagtgtgactgcaacataagcagtcacgctaagaccttttgatgcaaatccaagggtccaaaatctacaaagtactgttcacatccgaaaaaaattatagaactactatagcatcaacactgtaccatcagatttagaccgttcattgaaaaaatggatggctgagataatgtgtagttcctaagttgcagtcacagttaggactgcactggatctcaattctgacattgtacagatcagtacgacggcgcaattaatggtttatttcgacaatcaaatgtgggtataagttttatttacactgtcatactctctttcttacactatctttaaataaaatcctctgtttcttggtgtactggcctcatcctcaatttcttggtttattggccgtagccaatatttgaatttgggtatatttaataaaaggtcatttgggggtcttaattgaagtctttttgccatccttggtttttaaacagttaagcctagtgatgtaaaagttttgtctatccgtggttgctttgtttatttctactgcctaccaaccgcagctcaataaaaattggcatgatttttataaaaagagcgctagccatataatagaatgttggaaaaactataagacttaaagaaatatgtaattcttaattataagcatttgtctagtgaaaatatacagtgaaaactaccaaataaataaaatcccgtgaaaagtcaaaaccttaactagcagagtcagagacaaattacttgcatgaaatgattaaaaattattttggaaacatatttggtttaggaacacatatttgattggttcttcaattttggttttatatgtgttttttgaagtgcctttttacgtgttgatggctggggtatgatcaatgtggtaagatatttatatccctttttgcagagaaatcccaaacttaagcatcttcctcatagcataaagatatccctacactgccagctctaagaccaaaattgccccaaaattgcatctccctcctgcttggagctgtgttcccaacctccctctctagtttactgtgcgtacgcttttcaaactgctaaacggtgcgtgttatgcaaaaattttatatagaaaagttgctttaaaaaaccatatcaatccatttttaatgttttttaagctattaattaattaattacgcattaatctattgctccgttttccgtgttgtatgggagttcccaaccctcacctaagaacattagtattgtctcgtgttgcagtattggaaggtgtttacacccaaatttggcacctaggttcaaattacgaaaaaattgccaaaatttggaagagcacccggtgtgttggacggtcagacctctacttgtaggccggtctgaccggcgttatgtggccggtcagaccggtagagtctgatcccgagtctgttttcgtcgggtcttgggatttcttattcggaagggtatgtttcgggtttccattggtttatatcccgagttggatgtggaggtcagtggcggacgcaggtttaaaatatagatggggcggcaaagctagccctaattaggtgatggcataatgcacacaaaccatagtcgctagttcacagcattggcgcaacagtgcacggcacaaacatcgagaaagttaacaacaaagattggtagtcgaacaaacgtatatgacttatatgtagagagatgaaaaaaaatgagaaatgttgttagacaataaggggaaccactttcaatagttcgggggtataaaacgagatgaaaaattatttaggggtttaagtgtgtcagggttatggataccacatacctaatagtagttgactaaatctcgggatgacccaccacataccatgtcctatacggaaacaacctgcgaatataggaggagttccggataaggaatgataaccagagttctatatggaaacgacaaggactactcggattgtgtccatattggtttccctagttctacttggacaaggggatacctattggtataaatacaagaccccctaggaggagaggggacacacccaccatagaagacacggcacaacagaagccacaacatacaagccaacatacgccaagacaagccgctggatatcaacattagagatatacccagatcgacccaatccagtaccttcagagaccggccgtagggatctagcgctttctctgatctggctgggcacggatttgaggaggaagactaccctgttgtcgactacgagtcagaccttcagaccgccatgtcgacaacagttagataggctaccctaaatattgtactggtgtgattatggtgaataagagcaataccggcttcggccaacagaatgtagggttattacctgacaatttaggggcccgaacctgtataaaaatccctgtctctatctcttttacctcaatatcgcatataccctagtaccaacgatccccatactatgcaaatactggaatcgcgacatcaaacgtcgacaaggtgcttccccaaaatagttcaagtgaataaaatggattttttataaatatatcaatttaactatttactgtagactgtattatatgctaaagaaatagaaagaaaattgaattttatgtatggccaaaattagaaacggtcaaaatggtactacttatacacgaattttcataaatgttttggtttctacttaaaatacttgatttatctgattattcaatagtagactgatgactaatgtgttagaaataggactaaaatgaggtttgaggggtgtggggcgacacgaaccgtagctggcccgatcgacccaccctgcccaatgggtgtgtccgccactagtggaggaggacacgaaggaggcaagaccaacccctatatgaggaaagaggccggtataattggaaataaaacaatctacacacaatccaatttatccaattgaatcgctttttcaatatttcacctagttctagcctagttcatccatctttgtcgatttgcactgtaaatcatctaccttccctgcgagtgtgcgaaatccctttgtaggtttgttttataaaccttctttttgcccatgagaccggtatttataacttgttctacctaaatcggctccgctagcatgtttaatccatcaaaacccatcctgatctagcttttgctagtttggagtggttagcgactctatatcaccgcaaggcgtttaggtttcctgatcatgattgtcttcttgtagcaagttccgtagatgaaaccattaacgctactttcaataataaacttgaacatgatatgggttcttattttgacaaaagaattgaatctttagtgagttccaaattaagctctcttacagccgatttgccacacaattctattacaagtactagccaagcccctattcaccacttatatagcaaaaccgatggagcgactacgcaatatgccaggagcaaagctaaccctagctctgaggctagtatgaccgcgcccctggttggtctgaccgactctccccacatcggtttggccagcccacacgctggtctgacaatcttgaccaacggtcccaccggccctcaagctggtctgaccacatcgacctatgatctgactagccatttggttggtccaaccgcaccactgaccaccagtcctactaggttctcgaccggtcagactagcacaaatctgcccatgcaggaagtagatccaatcaccaataattatattttgcaccattttcatgtacctaatcatctagtagctccggttaatcctcatattcctccatagatacctaatgcttataatgatcctaatgttgggtgcccttaagatgttagatatggccaatataacagtattgcaccacgacaaccttttaggccacggaattcaccaaggcctaaaaatatggaggaccatgtgaggaatatcattagggaagcttttggaattgtgccgatgaatcgtgctagggtttaccaaaagtcatatcctgattattttgatgatattccatatccttgtggttttagggttcccgaattcactaaattcaatggtgaggatagtagggaccacatgggaacatataggccaattcttagcataatgtggtgagctagtaacacgtatgctttcaaattgcgtttgttttctttatctttatccggtattgcatttatatggtttacttctttactggcaaattctattcatactttaggtgtccggattttgttgatttatttgagtgggtcatcatgactttgggaccgaagaatgccggcgcaacatatcaaaaagcaatgaatttgatttttcatgattttctggggattatcttagaaataaacattg

SEQ ID NO: 65779 - DNA, 719 bp, Oryza sativa
aatggcccagcccaaacattcttcaggaaatttgtactcctaccaaatggattaaggactgtcaacctgtcatcaccaggaatggatcactaatcacttaattaatcagttcatctcagctcaccggtcaggaccagtacttagtaagtacactgtacacgaaacagtggtaggttttccatctcttcaagacttgaatacacacaacagagaaagatcaaaatactactacagctttgtggctggctggctgctgccgccaccaccaccatcaccatcaccaattcacagctccgtgcaaaaactgtagctgcgtttgtgtttggctcgggaattgggtgtgaagaaagacacacacagagagagagagagagagagagagatggcaccgaccggaaaggccatgggccaaggcaagcgaagaaacacaaaacacaaacacgaggcattgctgcgatgcaggggctgcagcgtagcaggggggtgctttctcctgccttcctcatcccaagcacgaaaacatttcggactggaccctccctgtttttccctgtctttccctcccccacactagagtgccctttttgtgtctctctcatcccctttgagctctctcttcgatgctttctttactgagtactcaaaatttttttctactacatccgttctaagggctgcttttaatcgcagggttaaaaaaattggaggaataggaaaaa

SEQ ID NO: 65780 - DNA, 2215 bp, Oryza sativa
ttgcttccttgacaatggaaacacagagccccacatcagtaatcaaagcatgaagaacaccgacaactaaaattacaatgaagaaacttgcaggtgaaccatgctatgaagcaaatcagtgcaggatgttcacctccaagccattaccatctctcaatagaagatcgcttcagttccttccaaggggaagtgaccggcatgagtatgtctccttgaaatctgacttcttggaagaagtaaaaatcgatgcatacacttctttgtttgcatatgctggtgcatggtctccagccttgaaccgcttcaaagagggagcctcccccttcttcccattttcaagcttctcagcaccccctgccatcacggcagcggcagcatgcttactcccacttagcccatttcccaccttcttctccttcttttccttcaccttccccctctcctcctccatcctcagcctcaatgccgcaacctcgtcctcagttccgttgagcggcatcttgtccgcctcatcaaactccttatggcataccaagcacgccgaggtcttcacctccttgagagccttcacgctgagcacatggccacacttgcgaagcgcgaggaattggtacttcccattgaaatcgagcccggtgaccgggcactggaaccggacctcctcaccagccgcatcggcatcaggcttaggatgcaggtggatggggatcatgtccttgagacccctgatgtgtgagagcgccttggggaggcgcttgtggaggagcgcctcgacgagggcctccttgttgaagaggttacccaggcgatcggcgacggcgggcgcggcaagcggctcgccggagagcgcgcagcaggtgaagcgggagagccgcgcctcgttggggtcggccttgtcgggcttcttcgcgaggtacatggagaggtagcagtcgcgggactcggcgcccgtggcgccgccgtcgccgccaccgccgcggagcgcgcggaggcggagctggaccgaacccgacggcggaagcgacgccacgggcgcggacagcaggagcgggcggccatcggcggtgaggtagaacgacgacgactcgagcagcggctgcggcagcgcgcggaggaggtgggagaccgggaggcgggacggcacggtgaggcggcgcggcggaagggagaggtcgtcgaggcggagcaccaccgccctggtggtggtcgcgcgcttctccatggcggtggccgctctagggttagggtttcgccgctggtggggaatcgagacggggagagagatgcacgcggataggaggagacgagaaagagagagagagagagagagagagagatctgaaaggacaaaaggaaaccgaccttgcggaggaggaaagtggcggcttcgtggttgggccgcattgttttgggccgggagcgaagcggcctgctcggtttgtccaattccgagactgactgggcttttttgggctgttgaaatcgacatgttgcccggactttctgcgtctgcatgaacacgaactgtctgtcggtactaaacaatcggatcagtattgagatcctctaaccccaaacaggcaaaacgaagtgatcattaacgtgtgattaattaaatattaattatttattttttaaaaatatcaatatgatttttaaagcacttttataaaaaaaatttaaaaatatgccgtctagtagtttgaaaaacgtacgtgtgaaaaggagaaaggtagccaaagaactcagccgaaatgtctgtcggtactaaacaatcggatcaatattgagatcctctgataaagccagacgtgatcgttggcacgtactccctccgtcccataaaaaaaactagtactctgtccatccgataaaaaatcaatctaaggtggtttttgggcctattcagattgtagttaaaataaaccttaccagattttagcaatgctaaaattttagcaagatgacaatattgttaaaattttggcaggattttttgtgtattgaccaaatttggactaaacgtagacattttttttggcaattttatcaaaaaatggtatggttaaaaatgacatcaaagtgaataggcccaaaatgatggtttttatgagatggagtaagcctactccctccgttaaaaaaaaaaggcaaactgtgggttcccgtgccaacgtttgactgtccgtcttatatgaaatttttttataattag

SEQ ID NO: 65781 - DNA, 1217 bp, Oryza sativa
gtgggtcatcgccgttagacatcgccgccggcgaggtcgggccggcggcatcgagcatcgtctgcgccggcgcgccggcgtggcggatggacgggcgggagaggagcgacgccgatgaggtcgccgacgagatggcggaggcgagggagatcggcatcagacagagccccttcccctgcaggtactgcatcgccgtgcccatgtcctcctccatcatcttcgccacctgctgctccgtcacccgcatcccaccaccggtgccacctcctcctcctcctccgccgccgccgccgccctcgccgccggtgccgcccttgctcgccttgccaccgccgccattgctgctcccgttgctgttcccctgcacggacgcacgacgtcgcatatctcagaaccggaaactacacgcaacggcggcaaaggctcgccgtgtcgatgaacattggttgcttgcttgcttacctccgacgacatgctcgccaccagcggcgccatgccggcggcgccgccgagccggctcatgctgagaacctgcggtgtcaaaggcagtcacgatggcatgtctgatcgatcctagctcactgagctcaaacacacagaatcgattgatgatcaccttgacttggagctgcaggaacttgacgtagtcgatgatctcgtccagcatcgacgccttgtccgtctgcaagcaaaatcaaatcaaagaactccattcaatcacttcattttcttcatcaagatgtcaagaaaaacgatgacaaaattgggcacgaatgcgcccatgtgctcattcactgcgctccatttctatcagttggactgttctttagttcagaaaaaggaaacaaagaaaattcttcttgacaatgcaatgaccatatatatgattaattctaccagaatgtaatatttcagaagggatgagagttttgggatgtaaccttgttggcgtttgggactagctcctgcagcgatttcatccgctccgctatcctctccctccgaagctgaaaataacatgaacaatacacaaaaagttgagaagaaaaatggaaatgttgctcaagttccatttattttttggttgaaacttgaaagaggcagtaataattgtaagatgatttcgtgaacagtgacaggtttgacgtagctgatttgatctgtcagatttaagcacgagccagatcaagcattttctgctgtcgtgagtaaacatg

SEQ ID NO: 65782 - DNA, 8143 bp, Oryza sativa
tttttttatttttaaacttttttatttttttcatattaattaatagacattttcaaaaagtatttctaaatctgaaccttttggtcacgctagcccgtctgacttggccaaataactttgtcacgccactgtgttatcctgtcacaccagcctcttgccatgccactgtggctggtggggtaaaacaacgctgtgtggtcaaaatgttcggttttcggaaatattttttggaaatatctattaataaaattaagaaataaaaaaaatctcctgcatatgataggcgatttgttccgatgattctggacaactcaacaaaaaaagttaatgtgagaccaaaccatctgaaagtatactccataacatttctaataagtactcatgagcctccataatcctggatcagcagctatgtccatttaaagtttggactatccaaaaagttttcggcagttttctaggtaaaaaaatattcaaatataactatagtataattctaatataattacactgtaacttgagtgtgactataatatatgtacaatatatagcttgagtgtaattatgcttttttccgtttgacaaatgttgtaggtagcgtactggtagtatgctctttgtgccaccatggcagatattggattcaaacttccaccgcgggattgcaaaagaaaaaaaaaagaattcctctcttccactagcatgaatcgtaaaccacattcttccactagcatgaatcgtaaaccacatgacatggctacattcttccactagcatgaatcgtaaaccacataacatggcttaaggaatgctatggcttgctctgcagtcgttgtcattattcatccacgcattccgtggacacacactccccattccttcacttatgcaagtacttttgcacatgacaataaaaaaaactcatggtatagtatttttttttgcttgaatctatagaatctatctatctatctatacctatactaattgggcactctaaagaagctaccacgttaatcagaaagatccgactattgattaagtgtgtcatatcacaatcaccgtagattttcattattgagaacctgcgttaaaatagattgtgccgcttctcagcccaaccaatgaaccatacgagcccatccaatgtatacgtacatgtatcgatcttttctcaggttacaattaactctgttaatttcagcaatccaatagatgggcacgcaaacatgtttgaggtcttcgctcgagagagacacaccgattccctgttcctcacatctgttcttggcatccttaattctcaatttttattgtcgaggtgaagagtgtggaacaagcctccagtcaccgagatcgatttattgttgtgatccacgttcctccggtgttgaatccatgatttgatttattttctcctccacggcacttgcattgttttttttatctagatatgattcgtaatataaattttgtttggttcgagtgtccatgcggcatcaacgctcgaattcgatcgatcccatcatcacgcatcatcatcatcaccagatctaatgtgccgtttcttttcaatgcccctgatccagcaccagatgcaatctgtaacttttttctattggtccacagtgatttttaatagatggtgcttggatcaagcggccacacagcatcaacaacttactgaaattcaatgccacgcatcttcaggttgccaaaataatcgctggaatcaaatttcaaactgatctaaatttagctcattagctatgtgggtaattaactgttgggatacgcgtaggctacgatagcataaatcaaaattttctatcgcgtaaaccagggaccatgcaagtattagatcatagatcgttaccactcgacgcgctgcgcactggaagaaggcgctaagaagtcgaaggaattctcgcgaagtagtgcgcgtcgatgtagaggaagtagtcgatcgcaccggctcgaccttctcctcctcgtgcgttctcctcgccgtattcccatgccgatcagcaccgcaaaccagtggtgcctctaccggtatccacacgtacagagacggaacgccacacgcagatgtgctagcactcgtgcgcagctagggttttgctcggggaggggagtgacggctagagtttctcacgtgatgcaatacctccgccggtcacacccctcacgaatatataggatccatcactcgggcctccaaggctcgtaggactcctattcggatccctatccgaattaagctcatattggatctccatccaatccccttattccggcccattaagcgtgcgaccctgtagtttcatgtacactcggctgtaacccgaaaactcattttcggtccacgcgtcaacagcagcccctagtagaacgtattgacctaccaggcatacataaagatcatatcggctgaacctctagtgtatacttgtatgaacccctttgcctcacgatatcgattaagctcaaggctagatatgtgccatcctctaatagctcaatcattcactcgaacctgttttgatagattatataacttgtgattgactcctgaatcacctttggcatagccatacacttccataatctacaacatcgaggggcctagagatatctctccataggaggggcaaatcccatcttgattattcctatctcactacatgtttcatagcatacccgaaaactatttttataactacccaattacggagtagtgtttagcagtccctaagtaagctactacacatgttgggaaccatgataatctcaggtctaaggattcaacaccaacactaaatgagattactgatgacacaacacatatgactcttgcaatggctcatgttgggtctatccaacaacatgttcactaacatgtgtctatattattaatttggtatctctataccatgatccatgagacatgatcattaattaatacatgtgctgatcatctaataatttttgttccacatataatatttgatcagggatcctttagaaatagcaacacacaatatacagagtctcgtgaaagaatcatatattcattaaccactatttcaaggagcaaagtcggataaatatgtaaacatactatgttatacaatcatctctatgattgcctctagtgcatatcactaacattaacatactcatgtcattttgttctctatgtattatataatagttagcagtcagagtaaaacaatggcatatatctgtgccagctaatcgagccatatgtttcacgtaaattccactcctaataacaatgttcagcgatataacttatgattttatctggcaatatattccatgtatctttaagttttttcctataggatatatggttattgccataatgcaattacgaaaatattaggtggattagtatggtctaatataattttcatgttctgcttatttcctcttatggatgcaaaattattggtcatgccttcactgcattatatattatgagctcaatctttagtccaaatcgatgtatctaaatttcattaataaatatgaagttgtatccatcttgaatatttcattttatttatttaataacgaaattcaaagttaccaattggtaacatatgattacatttttaaattttataatacaaagaaattgcataatttagtatttataatatataagtgatatatagcccgtgcaaggcacgggttggcggctagtgtaaatctaatataaaaagcatgcaccattagttgatcaagatagccataatcatatcccagctggtcctcatcacaaaaagataggtgctcaagggataaaacttcatagtttgtcgcacattttggataggtaagagtagtttaaaccatgagttttattttttttgcacatgacaataaaaaaaactaattgacataagagcagtttcaacgctttcttatatgacattcattgtacaaatcattagagacactggtcgagaacccctttttagccccagcttgcaaccacttaagtcccaggtagcaaaccggggctacgaatacaaaattaaagatctctatatttagtctcggttaaaataaccaagactaaagatagatctttagtcccggttggtgtctgttgatgtgaaaattaaagatgatggatcggctactcaatctccaaggacctcctctgggcatcattgaaaatatagagctagcaaggttcagtagcaaaaactttgacagatggtgggggtgaatggaagctacatctgttccaccaaccagcctcaatgtatatgacagatctttttcttgatgtcatacctcaggtaagccttaatcttattaattgtatttgaacaattgtcagccgattcataacttgactaatcttatcttctgttttgcagacaacagaatcttcccctccacatcaaagcaatagtggcagaaataccgaatatgccccaagtctgattcctaatggaggtggaccatctccccctatcatcggctatcatgcccccaggacttcaacccttctccaagggctcatcagagaaccagctcatcggctgtggacacatcagctccagacccaaagaaaaagaccaaattaaagaaacccaagccaaccgacgatctgcctgccctggacccaccatcgaacaagctctggatgaagaagagatcggagaggatgttgatcaagccgtagatgaagtatgtgatactgaaagaactccatcggcttcacccaaacaaactcctccgactccctctgctccagctcacttctccagggtaactatctctctctgtttcctttaataactatttatcctcaaccaatcactcattaattttgtctttgcagaaaaagagaattgttgtgaagaagaaatcggcagcaccaactctcaaaccggctccaccagtaagatgttcttaattctttcaccagttgacctcagccgatcttgtctaatacttgtctcttttcagcctcctcctccttctcctgtccagcaatcatcaagcgataaaactccatcagctgcagggagtcaccatgttgaagaagaagtacaaccagctactcctgctatcccagtaagtttcttttaaacaccaagtcttagatcggctatatttgtttgtcatctttgtcctttaaatttctcttttgttgccttagccgatctgttttcttttgatatcaaagattactttgatgagacagaagaagaaactacaagcaaggctctagcccctttggtcgacactgtcaagaaaacacttgaagacatatccctttggctagaatcttcgctggataatctggtagctgattgtggttcgatctgggcatgatttactgaaatccaagcttcaattccagacgatctagcaaacaccatcactccagccgtgtatcttgaacaacaccaatttaagctggagaaggctaagccatagatagccgatcggcaagaatggaaaaatattgaatctactatccaagccaatcggcagcttgtgcatgaagagaaagccaagttagatcaactctctgttgggccgattcagtcgaatatagatcggctcgaagctcgcaagatttatttaatagctcaactcgaagaatgcaacgccgagctggatctggaaaagcaaaagctagccgatcttccaaatgccgttgaagatcaaaagtccagattgagattggctatcaagaatgtggctgacatgaccaagtctctcaagatcatccctagaactgatgctcaagatgcccaagccattgaagaagtagaacaaattaggcaacgggctgtttcggctatccagtgttatttgtctcagtaacattctgtgtaatagaatctaggaatttttgtaattgtctaagaaactctgactctttatgtaactcatcttaataactcttatgccgattcaatgaaactccacattttgctcgaaaatttgcaatttttcataaaatttgcaatttttcagatatacgtgcccccctaattttacaatgtcaaaagctttgataaaattataaaaactactaagggcgatataatcatatcggccattgtacatcggcaaaccacaaccgattacaatatgaaaacaactaagggcgatataaccatatcagccattgtacatcgacaagccacaaccgattacaataggaaaacaactaagggcgatataaccatatcggccatctcaaggcgatgtaaatacatcggctatcatgtatcggcaatatcagccgatcatgcattaacccaaacacttgggtaatatttcttcaagtacttaccatttagtgctcgtccataaatttctccatcgagtccttgcaacatgtaagctcccttagacacaaccttatagatttggaacggtcctttccaattcggcgaccacttgctgaatttgttatcccaagtcccaatcagcaaaatcaacttccatacatgttcaccgtccgaaaaagtcttgggcaccactttcttattgtaatgtcgagcaactcgttccttatccttggtaacctttgcaagggctcttaatctagattgaaccaagtcttccctttcatcggccatgagattataatattcattggctgttaaatcattttgtaactccgttcttcttgagccgattctaacctcccatggtaacacagcctcatgtccataaacaagcttataaggagggacttggatcgacccatgacaagccatccgataagaccacaatgcttcatccaatcgagtatgccactgccgaggaaaatcagaaatctttctctaaatcaatttgatcaaactcttgttagatgcctcggcctgcccattagcttgtgcataatatggtgaagaattcaacaatttgatacccatgctatcggcaaactgaacaaactcattggacacgaagatttaaccctgatcggttgtaatggtttgaggaataccaaattgatggattataagctcttgaacaaaccgtatagcatcccccgaatcaactttcttcaaaggaattgcttccacccacttggtaaaataatcggtcgccaccaatataaacttatgccctttactcgatggtggattaatcataccgatcatatcaattccccaacctctaaacggccatggtttaatgataggattcatagtcgacaccggtgctctctgaattgctccaaatttctgacaattttgacatcccttgtaatatttgaaacaatcttccagcattgtcggccagaaataccccgcacgtcgaagtaaccacttcatcttatgagccgattgatgagcaccacaaattccttcgtgaacctcaccgattgcaaccttagcttgattggcactcaaacacttaagcaacaccccatcaatcgtccgataatagagctcatcattcaacaaagtataattcaacgctttgtaacgcaatttccgagaagccgattgagatggattctgtaaatattgatatacatcatatctccaatcatcggctattaatgcagcaaccttaaccttgatatctttgatcatcggcttatatcccgacgccccttgggccaaatcattagcttcaatattctgctatcgcgatacatgcttcaaagtaaccagctgaaattccttcattagctctcgacatttctcattataaaccattaatgtatcattcttgcactcatattctcctgccaattgactgatcactagccaagaatcccccattatctcaatagcatcggcttcaacatccttgagtaactgcaaccctttgagaactgcttcatactcagcctgattattagttgcataaggtttaatagtgtaagcaaactcaaaacttgccccccgaggggaaattataatcaagccgatgccacaaccatgagtgcatactgatccatcaaaaaactaaatccatggcacaacttcaaccgagccgattgaatcatcatgatgttcaacaataaaatcggctatagctttccctttgaccgccttcggtgactcataccgaagatcgatcaccgttaaggaaaatatccactttccaacccttc

SEQ ID NO: 65783 - DNA, 15035 bp, Oryza sativa
agttaatctgatcttagtactagtaaattagtgtacccacacctatcaactccaacaactaatcccctggggatgcgtgcagctaatgattaaaccggggagtacaaaaaaatataacaaaacatgggatttggagccggaacaaatctcgtcaaacatgctgttccatgtacgtacaaaagcaccggcgattactctatggctgcttggggatcttttgctacggacaagcagctaggatctgaaggccagttggccccatacatttgtactaacttcgtcccaaagtacagccgtggatattcgtacccaatatttgaccgtctgtcttatttgaaaaatttgtgaaaaatttaaaaatatttagtcacatataaagtactattcatattttatcatctaatatcaataaaaatactaatcataaaaaattttcaaataagacgaacggtcaaacattaaacgtgaatagtgtaaaactacacttattttgggacggagggagtacacaccagcatgtactagtaggagtactacgtacgcacaggcacagcacactgcacacttctcctttgcagaaagtaagtactcctacacaagattctttatacatctcgtccattccaatcgccatgattaatttggaatctaagcacgcatgcgtggctccttctcttccttccttctcgatgcatatatattgccagcgaaatgttaggccaagccaaaaaaaaaattaattctgagtctgatccccttacctatatgtggtatgtgacatactcggatgtaatacagtttgtaatatctctactacggccgtgtttaatttttcccctattcccaactttccattatatcatatcacatcaaaaactttcctacacatataaacttttaatttttttttcaaactctcaactttttttaaacttctaatttttttcaggaactaaacacaccctacgttaaaagaggagtcgtcctcctcctctctgtcctacgcttctctagaaaaccagctaattaaaaaaaccctagaaaaatagggaaaaccataactatctactaaaaacataacaaagcagttttattttttttaatcctggaatcccccttatcataattttttcatattgtttacatttcgttatattttggccctgatcggcttcactagctacagctgttgcacaagtccaatgtttggtgcttgaaggggagttactgaatagggcctttgatattatcaatcgaaattttgttcattactgttatataaaaaaaacagtaactcaaactataagagtataaatcgacctatctagattatagctaaactgaaaaattttagggatagagtagcacaaatcaacaggtaaatggagggaatagttttcttttatgggaaaaaatcataattatgatactgaggtaattatcgtcgccaacaaaatcactccccatcttcctgcgccacccatcccatgtgttcatagcctttaacaactagtggctaactgatatagaggaattaattaacaagctaaccctagattattgttccattgaaaagtagtaacccctagactaatcagtccctttggtttgcattggacatttggaccacatgtgccaacaatctatctagctagctagctcatgatcatgcatggatcacacacattttttttcaattgttcatgattagggcgactatctatgatgatgatgatggatatgtagatgcatgggtggccgttgcaaaaatgtatgagtgtctcaaggggaccaaaggatatggagacatggtcctcaccctccttctaattaaacagtcaaacatgggattataaatcgtagtagcatttggaccacggggagatggatgtaagctttttggtctcctcacactttgttgttgtgcaaagtgtggcaaatgtggcatgtgatggatttcagtgctgaatctagttacttaggatatggcctaccatgtacggtatgtcaaccatttgtggtttttaaaatatatttcttgagattttgtagtccttgaggagggattgcaagatactacacttttaaatattaatgaagctaagtgctagttgagcctctagagatatttcagagacccaaattggctactcatcttcagttaaatactaggaagattgatgttggagcgctagttaggtatatatatgtatacatattatcaattgattaatcatttgtaatttatttcgtaaaaaataaaatcatttgattcatttactttcaaggatgaacacctgctagaggggaacgggggaggggcgagatgtggtgtatgtatgtctatgtttaccaggatttaaattctaatgacaataaatactactctcgtcctattatcctaaaactctttatattttagaatggatgaagtacataatgtcagtcagggagttgccgctgaggcactgacccggttccttttggtatatctgcccattcacaagtgtctgcatgtgtgtcttatatgtaaaaaaaacacacacacataagcacaatagacaatgaaataccgatttcccttaaaaaacaataaaatataaaaacctggtatggaatgagacacattatagtattataaactggacataatttcttgtttaaatttcttccacccagataattctagtactccctccgtcccataatataagagattttgagtttttgcttgcaatgtttgacaactcgtcttattcaaaaattttagaattattttttttgacttactttattatccaaagtactttaagcataacttttcgttttttatatttgcacaaattttttttaaataagacgagtggtcaaacaataaaaaaaaaacttaaaatctcttgtattatgggacggggggagtattagaatgtgttccatttcatacatgtttattgaatggatggagaaccaatcaacgtgcaacagaccatcatcagtatgctctgaaaccatccgctacctggccggctgaacaaccttacctcgcaggtaataaccaccaactcctgtctgcatttttacatttgctcacatctcacatgcaaagcaacatgcctgcctacctcccctcctgggctccctgcctacacggcgcagcgcagcgcagctctcttttcaggccgcgcgcgtcatcgccggctcagctctcgcgacaccacctgcaaacccaaactattccgcctccctttttctgaatcctctccccctcgcacggtacgatcgcgccgtgcacgtacttccctggtctcaaaaataaactaaccttatacgaaatatgatatatattctattacgataaatatggatagaatgtgtgccacgtcccgtatgaggttaaattgttttggcacaaagggagtacgaatctaatcttggcgtgcgatccccttttggcttagtgacgatcagtcacgtttagctaatgtcggtttggtgctgatgtcttctctctcaggtgttgtgcaatgagcaaccatttcacggtgtaacaatacaactatactacagttacatttgaaagtctttttcctaaaaaaacttgataatttttttaacactttcctattttcctctagttacgatcatttttttaagattgtaatcttgtaattttttacgatgcgttaaagaaaaaaaactactccttccgttctaaaatataagaacgtaggactagatgggatatttcctagtactatgaacttagacagtccaaattcgtagcattgggaaatgtttcattcagttctaggttgttatatttttggacggagggagtagcttgccaccagcccagcaagtgtaccctagggaggagggaggggagtaccctggaaaaagttgcgagtgacggtagcttttgcagtttttgctgggtgggggactaggcattaggcacggcagcatcgcaggcaaaaacgcatcgctgcgcctacaagcttcgcgtgaagaactgcacggtgcatgcgagagatcacaagggccgccgtggtttgtgcgtgtgttgccgcggagaaagagattttttttttctggtgtactgtgtgcatagctgtaactgtactccgtcggtaaaaaaaaaaaagcaaaccatggatttccgtgtccaactttgactgtccgtcttatatgaaatttttttataattcgtattttcattattgttagatgataaaacatgattaatattttatacatgacttgtctttttaatttttttcataattttttcaaataagacggacggtcaaacattggacacggaaactagggtttgtcttttttttttttggaggagggagtacgtttgctggtttattacacacagtgagatgcggtatcaacgggtgaaatttcactggctcttatagctactttaaaacacaggaactggaaatccaaaaaataaggaaaaaaacgtagaaagaaaaagtcaaaacatatatgagccccattacgatgctctatctactagtcaagactagtagaaagcaatcttaaccattgatatgtttggttgaagggttcagaactaattacactaccacctcatctaacgataatagaaacgtagagatattattataaaaaatatatatggagaggtataatcgtcatttagctgtggctagaccttttttttcttctttttagctttttttatggaatatgagtgatgccaatgtaatggatgatcacaaatcgatctagctaggaaaacaaacataaatgacaaagttacccctaatcactgtattggtaaaatactaatttatccttaataacaaacgattcagattattttatcaatagtataatactatcattagagagcaccagaatatcgctcctaatatatacaatcctaaggaattgaaacacacgagaatttttgtgaaacagtttgtttgcatacctcatatggaaaatattattaatatagagttgagaggaaaggtaaaaataccataagattcgagcttatgtttgaaatccttcaaaaaaaaagggaggaaattaaggacttctgtgagatttttagccaaatccttcaaatcaaatagctccataagattttaatcctacaaatttcatatgaaaatcctttgttccaaaataaccctttgtaagggaagatgtacatgaatttcgcacgaaacagctcaattccggtttccaattagatctgaatggggctaggtagttgatcagttgatggctggctgaaagcaggtggcatctgcgcggcctagggtttgactatcaatgtattattacagcatgaaagtgcatccatctcaagcaaagcaagcgctttcagtttcagtctttcagagaatgggaagttacagctttacatgttgactgatagacaatggctgaccatactgcaagctaagtccatttgtgagtgtgacgatgcatcgcgtgagaccgattgaccaaacaaaaggcatagtatgggcctgtttggcatagctccagttccagctccacccctcgtagagctgaagctcagccaaacagtttcagctccaccaaaactgggagtggagctgtgtggagctctctcacaaaataaactagagttatggagctgggtttagacagctccacaactccactccagactcaactcctagagctaaattgaggagttggagctgtaccaaacaggccacacttcaggctccaaaattcgcccaaatcatacccaaggggtacatttgcgatggctgtgaaagttgcagggctatttggctgaccaccttagggcctgtttagttcgcgaacgaaattttttggcgtgtcacattggatatacggacacacatttaaagtattaaatgtagactaataacaaaacaaactacatattccgcctgaaaactgcgagacaaatttatgaagcctaattaatctgtcattagcaaatgttttctgtagcaccacattatcaaatcatggcgcaattatgcttaaaatattcatctcgcaatttacacgcaatccgtgaaattattaattttccatatataatactccttgcatgtgtccaaacattcgatgtgacatggtgaaaattttttgtttggaaactaaacaagaccttaatttgtctaagcttgtcataatttgttttgactgacctgccaaagggcttggctaacaaaactgaatccatactttagttagttttaggcaagtttgccttctctctctctctctcttttcaattgcatatgggacgaaaaaaggaaatttatcataaatgtggctacaaatcaaacgtgtgtctatcttgatcaatttatctaacttaagctatggtaaacttagataaattgtgtctatcaagcaagcaacccttagtagtagtaacatataaagagcgatatatgattgtattgtgatgagacaacaacattacaaaatgttcactagggttctctctctagatgatggaaaaacctgatctttattttaacaaaagaaataagtaattattactataaagtttgcagcaccaacaactacatcccacattcaatgtgaagacaagaaccaactaacacaggatgaaaaaacattattcacgaaatcctatcgctaattaaatctccatccatgatgataaatttttgtatgactattgtcagcggaattcctgcatacaagctgaacattgtccttatccttctcacatttttatagttgggttcaaaaccaaagtcagtatgtgaccaaaactacactaaggaagcagtataaattagagaaaaatgtaattggcaaaaataaaagacatactaagatatatggtttgagttatgcagtgattttgtttgacaacagaggagctctaaaacattgaattaactaaagatttatcaacaaaggctgcattttgattggattctcggctaggctactccatcattgtccgtgagtacgtttcctgaagacccaaactactaaacggtgtatttgtacaaaaactttttatatagaagttccataaaaattcaaataaaacaaaaatatccacatttataatagtttctgaatgaatcacatgctaatgacccatcttatttcgcatgccggtataagcccaccaacaaaaaaaccgttccgaacgaagccaaccaattagaatttggttcatttccaaaatttcaaataaagagtttaaaaatatagatagctatgcatttacccaatttttcagccactgctaggcctgccttttcttctccccctttggggtgcataagtgcaggggatgccactctaacaagagacaaaaagaatgctctaccttggcctacccagccaagttggcttctccaaagcagcacctcctcctgctgctgacgctgcagcagcgccaacctctaggatttcaccaaaactcttttgctgaaaccatctgtgtgtgctactttcttcttccttttttttttctcttggtgtgctgttgtagttttgttggtcaattgcattctactttctctcttttcttttggtttcttgtggatgttttttccctttggaaaaagttttcgtactcctctgaatgttgtgtgtgattgtgctcctaactcgtctttccatgtcaacaatatccaaaaatccctttgtggattcgaccttattggcgtgtgatatgtactttgttctctgccaaacatttgatcaagatgatgatgatgatgatttgtttaagctaacacaaaaggttcagagatgccattcaaaggaaaaacaaaagaaggttcagagatgttcgtttggcacctttcgtaaagaaaggtatcggaaaatatgtctttctgtttctatttgaattgggactatctacaaatcattcgccataaaacgaacccaaacgcagtcggatttttctctactgctaatccatacctaacgactcagtggacctccaactacgtacacccttttatgattaattagggactagtacgtattttattttttaaaccatatgattaaaaacacataaaaattacaatgtaattattctataactagtaatgtaagtggtatgtaattatagtgtaagtggtatataattacattgtaactgtagtgtatgtggtatgtaattacgttgtaagtgtggtgtaagtggtatgtaagtgatatgtaagtgtggtgtaagtggtatgtaagtgatatgtaagtatggagtaagtactgtaagtacctcgtgaatgaattttaacttaattttggcattgaaatcattaatcctattatgctgagttggttagtcactctgtctaagaccgaagagaccagagttcgactccccaccactgcgcctgaatttttttcctttgcactggcgcgaatctcgatgaatatcgtacgggcaacaattcgactgttttttcttagaaaatctggcgacacatttatagcaaatccgtttgaatttctgcgatttttatgcaaagccacacattctttttttaaactaaaccggcaggagagctgccaattatatttttaataagcagaagtaaaaaactagacgggttataagaaaagaaaaaccaaccacggactggctgaacagttacacagcacatgccagaactcactaacagctgaaaccgctgacggagccgtgtattccttctgcacgatttccgctgctccaaaatcattcatatgcattgtgggaaacgatgcacgtggtgatatatcattgtgggatcgatgaaaaatatgactagaagatgatggtggagatcgatcggaaagtttggtgatttgaatgcacttgaaatcttggaacttgttcgtctttttagaatgactgcatcagaaagaaaataatggattggaggatgcatgttcttactgtcttgcctcctccagcaaaaaaaactaaacctttacatgcatgtgtagcgacatggtgatgacattgtttgatggtgttgagatcgttttatttcgtgatatttttctctttatttataaaaagagcgcacagtcgcacacgctacacatacgaataagccaataaggtaattttcgtggaacaaggagtggatattaaaagttccaccctctccactcgaaaatattcgtatttttgttgtttagcgaagaataagagttaaaaagatatccctgcattcactccaacgatcaatttttgaatttttaatcgcttagattccctcataatcacttaattggctaaaaaattcttagattcgatgcattgaaatcagtgtccagaaatacttatattctgtgtaaattttgattattaatatatatatatatatatatatatatatttatttatatgatacacatatgggactccatggtacccgggctccaaggtataaaacacacaaattttctcaaattttttaaaattttcaaattgtgagtatatacctaggtatatgaattcgattcatacaaatacttaataacaaaacaactcaaactcaactttatttcacaattcattattacatacctaacgaattatatgtttggatgttatatacctagaaccaaaatctaacgaaaaaaaaagttcaatctcagttcaaacttgtttgaacttgttagtaaagaagttaatgttcatatctaaacatttaaaaaaaatttatactcatttaaattggatatatactcaatttaaattttggagcccatactccatgtagcactagttaatttacctatatatatataaaggaaataatatatatatataatatattgaaacatactcgtaaaatggacgatttacaatatattaccactacttatagagttgtaggtagcataaacattccatatagcctttgaggctttggtgtagggtgtatccaaccggagctttgccttgtcggctccgggaaaaggctacgaacgcagccaactctacgagttatccttgcaaatttccaaacgtgatcgataaattcatagccacacaaaagctaactagcctcgtcgtctccaagaggattgttttgaacatttgatggtctcacctaaacaatcgttaattctatatttctacgtcatgttacgaatttatctgttttacccatccctaaagtacgtgttgaatagagaattaagaagcatttacatgtacatgcctgtagcgtggatgtacatatgcatacgcttatataatacgtgtacactcacctttcataaattgatatgcacgtatatactatctctagactaggatattttaagattaataaagtcacatggagtattttccttggtgaaacataggcactcatataaacgcgcggacacttacccctaaaaatataaatctgtacactgtacaccccccctcccccccgcgccccaaaatgagcacctccaaagaccgagtgaacttatctaaaggtttacgaagtcaccgtagacgtttcggtggtgaaaaaagaatcaaaccagcttgatcgtttctatatcacgaatgaaaagaaacacggtatatattaaatgtatcttttcattgaaccgagattttttctaatattagttttacatagtctcacagatcacctatacatttgtccacaaattttatcctaaaaattttatagatgtaattatagtataatcgtgatttaattacactgtaacatatatgtaactttcaaaattttctttgtaacatactatttcagtgaaaacggaggtcatgggaacgaatcctctcacatatatgcgcacaatggcttttttctttcttcacttgtataaattttgaaacaatttttttttcttcgcttgtacaaattttgaaacaaatctaactgttcaaaatcatgtaaaagttacatgcaaataatattatagttacatacaagttacagtgtaattacatccaagttacagtataattaaatgattgtactgtaattatatctgtcaaaatttagaagaaaatttatcgacaaatatatagcaaaattgtttctattatctaattttttttcccaaagtgaacataacccacaatgacacaaggaataagttcactttaggtccctctatttgtcacccagtctgattttcgtccctaaactgcaaaaccaggtataacccatcccccaacttacgaaaaccgagtaaacgaggtctctcggctgttttgataacggttttggctgacgtggcgtctacgtggctaatttgactcggtcttcatctgacgtggcaatgacgtggcgcttaagtggcaattcgatccggaaaaataataaaacatgtgggacccacatgtcagtttcatacacaaaataataaaaatggtgggacccacgtgggccccaatgtcatcctcactcctccctcttctctctatcctctcaatctctctctactctctcttcctaaatccctgtcccccctctctctctcctccctcccctactgcagcgagcggcggcggccggccggcaaggcgcgacggcggcgcgccctctctctcctccctccccttgctgcggcgagcggcgaaggcgggtcggcaaggcgcacactgcggtgcgccctctctctactccctccccttgctgcggcgagcggcggcggcggcgagtagccgccggtgcggaccagctcggctccctacacagcatttgatcggggcagcattaggactggttcaagaagcggcgagcaatcgggcgaagagagaggtggctcgccgatgcacagccgcatcagcgaactccggccgatgtcgcggataaccaggcggccgatgagcggcgacatgggtgtgttcagggatgatggatcgagctatggtttagacaacgacgtgccgacgtctgctgccgcgagctaccgccgccgggcgtcgcctctgagctcccaagaactggaggaatctgtagacctcccattgacgttctgatgctgtctgcctcccaatttcagcctgaaatacataaataagagagtaaatacaaattcattttgaaccctctctggataatctgtgattcttacagtcatataatagaattattatgtgatgtagctcggcagcatattgcacaagcagcttattgcccaagaactatcgtcgtcgtcgatggggtcgtcgggataccaaccgtccgaggcatcgtcgtcgtcattgtacgaatcatccggcgcggcgaggtcgccgttgacggacccggtgttccagagggacctgctgcaggcgctggacaaccttcggagggtcatcgctgcagttgagcagtcgtacggcgtcgaggcgcacctgcaacaagccggcatgcttcccaagagcgcgtcctgcaacgacgccgacgccggcggcggcgacgcgtacgcagcagtcacgcggcgcaactcccgcctcatgcgccgcctcgagtcgcagctcgtgcaggcgctgccccgggacggccgccgctcgccctactccatcggccggagagagggaagggatagagagaagaggggagagagaggatagagaagagagaagagtgaggatggcatatggggcccacgtgggtcccaccattttttaattattttgtttgtgaaactgacatgtggggcccacgagttttattatttttccggatttgccacgtaagcgccacgtcagatgaaaaccgagtcaaattagccacgtaggcgccatgtcacccaaaaccactatcaaaaccgtcgagggacctcgtttgcccgattttcgtaagttgggggatgggtcatacccggttttgcggtttagggaagaaaatcagactgggcgacaaatagagggacctaaagtgaacttattccatgacacaatgccaccacagcaaagtcaccacaatgacacaatgccaccacagcaaagtcctcgcctagcccaacctcccaatgccaacccgtggaccaggcccagcaaagaactacgtctcagaaaccgcctttgatgggcccccgtaagacagtaaatctctcggcccaaacctagcatcaatccggcccatctcagtcagtgcatctgggccacgtggcgcttcgtttctttcctcccctacgtgcgtgtcacgttagtgaacagtccaaaagcccaaaaaagctagcgccaaaaaatcaactccacttcccggtgcgatccgagctcggaagattccgtcctgagacactgacctgtgggcccgacgtcagcggggcccaccttgtcattggccaatccttcgcgtacggcccgcgagtgcggttgcgcggcttttcgcccaaggccgaaaagcaccttttctccttcgatacttttctcacctaggccgaaccctaccccgctgcacacgtggacgttggtgcgtggggcccatgtaccgtgggtcccacggatcagtggctcatattcgaggaggagttgcaatgcacggcgcgttgagcgagtcgagggtgtcagaactcagaggagcggagacgacgagagtcgagaggagacgagagcgacgacgcgacgcgctcgggtgagcgagtgagtgggcgaggaggcgcggcggcggcgccggggagatggatttcgtctgccccggcgatcccgcggtgagcttctcctaaaaccctcccaatccccttcctcctcgtcggagtcgaatgctggagcagcgatcatgagagtttttttttttggttttgttttcatttgaagtgatgttttttttttgggtgcaggcgtgggacgggaggcgattcaccccgtgtttctccgatttatatcctttggtttcgttcgagaaatttggtggtgttcgtggtctctgcgatggcggttgatcgcgcttcggcttcggcgcgtttgtgtttgcgtggtttattgtgttgtttaggccttaacattctacggtgttgggattgagcggaaatgtggttgcggctggtgctgccgttgtgctcttcatctccaggaggaacgcgcggagaactgaggtagtagatctgctctgtttattgccctttgtcagcaaaattcacgagtacaaactacaaagtcgtaggaaggaaatggataatcggtttttgaattcacaatgtctatggaaatcaaacttcaggagtacaaaggtgtaggaagtgatcactagcgttagcggggcattggcttaatttccaacaaattgttcacatgtttgctgcaatttcttttgttaggtatctgaagtgtgaactagtcatacaaatgtttgtttcatagctaagataacatcgtatccagagtaaaaaaaaacattgtatcagcatgtctcgcatgttggatgtgaattggtatttcatatagatgaagcttttatggttgcattgctgattgtttctgtttttggaatgacggtgttcagtaacagatatggttgagattataaacgggatagtggaagctaaagctatttatattcacaactgatggtatgagttgttaggaacttaggatagcgtgaacttcaagcataatgatgtttttgtgcacgaagtggcaaaaacaggggtcattcactatacttctactaaattaaatagaggccgagatccttttattgaatactacctccgtttcaagttataagactttctagcattgtccacattcatatagatgttaatgaatctagacacacatatatgtctagattcattaatatatatataaatgtgggcaatgctagagtcttataatatgaaacggaggaagtaacttatttggactttgaaaccattgggtttgctttgactcaagaaaatcttatcataattagtttcagcaatctagttcgtattctatgtttttgtagaaacaatacttgaacgttctttttcttgaaaagaacagtaggaccaagaaggtccaactattaatttattataaatgaaagataaaatgaagcactcaaaccatgttactt

SEQ ID NO: 65784 - DNA, 1643 bp, Oryza sativa
tatattgctaattatatttttctatggaatcacgtattggtcagcacagaataatgtacttactaaaatagtgaatatcaataaaaattgtttaactaaatttgaatggatcttgtgtcaaattaattagtgatatgaggaaatttgagccattttctcgggatagtatttgtcttgttgtatgcatttgttcgttcttgaaattctgtgaatgattcgtttttacttttccttttcaagtatgatcatctaaaaaaaataaaaaaaaatacaaattaatagttcaattacgttttctaatgccattccccctatactgcaaagtttacaatgcatcacatacatatttgagaactcaatttgaaatctttaaacaaataaatgcagctatatttttgttaaagcacaaataatttagaaaactatgctagaaacacatcctaaaactaaacatatgtactccctccgtcctataataggtgacgttttgactttttatttgcaacgtttgactattcgttttatttgaaaaattagtgcaaatataaaaaaagataagtcatatgtaaagtacttttgataataaatcaaatgataaacaaaataaataataattttaatttttttttaataagacgaatgatcaaatattgataaacaaaaactcaaaaagacaagtaatatgggacggaggtagtatataggaatatcgatagacatataagttagttagagtacctatggattagttagactatacaaatcgataaatacctatgtaaaacagaagggatcttcttaacggcaaacggaattagttggagcaaatcgacgggtaccttcttaattaatgaagcaatgatcaaacatggatttcttaggtacgaccggacttgtcgaagtgtgggtaaatatttcaacacctgatcgaaattcatacctaaatgaatttgagccatgctggatgttgcttcagaagcaaacatgcatgtaaaaaacaaaattagacagaagaagatcaaacctaatcaaatcgtgtcgctgcctaagagaatggatgtgcttgcccagacgtgatgggtttgtgccagcagttgcggctggtcctctgatgcagaaggaaaaaggactcccagcatcacctttgcgtgacgtgagaacgggatgccggagagaacggtcatggccatcgtctgcgcagatcgtcagattggttctcaatgtagcctgccatacgcggatcaagcacgtgcatcgcaaagatcctccgtctgaagcaacatgagaatagtctcaagttgggcagtagaaaggtaccacctccgtctgattttaagtgaagttgtattctccatcttatttaatttttttttatgattaatattattagatgataaaacattaatattattttatgcgtgatttatttttttattttttcatattttttagataagacggacggtcagctgttaggcagtaaaacttataattgcatttaaaatggaattgagggagttgatggtattgcatacttgcatgagctttttataagtaacaagaaaggtagcccatgcatttgcgcgggcatgtatcgtatgctatatttgatgaatctataaatgtgaaatatcatgctttaa

SEQ ID NO: 65785 - DNA, 4362 bp, Oryza sativa
cattgttctaggagaggtcacatcccaaacgtctaatgggcgatcgatcacccgacccatctggtagcgatcagatcccctcccccctccctccctccacctggtttccttttttggcaccgcattactttcctattttagtaaatttatgcatctaaagtttaaacacctcaagtttacacatctaaagtttagagacccaaagttcataagtcaaaagtttatataaccgattcaaatttgaatttaaatttaaatattttctatatatagtatttctatacatctaaagtttatacacctaaagtttatagacccaaagtttataagttaaaagtttacatacccgtttcaaatttgaatttgaattatatctgattcaaatttaaatttgaattcaaatattttctatatatagtatttttatgcatctaaagtttatacacctaaagtttatagacctacaatttataagtcaaaagtttacatacccgattcaaatttgaatttgaattatatctgattcaaatttgaatttgaattcaaatattttctatatatagtatttctatacatcaaaagtttatagacctaaagtttatagacccaaagtttataagccaaacgtttacatagccgattcaaatttgaatttaaattcaaattttttatatatagtatttctatacataaatttttctaactttttttttaaaaaaaattgtgtggtgtattgtagtaagaagagaagaaggggagaagaggaaggaggtattgcctatagaggatggggggatcgcccattacaaccccgtcacatcccctcctagttttttttttttttgacggagggagtatggtttatgtgattcaggctggagctggatagctcgtgtgtgttgcttacattattgttacagtttgagctcagttttccattaatttgcttttgaagactcgtttcttagtctgatgaactgcaaatttgtacactcctccaagagtatagaatatcgctccacaaatttttttcttctttttccggcgcacacaggaggaaagtattattttttaaaaaataatgatataatctaatggtctaagatatcgggtccaccaatttaagtgaaaatcaatggtgagattaaacagtgccatgtggcgatttaggtgtatttgtaggagtgccgcgtggcagtttgagagcgtttgttggaggtttaatggacttttagtagataatagataatagatagaagattattgtgggtgggctgtaacttgagactattctctggagatgatctcatatattgaaaaaaccggatccaactttaaatatagagggcattggctccttttattaattggatttgtttagaagtgaaaagggacatgacaacagttcacccccatgttcctttcattaattgaatttttctagaattgaaaacggacatgacaacaactcacctccatgttgttgatgggaaattggatgtctctttctaaaatattgctatgtttatctttatcttcaaaatatattctccgcctacacactgcacccttgtcttgacaaattacaatcatctctaatttaatttatctatttatctttcctattttattttatccccttccttttaaaaagtctaaagttaactacttcctccatctataattttagcctaataatttataaaaaaaaatgtacagtaaaatgtactagacatctataattgtactttattttgttcttctcgttttaggcatcaaaccttactccctccttgttctctctctttgtttcatctccgtgttaattagttaaagatacggtagctttttaatgtcctgcttaatatattttgattagctaaaattatcgtcttttgtgacacggacgtatattttagaatgatgacaataatatttatggaacaacggatgttgacggtttgaagaacagaggtggaaggcgccggcacaggctcttcgtcagaggtggacgaggcgtcggaagcgccggagctgtgcgacatggctagcaagggagaggtagcggaagactaagatcagagggtcactgataccatgtagaaggagatttggatcaaccgtaactttcattgatcaatggagcttatatttatacatgtacaacaaggcttgggagttgcctgggcctaactaatcccctgatctaagggacgtgcagcggtgcgagcggagcgaggagcgcggcgtcgtgcgcggggtgcgcgtcgtgcgcgtggagcgcgcctcgagagtctgacgaagccgttcgccaacagatatcttgaacaaaatcacttatacggtagctttttatgaaacttgcacttgttaaagacacttcttgaaataggacgcttatcaaaagtgtttttcggattttctctttatattataaggctttggtactagtcaattcacaagttgataccttgattataaggggcatgtatgccatcacccaactacagtactgcccaccaagtggctgccaaggtgacctgtcccggccgagtcaaccggtgtgatggaataataatttggttaatcaattcacatgttgataccatagtaaggagcatgttaccgtagtaaggggcatgtatgccatcacccaactacattactgctcaccaagtggctgcccaagtgacctgccccggcctagtcaaccgatgtgatggaataataatgtggtttcgccgtacacaagttgataccctaacggtaaggggcatgtatgccatgacccaactacagtactggccaccaagtggctgcccaaggtgacctgtcctgtcctagtcatcgagtgtgatagaataataatgtggtttcttcttcgatgagaagattcttttgagaggatatcctctcgtgtaactttttttttcaaatctatccatctactatatactaaaagtctactaatcttcctataaacactctcaactcgccatgtggcattctacaaacactcctacaccgccacgtagcgctataataaattagagaaattaatagaaattctaaggaaaatagaaaacatcgtactgtaccattgattttcatttaaactgatgaacctattattttagaccattaaattattagatctataaaaaaataatatctctctcccagtatacaattgacgtacgagaggaaatccttgcttacaattcatcgtcaaaaaaaaaggcaaaagatatgtcagggttatagataacacatacccaatagtagttgactaagctcggcaggaccaccataataccaagtcttatacgaaaccataccttgtatatagaagaagttcgggataaggaaagacaagtagagttctacatgaaaactataaggaccatcccgatcgtatccatacttatctccctagttctatttgcacaatgagacatctatgggtataaatgcaaggccccctagaaggagagagggacatacataccaagacaagcctagacaaatcaacaagctcagtcagaatagacactaatacacatcgccagacatcgacatcagagatcagtctacacagacccaatttggtgccatcaaaggccgacaatagggaactagtgctttctctaatgttaccaagtacgtattcgaggaggaagattaccccaccgttcactacgtgttggtgctccatgccaccaagtcgacgacgactaggtaggttatctcaaatattgtgcttgcgtaattctaaagaataagagcaacatcggctttggtcaacagtgttatatttaattgggtaattgatccatttaaatcaattaaatcaaataaattccaagcctcattatgttaggaattcatgtgcattcattctcttatgggatatcaatgggatgaggagttttcagaattaatccatttgattagggaattgataacttatatcaattacgcctaattgatggatggttgatgcttgtgtagtggaggatggttcatgactagttaatgacaattagttgctctattccttttcctattccattggtaacctacatcaattactcataattgatggttggttgatggttgtgtagtggaggatggttcatggctaattgatgagaattagttactcttttcctctttctattccatgactcttactcttcatcttccattccacatataaaatgagaatggatttgatctccctaagaagaagtcagacacactttcatccatttccaaggctgttgctgctacggtaatcccatcccgaagagtgcgtgcacacacgttgggagacttggtctctgaaaccacgcactgctg

SEQ ID NO: 65786 - DNA, 3557 bp, Oryza sativa
attcacaccgctccctctattcaaaatccccaaaatggttttaggctgggctcggggtgcatggttttgatagtagcatctcggccgtgtaaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtgggattgggtcggtactcttgtctatggctaggatgggttggaaactatgtcacgtcttccgtccgtataccgtggtggtatgtggcacgtggctacacgtgaggaagaggtgtcttgtgggtaaagatgtacacctctgatcagagtataatctattcgaatagccgcgccctcggttatgggcaagccgagcaatgtacccaagttagtgttttaattcttaaaatttgcttaacaactaaatgtggaatggttggcctgggttggcttgggacgagctgggacccaaggtcgggttgccagttcggtctgagtcatcgtaggccttgggttaaggcaggttcgtgagggttcacggccttgattaataacactgtgtaactctaggatcgtctttataaaatggctttgggcaactaagtgacttttaaatgctgttttctgcaaaacttaacccctatattattaccccttgtatccccttgcattaatcatgcatctgccggtgtggcttgctgagtactgtggttgtactcattcttgctcaatctttcccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgccttttataccatgtttgtgtggtgtaccccggcttttcctgggacggggattaatacactagcgttcgggaaaatgtatttttctcggtcgcgacaagatggtatcagagccatctcgactgtaggataagccaagtggataaaacctaaggacatattttataaataaagctatttgcgaaagttccttttttctccttcccctaatgctatttgcaaaaggtttactcccttcttccttcttcggatttcaactagtactagatggtcaggtcagtgaagaaaaagacatcgtcagttgtttgccgaagctccggaagactgcaggatccgctagcgaagtggaggaagcagtgaagccagctgtgaaggagtgaagatcttcggaaccagtcgtagaacctaagccgtcctctaggatagtgttgttagtcgtgtgtttccttgcttgtgtgtgtagtgcgtggtttgcatcggtgggttgtgatgtgaccatgctaggttgtttgcttaatcaacttgcagaataagcaaaacaaacaacacatcaacaaaaagagttagttcctttaaggtctggtccctagttctggtctattctttcctggcttgtttcctctctcacctcaatccctgtcacagatgtttaacagagaaaaaggaaagaatgtcagcgggtatgcctcaagtaactcaagttttcaactcaatccaccactggcctcaagagagttaacaagggcacacccttggtccattccaagcatgctgcttagttcacagctaccattggttggaagtcaagaccaaaatcagtatgtgtttgatcgagcatttgccacccaggtcaatgagctttcaatgccagaagagcatgtccccttttgtcatgattgtagagagcaaggacactatgccctgaattgtccatgggtatatgccaaagaagccccttcctttggtttagccgggcagacatcgctaaaccagcctcctcgcaccaagtcaagcttgcaggctagtgtacaaagtagagaacccaatggagagaatccattgaatccaaggaaatgctttcctcctagcctttcgtaccacgtggggtcacgtactaagcaagccaaaggcaagaagagtaagaatcagaagagaaaagcgctgatgcgaactgaagaagaagtacgtaagatgactattaccagcaccgaatggcctccagcagggataactattcctagacgtcaaagaggaaataccttccgaggtgcacgacagttgacccagcacctcctaagccatggtggcagagtatctgatagtgaagggtcagatcaagtctcctcggatgatgaagatgagtctccccgacatcttggtgaggaagagatggaatcaaaggcatgcacccgttgtggagaaattggacacgttgctagcaggtgtctcacactctgccctcattgtgaagaagaccatccacccggggagtgtcccacccgcaaggtgacatgttttctgtgcgaaggtacaaaccatgtgcccaaggattgccaactcagtgtgttgttgaccaagaccgcagaaatccaacgaacaaccctacgattgtctcatcagctagtcagctccaacagcaacatcgacgatatcatccacagcaccaatgctcctcctgctgcacctgaccctgcaataaatcatagcaataatatcttcagcaccaaccattctctacaccgacagcctcaacaaagaattgtcgtcgatggaagaagttgtgtctctccccgacctactccaggccgagcaaagggcaatcaacctcaggagggcgataccaagcaaaagaccgtcatccgcttcaaacagcaatcagaaggaagcttctcctgtgaatgatagcaatatgcagtcctatcacatcatcacagaaccaatcaaggatgcagtcactagaacaatgccagctatatctctccagaatcagaatgagtatccatgtttgtgattttcagttcgctacttatcactgtaatcgggagtttgcagcaatcatgtaataaataaatatattcatgttttttgctatgtttatggatgattcatgttgaggatgcaatgtaccgatgttaagcaccttccctttttgtttaaggtagggccttgtattcatgtaataagggagaaatgtgtaacaaaaacaagttctatgaggactctttcggaagatgctgatatgggattatgtgtataattgtttactgtcaaaggagacctagggtctcatttcagaggaaccatgttctaacctcgagttaataaccaacctgctgatggaaaagaaaatcaagcgagtaaccaaagagacatttgtttggactaagagtttcagatgtgtctttttcggatcaaaggcaacgatagttagtatagcttttggcgaaacacttcaaggtttcactgaa

SEQ ID NO: 65787 - DNA, 11477 bp, Oryza sativa
ccccgaatcctggccgagcacctcgcttccatctttggcacggagaaggaccgcgtgaactgccccttctacttcaagatcggcgcgtgccgccatggcgaccgatgctcccgcctgcacaacaagccgtcggtctcgccgacgctgctgctctccaacatgtacctgcgtccggacatgatcacccctggaattgatgctcagggcaaccccatcgaccctgagaagatccaggccgacttcgaggatttctacgaggacatctttgaggaactcagcaagtacggcgagatcgagagcctccacgtgtgtgacaacttcgccgaccacatgatcggcaatgtgtatgttcaattcagggaggaggatcaggccgccagagcgctgcaggcgctgacggggcggtactactccggccgtcctatcattgtcgagttctcgccggtgtccgatttccgggaggccacctgccggcaatatgaagagaacagctgcaaccgtggtgggtactgcaacttcatgcacgtcaaggagatcggcagagacctgaggaagaggttgtttgggcacctgcataggtcccggagaagccatagccatggccggagccgcagcccgagcccgtaccattaccggagggactatgatcggaggagctcatcgcggtccagggaccacgacgattactaccgtggaggtagccacgattactaccgtggaggtagccggaggagcagcgagaggcaccgcagcagctacgacagcgatggcagcaggcggcggcacaggtccaggactaggagtcctgtcagggatggtagcgaggagaggagagctcaaattgagcagtggaaccgtgaaagggaggctgcacaagtgtgatctctggattagttgctgtttgcaatggcccatgtttctcatcttgtactggtagccctagattaaattagcatcatatcttatcttaatgatctgagcttggatgtactcgagattttccttactgaacttgaattttctgtcagatgcatgtgttaactgaacctatttggtgttaaattatatttgtactgatggttgtgtgctttcggttttgttcagcattcggtatgtttttgtgcatgtggtcaggactagctgaatggttgagtaaatctcgagtgatcacgatccacaatgcattccccattcggtagtatgctattgtgcatgtgatcaggtctagctgcagtagaatttgttgacttgtaatgataattgcagcttggagcaccaattgttttttgttttcattcagaggtttcagcacgttgcatcttttagcacctgttagtgagatgaaatgatttacaggtgagatcatttaagttatcattcaaatgtagtagttgatcattcagacgtttcagtatgttgcatcagtgcaggtaaaactaagatgcaggtgggaagagcgacgtaccagctatatttctgaattttctgatatttcggatcttttcatttgtaacctctgaacttatgtttcgcatattttagcaccgtgagttgttatgatacactgccgaactacacatcttcagcgactaggagcaagctagcagcggcctcgtccatgataccagtatatgtttcctacaactgattgttccactgataggatatattgcctatttctcatatctcagacaaccgaagaacccacaaagaagacatctactgcaaataacaatcatctgaacgaaagagctcgataacagatgacaggaaaaggaaaaagaaaaatcatgaacaaaaggaacatgagaaagaaatcagggagcacaagcatgcacaacagattaacagcactgcaaatactgagcaagctggacatctgacgaaacataatgaaatatttcgtggatggctcaattaaccaatgagtttgttcccgctcacaatttatcagcgattctccgcccaaaaaagctacaggtatagcaaccctcttagaaacctaagaaaccaggggtgggtaagatgtcaacttcctattacatgaacaaaaaaaggtagaaactagatgtagatcaaatctacatcttagcttccttagcagcatcctggtattcagcctcaggagtctggtcaccaccactgctgctgctgctgccgccgccactgccgccaccgccaccttgttgcatgtgctctccaatctttgaaactgccttgtttgcagcctcaagcttctgcttgatcttctccaaatcatcctcagccattgctgctcttagatcagatacagcagactgaatctcattggtgacttcagcaggaaccttgtccttgtactcactgacactcttctcaatgctgtagatcgtggtgtctgcagagttcttcagatcaatcaatgatttcctttcctgatccttctgagaatgtagctcagcctccctcaccatcttctcgatatcactttcagacaaaccgcctgaagactttatagtgatttcttgctctttgccagtggacttgtccttggctgacaccttgacaataccattggcatcgatgtcgaatgtgacctcaatctgaggcatacctcttggggctggtggaataccttcaagctggaactcaccaagaagcttgttgtctgtggccatctccctctcaccctggagcaccttgattccaacctgggtctggttgtctgcagcagtggagaagacctgactcttcttggttggaatggttgtgttccgattaattagccttgtgaagatgcctccaagagtctcaataccaagggagaggggagtgacatccagcaaaaggagctccttcacatcacccctcaagatgccaccctgaatggcagctcccatggcaacagcctcatcaggattgacacccttgcttggtgtcttgttgaatatctgagaaacaatatcctgaacctttggcaccctcgtcataccaccaaccagtagaacctcatcaatgtcttttgcagatacgcctgcatccttcaggcagttcacacaggggatgcgagttctctcaatgagagactgcacaagagactcgaactttgatctggtcaaggtaatattgaagtgttttgcaccagtggcatcagcagtaataaaggggaggttgatttcagtctgcatggttgaggaaagctcgaccttggccttctctgcagcttccctgagcctttgcaaggccaacttatccttgctcagatcaatgttgtcagacttcttaaactcactaaccaggtagtcaagcaatgcaccatcaaagtcctcaccaccaaggaaagtatctccattggttgccttgacctgaaaatggtacaaaaagttatgatcagcacacatgtggtacaaaaagttatgatcagcacacatgttcaacagatatgcttaggtttagagtatatgaacatgcaatgagaaagaaaattacctcaaaaactccattggagatctcaaggattgatacatcaaatgtgccaccacccaagtcaaatacagcaatcagaccctccttgttgttcatcccatatgacagagctgcggcagtgggttcattgataatcctcatcacctctagcccggcaatcctaccagcatccttggtagcctggcgctgagcatcattgaaataagctgggacagtgataacagccttggagacagttttgccaaggaaagcctctgcagtttccttcatcttggtgagaacaaatgcaccaatctggcttggggagtactgctgcccacccatctccacccaagcatcaccattaggtcccctgacaatcttgtaaggcaccatcttcatttccttctgagtctgtgggtcatcaaaagttctaccaatcaagcgcttagacccacggaccgtgttctgggcattggtcactgcctgccgactcgcggttatgccaaccaaaagatcaccattctggttcttggcaacaatggagggtgtcgtccttgcgccttccgcattctcaatcactcgtggtgtctgcacaaacagattcattacttctataacaaagcatggctagttcaatattaaccgaatatatagataccaaactaaaagaatgtaacagtaagtcagaacatcctgttaatcacaaattaattccacacaacaactatattcatcactactatactaaagcatccataattcactaataactgaatgtatcactatccaattaaaagaatatcatgactagtcagaatatcctattaatcacaaattgatccaattcagaatatcctattaatcacaaattgttccaattcaacaactatattgcagttcaagatatgctactgaatcaggcaccaattcaagatatgctactgaatcaggcaccaatcaggcaccaactgttttacaaacaagaaaagataacaaatttcgaatggaacagggaaagaaaaaaaagaccacaccttcccttccataacggagacacacgagttggtcgttcccaaatcgatcccaataacatccgcggcggcaggctttgagctgtacacagagcgaatccaatcaaccacccatcaagcacaaagaagagcagttgagatcgacacaaaagacgactactaaattacctgaacgcacgagccactgatccaagcctggacaacagaggagacgccgccgcgtgacgggccatcggagcctggtcagatcaatcaaacaaacaaaatacattacatgagatcacctcaaccatcgcacgcaggcaaatcaacactacagatcccaaaataatattaccacttcaccaagaaaagaaagaagagcagagaggggtggaacctgagaggcggcggaggcgagggcgtggccggtggacctggccagcctcgacgcgatgagagatccgatggccatggcggcggcggtggtggcggcggaggtggagaggaggaggaggaggcggcggcgagatccggaaaaaccctaggcggggtggcggcgagggcttcgctcttaaacccctcgcgggatgcggctctggcttgcaggaggggaaagaaaggcgcggccaggggcatttccgtcatttcggtggggtcgggttgtgtgactgacggtgggcccgggggtcgggggtcgtggggagaaggttctagaccgcatcttagctctcgataggtggcgaagtcagaataattgtttgaatttgttttttcttcttgcgaaggaatactggtagtagtgtttttcttgatgaagaatgcaacaaaacaaatcaaatgcatctagcgaagtttgatttcaatccgcagatattacggaagaactgaaagaataccctgatcaggttataccgaattcgggtctagccgcttagggtcagatcggtagaaagttgatttttttttttgaaaaaaaatacattttttttggatgctctcaccgaatcgaatagcatgaaaattccgagctctattacatttgcccaatgatgaagatttcaagcaatgcagcccattaaatctcctaggcccagctcaacatttggcccataaattccatgatccatctcactatggccgactttcttgtgctcacttgcaaggcacacgagatgaacctctgctttctgaggcctccaaaccctctcttctctaactgaatttttgtttaccagcattcgagggtctgtttggaaagctgaagattatgaaagaagttgtgattgttagaagcttttccaaacaagatttgctctggtccaataaaaaatatctcgagatacggtacctcacgctaataaatcgtttccgatcattggatctacctggacaggacattgttagatccaacgatcgaaaacgatttggtacctcgaggtaccttttgttggatagaagcaaatctcacccaaattactctgcagctatagaattcagaaaatgaactagaaactagctctttcaaaatctcataagctatttatcaaactgtttctcagaaataaactctccatccgttagttaccgtgctggagttttaagaccataggaattaacacttctcttgaagaagtgctacctgctgctgcatagagcatcagaaatgactgctataaatcacaagcagttttccacggatcaacaggttgagatgaaagcctgaaacggatgcatatacactgagcacaaagctgcatctgaatcctgaatggagcagagcagctgagaatgaggacagaaaacacatttactgaaaaaatgtgtttcagtgacaagttcagtgttcactcctgggtatcaggcatacggtaaacatggggaagccggcaaggttcatcgtctacaaggcctgccttcttgtaggattcgacgctgtcggcgagcgtctcctcaagtttcctaggtttccagcccaactttgtcggtttctccgatgtcaattcgaccttgttgcccacatcaaccaatctgaccaaggaaaaaaaaaacagagagagaggagctgctcaaatcgtgttcatgttttgagcacaaaacacttagggcttgttcccttcgttgagaaaaaaacaacttacaaaactatggtaataccaaattttggtaagttaaagttaggtggtgtatggcctgaggttttggcaaaatttggcaagtagctgcagttacttaaacgagtagctgcagttagggtacatgctcttcatcaaatccaccaaatccttcatgtccatttggtcttgagcacatatgtacctctcacatggccctgacttgtcatacatgatacactagaagtaaagaatcagtgacatcacggacatccactatgggccaaaaattgttgttcataacatcagggcgtcctggattgcaaccaaaaatccaaaactaatttagtcagcgtacaagaggaaatacgtattagaaagctagaaactactccctccgtcctaaaattaattgacttttgtacacgaatctaaacataggatacattcatattcctttacacaaattgatttatcataggacgaagggaggagggtgcctttgagggtgaacctttcatgatgtagaggagaactctgctgctggtgttgagttgcatggtatgcaacagtgggccaaagacaagggcagggcaaactgtaatgacatgcagtccatttttctctgaatattccagggctatctcttcagcttcggtcttggcaaagctgtaccagttctgccaacacaagaatatatttggaggtcaataaattagtccccgaaagataaattaatgctgcacgaagaacagtttaatttgcaatatctgaccttattttctctgcagaactccttgtctgaccagcaagtctcatctctcaccctgtcttgaggccagctcgggtaaagcacacagcaccaatggaggagaccatgacgagtttctgaacaccggaagctgagcaagcctcgagcacatttttggtgcctttcacagcaggaaccatcatctccttctgcatgtatatatgatcaccagctagattgtaagattgtagaagagttattgtacaaatatatatttctttagagaagggtattttttatccagcatctacatacaatcggatatatgcattatttagttacttagccccttaaataaccaaatctaaaagctttttttttaaattggaaacttagcccctcaaataacccaatttaaaattcgtttatatggagatttgaactcagaaccttagagcgccactcaggtcactgtaaccattagactacatgtcctttcacaattgtacaaatatatacttatcggacacgtatcctattcggtgctgcatatgcagtagttgtaactgacacgtgggtcgtacttgcaccaaacccagacccagtgacccacatgtcaatgacgcatgttacgcatatcagggttcacatatcacatatcagtgacacccactgcatatgtagtgttgtagaggatcccactccacacttgcctatggatcaaccgtctcgtcttccggcaccgaagtgccggtatggaagaccccctcgcagccggtgaacgccaccgtcagagcgtcgccgttgagctcgtcggccttgaacaggtgcaggttccccggagccaatgtccagctgcttcagaaacgcgtccctgggatcatctgaaacaagaacacgtataatcaccatacctgacctgacaacaaaggaaaagatcgatgaacataagcaaatatactgacgtgcaattctttttgcgcgtttgcaaaaagccgaaaaagatgaacatcagcaagaagtcgatcgagaggtccatgcctgggtcggctgcaacacaaaactacaaaagtccattgctactgctctgctagtagcatcaaacatttgtttaatcgggtggcggatatattaaaattacacacacaattgtccatcttaatcagtagacaatattcaattattgccaggcataaattgtgtcattgatcacaggctgaatcaattcactaatggaacagagcagatgataatgtggacactggacaggaacacctgatccctcatctattacagtattattggaaactttttttttcagtgacaattagatcaagaacagtagcagcaagacggcgccggctgttcactcctgagcatctggtgcacggtaaagatggggaagccggcaaggttcgtcatctacaaagcctgccttcttgtaggattcaacgctgtcgacaagcgtctcctcgagtttcctaggtttccagcccagcttcttcagcttctctgatgtcaattcaacactcgtagtcatatccacatcaaccactctgcaaaaataattgtgttcatcttgtgatactgatgcaataacctgatgtcatttcagtttctctgtcatgaataggatagttgatgatgataatgatacaaggcaaattacttggctgtgtagctgtagttagggtacatgctcttcatcaaatccaacaaatccctcatgtccatttgttcttgagaacagatgtatcgctcagatggccctgccttgtcgtacactagaagtaaagcatcggcgacatcgcggacatcgactatgggaaagaatttgttgcttagtgcatcagggcctcctgcgttgcaaccaaaactgatggaatcagtgcaccaatcaccagaacaaacaaaaactgtagaaactataaaccattgagaaaagctagaaaacagataccgtttgcacggtatagttaggcccggtttagttccccaattttttttcccaaaaacatcagatcaaatctttagacacatgcatagattaaagaaaaactaattgcacagtttgcatgaaaatcgcgagacgaatattttaagcctaattaatccataattagccataagtgctatagtaacccacatgtgctaatgatgaattaattaggctcaagagattcgtctcgcggtttccagacgaattatgaaattagttttttcattcatgtccgaaaaccccttccaacatccggtcaaacgtccgatgtaattcctaaaaattttcttttcgagaactaaacagggccttaatagaacctgctccctgcttgcatatgatctgacacatgcattctcacaaatcacaagcaactttccacttctcatacggatagctcgggaagataaaaaatgacgagaagtagggtccatgttgaatatgtgcggatgagatgacatgggccctccggatttccattgatgtccacatataaaatggaccctagcttggcatgcagctacaaaattttttagaaatttgttacgttgtactattgaagcagcaccgatgaggggaaagtcactaaattgtccccttttctttcttattttttgattttgtttttttaagatgaaaccttctaattttcatctcaattaatcggtacctaggtaccaaacatgatactatacctatattactatctttgatatatatctaggtacctagtctgagacccataagtatcatatccgatacaataagtgccatgtttgatacctattggtaccatgttcaatacctacgtacttggtctgatactcgtgggtatcacatccgatacttaggtatcaagtctagtattcgtggataccatatccggtacctaggtatcaggtctgatacctatggtaccatatccgatacctagtaaccaagtcccatacttatggtaccatatttgagacctcaggtctgatacctatggtaccatatctgatacctagtaaccaagtctaatagtacttatggtaccatatttgagacctcaggtctgatacctatggataccatttccgatacctagtaaccaagtccaatacggtaccatatctaggacataattaccatgtcagatacccatgagcaccaacaagtttgatacaaatagacatgatatgtatctccaaatattagtatcatcacatgtatcaatctaggtgactcaacctaattggtcagcctagctctcattccctattttataaaaaaaaagaaataacgaagagcatctatccattacatattggcccgactccatccaagccacctagcacataggcatgtcagagcatgtggcctagctctgtagtcgtcccatctatcaaaattatacatgaagcttgaaagttagggagtgtttagattcaggggtgtaaagttttggcgtgtcacatcgggtattatatagggtgtcgcatggggtgttcgggcactaataaaaaaactaattatagaattcgtcagtaaaccgcgagacgaatttattaagcctaattaatccgtcattagcaaatgtttactgtagcaccacattgtcaaatcatggcgcaattaggcttaaaagattcgtatcgcaatttcctggctaattgtgtaattggtttttgttaatccacatttaatactctatgcatatatccaaacattcgatgtgatgggtgaaaagtttttattttgggaactaaacaaggtctaactatgccgttcggacgggatagcgtgctctagtttctctccattgagaaaagagggtgaggtgaacctttcatgatgtagagcagaactttgctgctggtgttgagtagcacagtctgcaacagtggcccaaagataacgccagggcaaaccgtaatgacatgcagtccatttttctctgaatattccagggccatctcttcagcttcggtcttggcaagacagtaccagttctgccaacacaagaatttgaggttcataaattaatcctagctactattaaccaggaaatccaacgaaaggctaaaagagctttttttcccccttttctttttgcagttgtctgaactctgaagtgttaagctgctatctgtagaacactagtttggcaacat

SEQ ID NO: 65788 - DNA, 34398 bp, Oryza sativa
aaagtcaacagcgtcatctattaaaaaatggaggtagtataatttaacatacaaactttaaatccaacttgaatatgagatctagagctgtgcaagggatgcctgatcggcgaccagccgagcggggctgcacccgcgcggtcagtcctgcccctctagtcccattagtatatactccctctatctcataatataaagcgtgctcatattacaagattcaactttaaaaacatttgaccaacaattattataatataaattaaattttatttgctaaaattaatatcattagattaacatttaaatgtactttaagatgattataattttgttgcaataaaccttatagcatatgagaaattataagtcaaaaattagttttgaagaccgtgctaagtttgaccatgccttatattatgggatggagggagtacgtatgtatatactttatatatgtacgtatatactttatatacatacgtataaactttgtatgtatataaagtatatatatgcgtgtgtatatgatgtatataaaaaatatgatatatatatatatatatatagttttgatgtataaaaaatatacacgtacataaaatttgtatatggcatatacaaactttgtatacgtgtatactccctccgtactcgtaaaggaagacgtttaggacaatgtttaagtcaaaccttgggaatataaatcatgaataactctcaagttgttgagtttgaaaatgtaaaaattatatgaatagatttgtcttgaaaaatactttcataaaagtatacatatatcacttttcaataaacatttttatagaaacaagaagtcaaagttgtgttttggagaccgtgtcgctgtccaaaacgacttcctttacaagtacggagggagtacatacatacatatacaaagtttgcatacacatatacaaactttgtattcgtacgtataaaaaactaaaggaaaaaaaaccaaaaaagcaaaagaaataaagaaaaacataaaatagaaaaaaccgaacggggacacgtgtaccatctaccgtgctcatcccgccccgcccccctctgcatccgccacatgccgcgctgttgatgaaaaaatcgaacacaccggcctgggagatctgcttagctcctgtgcaggtccaaagattgatgagatgcggacgtgccagtcaatttaatcctgtaactgacaagatttgcaaataatagatcaaacagccgatcggctgacaagccgatggagtagttccagccgatagccgataatagccgatgccgatacaagccgatagcgatagggtttaagcaatcggctatatgtcaaatgtagatactgatataaaggcaatcggctgatgatgatgtaatatagcaatataatcctgtataaaccaatcggctaacaatatgatatagtagaacaagtattgatccgaaggttaaagcacccatcggctggaggtccgatgtcatgaaatccacaagattagattaaacaatgaaacctttgttgccatcggctaaatccaacttatatgtatatgcaatccttatgagccgatgcaacgtccatgtaactcaccagctgaaaccccgatgaaacccttactggcaatcaataagcagtctagagattatggttctaagcacgacttagtagatcaaacttaactgatgcaacactaagtatgaaaagaaacacaatatctagacaatcaagccgttgactgattttcagggtggtagatgcctaggctaattgtcggagcccaaaactaacaacttggatccgactgagattattgtatcaatccctggatcagtaaaaattgatacatacaatataactggttctttattgcatatgttaaagtcttacaatactaagggttttacaataataggtactcacctatctaattagtacacagcggaagtttctatacattctgactagtgaggtaaaaccctcagggattttctaagttatcggggtcttcgtagtaatagtcatatgggtcctcctcttgacccagatctgaaaaaggggttataagagcaaggatgagtattcacaatactcagcaagttatcatggaaatatgttatgcattgacatataatagggttctttgcaaaaagcggtattagacaatctggaaaagttatagcagaatttataaaacatataaactttagatttctaaccagggtaccatatgagtcccagtactcaactccatgagtacggctattcgaatagtttcaaagatattctactgcagcagatgtacgttttacccgcagtccacgacttgctgataattatcggctttagtcatggcccagtattaagtcaataacaattatggcacctgttccatgaacttatatcctcatatgctctgaacgtaatgttaacagcagcaagaggagttctggcgttcccgaggtatttaaggggaactgatcgtatgacaccacgtcatttcgatcagggtttagaaatataccatatagtttatactcgagtatcacaaaccatttacctgtacatggtaatggttaaagttgcccttcgcggctatagttgcctcctgcgcgaggacttaaaaataagaaccactatacagaggtgccatattgctaattaacataataactaggtctgtccccattctagaatctgcggtcgtacccgttcgttcgacataagtacctgttaaaacttatatcgattgagacaatactagccacctggaaatcatccaaatcttacgtattgtcccaatctaagtatagggtattttaaccagattgtaagcaaaataagcaatactaaattatctgggtttctatgattaatttatgcatagaaaatagaatattgaatagaaggctataaataaataaatgatttgtaaaatataggcttaaatgatcaacaggtatatggtaacttgccttgctcgatgtcctgagattgattgatattatctagagtgtcagaggaatcctcaagacctagggttagacatataaaatttaaattcaaaaggagtttaaataaaatccaaaaataagaaaaatagagaaaataaaataaaataaaatgaaaaaatagcaaaaaggggctcaatagatagagaatgattttagaagaatattggttcaagtttcactgaaattggatctatattttaaaagatatggacttctaaagtttgaaaatcaaataaatgtgaaatggcactgtgggtgggtcccacctgtcagtctctctctctcttctcttcttcaacctccagccgttccccaattccagccggcggcgctagggttggcgattgcggcggcgatggagggggaaagtggttgcggccgaggaggggagggagctagggatctccggcgacggcgagcggcggcggaggagttaatttgatgcgtggacggcctagcggctacggcggcggtggcacggttaggccgagatggcgatcaaggtgataagagttaaacatggctaggggaggggttctagagcatctacgaggtgcctagagggattccggtagcttgccaacctttggcaaggcgcggaacatagttgtcgacgagcgcctccataggccgcggccgtgctcacgtcggcagctcagagggtggcatgttagtgcaaagggattgctaaaatggaatctaggtagtatgtagatgattgaaacggaaaaactcaccgagatcggttgaaatgacggattgcggcggtgaagaacagagcagcgcgggggcggcggtgctcggcttggtgcggcgaggtaaaaatcgacgcagggctttggttagggcttagtatactagaacatggtatgatataggtgttctaagggttatttagggcggaagatggatggagaggggtggagtcgatcgcgcacaaggtgttcgaccgacgggcgagggtggttgatgagatggattggtgaagcagagcttcggggttgtggggctatggttgttgatgatcgatgatggacagggaagggattggggtcctatttatagggctaggaggagcggatgagctcgggcaccttcatcgccatggatgagctcgggatttggatgaggcaaaggtggcagaggctgagagagggcgggcaagatcgatttgagtggcgggaggccacgttcgaatacttaccggcgaaggattgacttgaccgtagttggaatcggctggcgacgtgttggcgccaatccgagcacgacgcgcggcagcggcgagggtgaaaatggccggctcgggggtgaatggtttgaattgtgagaggggataccaccatctatctccaatccaaccatgcggcaagaattggcgcgattcaccccgggtagaagcaaaatcgcactcggcggcggcttggacgggtgcgcacggcgtcgagcggcaatttcttgcggcgatcgtcgtcctggctttgtcgtcgtcaagattggtgcggcgacggtgggctgagggcgtcggacgggcgacggcgcgccaaggcagtcgggcacgtgcaaacggccccaaggccgacgcgcggcgacacggcgcgcagcaaaatcggatgccagtgcggtgtgtgcaaggggaggaagaagtaaagaaatccacggtttttgagtggggtgtggtccctaggatcaaatctaaactttgtgcaagattggatggagttgggctgctctaggtgggctagacattctaccgaacaccttatgtgcaatgaacagtagaattcagaatttttgaatatttcctagaaaagatttgaattcaaactaggagtttggaaaggtttcactagggtttagagtatagcaaatctccactaatattagggtaagctaaagaaataatctatggtttgaatttgagagaatttgctcaaattcactagggtttagaataaagggaataagttagagtaaattggttgggttataatacttaaaccaattttaaataaaaatcaaatagatttttgaaccaaacaaatttaattaaaagccagaatgatgcagtcaaattttagtttaaaatttgaggatgtttgtcacaccccgaagttctcctcccaagcctaaaatttaatttataaatgatcctaagaaaatgcaggtgcaaatcaaaagaaaaccctaagaaggtaatgcaaataataatcggatttgacatgtggaatttttcttgagttctacatgtcgaaattcattaacaggatttttagtggaattttcagagctctagaaataattttaaccaattaaaattgagcaagcaatattttaattccagggaaaatcctttttcctttttctttttctttttcctctctttttcctttttttttctttcgaatgggccgtcggcccattctctcctttcctccccccctcctccctgctgggctggccgcaggccgaggcccagccaggccgtcccgccgccctcctctccggggtcgccgacaggtggggcccacctgtcgggtccttcccccacctcccgccgctctcgctcgcgccgccgcgctcgcaaccgccgccgcgcccacgtctccgcctccttcgggccacgtcgaccacgcacgcgcgtgcgccgcgtttcccgcgcccactcccctctctctcccgctcgcgcccgcgcccgagatggccgggattcgattttcgaatcccgcctctctctcctcccccactcccccacgtcggccggcgattcccgcctctcccggccacgcccggtcctctctctccctatttaagcttccccgtcgctccctctcactttttccccattccgccgtactctctcgagcctcccatcgctcccgcgccgtgcaaccccttgccgccgccttttccgctactccggccgccgctagccgccgttagggtcgccgccaggccgcgccgtcgccgccgtcgggttcgcgtggccgagatccaccccgtccacccctcctccgtcgaggttcgtcaccggagccctcgttccctcgcactcgggtgagcaccacctctaccgccgccttcggccatggtttccggtcgccgtggtccatctccctctctctaatccctctcttctccttccttagggcaccccgaagctcatccgcccgccgacgtcgtcctcccgtggcttgccgtcgctgttcgccatcgtcttcctccgcgccggccaccctcggtgaggcaccccctcccctctttttcccctccctctccctcctagccgccgctttagcgccgccgcccgttagtcgtcgctttagcatcaccgcccttcggcgccgcctttgcgccgccgtctccgccgtcggttgctgtcgtcggcaacgcacgtgcgcgtgcgcacgccgtcgccgtgaccggtcggccggctttgtgccgagccgagcctagcctgaccgccgccgcaccgtccgatcggccccgggccgatccgggccgtcgatcccgtggatcggcggtggatcacccgcgtggtcccggtccacggtagaccggccacccttgagtcgctgaccagtggggcccgcatatcggcgccgcaccccctccgtgctgacgtcagccctggggcaatattgcgcaataaattgattaaggcttttctttaatagtaaaaacacatagaatcttctaaaaatcataactaattcatccgagctccgattaaatccattcaagtctcagtaaattcataaaaatgtgtagaatccattaaaaatggctttgttatctgtttcagtagtcttatagcatgttttgcttgtgtgctttatttgtcgcgtagatttcgcccgtttcgtcgattcgtggtttctcgaagacgttgctgtggttccatcagtgcgagagcaaggcaagtcatacattgcaattgatcatattgtacccaatttacaaatgtcccgcatttctattaaatattgcattgttttacaatatcatgtgggattggtcctattactcagctatatgttgtttcccttacgccattgataacttgggtattaaaatgactagatgttggtttaggagatgcttagccatgcttagttcaactagtgcacaaagggggatcacattaaagcatagacttgattattggtatagctttgatttagtgccaccgtaattgtgttggttaattaaaatacacgtcatggtgggctgtgggtgcatggtcttgctagtcgcacccatggcatttaaggaccggttcgcgggatgccctggaagaatttatcgtacttaccacaagctagcgtgggcaacggctgggcttgtagtgtagcttttctctagccgacgtacccaggcgagggtgggcgtgatggagttgggtcggccgaggtgtccggttgatcggcttccggattcaccgcggcacaaaaggggggctgcccgttgcctgctggggacgggggcgaaccctaaggtgtggtgcgatcggttagagggggttatgcgaagggtcctgtcacggcctctttccggtatgtcgtggtggtatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactggttagttcaggtggtggtttgggcctgttgcaacgtggtgtaacgttggacagtgattggttaatatggattaattactacaactgttttacggctttcaactactgcttgaaatgccggctttatgcaaaagaacctttagcctcccttggatatatcttgcatcatacctcctcttccggtgtgacttgctgagtacagtgggtagtactcagtcttgctctcttttcccccacaccagagttgaagtccttcccagttgaggatgtctcgaagaggttggtttcgtcgctgccgtcaaggatgcctgtggaatggagtcgcccgctgcaggagtcaagccttcaggcttagctcgcttttatctttttccgctgcatttgtaatcttttatgatgtttgtaagacgtggatctgaatgtcaacactgtcgtttgtgtaccccggctggtcctggacggggattttaatgcacattctgcttggaattctattcgggaatttctgggcgtgacaatgttacactaatctaatctagtaacgcgatttagccgataccggcagaaaccctaaagcgagagacagccgatatagctaaattgatatgctaagactagattaacagagacatgataaataggtaggcaaatatatcatctaaaccagagcaatccaagaggtcgaatgtaatgatgcagccttgaacgacgccgatgtagatgagacaattgcctggaccgacggaactttggacttatcctttcgtcggagatcgaagacgatgcagccccgcgtcgggtgccaagttccgccggaacgtaaaaaacaaaagtagaagtaaaaagggtggcgatgcgccgaattgtattgatcgtagcgatagattacatagaccccgggtgtatatatttatacccatgggttgatacaagtccttgtcggacaagaaagaaactaacctaaagataaaaggaaaatataaagtccttatcggacactaaacacattttcctaaagataaaaggaaactaacaaattattcctaattaatagataaactgacatgccgcatcctctttaaactcggtcacttaaggataaacttcatttagtagattgattttcttaaccgaatatagcaggaatccgactattggcgactttataactcccatcggctgattccgagatgctgcagccgataatgattctaagccgatgacgtctttgccgattaccaaatttcactgttaacacgcgccccgccccgggggggtgggggggtgctgttcgccgattagctttttcgctttgcagatcctaaaattccttcgaaccgaaaaccctaactgagtacggagctggaacgtactccctcagtcccaaaaagaccaacctagtacaacgaatcaatgtgaccctttctaataaaatgaatcaatgtggcccctcctagtacaacgatgaagttgccttttgtttttgggacggagtaaatactggagacgtcttcgaagcgaaacggctgccaaggagaccagctgttgggcttcaagaagtccggcccattttgggtagctcacgggactcaaggcccaaacccatatagccagaagtgggccatcctaaaactaaccgaattgggcctcatttaattcctcgattcttctgacagacgcatccacgagtggcacgcatggaacagccgctccccaccgccgcggcggaggcggccgccgccggcggcgacggcgaggcctaccggatccggccgctggagctcgccgacatctccagggggtttctgggcctcctcaaccagctctccccctcgccgcccctcacggaggaggccttccgcgcgcggttcgaggagctcgcggcgctgggcgccgaccacctcgtcctcgtcgcggaggacgccgccacgggccgcctcgccgccgcgggggccgtgctcgtggagcgcaagttcatacggcggtgcggccgggtggggcacgtcgaggacgtcgtggtggacgccgccgcgcgcggccgcgggctcggggagcgcgtcgtgcgccgcctcgtggagcacgcgagggggaggggttgctacaaggtcatcatcaactgcaccccggagctgacggggttctacgccaagtgcgggttcgtggagaagaacgtccagatggggctctacttctgaattctgatctaggtttcgtcttcttggatctctctgcctactacttgttgtacttagttaataaggaattttatgtcagttattgctccttgtatggatggatggatcactgatcaatgtggctaattccatttgcattgccaagatgtgcaagtttatttaattgaatggattgttctctgcatttatgtgcaaatctcattcttgcaaatgatttcaatgagtaaaagtaccataataatcgcaaacaaaatttatagtgcaaacctgtgacagtatggtttcgtattacatcgctcctgcctttgagaaattgagagtgatagtatcacttttaacagtttctgagtcgtatgaggccatcaggggggttagcgtggctgataaacaaaggttcagttatgttgcagcacttaaattgctggaggatatcaatccttccttatttccatcaatgacttgacacagtgtggtttgatctgatcacctctttagtttggaaacatttaggtagaaaagatttcaacattcacaagtactgttgtaattgaactcagtgtctactttatgagtaagcgctgttttgaatgtattcttagctttaggttggcgctaattaccttctctttctgacaaaaatgctccttatgttcatacagcattctttcatctatatcagaatttttagcataagttcaataccacatccaaagtaccctttagaacagtaaagttcagtagtatacaaaggtatatcaaaccaaggaggtgcatttgatacaagtaagtcattattcatgaggctacaagtaaatcatggatgcttgtgttggaagagcaaaacttctagaccatgcaatgcctagtttgaagttatgaacaatccactctttgcttgcgatggggaagtttatttattcttgtaaggtaacacttactttcatctctcttaatcctccactcctttagtctattattatgtttagttgttgattacttgatttcatactccagtttgttgacagcgatggtcctgttaattaaggcatgatcatatctttttaaatcaggtctagaggctaagattctttccattgtgttatagtagtggctcagcgagattgtgtcatactagtaactactattttgaatgcacaagggcaagccaaccgaagtcctagtgatagatgaatattctgtgattggttggcattataccaaggagtagtgggaatgtaaaggtggaaaaatgtctgaatagcgtcagaaaggttacataattcgaatagtatggtagtggatccctgaatcagcttgtgctggattgcttcttttgctttcttttaccaccctggtttccaaaatttgaattgacctgacttttgatcataatgatctttcaaagaaaaaaaaaaacttttgatcataatgcaaccagctggtgatcttgcctatcagcctatgccacaagtgctctctgaaattcacagttcatgaacctcatttggaagtaacattattaccaaaagttcacttttaaaatcttctagaggcagggagccagctttgactgcttattgtccctattagtatctgctttgcatagtactctcgctttcgtgttgtaccgtcaaaaggtttatcgttactgtttatgccattgtgatagatcatagatggcctctttggctttgtcatgatgcaggtgcaagtgctgagtcgccccctatcatagatggcaccaaagcaggttcttcccagactttgataactctggagtctggaccttcacacatggagaatccccaaggtggaggaattattgaggattttgctggcactgcatctcctgcgtcgtatgtctgaaccaccacaatgcattgcatcgtattcattcagaggatgagccagccattctccattgccagatccacgcgacagtacatttttccatcccaatcaagacctgacaaacctgaaggtaccgtcatgtggccagctcttctcctcccttgtgccgttcaagttgtcacagactcacagtgctttgcattgtaggatccgggacatgatttctctgtggtggccatggcaacaaacaactttgctgctcggttgcagcacgaggtgtggtgtagtgcagtgttagttgctgcccacttttaattggcttccactgttgcagtggctctcctcatcatccttcccacttattatcataggcacgctgctgccctttttaccactcttcgtctctcatccattccaattcttgtgcatgcagggctgcaggcactatctctttctcatctgcttcataccaaacctacgcttttatcctgaagaaagactggcaggcaatatgggtttcttgcagtgactaaaaccaccttcgttcagtgttcatcgaggacatggaggtacggtaccgttgtcgcgttctgcacttctgcgttgcatgcttgtttgtagactgtatgtattgctgacaccaccacggcatggcgacggcttgcgtgtgtaggggtgtaagttgttaagccgtgaacccacttatagatcaaaataagcaggttcatggcttgttttgttttataagtgaattttacgggttggccacttacaaactcctgtgtgtgtgtgcgcgtgcgtccaaaaacaaatgcaacacaatgttgagctttctttaacaatgaaaatggtgaacaggtatgtagcctagtgcttgtagctctctagtagagtttatcagctcctgagttcgactctcctcgggatgaatttccaatgttgatttagcaaaggatcactttatggccctttggttaaaacatgtgttaagaaacggacttatgatgaatatgttcttgagtacggagcagtgaccttaaagcacgggttaaggctcaaccatggggagcgaaaccgtgtgttaagagaccaaggtttaagacatgatctatggtggacaggccctcatgtacggggtaattaaggacctcaaagcacagattaaagctttgtttgatttactttaggattattataatctaaattattagaaataagctgaaacaaacagatagcttattatgatagattattataatctataaaccagattactataatctaatctagtaattcactataaatgtgcttattttagattattaggttgctaacagctaacaaacagcttataatccagagaaacaaacagctcacagcttattctatgtcggcttattataattcagcttacagtaatttgactcaataatctagattataataattttaagctgaaacaaacagggcctgaggctcgaattatagaggacggatccacatgttaaggatcaggctcgtgatctttctcagccggctttggttaagatttattattcttagcttagagcaagtttaatagtatagccaactactagctccaaatcatttatagtcaatttaatagccaatttatacaataattacctataaatatatactacactattaatatcttgggagtccgtgctgtagctgtccctataaatatgtagcccactactcttctattccctctttcatctctttaaaatatgtttatagttggcttatagtctactattgtacctactcttaaaaaacagtgggtgtggtctttctcatgccggtctgagcttgtcaaagtttttttttcaaggactaaactatggcctggtttagttccccaaaaatatttccaaaaacatcacatcgaacctttggacatatgcatagagcattaagtatagattaaaaaactaattacacagttaggagggaaatcgcgagataaatattttgagcctaatttatccatcattagccataaagtaacctacatgtgctaatgacggattaattaggctcagaagattcgtctcgcggtttccagacgagttacgtaattagttttttcattcgtgtccgaaagctccttctgacatccgataaacatctgatatgacgtccaaatttttttttttcgcgaactaaacagcccctatgtcatggtgtttgggcttataaatagagctaagcttgtggctggtttttggtcggtcgctggtggcttgcctttccgggcaagagccaagagggaaaacaaaagagcggcaagacggctggggtcggtgacggactgacggctgcaaggcgacgcgacggcgacggcgactcagcaaaagttcctccatgatcctctcaagaaaagggagaaaagcttgttgatgttgcctgctcggcctcccctttttaaccgtgtggctggatcgtcttctgacttgtaatcaccggcccgtgaacgatcagtggccgagtgtgagtgacactgtttgcgattgctcatatttctctaataagtcaaaataacttattaaaaaatataatttataggtaaaacttttacatatttattcatagcgacttaaaaaattaaaaaaacattaaaaatatcttaaaattaactttaaaatcaagttggaaaattcaaatttggtttggtttattaggctaactgacggggctctcaatctagaaaagaaattctatcagttaatcacatcatgatatttacttggtgctttctagttaagacattagacttctctaattggcacccaagaagatttggacatgatgtacagtacgtcctaaagagacgtgagttagcccatgactccgcaccgttttgtttctgcatgggacgcaatgatcgatgggcatagtccggttaaccgcagctactaactaaaaagttcattgcaaagagtagcaggcaagtcctcaccagggtatttttattccataatcttaaaattttagtagtaatagtaccgtagtagctatagtagctaattaaccgtctagcaagttaatagataacgacgattgcaaaattttgaccttgaagataaaaaaagagcttttgaagcttgtgcaatctgctaagtactcttgatattaccgtgctgacgtgttgatgatagacttgcactatctaatcatggtgtcttttgtgaccatcattcacttaattaccctgcctttttcttttccaacttctacatcggcctttcaaagcagtaatctacataaaaccggaaaaaagagagcacttttttatactttgatgaaacactttacatcatgaataaccaagcactataaagtactccaagaagcaacaaaaaatttcaaaagtccggaggaaagaagcgagaaaaatattggttggcgcagttgcgtcgctttcattcaccgtggtggccctcgcgcgcacgaaacagatgggggccttatcgccgtcgtaatcacgggagcggttttctcagccgtcggattggcaaggggcaccgatccgacggctgatgttgcgcccacaagatagccggtgatgcagacgttcactcaaaagataccgccgcctctaggaaattggtaggtacactcacacatgcagggaccactttgggttttccactcccctgcaagaaatgaaagttttctctataagagcaagtttaatagtatagcccactactaactccaattcatctataaccaatctaatagtcaattcatataatagttgcttactactacctctgtttcataatgtaagactttttagcattgtctgtattcatatagatatgtgtctagattcattaacatctatatgaatatgagcaatgctagaaagacttacattataaaacggatgaagtatattattaatatatggttccacctgtcatatacaactgcgtcttggaatccatgctgcagctggctacagatctgtagcccgctggtcttctctctcatcttttatctcattaaaatatgcttatatctggctaatagtctgctattgtacctactctaatacatctccagtaaatatataaaactgttagaggatgtgatcttctaccacgcatatggatgcccctcgcccagagcccgacaagggtacacgtcacgctaccgcttgattgactggggagccgcctaccacggaccatggtgtcttccctcctcttctcccttcctctcctgaacaatcgcagtgagtcagtgtggctgggcttattgaacattgtcggacaatgggcaccccatgtcgtagtttgacaactttcgcctaggcctcatcaaggtgccaacgaggtggtcaaatgtatgtagccgtggtaagactactctattgaactctaacgagcacaccagcagctactacggtctacggtggaatgttttggtgtaaccccctaggtgtagcttacacggttgcgcggaggaggcaacctgggtgaaggtgttggagatgacgctaagaggcgatatcggcgatgcacttcaataatgtgagcttggtggatgggttcaacgtaccggtgggaggtggcgttgggttaagagtggttgattggctaaaggtaagatgggaagaaattcgaatagtggtgattagagggaacattaaaataatgaaggggtacaacagtactacgtggtatggtttgaggatttaatttgatagtatcctctatttctcgaggtgtacgttacaggtgtgctcgtaaggtttgtggtgtacgtacatgcagtgtgcacgtgtgtgcatcttttgtatagtaaaataaatatgtatatcttcattaatttttgaaacttgataagaaaatttcataaaaaaacctaaaaatgcactgtcaaacagcatggttttccttattatttttttaggcccatttgaattataggaatgaaaaaacaaaggaataaaaaaagattttaataggaatgcaagtgcaaaatagaggattggaaaatacagaaaaaaacatataaatgatcgtttgattggatcacatgaaaaacataggaatcagatgagagagatagactcaaaaggaatttttttaagaggttgaacctcttgttaacttttttctaaaatctctatagaattatttgttccacgagaattttaaatgatatgatattattcaatcctttgtttcaaagcttatataagaatttttcccatatgattgaaatcattgcttctcctccaaagcaaaggggcccttaactttttcctgagtgtatctggatatgcgcaacgggaagtcagttagagcaagactaataatatagccgacctgttagctataagattttttgtagccttctcttagcctacccatatagtagatagctctttacaattaatataggtcccacttctctatctcgcagagtttcttgggtttttttttctaagccggctataagtttacagctcgcttcttctctctcctctcttctctcttctctcttctcttctccacctcagcatttagatttagctggcttatagcatactactattattcttagtatttgttgcccacctgatcacgcgccgcgcgggtacttgtgcagttgtgctagtagtagtacgtgggggagaaaccgttatgaccgccgccgccccccacccacccacaaaagcgtgcgccgccgccggttttctctcgcctcacagttcgtccaatcgaatcgacagcaagtactactcctaccagtagcagcagcagcatcagactgaaacttttctcacagtactagtctctcagatcccccgtcagtcactcactcgcccgatcgtgctgcccacgcattcataccgtcggcgcagccagccgacgtcgatcgatcgccggcgaaaaccggcgagccgacctggccggcaaaggctgctgctaccgcccgtggtttcggaggcgacccctgtggccggatagatgagcacgtcgtacaccaccggatacagatgccaggagccaggttagaggagttgagatcgacagcgacgagagggacaggaattcgccaaacagcttcaacgcatgcaccaccgttcgctgaacctgaaactattcagcctctgtttggaacagattttggtacagattgttaagacagactcgctctgtttttaatatataacgccattgtttttttaaaaaaaaagtgtttggccacttatattatttaaaattttgtgtaaatataaaaaaagttcaagtcatgcttaaagaacatttgatgattaatataatcacaataaaaaaatgataattacattttttaaaaatagaacaaatgattaaacgtatcttaaaaaagttaacgacaccatatattaaaaaactcctaaatagaagctataattgtatgagatatttcttatccagattgtattactaaaaaaaatatcctaaattcttatgttttatgttttaggatggatgtgttttggaacggcggtggtactgtatacttaataatggcacgatagattaattttttaaaataaactttactagaacaacacggtggatggattttttttttataaatcatatttttaccaacgttgagaaaatattttgtgataaaaatctgaaaaaaaaaagaacattagacttagatcatgttatgaaagcttttgcaaagccatagtttctccctaacgatccggattctattacccagattacgagaaactatacttgtagaatttacaaagcgaactaaaaatagctgagatttcaacatatagattctatgaatacgtacttacataatccaaataaaaagagctatgggactgctcaaaacagtgaccaggattattcgtgaacattgttgcgatgcatgtacttcacaaaaacagggtgtagcaacgagaggaaacaggatatggaggctgtctggatgtgtcatttgtcaagcaaagggggatgcaatgtacatgggcatgcattcttgcaagcagacacagctgcaacttgcacttggtgtgtactatgacaaacagagatgagacaaccatctatacacttgtgagttactctcctctccttcattatcaaaagaacaggctaattaattaatcaagctttgcagctacagtagtctaccactaccatgtgggaccccaacccatcatctttgtgaactctgaagaatgcatgccactgctccaaaatccaatgccctcatgttcaatttaccagatagaccagcgaattcatcagcaaagaaggaaacgaagcttagaaaaactgccggtgcagatgcttctgctgcatgccttttgcggccgttcgtgtgttgcgcactgctgcaccggtcatggcgattgattgacttgattgatttagccggcgaagtgcttctgcttgctcgccgagcaggtgcagctggaacggctgtcgtttaacaccttcagatgaatcaagaacaagaacaccgtcagcaacttggatgatacagtattacagtatttgattgattatgtctcagtctcagacaagactagctagctggttagttatgtatggttactgatcgaactgcaaacctcatcctcatgtgagcatctaaaaagtgttcaatagaaaaagaacatgccatttttttaattaactagagtaactaggagatcgatgcaatctggatgtgcccagctagccactactactactcctactagctaattacagttacccctgccctcatctggagggtaacaacttgatctaaacatcacctatatatcccgggacaattaggcaagtcgcagttctgaattttgatcaaacaaaattgggagtttcagactcatatatgttaccttgacctgcttctggagctccttgatgtagtccacggcaagatccaacatgtcagcagtgttggtttgctgcaagtaaaaccaaaacccaaattcacaaacggtcagctcatcagctagtactagtagtagtagctcacactggagtacagtgttagtaattttttttcacagcggatcagagtcgtggtccttccatggcagcagcagcagccaaaatgaacccaaacaggggaaaaaaccaatcatggagtatagcacacaaggtgttcgaccgatgggatccccctcaccttttccatgttggggacgagctcctgcagcttccgtatccgctcgctgatccgcgtcctcctcacctgcaagcgggagacgattttcagctcaggaatcgaaggaaatggatcgcgtgccacgccacgccacgccacgccacgccatgccatggcgtgcgcgtggcggcgagaggtgtgcgcgtgtgtaaggtacggtactgacccgctcggcgatgctgcgggggtgggtggcgcagccgcgcttggcgcggatcttgcaggggacggcgtcctggaactggaggaacttctcgatggcggccatctccggcgacgcggcggcggaggcggaggaggggggcttgctgctgttcttggacgccgccgggaggctgagctgccgcggcaggtcgtcgcgggggcgcttggacgggaggctgctgtccgggaggagcgacgtcgccggcggcgagggctcctcccaggcggaggaccccatcgcgtacccgccgccgtagccgccgcgtgcggcgccaccgccgttgctgccagcctccgggctgccgccgccgccggcgagctcctcgtcctcgctgcccatctccgagatctgggacatcaccgacccctgccgcgacgagaagctgagctgccccttgagccgcgggtcgccgccaccgccgccgccgcccatgcccgctcttagcatattcccgtatcctataattggtaaggatattaatggcgcctctcgaattccagaaatggaaaggctagcagccacctcatgattgctactacttcttgcaagatcaaggtggagtggagagggaggtgcaccaaccgttgtccatggtaagatggttgaggaagccggcgggggagctgctctgccggaggaggctgttgccggcggcggcggcggtggactccgtgccgccggagctgacggtgcggtagagtccctccatggcggaagccatctgctgctgctgctgatgcgactggtacatgagctgctgctgatgcgaggccatggagtcttccggtggggcgaagtgggcggcggggcggggaggcttgttgtcgtggccgccatggccggcgaggaagcgcgcgaggacggtgtccgcggcgtggtccgggctcccaggccgctgctgctgcagctgcagctgcagctgcccaccaccaccaccaccaccggggaggacgaagtcgccgcagacctccccgagcagcgtgctcggcgctgacctgtaccgcagcaagcccggcgagctcatctgcggcggcgtccgcaccccggctggctgcaggctcaggtccttggacaccggcgcgccgtacatcacccacccccacccaccccactgatctctccacacaccaaaccagcaactcagctcaagctcaagctacgatcgagacgagggctcgtgattccgctacgaaatttcttgtggatgtggagaagagaggagaggagaggatttaataatggcgagaggtagggaggaggtgattggggaggaagatgtgggagtgagagcggagaggggtatttatagcggtggaagttactggaagcaaggggaggggatcgaggcgtgcgtgccctcgtggccgggtcagctcgtcgtcgtcgacgacgacgacgacggcgacgtcggcggcggctgcggctgctgctgctagcttttgccttagctacagccaccggcctacttcactgctttactactacacctcttgtggaatgtggattattaacactaacaccccaaaattcgatcgttcttattctaaaaaaaaatcgatcgttcttttttttctctcctaattactcacttaaaagacgcatgcaccctcagtgcaagcctgtaacacacgtttgaagaaaggacgaaatacatgtaaactatccttttgcatagaatgattttctgatattacatggttcacgcaaacgcacacacaatactaaccatgcaacatcacaatcacactcacacccctgtgaatatgttccaatatacatactctaaagaacggaaaccagtggcacatataatgatttaaagattaaatagctgaattatttatgataattattcgagagtacacgtgagtaaattaaagttaaaattttgatttaaaatagtttttttaaagaaatttatgtaaataaagttgtacagacatatatttgcaacatttctctttttttatctgtttcatttctactccaattttaatgtaaaaaaaatacagagggagcacaacacaagagcagagtggattcggcccaacgacattttcaccgatccggcccagcaaggttgaatacgtggacccaccgtagccacgacctctcatgtcaaaaatactacctttttttattaaaaaaagtcctaaatatggtaaagggagaagatgcaagaaatggggaaaaggcaaaaataaaatcacgttaacgaggggtgcacatgtgtgcaggcaaagatacagtgctgttgcctgcttgtagcagctgcacctcgctgcactgactgacaccttacaaaaaattgcatacttaattaagattttttaagagcccaaagtgacaacatagtgtttaccatttgtttaattattcagttaagtcactgtcaagctatgctgtgcatccactcttcagttcagcatatgctcaatcaccactggtcaatggaaagcatgctactttccagtttccacaagaggggggaaatattttttccctcattttactaacattttgtcttgagagaatggatgttcataagtttgagcaaacaaaatggccaatgtgagagcagcaatatctgcaggacatgacagaagcaatactgaatttatactactgatgatgcagtggagaccatcagcccatcacaagctgtttcctggggatacttttgtcttgatattaggtccatatttggctgccgtactcctcgttgctttggaagagcatatgaagttcacagcaatttcgtgtggattttcaagaatatctgtggggcttaaggtaattaagattattttctttattggatgattgatatattttggacaatttgtttatagtgatgaattatatatatatatatatatatatatatatatatatatatatatatatcatgaacaaattgtctaagcaaatattgatgtagagagttttattaaaaaaatagtttgagaacagtggtacgcatattttcatttacatagcctggaaagaactggttctaagcaaactaagactagagtagtactagtacttgtttagagatgctgtcatcttatcaagggcgacttggatgtacttgtagcctcattaattcttaatccataacaatcttggtcctaccctgtactacaaaagaggctggatctggcttaactaaatagtatattgatcataatgagttgatgacactgcaatcaagtaatcaactactcctgccctgctgccatctccctcggtgcgattaatcaaactcttctccccatttgattccatctgaaggaatcaaaggaaaatgccatccttttcacccaactcacaagatcttgtgaaccatgtggctccacatgtgtctccaatgctaaatgttctatccctctctctctcttaatctctctataaccaatcttctctcctactttgtgctaagcttgtgttttactgttccattatccatgcagaaatgagaggcaggaaaaaggtgagcaaggaaaaaagaaaggcaggcagtgtggctccctctgcttttgttggtgagccaacaagagacaaaaacatggccacactttggagagtttgggagggtggtctctcacggcataaagtcctaaaaaaggagggaataggaggtgatacggttgggtttgacaccggctgggcagccaagaagcagccactagtcctcccagacctggccaggagggtcttcatcaagaggttgaccctgccacttggatgatgacacaatcagttccaacatttcgttcatagttgattataaactaaaatgcttattagacatataaattaattataggtaaaacttttatatatgtgggttcttcacgatctaaaagcaaacgctgaaaaaaattatgataacaaaatataaaaagacaacttaaaatataaattttgattgggacggataagtaaaaacaaacattagggatagataataataggacataatgctacactagtatttcttatgcagttttatacagagttagattttaaaagtagaaatagatttgatgcgtaacccttactctctttatatacacaatttattttctatacaacattattgatcaacctacatcattactagatttaccacggccaacgtgtgtatgtctctctgatttttgtcaagtaacatatgatgtttttatgcttctatagtgaaaatgggggctctttttagcgtgctctctctctctctctctctctccatagtacatcatatattgtgacttgattcctgttctctttttttttaagtcggtgattattcccatccgtcttggcatataaaacctggcgtgttaacacactcccatgtagcaagtgtcagcagcatgtgtttttgagatatgtcaaatatgaatggaataggttcaatttggcatgcaagataaggtaatatgcatgtttgaagtcggtatatgttcatcctatattatacagcctgttttggaaaaagttgccatgtttatttttagttcgctgtagatcgtatacttttttactctgtttccactttcttgaaggatttttttttagatgcactttcttgtagcagttagaaagcttcatgtaaattttacataggtagaaattgtattcggatgttgccaagctaagatcgaagacccttgtatcatccatgaactaacgttgacatgtttgtttgttcgataaacccaatcttcaaaggtgctcataaggatatggaaagatgtattcaagggtaagagcgctcgcgtatatatgaatgcccgcacttgtaatatatttagaaaatgtattattatgggcatgtactaaacaataattctctttatgaatctattctcgagaataggcgtatcaagaatcgtgtgctctaatattgataaagtgatgaaccatatccgaggatgctattcctcgagaatccaacggcagtaaaaggtcccccaatgcatggagtcatggagtgtatgtgcgtttgtacataaaatggcataattatcgtgataaggatctcttgatggcataaggtatctttgatcaaacgagaacgacctcaccatggatgaatggatgaaggtgttgcaagcaagaaaaatcttctgaagttatctgcaagaacagtggataataccaatataccatctgcagattagtgccaaaggatttgtgaaatgtatgtgtcgccatgagcgcttcatgatcttcacgagaacttggccgtttctggaacctaatgttcccattattcctaccggtggaaattcctcaataatgctcacattttgttcgaatatacagaaggatctatgcattattatctgaagcagtctataccatttatgtactaatgttctgtgatatattcccctgagaataatctcctgaatcctgacagcaattgcaaatttttatgtcttagaaaggtccaaaggaaggtactctcagcagccaattaccaaagtgatcgtggtgcaggaacactattcctctcggtagctaaaatcacgtcacattattctttcattgggataagcttcacattattggcacctttggtcagggcgtatcactacaggagcatgaaaggatgaaaagacaaagataacggaattatgtgtaaaggttgcatggatatttattttgcaaaaggaattcaattagttagtgtggtggtctcaatattttgctgtccaaataataatattttcacaacccggtatcagattctaacacccaccttagataatactcccttcgctccataatggatgttctagttttgttctaagtcaaacttatctaattttaattaactttataataaaacataacaacattttcagtactaaattagttttattaaatcaacattttaatatatatttttaaaagacatatgtttcgtgttggaaatgttgctattttttttctataaactttgtcatacttgaagtttgactttggacaaaccaaaacattttacattatggaacagtgggagtataatctttttttttacactcaaataaccattttttctctcttaattacttggacgctagtgcatggctcttgcacaaatttagttaggtgaaagccctctacttctttgggggacagggaggactccaatctgatctctgatctgaactgaatgcccacataaacacatgagagttagacaaccagcccagacctgagtagcagatgccaagtccagtttttattggcctttcaatgcacaagaggtggtagctgcccacgtaactgcagggcccccgtactgcatagatgtgagggaagtgaagccggagccgtacggggaaacaccggcccgggcaggcaagcatggcgcaagattgagatcgccagccagcgctaagcttccctcccggttgacacaacagcatgaggctataggatctagcattctagcaccagtgcaagccaaccaccaccaccaccacgacgacgacgaccgcggctcaggtgggtaggccggtggccggatacctcacagccttgaccaaagacggcgtcgccttgtggccaccggccggctcacgcggcagagaggtttgcagggtaagcaaactcaagctgcttgcagccagccagggtgcatacatgcaagtttctttttgacatgtactacaagggaggctagtgcaaccaaaatagaagaagagatggattcagcggttggaacttggaacatcgcagcattttaaatttgttgagggtagattctggttacatttggacagcaagcgtactgggaaaagaaagggaaacaaaggttggttcaaaacttactgtttggaatctgagctccaaatgttacagccttgaccttggaccaccctttcctggtatctgtagagcgtcataatggccaaaaccatgaaaaagaacttgaattggatcttctttcccgtactcctgaccatattctgcaattgctattaaaccaccagcttccttatcatgcatgtacacagtaattggcatcctggccacattggtaacggcatattagagcttttgttacttcccgttttcagaaggacaatacaacaagactacacatatatgaaactatccactattgctgttgagctacattaataaactttggtcaaagcctaacaaaatggaatattaatgacttttgggagttgtgttttgaaaaaaaaaaaggaagatccccgcaaaaaaaaaaggaagatgcttaacagtcataacatgacaaaaaaaaacaaacaaacaagacagtataagtggacaaacttatcccaggaatcctaaaatggattaaaagcaaaccaactaaccatcaaccctatataaatatgaccaagagggcataagtattctaacaggttactgcacaaatgtatactgcatttgaaatggtgagagtaaaataactccaaacatcatggctaattctcaccgaagaacatgcgaagccattaacagttctggttcacctccccacacatgtggcttcctaatccgagagacatatgcatcgaagtccccctcaacaaacctgtgaattaatgtcatagcgaagcataagaatgcgtaactcaacaatatttagatgcagagtaactaacagaataatgaggacaggtagaactaaccattcagtctctgcccgtctcttgataaattcatcggcgacctaacagtgacaccatttaaatagatcttttacatgataaattcaccagaaatggttgcgttgcttccagagcaacatttagtatctaagaacagaatggatcaacagtagtacatcagcagaacattacaagcataccattgctcttaagtcatcagccatctttctctggagatcatcatcaggtcgcttacctgacctaatacatgcaccatgagccacagatcggaacaagcaccttccatctccaggaatgcctgagggttaccatgtgaatcaaacacaagtgagcagacgatgcatgctttaaccaaatgcatattgtatagtaattagaaaaacacgcacactgtctcaccagtaacagaataatccgtgcaaacttttttcccatgagcataactagtggacgattcagtagtttgggggctatcagtattattgtccacaggaccctcagcatttgccttcgcaggaactgcaaaacttaggaaaagtccagtgcctgtagctccaactttgtgtcctatgcttcttgaatcccagagaatactatacaacttctgacgtgagggctcatcaagctttagctttagaatattatccctcgcaggttgtctgccacacaactgtttccccgaactggcaaaacatgttcgcagtgattttatgttcatcttaggaggcaaaccaactaatctgatctttacatgataaccgactgcttgtgaacgagaatacttccataatgccatgccctgtgtcagccctccttgtaactgacaagactgagaatacaagctataagtacagcgttgtaaacagacagtaggtgtgtagatagccatctgcttcaggcagcaccgcgccaccaagtataagctgaaaaacatgtttcgatgaccaaaattaagaattagtggaacatgagataattcttacgaaaatcaaataaagcaagccaccaccacaatgaagtagaagatccaccatgacacaacggacctatgatagatatgattgatgtcaacattagtatcaattgaagaggattaaattatttttcagcacaaaaaatagtttcatcgttgacatatccaggaaataaatgtgtggcagatagttattagtgagcataaaagactgaatgtctccaacctctagcaatcgaccactttctgctgagattcgacaaaacaatgggaaggatgggcatgctaaatcataagcgcacacttgctagaacaaaagcaatttgtcctccttttctttgtcacacttgcgtagagaatccatattatcctcgtgaacttctcaggatgtgctacagggagaaattgccctcccaaatcccgagcattcgagggcatgggcagcagcgaatcactagaaaactattctcattaagattatttaagttcctgtcttggccgcgaagccgagatttcgtgctaccaggccattcccatgcccgaattcacaagactacaaccctaagctggtggaaaataatgcattatatgcacaattgaattcagcaagtgccaatgcacccaaaccattcccctcacccgggagagcagataaattggaagatagtagtaactcaaattagtcacaaattgcagaggataatgaagtaaaatccgcaccttagccttcggactgtccgaagcgagcggagccgaggagagacgcctgcaagaatggagctgacgaaagcggaggttattggggacgggagcgtgagccgaagaggaagggatagtggtggcgggagaggctttagacctccgttcccgcgaggggattcgccggtgcacgccgccgccgccgccggcgcagagtcagtcacggccactggcgcgccgccgccgcacgcgaggaggaagacgatgagacgacgcctaatcgatatccaccgcgcatggtagatcggacggttcaggtggacccttcggatatggtagcgatcctattccgaggaggcccacacggaggcccagctttgtttggtctttggtggcccgagaagagaagaggctcgattttgttcggcgggggaaaagtctaatgtgagttctcatataggagtacatttcaagtgcaaaacttggtatatctagttatctaccactttaattattaaaatattttaaaataacccccttgactgttttgaggatagttttcagtgatttggcatctaatggcagtctagtcataagatgaaccaaaaatagatagaggattcaagtgtaagtggtacaaaagaaagtaaacaactgtggtgcccacttgtcatagcccactcttattcttctctttcttctttcttttgcagatagcagcaggaacccgacaagcggtggagacgaggctgatgagcccagcactgatgccatctccctcacttccacacccttcctctctgcctcatggagggccaccgcttgcctacctcctcttcgtgtagctacctctacctcctccgtttatcatccctcttctccataacggcagtggcggggcggcaaggtgggaagtcagagtcgatgtaggattccccaagctctgccacccttgctgttttggcctcaccggccaccgcttgttgtccacccagagctccacaccccatctccctcaacaccgatggtgatgcttagggtatcgatggggaggggatgaggtcctccaaccttgccgcttccagggctccgtcgtctctccgggtagggctcttacgaggatgcgatggcgacaataagggatcgataagggcgccgacgataaatttttatactgcaacatgctcgcctgctccatcgagatggcctcttgaatgtaccttaacgtcatctacctccttaccggcatcgagcgtctgctccgaaagcacctcgacatctgcaagcatctcaagattaccaaccaccgatcccgcaagttggggaaagaaaaaggggagaaagaaagagaggattgttgatgaggagggcagaatctccaatttatgaggattgtgctacagggaagctattcactcttttattataagcatgttttcccatattgctaaatggtatttttttttcaaaaccatctatatcgacattttttaaaaataaatcaatttttcaagtttataatatcaccaattgtgttttctgtctcggtgagttgctactacagaaactcataccattcaaagcacggatgactggtcatttcacccacaactagggctccatatcaagccagttcagctcggctcgttatcctacgagccaaaagcctcgctcagttcgaaccaacatcatttcaaagttacaaatgtttgcatacaatataagtattaaatcatcacaaatttagcaaatgcaccattaatttcatactttcatataatcatctaaagtcagtctaaatatttaggcctatgaccaagtggagtggtgtgacaatgagtggatgggggatgagttaagttgagatttacgagtaggttaaactttagttttgacttgttaacaaacccaaacaagccgagctgtgcgagctaaagtgccatcatccttttttccagccctatccacgacccatccaacctgtgcaaccttggcaccgcattctctgatgttagaaaaactatgttagagggcagtggtgtatcaattcattgtcctccgagtatggaatgctccaaaaaaaaaagccaatgatgccatcgctcgcagtcactatcatgttcgctagcgtgcgagcaaggacaacattggatttttcttgggagcgttccatatttgagaaacggtcgatcgatgggctactgacgtactctctctgttttttttaaaaaagacaacctctgtatccagattcgttgtaatatgttgtctttttttagaatgaagggagtagttttcccaacttcagaggatctggttccgtgcaacctcgtgccacaactctcaaacttgtacaggcaaccaagaacacctgtgatctacattttgagatcaggtagtatgattgatccatgaatcccattatccatcatcctcgagtgagagtccagcacgaaagctgcagctaccactccagcttatccatctcatcatccattcccctcgcaacgaactccctgcctctcgctccgatcgtccgcgccacggcggcgacacgatgaaaccccgatccaactgacaaaattcccaagcgaatcctgtgcagctcgagtagaagagaagagagagtgcttcttggcgagcgagtcaacgtcacaatggcgtccccgctgctgctgctgcttccgctcgccgtctcgtcccttctgctgccgttcgcggcggccgcgcgcgtcttctccgtcgcggactacggcgcggcgggcgacggcgcgcggtacgacacgggggccatccaggcggccgtcgacgcgtgcgcggcggcggggggcgggcgcgtcctcctcccggcgccgggggactacctgacggcgaccgtccacctccgctcgcgggtggtgctcgacgtcgcccccggggcgcggctgctgggcgggaccaggcaggcggactaccctcccgagtcccgccgctggtacgtcgtcctcgccgagaacaccaccggcgccggggtcaccggcggcggcgagatcaacggccagggcggggcattcgtggtcacccccaacccgcagaagaacatcatggtgagctggaacgccaccggcgactgcgagggcgacgagtgccgcccgcggctcgtcggattcatcgactccaaggacgtcacgatccacgacatcaccctcaaccagcctgcctactggtggtgagcatttcttgatacctcaaatccattgctcaattcgtagtagaacagccaaaacatgacaacatttcccttgtcatttcatcctaaagatgataaatccggctaatttgtactccactgccctagatatcatctgattagcaaaaattacacagcatttgtgtagtgatgaggtattcagggaaagttaacaggctatatgcacttgcattccctgcagtctgcatattgtcaggtgtgacaatacaatgatccacaatgtgtcgatatatggggattttgacactcccaacaacgacggcatcgacattgaggattcaaacaacacggccatcactcattgccacatagacaccggagacgatgcgatatgccccaaatcaaccacaggtcctgtttacaacttgacggcaacaaactgctggatacggactaaatcttgcgctatcaagtttggcagcgctagcttctttgacttcaagaagctggtatttgacaacattacaatagttgattcacatagaggacttgggatgcagattagagatggaggtactgacctgtacttgctgttgtgtgtattgccattctgtgatattaggtagtacttactattttctctagcaagctataagatttccgcagcaattaaaatatattagattgttttcacggacatttttttaggaaaactgaaccttatgctgcatttgtaccccgtgtttatatagaatttataaattgctttagcaccatgaaatttttatacagcagcgaacctatcctgtatgctgaaatatttctattgtgaattttcatcaagtaaaaactgcaccattaaggtctttggtctagaaatgagatttgctttaagcctcttctaaactggagttttcattcctgcaggaaatgtgagcgatgtggtgttctcaaacatcaaaatgagcaccaggtactaccatcctttatggtgggggagagctgaaccgatctacatcaccacatgtccaaggcacccagattccaaagaaggcaccatttcagacattcagttcatcaacatctcatcggtatcagaaaacggagtattcttggctggatcgaagcacgggctgcttcgcaacctgaagttcaagaatgtcgacctaacctacaagagatggacaaactactcgggagggctgtatgattacaggcctggatgccaaaagatggtgaagcaccgaaccggtggtatgatgctggagcacatctctggccttgagatcgacaatgtgaggatgagatggtcaagaggaagcctcaaaggctgggatgttgatcctctcctcttccagccatcgacagtcgacaagctgtcattccatgactggcaatcgctggctgtcagtaggtaatggaagagcaagcctactgaacatcacatttgtacaagtatctgtatcacaatctgagtggtgattcttttctgaaacgtgtaaataaagatcacatgaaaggcaatggtcttaccatgttgataatcatcgcttgaatggcataaggttcttaccagtcaataaaaatcctcaagtcccaactccctgt

SEQ ID NO: 65789 - DNA, 1897 bp, Oryza sativa
cgacgaagcacggggaacacctcattcgaacgaacgagtgaatgactcaacaatggctgcggctaaaccggtgggctagacacgattcacggtaaagccccggtacgacaaacgataggccggtaggaacctagggttgcacctacggctagacaactcaattaccgagcaacgggttaaagcgacggctaggtttaagcggcacacaactgtgacacggcacggcagcagcagcacagcggcgacaaggcaattagcaatggcggcacagcagcggctactcgatgacacaaacgagagattaaaacctaaaccgagggaacagagatagaagtctcaccgaagcaaagcgattggagagggagagatgacgacggcgacccggcggcaacacacggaaacgatgacaatgctagacaagcaacggattagattgaatttgatctagggtttaggtagacgtggcaatgataagacagccaagcgagatctccggataacgaacacaggaacgacgatcaccggcaaactacggagcgacgataaaagggaggacaccgggagaaagagcgcaaggcgacggtccttaccaacacttacgagacgacagacggcgacggaagatggccggtgacaagcttcgaagggcggcgaggtactgaccacggcggctggagcggcggccggaggtggagagagagggagctcgcagggagagcgattccggcgatggaggaagacgggacttgagaggataggtagaggacgactagggggtcctttatatagccatgggagcccaggatcgagcccacatcaacgggaaaaactctggaaagtttaggatcttcgtcggaaaaaggatagattgaaccgcgaaattggaaaggatttccatagaaacttttggggatttcgtggggaaattgtagaggagattgagaggattccgttcccgcaactaatttggaaaaaggagcaacggggaggccggattcggaaggggatcggcacggctgcagctcgggacggctcgggcgctgtccagatgttgaagacaacactgtagcgagagggaagaaaaacagacttctatgcgggctgagaggaagggagagagaagagaaggaaatgggttgaaaagggcccaagctgaggaggaagattttattacttttccaaatatattaaccaatgagatgatctttcaattgttaaaaatacttccaatgcacaaatagttccaagaaaattcttgaacatacttggacactcaaagtatttaacaaaactgtaaccagctcatttaatgattaatttaatatgtgaataattactgaaatgttctttgtattattaaaattattaaaaatccgagaaaattccagagagtacaattaatcatggagaatttaataaaaattaaatccaaccatgctttatatttaggaatttttacttcccacatttaacttcacttgtaaattaatgaacatttaatataaattctaatattaatttattaaataatttataaatcctgagacaggaaattcaggctgtgacattaacagtcttcaccgaaacagtggtatataaaagctgctatggaatagggagcattctcaagagccttaaaatttggtggggattgttagatttaattggttaattgatccatttaaatcaattaaattaaataaattccaaggctcattatgctaggaattcatgtgtattcattctcttgtgggatatcaatgagacgaggagttttgagaattaatccatttgattagggaattggtaacttatatcaattactcctaattgatggatggttgatagttgtatagtggaggatggttcatcactagttgatgacaattagttgctc

SEQ ID NO: 65790 - DNA, 1866 bp, Oryza sativa
tagtgctagttttctaataggatgtagaaatggccaagatggtagtgtcatcaagatatatgaaatttaattgtttattgtaacaacatctcttttttctttataatgcgagttatggtaactctcctctttcctgcagccaaagaagtggcgcctgaaggcacaactgatcagtcacaagtttcccatctttacaacaaggtacttatggaacaaagttttttttttttgaggggatcctctcaaagaaaagttttcctatgctaactctggcctgaaaattttcttgagtgacaacttcctatctatctatgatatgcagatgtgctttgtccttgaagacagtgctgttcctgcactcaactcgcatttcggtgacaaggcagcttcctccggtttagccaatagcctccataagtttgaagctgtatgcgaagacgttagtcgcatcttgagatcccatgaaaatggtaccactcccaaagaggaagttatgctagatgcaagctccaaagagaccacgtctccaaaagatccagcaaccgaggtgccttcgtcagcttccaaagaagctacgcctccagtacaagatccagtcatagaggcagtgaaggaggagccacccactgttaaggcggaggacaaaatggaaatcgatagttaatttgtaggaatcataacgataatatcgaacctttttcgtctaatctaatcgctaaactggctgtagcttttaccatattacaagttgtaaactaaaaaatcactctaagctagtctcatcctgtagaggcctggacatctccaggcctgagatgaacgattaccatcaaatctgtcgtactaaaggttaccaggttttgctagctcctgccccgctgcatctgttaaatgtttaactcttcactgtcgaataggtcacttgactggtttgccatcaggatgattaggcccattgtaatgaccctactgctaaagctgtgttgctaattgtggcattgtgatgtgatgatcccaacgctataaagccgtgtggctgattgcgattacgacgtaaacatcaggaccgtagggacaggacaaactagcatcgactaatcatgagatgccgtgattagtagttgggtcggaggccccaccccgagatccacacgggatattttaattggatcatcatcgtcgttagtccgtcctcatccgtgtgccattaacggtggcctccatcgtcaagctgccaacgtctacaggacgagacagagagagagagagagagagagagagagagagaggtggccatggaggtggaagcggcgcgtcggagcaagcggccgccgtggagtcgcacggtggccgtgcaggtggcgctctgcgtcgcgatgtacgcggccttcagcctcggcgagccacgcttccaccggaatcggggccgcggcggtggcggcggcgtggaggcttcgctgggtcgtggcggacgcggcggcgtctccttcctcagcgtcgccggcggcgcgcggccggccgccgagcaggcccgcctcctacggcaggtgcgcgcgttccctccctttctctctccacgtcgtgttcggttgtcctattgcctctgctccacgccgattgcgatgttgttcgtcgcgatggcatcatttcccgtcgtttcgcggcatcgtttcccgtcgtttcgcggtgtgctggatccatccgcgaaacctccatgagagagaggctgcactgcacggcgaccaaccgcgccgtgttcgtagtgctatcgccagcttgccattcgcgtacaatgtggcgcgtctgctgctacaccgcacgggaatgtgtctctcacagtcacacagcagaactgggcattgctga

SEQ ID NO: 65791 - DNA, 1119 bp, Oryza sativa
taagctccgaccggcagagagttctgacttctattcttgtactgccttgcctcacgctcgattaatgattgcccaaaaagctatggatcgtatctgtttttctactaacccgttattaccaacgtgttgtgttggtatcaaaggaagtgacagaaattccatgtgaactgcatgatgctgttcattgacaacaacgtttttcccttttcttgaaaagaaaaaaaaatgaatagctgaagaattgttctaacagcctactctgcatttgcttttctaatcattctgttttctgtgaagatggagagcatagcaaaggcctataaagtcaagtttgtggtggatgttgctcagctaggggaggaagacccactttggcaaaatgtaagcaactaacttgttctgacagtacactaagtagtaataggtacaatggagttttgagctggtccaagtaattcaaccaagggtgtgtttagttcacgccaaaattggaagtttgattgaaattggaatgatgtgacggaaaagttggaagtttatgtgtgtagaaaagttttgatgtgatggaaaagtttgaagtttgaagaaaaagtttggaactaaactcggcccaaatgttctgaagttccttctttttgtttctttcagggttccctgtacttccaggctctgaagatcccctggtatgcttgttgtttccgctttcttgctagcttactcgtcattaataaatttaacaatggcagtatggttatatggttgcattcttatgggtgtgttcggcaccccattttcccaaccgatctcccttgttttctgcgtgcacgcttttcaaactgctaaacggtgtgttttttgcaaaaagtttctatacgaaagttgcttaaaaaatcaaattaatctatttaaaaaaatagctaatacttaattaatcacgcgctaatggaccgctccgttttccgagagtactgggaactggaaatggcgaacacagccatatgcacattacaacgtgtaaaacttcatctttttcaggtattccactacatcatcccatggacagatcattggtaattttctgaagagagtgatgatgccatatgatcaaagtctagaaat

SEQ ID NO: 65792 - DNA, 3330 bp, Oryza sativa
agttttattatttaaaaaaacttaggataaacatgttcatttccacatggctactttttattaggaattactcatcgacagatcaaagctacaaaatgtattcatattgggattttctcctattattggagaggtatacatctcatacttgacatatatgtctccttttatcttacaggttggaataggatttagaaacttacttcgccatcgaaatataaatctatatatgtacaatattacatacaaatgtatctttcctgagatttcttggtgagattgttagcttgataataatttttcctgtgcaacaggcatccatacagtgtgatattccagcagtgagcaccattgcaatgtacccatagcgaggcaccattaacaccaataccgttatacaattttttcctaatgcctcttattactacagcattgtgttgatcgacattgtttttgaaccacgttgtttataggtatattttctctctgcaggggaagaagaaaggaattataacaacgatattaagaaggaatgagatgagaatatataagggagaagttataatagagaatagtagatatgtggaggttttgatcgatgcttttattacagctgacgtcaggaactgccttgattgttcagggagtagatgttgggttagaaatggtctttgtcactaaagaaaatgtatttactaaactacattcgcatgaaaaattggaagcaatgtctgaaaattttcttctcactgatcagcattgtggtctatgctcctgtataggggtaaaaacagtcacagaaattcccgattaaccgggcgttgtttccgtttaaggggtacattttccgaccgtaccgtttttgttatttttaaatttctttttgtctaatttctttctgcatcatattaatgtcgatactgagtagtttaaataataaatatggtcaattaccggccgatcgagcatcgtttccgaagagatactaccaattccgatcgttttcaccccctactcctgtatcattctcttccatctccggcgacctcgacaaactctgacataaaaggcagcatccccaagcagaaaggttttagggtaggtatcggaatgggataccgggtgagttcaccggtttagaggaaggccaacgggtggtagagagagcagcgacgaaggtagggaatcaaaaagagacagcaggatcggcttacatggtttttgccttttctttttttgacagcggatctgtaatagatgcagctgctgtggcaactgtaacgactctcctttttttcatccagggtgactagtccaatacaaaaggttgagaatcaagttttgaaagagtttgtgttgacatattatataaaaatgattacaaaacaaaagaattttttcaactatgtttgatgaaagtagcaaatctcaatcctctttaaattccaaacatcacgatgataacgcactccatgcatgaaatttgaagttaattatcatggtttaaattaaagtcatgttcacataacttcacctccaacctctaaattcaccagcaagctctagtgttcctgaaaaatacggaacttcaatgggcaaagaccaatacataattaaataaagggatgttcgtcctgagtgtctatcaacctcaactactttatttttggtggagtttgctctggcttatgatactgtcgtaaaaacttgctgtattgcaaaatccaaaccaagctggtgctccaaacatgctgtatagaccagaaaaaaagtattcagtatagttattacaagatatgtgcttcataatctttccttcgaaatgagaaatatttaaaggaaaaattaaaatacaaaatttaatggaagagaaactataaagcaacagtaattaaggtaatgtttacaataacttgaacttgtttttccttttttttttgggatccataaagaacttctaatcttctctgtgtagaaaaaccaccacacaaattaactctgatattgcggtttcacccttgcatccgggtcccaggtcattttataaaatttacaacattacaattttagagtttgatccgactaacatcacatcgaataaaattactctcactgttacgggccgatgggagcatatgcagaatagagcacagctaccttgctcaaagtttgcaagaaccaacgccaacgggtggcatgcgtgcagccattgtagcgaatctctgccaacccgtccctatgtgttctactactcggcaccagtacgtgcttggaatgaccgtctgttggtgtgatgggtggaggtacgcatggctgtcgtaaccatatcagcgagcttccatacatcggaggtgatgcttacaagccgattttctcagacaaatctgtcatatctgtgcatcaacgattcccggcgcacccatacgcaccgtgtatagcctgtatagtgacgaggtggagcacacgatttaatagagtatagcaagcatgcatcatcgttcccttgctttaatatatgcatattgtactatttatcagcattagtaattcactagtaacaacatgattgcacacaacgctccacgaatatacatgtatatattgccatccatgcatgttacttttctgaacatgaatatatatgcatatattcccttcttcttgttgaaagaaattttaaaaaaaagtataatagattttttatcagctcaattttgcacataagtctatggagtgttttcccaaaagtgagtttgggcagtgtcctagggctaaaaccatacataagcagtgtcctgtagcaaaatttgtctttttaatttttacgttggttacttcatttctaaactaactaatatagcaaataaatgagaatggactgagtatgtgtactaaattggtgtgacttgtttacttctttctttggagattttcagaaagatcacttcaatatgttactcttaacgtaaggtttccatggctttagtggcacaatgaacaccagtctcttaacataagttcaaactttcactatgacaagtttaattaagttccctttctacacatgggcctaattatttggtgtcttctcatacaccaaactgaaaaaaaatccactaatatacctagctttcagcacaaccgaaatccaaacatgcattcgaaattttaaatattttaacatgatttatttttcaaatattatttttaggtttcatgcaatgttcattacaatgtgttgccatgcacggacacacgtatagtttctcttcatatatctccaggtctttaaataggcgcaatgaatcaaagaaacaaattaaagccaac

SEQ ID NO: 65793 - DNA, 4972 bp, Oryza sativa
tttcctgcagcgttggcactgatattgcttttctcccccatctaagagctcttccgcagtgaaattttgaagtgccctcaccagagacgtggccttaccaatatcaaggctgagatccaagaaaggatcaaatttgttggagcaatgtgagcactgtgtgcatttcacctggggcacatgtacatagccaagcagtgatgactatgaaattgggacttcccatgaaattgccagctccagtcttactgaacaatgtacagatcatacctgacttcttaggcggccaccaaatattttgtgaactaagctcttctcatatgcactaggagactcacttggtactccagaaggtagacaacatttatgcatggattcaagtaaattaaccattaactcatgtgcatcctcctgccttgaattgcggaaactacgggagatgcctattttgtagtcaaagattccaattccatttctttaaaaaaactagaagtccaaaatttaaatcaataataggtgctcagttaagctaaagaacattgaaggatacagcgcaagttcttgacaatctgtgatggcgtcactatttttccagttgactgtagagcagtcttaacatggttttgaagagcacatagtgcacaaaatccagcagtacgaccttaagaaaggggaaaagaattagcaatagaaatatcttgtcgcaaaattaagtgtttctctatgcttacttgaacatgacagaccatagaaaacatgcttgcagttcatacagaacatgttacatagtgcagaaatattggtgcaacaccaatctagaaaaggcatgatcagttcatactcgatacctcatatattgttctacggaagaccaacgtaactactctttataagcaggattctccccttcttatcattcttatcctttttcagcctctttgttcaagtgttttattattgcatgcacaactaatgggtctaaactttgaaatagaattaccaactttttcacgaatttcttaatgggcaatacctgtttatgggttaaacaacattcaacctgaagaagtgttgaaattttccagtaatgtaaaaggaataaccttgagcctcttgcaatgtaggtatcattatctagggcagttatacagcaattacagaattactagcctaggctatcagcatagcttaagcatgcagccatataacttgatttcaaggtccaggctcaacttatcgtatgacataaagaacattcacttcagttcagttactactaggtgtggaatttacatgttcaaaagtaacatcataacattggcatctcatgcaacatgccaaatcatccggttgaaaactgtaacaatacttacatgaagacttgtgcttcccgctctgcaaataggccgcaaatggttctgtgtacgtcaagcattgcagcaccgagttcaggtagcaagtgttcccaagattttgcaggccagcaccctacatcacatcaaagcactccaatttaagaacccgggaagaaaaattacaaaataataaaacgcccaccatactaaaaccccgataaatgccagaaccgttaactagatactacactagctacgatccaaaaaaaaagcagctactaatccatattttataaactaatacaaatcgacagattccgtggtaaaaacaccacgcattgcagctccacccccaaaacccctaacaaaatcgcggcctctaagatacaccaacagaattacacagcttcgtgcactcacaattctcccgaggtagatcctggcgacgctgagctccggatccagcccaccgccgaccacctcccccttctccgccctcctcgcctccccctcgccccccgccgccacccccaccccttgcgccgcccccgccgccgctctgtcacccgcgtcggggttcagcgtctccatccggaacccgcctcccccgaccgccaccaccgagtgcgacctcctcgcgaggtggaactcgatcctcctgtgcagcaccccctccgccgccgccgccgccgccgccacctcaacctccgccattcctagggtttcaagccccaacacagaagcggaaaccaaactacacctcaggacagacagggacacgatgatggatgggtatcggacgaatcaacactccactctgaatttttctgcgatttttccgggattaaactcgcgcggattcgatcgatacgggtgtgggtaattggtgcggcgcgctgtttttttttttcttttctttttttttttggttcgctcggccgccgttcgagctgcgggccggaagagagggggaggagggggtgggatgggggagctataaaccctatacccctagcgagtggacggttaggattggacgggagggaggggcggggcgatctgggacgttggatttttttgtggagcacgtgctttgattgcgctctggctggtggggccggagcgggaagaacgcggagtggctgtggctgtgagccatgtgagagtggtgtggctgcgggttcagtcaaatcgtgtgtggcctacatggctacatcaacctttacccatgagtgctccattgctcgtatttccttttttttttactgtttttaaaatcatgcacccttcgttaaaaaaaacatttattacacatttcctattacaatgaatcttgtattagaaaatatctcatccaatatttagattggttttttaagggagtattcgtcttcattctggtgcttctcatccaacgtagaagctcatgttctcttcgtgtgtaggtaatggctaaaggatccaatccacccatatagtcaatctctaattatatgagactaccccgtatattatcattaatctattcacccattcaatcttcaattatatggatctgggcattttaaagcatgggtgtcagggttatggataccacatacctaatagtagttgactaaatctcggcaggatccaccacataccatgtcctatacggaagcaaccttcggatataggaggagttccggataaggaaagacaaccatagttctacatggaaacgacaaggactactcggattgtatccatattggtttccctagttctacttggacaaggggacacctatgggtataaatacaatacctcctaggaggggagaagggacacccaccagggagaaccaacacaatcaacatacacccaccagggagcaccaacacaatcaacatacacccaccagaagccacaacatacaagcctacatatgccaagacaagccgccggatatcgacatcagagatatgcctagatcgaccctatccggtaccttcagaggccgcccgtagggatctagcactgtctctgataacgtcgggcgcgagctcgaggaggaaggctaccctgttgtcgactacgagtcagaccttcagaccaccatgtcgacaacagttagataggctaccccacatattgtactggtgtgattatggtgaataaaaagcaatatcggctccggccaacaggatgtagggctattatctaatagctcaggggcccgaacctgtataaaaatccatgtctccatctcttttacctcagtctcgcgtatatcctagcaccaacgatccccatactgtgcaaataccgtagtcgtgacatcatgcaccctccgttaaaaaaaacatttattacacatttcctattacaatgaatcttgtattagaaaatatctcatccaatatttagattgttttttttaagggagtattcgtcttcattctggtgcttctcatccaacgtagaagcttgtgtgctcttcgtgtgtaggtaatggctaaaggatccaatccacccatatagtcaatctcattatatgagactatcccgtatattatcattaatctattcacccattcaatcttcaattatatggatctgggcattttaaagcatgggcacattattaatatgggaaaaaattgttaatatacataagttgataaaatgtatcgatatgcataaactgataaagataacggaaatcttagtggattcctttatgttctaaaaaaaactatcaactaatgtctcctacttccttcgtttcatattataagactttatagcattactcatatttatatatatgttaattaatctaaacatatatgtgtcgctagattcattaacatatatatgaatgtggtcaatgctataaagtcttataacctgaaatagaggtagtacttatttatgatactagtggaatcaaatcttgccggtcaataattcttgtactatctcttgattattatttttttcgtctcaatgaaaattgttattatgtggtattgtccaaaatatcgtcatcgagcctttttatttgagaacaagctgtcttaagtgagcttttaatggcggcagtgtagtcacatatatagctccttcaagccaaactctatgcttgaacatattggttgtttctgaattgacatcctatttaaaatatgaattccaaatgtgaatactagagggaaccaaaaaaaaacttctcttttgttttgtttcctaccagtactattttaccgtgttagattagacaatatcacaataggcaacatatatagaaaaagtggtacatatcgatgaaaatgtgcggttatccgaaaattcttgctacttgtgattagactttagtgccagttttcacaaacaactggtagttatatgaaatttactttgttttcctactttctttttctacatttatgatatattgttatcgttatcttttctaaattctaatagtgtgatctttttttcgcaaacgcctaatagtgtgatcataaaattatttttttaaaagaattaactgaatgaaagtatttttatggcattaattccactgttatcattgtgtgatcataaaattattttttttaaaagaattaactgaa

SEQ ID NO: 65794 - DNA, 10619 bp, Oryza sativa
ttcttttataaaagaaagggtatggcataagttttatataatacttcgccatttcaatctaaatctatatatgtataatattccatacaaatgtttcttttctgagattaattaatttctttgtgagtttgttagactgataatattatttccactgcaacatgcagccatacagtgcgatattccagccagccccattgcaatgaaccgacagcacagggcaccattaacgccaatattgttatacattttttcctaatgccacttattcctgctgcattgtgttgatcaaccctcttttttttaaccacgttgtttattggcatattatctccgccgcggatgaagaaaggaattataacaatgatatttaagaaggaatgagatgagatataagggagaagttttaacagagtagtagaggtgtggagttttcgatcgatgcttttatcacaggcggcgtttgatcggagctagcacaagaagaagagccctacgtcacaggcgtttgtcagccacgctatagaacgatatcaacttcgcaaccaagataaaatagcacattgatacaataaggcccggtttagttccaaaaatatcccattgaatctttaaacataagtaagaatcattaaatatagattaaaacaactaactgtacagtttgcatagaaatcgtgagacgaatattttgagcctaattagtccataattagctataagtgctacagtaactcacatatactaatgacgaattaattagactcaaaagattcatctcgcggtttccaggcgagttatgaaattagttttttcaatcgtgtccgaaaaccccttccgacatccggtcaaatgtccgatgtgacatccaaaaattttctttcgcgaactaaacaaggcggtaaaagctagagcgcaataaattccccatgtctcctagaccctatttaataggcggcataaataacagaaatattacttgtgcgtcatgcatgattgaattgctgaagaggccgctagccttttgcaggctggcctttgtacaagctactccctctgttgttcatgtgttaatcttcacgccatagtgcattactgattgacggatcggtatatatacagctcccaagtcccaagttaatgtactgttaatacttgaagtatttgtcggatctctcatctatgctaatcggttgttgttgtaagaatgcaaataattaaggcaaattgagttcatttcagtgcccatcgagtgtaattaagactgatgtgctccgagcaatccatattatatagattctaatttctgcaatcatcacttctctgaaaaacatgaacattgatgcctggaacaatcgtttgttaactaggatattaaagctatattaatttggtacgggaacattactcagtttcggcacaactgaaatggtggcacacgaggatttactcagtttcagccagatacattaatttggtacgggattgccttgatttcaattaagcatctgaaagtttttgaaaatatgcggtcacttttctcatctctcggatcaaaaccaccggcaagaccgcagctcctgcgcacaggtgaacaggatcagcatactgtggtgatcacctgagttgtctcctcagtcgacagctgctgcttgctagccactactattcagcagccttaaccgaagatggcatcgagctcaggattatatgcacttgcttgactcgaaaaaagcagcgccgatggctggcattcgtgcggccaggcatgtttggtggagcagtgaatctctatcgacttggccacgaatcccggtataggtccgaattgcggctgctcgtcgcggcttctcgtctacacaagcccgtcgatgattgaccggaggtaggctgcccagtggtggccacgcgtctgcttgtgtgggcaataacaagggatgcatgcaggcataacatgcttccatgtctctctgcccatcaacgattcctgatgccttccaagcttagatagatagagttcaaacgtaacagttgcaaagttcagttggcatatgttaacttgtgagggcctaccatacggagtatgcatatatatgtatatattttgggggaggagctagcagacaaacttatttacagagtcaaaatcatgcagtctctttgctttgcatgcatacataagacaaacttatttacagaatcaaaatcatgcacgttgatagtctctttgctttgcatgcatatatatacatatataagagtattgatgagcagtcatgtcttcataagacctggcacccgttctcattctgagtagagttaccttcttctccaatatagttgtcattcttggattttgcttatttagcaaagagtaatgtttagtaaaaattactatagtgccctctattaaaaaaactagagaccggggcgcgcctttgcatgccgcctgtatatagcaggatcactcgctgtagcaattgaacaataaagttaaggtaataaagttacaggatagtaaagctggatctgataacaaacctatgaggtaagtaattagttgataaaatatgagtaatatatgtatacatatcttgatttttatttaactgtaaataaaataacagttcaattaaattaaataagtgtaatataaatcttaatttatttagctatctaattataaaacgacagtccaatagttatgattatgattaatttgctacctaacttactgttttttccattaaacttttagttacaaaatagaagagaatacaagagtacggaaggagaggagagaagaatgttcatacgtacgtgatatagtatatatagatctatatgcgtatcggtacgtacaattaatagtatggatgagaggatagtttattttcataaaataaattagttggcccacctgtttaagttatctatatatctaatggcttaaaataacagattcacgatttaaatgaaattcaagggtcgatatttagagtgctaggtggtgtcttgagagtgtttgtaggatgtccacgtggtagcttgagagcgtttgtaatatgtttaatggacttttagtatataactaggaagatagcccgcgtgatgcacgggcatgtattagagattatgtttgaaaaaaattaaaattatagtataccaaccagatgatacttgtcatttcaaacttactgtttatccataacttatcatcatcagtgtgtctattcgtttgtttggaaacatatggtgttttttcttatttaataaaatgtttaggggcgttctttttttagcaaagcctaattaacattattgttaatgaatatgttttatttgtaccaccaagctagtcctactagttggttcaattgacgcaatttgttacatatttacatataaattttttaaagaaaaaagaaaaatacctagtcaatatgactccgaacattttagtttaataattacaaaaataacttctcaaccaactataaatcactaactttgtgtggcttatatatgcaataatatgtggagtaactcataatgtcatgaaagcctataatatctaagcacttaaaaaatgatatggccatggaagatgcaatagttgttctaattttagtgaaaagtaggaaccaacgttccttttatatttcttgttttattttataccactcctattttaagttcaaaatatatgatttatagatctttaaattgttggtttaattatgaatagagcaatttagactagaaattagaagtgtggcataaaaattatgtatgttttaatattattgattatttctccttttagtttgagagctataaaaatatctaggagggatagaggggaaggcgcgagctgaggggtgaggggactaactagtgttgtgtttgtccacatgtgaggtggagggggaagtttttgttttttgggccagttcttccctactttctataaatgatttaaaaccgatgatctattgttttgttcctaaaatttcaaatatttttttctaactattaaaatgtaacacctagcggcttaaaattttctttaaaagtagttttaatggttcaaaataatggatctacatatttatgtcgaaactgatggtcaaatgttttttattataatttctaatattttatttttaaatttaatacttaatacatgacattgttagtgctctataaagaatgtatgatgatttaagatgatataagaattattatcaactttttattgttctatttttcttatttggttgacacgcataggtgtttacaaatgacgtactgtaaatatggttgatatggatcctgaattatttatttatttataaataaaacaatagttcaaaagaacttaaaaacccgatagtataacttaaagatatagtcatttagattttttattgttatttattttttattaagttgttaatgagttaaaatttagaataataaagaatggaatgagagaggagaggaggagaaagagtacgtatgtatataataagaatatttattttacaagtttaatacattataattactactgttttattgtataaaaatagaataaatgccttattgattgattaagatgcatcttttttagttatcttttcataaatatatttatatgtatacaatatattttaaaaatatatacactacaaatataataatattattttgacttactctaatatcggaatgagaggagtattttttggaacattatttaggttcattcagttttttcattgtatatctaatttaatcattgttaagctatatacggtgataaaatctatatcattatttttttccataattttataactttttgagttggacagaaaggtcgaaaaatataaccaaaagttacatatatattttttgatagttgcattatagtgaatgtgggtcgttaaatgtaaaatagtatgaagaatgtgctacgtgcgtaggcatggatgtcttgttattaaaataacattatttatacgatttagatatcatagttgcctaattttttagcacaattttttttccaggtgcgcgcttttcaaactgttaaacggtatggtttttttttaaaaataaatctatgccaaagttgctttaaaaatcatattaattcattttttaaaacatggttaatgagttgcttcattttgcgtgctagggagattaggtcccaaccccatagaagtaacataggcggttcattttactttttagaactgtagatctaatttaattatcgtgaagttatgtaagatgataaaatatattatcattattattattattattattattcatatttcttccaattgtttgaaatgcatgcaaaagtcagaaaatatagcccaaaattaaaatatttcttttcaacttttaattatagtgaattttggtctttaatcatgaatttggtcgtaaacaatctaaaggcatcgatggataaaaaaaacaattatatgatttagatatcgtagttacttaattttcataacaaataaagcaagaaaatatgagaaataattaatggaaatagaaagagggaagggagggcgtatgtaggtaacttagaacttacgtacttaatgctcggtggggccgggtttaggggatgatttttttaaaaaaaagtaaatctaatggttgtaaataatgggtctaccaaatttaatgaaaatcaacggttattttttagagtgccatgtgacggcttataagcgtttataggatgccacatagcgacttaggtgcatttgtaggaagattaatgaacttttagtatataatagatagatagatagatagatagatagatagatgatagatagatagatagatagatagatagatagataaaactaggataaacatattcatttctacatggctgctctttactaggaattgaagaactcattgacagatcaaagctacaaaatgtattcatattgagattttctcctattattggagaggtatacatctcatacttgacatatatgtctccttttatcttacaggttggactaggatttataggccgctgttcactgcatatccattccagcataacagaaataatggcacacgctattcacttacttccagccggattcactaaagttgtatataacggagctcgtgcgtgctggtgaactgatcagcaaacagcgccgatggctagagttcctcgtcagtagatagctgctgctggacctgaagacgccgaggtggcggctggccttcgatcgccagagttctctcatcagttcaccttgcagcagcggcttctcgacggcccaagccgtggaagcgtagccacaggcagagtgccgtgtggcagccgcgcgccgacgtgtaaacccaataacggatgtgagcaggcatgtcctgcttccacttgtattcttgtatgaacgattcccggtgccttcaagcttagacagatagagaccacaacatttagctggcatgttataaaagatgtaaactatgttagttccaacaatgtggactatattgtcatattatgggggaggagctagcatagtaacttattgagcagaaagcacatgggtcgatggtctctttgctttcaatgcgtacaattatttatgattattcacctctctttgagagcttaccctcgttctcattctaggtttacttagcttacaggggaagtgttctttttttcattatctgatgtagcatatgtgtggacgcgtgggagcggtgaaactagtgttctaccaactttcaagaagttaggatataatatacgaaatgtacaattctgtatttctattggcatgtgtggacacttattaagtacctatatataggggagaagtgtgtggtcctttaggagctgaattaatattcttgaggtcgtctaggattgtcaaagttgatttatacctatgtttttatttacattggttactttaattttgaactaaccaacggcaaataaatgagaatggagggagtatgtgtactaaatggtgtgacttgtttacttctttattggaggttttctgaaagatcactccaacatgttactcttaacataaggttttcgtcgttttgctggcacaatgagcacaccggtctcttaacataagttcaaactttcactatgacaagtttaattaaattccctttctatgcatgggcctaattatttggtatcttatcatacaccaaactacaaaataaaatccacaaatatacctagctttcagcacaaccgaaatccaaacatgcatccggaatttcaaatattttaatatgatttatttttcgaatatattttttcggtttgatgcaatgatcatcacaatgtgttgccatgcacggacacacatatagtttctcttcatatatctccaggtctttaaatagtactatgcattctcctctttggtgcaaccattctgaatcaaagaaacaaattaaagccagggattactcctccttcctttctgttctcaagattgatccccacgtcatcctactgcagcagcaaagcagaagaacaacacaatagcagcataagaagatgactacacgtctacacctctcctccctctattctctcccctctccctctcttccctgcagcaggaaagaacagcaacctcttgcttgtcccgggaggtattctgtaggaaaccctcaatgtagtggttgttttggcgtggttaggtgattaggagcatacttaaaagactcggccactactatgtagaccatcaaaccccaccttaaaaataacctctcctcacccttccttttctaaaagaaggcttacgacagaagttttatatgatatttcgccatttcaatataaatctatatatgtacaatactctatacaaatgtttcttttctaagattaatttatttttgagtttgttagcctgataacattttttccactgcaacatgcatccatagagtgtcatatttcagtgagcacgattacaatgaacagacggcacgaggccacattaacgccaataccgttatacatttttttcctaataccacttattcctactgcattgtgttgatcaactttttttttaactgcattgtttatttgcatattatctttcccgcgaaagaagaaatgaattataacaatgatattaagaaggaatgatatgagaatatacaagggagaagttataacagagaagagtaaattgcgtccgcggtacacaaacttgttaggtgggtgcaatttagtgtaaaaacttgaaaaactctctcgttttggtgcacaaacttgtataggtgcgtgcggactatgactaaacagaatagcaaatctaattttgctgagttggatgatgagtagaccgccaactaagcattcacgtaagaaggacaggttcgcctgctcgtaagcaatggccgtgttttatcagaaaaccccttctattgtttggtatttcgatcatgtataatttttcagtgaaacgaatctgagaggtgttcatagcggcggggagctggggaggtcgaatccgcggaggttgtagtgatgggggtcgagccgatagctacgccgtggggggagtcgagtccgacggtggctacaacgggtaggtcaagtttgacggcagtggctgcaacagtattgttgagactgacgatagtgacagatggcgaggaggtcaagtttagtgggagagcttagaagttgatgctgcggtaggcatttgagtggcttgctttaggccaacattggttatctcagactctgacaattcatatagcaactttgaagcctagctccaatgtttcagtgcagacattgaagcagcaaggaattaagccattgtgccgtcagattaacagcatgaacattaaatccactgaagcaacaaggatgtaatgcttaattgtacacattgtgacaaaatctgaacacaatgaaacacgtgagtgcatattttgaacagaaactgaaatcctgaataaaattcagtgaataacctgaatgaaaactaaatgcataacttgacatgaatttgattgtgcactagtaatgtaactcaaaattgataacatggaaccaactttatgaatgcatagtataaactactgtttctttttcttgggagagtttttcttcttgggtgctgcacttctcttcctcaatgtggccctgccttgtttggttgatgtggttagtggtggttgaaccccttctctcctattagtagcaatgaaagcagtctctggcactgctcctggattcaccctttcttgatggttgctagcagcctgtaaaagattatgtactaatgttatgatggttgctattagctgacaaaatgctagcttaatgaaggattgttttttctttgagaacttaatgaaggattgtcacctccttaataaaagcttccaccacagatgaactcagatagttagaattttgctggggtatgctaagtaggtgcatttcctaaaacaaatatatgttctgtttaaaattccttgttagtgcagctaaacatatacacaagcaaaatgagcatcaatagtacctgagtgatgacaggttcctgaaacaaatatacaatgagtttaaaattcatagttagtggagataaacaaatacacaagcaaaataagtataaatattacccgagtgatgacaagctcttctgaatcaacaattgatgaagtcgccatttgtacataggttgcttctgaagttttaagtcagccttcctttgtttacaactagttttgttgtgaccaccatttttgcagtagctacaatgcatctctactccatgctttgaaattttagtcccaccctctagttcctggggctgttttctcctagttttctttggcctccccactttcttctcatatactggtggcttcacctctataccctgcatcttctcccagtggatactatctctcagtggcattatgttgtagctataagcttgttcatagcacctggttgaatagaaaaatgacactacatcctctggcttgattctttcatgtcttagacaggaaatggcatggttacaaggaatcccagtgagctgtcacctcctgcaatcacatctctttacattaagttcaacaatgtattgagatcctttgtcgctaacctgaaatgctcccatcccagtaggcaaaacatagcatgtattagccatctctgtatttttctcgaccttccgttttatttttgggcagaggccacatggccaattcctttctagttctttttgcttggtgtacaacctgttcatgatctgatttctaatcctctcaagcatagacaaaataggcatctccctggcatcaagaatgtacttgttaaacacttctgagttattgttaagaaggatatcacacttcggaaagtcactgaaaaaggctcgacaccattggtttggaggaatttcttcaaggtacttataagcttcactacttaatgccttcatcttttccatattggcattccactcgggcacagtgctagatcttgcaatagcccaaagttggttctttagtgtctc

SEQ ID NO: 65795 - DNA, 7098 bp, Oryza sativa
ccagaaaactgtgagatgaatttattaagcctaattaatctatcattagcaaatgtttactgtagcaccacattgttaaatcatgacgcaattaggcttaaaagattcgtctcgcaatttcctggcgaactgtgtaattgtttttttttgtctacatttaatagtctatgcatgtgtccaaatattcgatgtgacagcgtgaaaaattttgtttggtaactaaacatgccctcaatataagtgcaacttagtacagatgtacttcctccgtcccaaaatactgctacctaggatagaatttaacccatcctaggtagcaacattttgggatggatgtagtaatatattctactgaatataagggagcaatctacccatcggacgtccgatgacccaaaaaaaatcagacggtcaaatgttgcagttggccaacaggtgaaacattaagttatatatggtgaaaaaaaattcagcaactgaaacatttaaatattttatgaaacatggtgaagatatatgttgaaacatgtcgctgtcatgtatgaaacaagtattaacggatcgaaacatatgtttttcttttatcaaaatataatcattcgatatcttgttgtaaagatttaattaaaacgaatacaatgatgtgatcggatcatagattggataagtaatttaagagaaaaatcattttgaagcttgctaaaatatatgcatgtatgtatggatgaggtggagagagaggagagtagtggcagttagtttcaggaattttgtgaaacacactgaagatgcacgttgaaacatatcactatcaagtatgaaacatttagttttaacggtttgaaattcatgtttttcttttgaaataatataatcatatgatatcttgttgtaaagatttaattgcaacgaatacaacggtgtgatcggttcgtagatcggataagtaattagaagaaaaaatatttaaagagaggagggaaaaaaatgaaaagaaacaggtagcatacatgttacagtgaggttcctccgatccatcaggctttttagtagggtagacgaggcgtccgatatttccgtttcgtcggacgtgtgatacaaagcattttctgaatataagacaaggttatacttgcattgggacgtagggaatagaagaaaacaaattctactgaatgttgcctatatctgtgacctttaaattagacccctctctattctctgtccaaaattgctttcctagctacaaattaagagggtctcattgcaaactagctaggtttctattaaaaaggcaaaaagaaaaaaaaaccatattattactatccccattttaaatatataacgctgctacataaaacaacccgttgttaattagctttcatttgtgtcggatcctgactggaacaataacacacataggggcaccgatgagccccctatcactgccgattaattttgaaatagcacttatgaggttgacgagctgcaaagaaaaagattaattcgagccagctcgttcaaatcaatacatagacgcatgcccagatcaataccaaatgtccatatcatcaaatccaagtaaacatcaatatttcacagatcaatacacatcgatgtacacactcacaaataaatatgcacagatcaataactgagaaatccaaatcaacatcacatataaaaactaatcgatgtatgcaccaccacaactacagaacctaccgccaccgcggtcatcgatctccctcttcttcagtccagggtccctagatcctctggtctatatgctccttcgatcatcgtcatcgtcgcattaggtcaggcccgcctcctccacctgctcgtgttctcctcattagggtggaagaggtggcaagagggtcagattgtaggcctgagcttggggggtgggtgggggggggtggatttggcacccatgcgaccttctccaccatatggatcggggtgccagcgtgaggagaaaccctagtggagatggaggaaaaagaagagctaggtagcgagcaaggaggtcgctgcctacgttgatgcttcaggaggagctcgtcgttggcacctatatacgttaagaagcgcgtcgacaacatagagatgtagggcagtgaggttagaggccaccgctacctgtgggctcattggccttgctattctcattctcaagctgattgacgtcataagccaagttagacgtcgtcgcgagttggagagattgaaaaaaaatggagaagggggagaaaggggagatatttaactatttccattcttagatgtggcgattaactatttgctatatggacccacatgttatagacatatgaggtcccacgtatcattgacatatgagtaaaaaataattaaacaccaaatttaaaagtagcaaatagttaaatgccccgggagagagtgagataggtcaacgaggggagacttgagatcgatgtctacgggctcttgggctgttgacttggcctgagatatggttcggctcgctagctagttcctcctatcagtatcagtttacctaaagtaactaatgaattatcattaattagtgccggtttataataaaaacggtacaggtaaaacttgatactccactagtggtgccaatttacggacactactgaggactcattactgcaggttcttagtgacactaggcacatgtatgtgggacctaatggggcatcatcgatgaggcgctacttttagatttgatatttgactatttcttatattaaaaatactttataagtaccatttatgtcattgtgacgacttactttctcattaaatttactttaatcataacttattttttatttcttttaataaaacaaatgcttatacgtcatctcaaaaatcacattggcatatatttaaaaccgagagagtagcatggggagcattgtaggaatattcatcattaattaccacaacacttattggcaacttagagcaggtacaataatgggcgataggagatccatgtaggattttctgctgagctggaggagagaggggaggggagagggcgcaagcgggcgactaattagtcgcccggctgtacgcatggcccgaggacgtgggcccgcctgtagcaagcgatgcacccgtgctactcgtcgttgcctgcgtcggagcgtccaagtccagggccgcgccgccatcgtcgcgcacgtccgcgtccgccgccgctgccgcctttgtccactgcgaccaccgctaccctcgtccttgtcaaccgtgctcgtcgcctctgtatgccgctgccgccgaccttgtccactgcagctgtcgccgccaacttcgtccgcctcggccacggctgccaccgtcgtgtcgttgccctcgccctcatcggtcgatgttgcggctctcgtctaccgtggccatggagagcaagtaaaagagagagaccaagagagcacaaagcttggattgagttttgaggccttgtgcttatgaatcagcttgatggtttgcccggttgcttcacttctatcttccaccgttccgcgtgtagaaggccagctcaacgccggtcgccggacgacgagctcggctccggtgacccgtttgctctatccccagctacacgggcagcgtgagcctgcacgatgagctgtttatattttctgattgagaaaatagaataacatctttctctagaaaaattagatagcttaagcgaagtagtagcatacgtatatgtatatattgttctgtaccgattccttccatgtagatgagcagatgtatagtacaaaacagatgtgtatatagccataaatttgttcatctttttggccatggatgagcttggatgcatagttcctgagaagcaatcgccggcgagaacaggggattaggggagagagagagagtggggatagaagggagattaaaataaaatttcttgtacagtgtgggccatagtagtatagcttgattattgtgtttactggctacagtgttacctatagctgagatgaatcaaaattagagtaagcagctggctgcactattgaccttgctcttaaaaactaatttatatatgggtaaaactattatataaatatatgttatatatacgctattagcgacttaaaagccaatgctaaaaaataaattatgataaaaataatcaaatcaactctaaagtttagattttagctgcggctaataattaataagagtgaagaccacgcgctgtgaatctagatagatgatcttcccctgttccagcatatcatgggagcacgtacttcccaggccggccacaacaatatttggtgtattaattgacttaatttggttgaactgatataagccaataattattaatacatgtgtgtttgaatatacaatgaactcatttgacactattcagtactccaatcctggtacatacgtatataagtacgttcatatgaattaatacaatagataaaattaagcaactggacgtatagacgacggtatagtatactgtacacgtatacaatatacgctcgaatgagcggaatctgggtacagtcgccaactgccaaaacacaatacgcacattaattatattcacacgtacgtaattactttctctgttccaaaatgaagatatttttaaggttgacataagtattaagaaagtacgtgagaatgattgaaggaagtgtgtgattggttgaaaagagaaagtagctaggtgaagaagaatgattgtgattggttgagaagaggaggtaggtgaagaaataactttattttaggacaagacactgtgctagaaatagctatattttataacgcgccacgcatgtatagatcatcgatggggatctatgtatatctgtatatatatgtgctgcaatacgcacatcatatatatcgatcgtataaacataaaatgataatatatctgttctctgacgagagcttttactacccgtgtcagtgtatttattgaccggcctaattgagctacaggagcctgcaattttttcacttggaaaaaatgggacagaaaataattaagttgaactagtatacatggtatagtacgcgacatgcctcgctggatcactagctgtcgtacgagcgtacatgtacgtgaaaatataccatttggcctacgtgcaatgcgtacatatatatactagtacgtgcgtgttgttgggtgtgcagcgctgcaggccgcgcaaagtacaaattaaatttagtgacaaataaaaagaaagcaggagttaatattagaaacaaaatatgaaatttaaagttggctgtggcttataaatctatcgcaacgcaaccctataaggccatgtctagtgtattgttttagcatcaatttttcacactagctagataaaaaaaattaatggagaaatattatttctatactcttgaaagcttagccggcgatcccttcaatgcccttaagtatcatttgttaatatataaaaaaataaatatttgttatcattatctagaagtatcattttgctgtgaataatatatatatcgcacaacaaagtcatgaatttaaaaagtcatatacaacaagcttctacacttttaacaatatagtttatcaatttatgtgttcttcttccatgcacgagggtaaaattaacctctttcatagaaattaaacgatcaactaaccgtcaactgacgaaatgggtataaatgggtatgtaagggactaaaacaaaaatccaggggcattcaagaaagtgagcaatacttaggggcgcataagagattagctgaaattttaagagcgttaaagaattttctccaagaaatgatagcacctgtgcatgtacagacatccattatcacaatcccaataccgataaaaaccgctcccgagtgctatctatgaatttcgtgaaaacctttgataaactaacaagattaaatatgaaaaaatcatataaaaaatttaaattcattattaacttacccaaaaaccaagttgtttgtgttttttacttggtccagaaagtccggatttcacggtttccattgatttttttaaattcatactccctctgtcccattttaaacgcagctcatgagtttctgtggccaacattaatcatttgttttatttgaatttttttaaaaaaaaattaaaaacataagtcacgcataaagtactattcatattttatcatctaataacaataaaaatattaattataaaaaattcaaataagatagacgatcaaagttggacataaaaactcatgactacgcttaaaatgggacagagggagtagatatattaattccatggactaaaaaaaatatttctcacccttaccaagtttgctagtaattgcttactatgggggtgtttagatccataggtgtaaatttttaacgtgtcacaccgggtattatatagggtgttgaatggggtgttcgggcactaataaaaaaactaattacaaaatccgtcagtaaacagcgagacgaatttattaagcataattaatccatcattagcaaatttttctatagcactacattgtcaaatcatatagcaattaggtttaaaagattcgtttcgcaaattagccgcaatctgtgtaattagttattttttagcatatatttaatacttcatgcaggtgtttaaacgttcgatgtgataaggtataaaatttttgtgtgggaactaaacagggcctacttgttccttgcattattttttttgttaggcccactaaatgctactagcattgatgatagcaacactagagagaaagagaaaattcatgtttataatagttttaaatgtatactcgatcgtctcgtttcacctgcaatgaaaaaaagcttaagccaaccctcacattcaagcacagtactagagagaaaaagagaagatatatattcacctatactatttaacatggtatatatatactacccccatccatatatgtataacattggttagtttattgaactaaccaacatcatataaaaaaatggagggagtattaattaatgtgataacattaattagttttatctatactgaagacataccgttctgat

SEQ ID NO: 65796 - DNA, 1453 bp, Oryza sativa
  unsure (1)..(1453): unsure at all n locations
tgcactccttcgcatcaaagtcaccaactattatggcagctatttcaccgcttgttggaagattatactgaacatcatccttagcattgcagcctagcaaacacaaagttatcttctcatcgccatgttcagcaagtcgtgacctggcatacctaaaattctgaacaagtttgttgtgcgtgtcaagcatggccgataaggctgcgattattttagggtcaggcctatcgttgctatcgcgttcattctcgaaaatgtttaaccgattttggacctcgttagcaagatcatagatgtaaagctgtgcaaattttgatgtcgcaccatgcgatggcaaaagagtgccaatcttgtggtgcacaacaccgttgattttgaaaacataaggtgcattcccagtgttaattgatctgtcgatggttgcgcccatcgaagtaaaagcaaaggatgaattgtatgatccaatctgtcttaaaaatctcttcgatcgagcatcaccatcagattttatcagagccgcaagaggctctgggggctgctcaaaacgaggcacttgtattttgccgctcttgcaacatagattatagacaattttcctctttgagacagcagagagtgacttaaccctctcctggaaccaaaagacagcaccacaatatggacactcatgcgttggaggaccatagtatgaccggcctgggtaggacgctgtaagacacacattttaccattgtgagacagacatgtttttttcattaaacaaagcataggttgtttttcctatcgcaggatacgaacccttgagcgactggatgtattccctatctgttgctgatgaggcagtgcttggcctgctagcagaagctgcaatacaggcagatcataaccatgtcttaatcggcgtgggtataacagaaggataacatgtctatgaaaataactntctaccataccacaaggagcgtgtggtggcggcaaaggaggcagctttgaccgcagtaaacaacggtgctgtctatgcagcttggataagccatctgaaaaatccataagggaacgcggcctcttactccgatctaccgcaaaggttcagacgatgttcccaccgtgctctgtatgtccattgcaaagggccgcagcaagacattggtggctcgcctttcacggcttgcacgtacccttcggaccctatctatactctgttgcgacatctgcagagcataaccaaacaattggagcaaacagggagcaacgaagaaaccgtgtgattgcatgacaacagaagcagcagcaggcacgctaccgtggtgaaaaggatagaggagaacgaagcagaatgcactcgaagaaaagagggcaggaagacatagctcacgacaggtacaacacctcaataaataacagcatataaaacaaagagtagcatacagaaaacacaacatctccgagtggc

SEQ ID NO: 65797 - DNA, 5706 bp, Oryza sativa
  unsure (1)..(5706): unsure at all n locations
cgcaagttggtcggcgcacttatgcgtatggaaactctgattgaattttgtccggttcatgaattcgttttagtttatttacccctctattttcattaccaccatttttttcttgattttctaccataaaaaaatgggtctagctatacaattttcgatagaaaatccgttaagaaactatagtactacattggaattgccaaatgtcatttgacagaaaatccatctccaaatgttgcagattttgtgccatttgatgtactttgcgattcgtgctcctgcccttctttttcagctcaggcaacctccttatcttctccggcgctagcggcatccctaaactttggtagggacctacagattagggtctcggttggggtcaaggtggaagggggaagaggggggggggagtttgcctattttagagggatggccacgtgaggtggcagtccggcggtgagtagcggattgggcaggtggcaaggtggcgttgacactgtcgttgccgcgtggctggtgctggtagcgagggtaaagtagaaggacattaggatgtaacgtcccgcctcccccaggccgggcccacttacatctgatagctttcataggtcatagactgccctcacagaccaacacatatcttttctgcacactttgtcctcactcatgtgcacccgggttcccggtcggtcacccatccctgccctcacagaccaacacatatcttttctgcacactttgtcctcactcatgtgcacccgggttcccggtcggtcacccatcccaaattgctccaggccaagcacgcttaaccctggagttctttggagattggcttccggaaaagaagttgcaacttgttgatatgagtattctattaatcctattaagccctaggctgggatgttacaccctcacccccttaagagagatcgacgcccccgtcgatcaaccctaggccaggaacgtcctctcttggccacgtccatgtgtccagtgccagcgcatgtgccatgctgtgtaaccactcccggtctacaccagccatgcgcaccatgcctgcgcaactgcgacacacgcgcccgtgaaaccgcgagagtcggctctgataccattttgtaacgtcccgcctcccccaggccgggcccacttacatctgatagctttcataggtcatagactgccctcacagaccaacacatatcttttctgcacactttgtcctcactcatgtgcacccgggttcccggtcggtcacccatcccaaattgctccaggccaagcacgcttaaccctggagttctttagatattggcttccggaaaagaagttgcaacttgttgatatgagtattctattaatcctattaagccctaggccgggatgttacactccgttaagaaactatagtactacattggaattgccaaatgtcatttgacagaaaatccatctccaaatgttgcagattttgtgccatttgatgtactttgcgattcgtgctcctgcccttctttttcagctcaggcaacctccttatcttctccggcgctagcggcatccctaaactttggtagggacctacagattagggtctcggttggggtcaaggtggaagggggaagagggggggggagtttgcctattttagagggatggccacgtgaggtggcagtccggcggtgagcagcggattgggcaggtggcaaggtggcgttgacactgtcggtgccgcgtggctggtgctggtagcgagggtaaagtagaaggacattaggaggaggaggaggccggtggtggtggatccaacagtggggagtcaccgaagatggggaagagaacgatacggaggaagctcgctgccagcagcttgaggaaaaggagagaagggggagggggaggaggctcactggcaccagccagctcatgagcccgagcgacggcaatgctagggctacggtggcggaggcgacatagtcgtgatcttgcatggtgagcggcattgtgaggagagccaagagaaaggggatgagaacagggttttagggtttggttgccctgtataaatcttaaagcaatcgagtggtccagaatttacgaaattttttagagcgttcctatcaaatggtgtgtagatagtcccatagtacaatggtaactttaaatatttacattataactcgcacataactatgatataagttggatgtaattacattataacttattctaagtcacgcaacacagtggtggagtgtgtcgtgggttttaaccttgtcccctgcatgcgccgtttgatttttattttcttttcttgtcctgcacatgtttctcaaagcatatccaaatacgaaaaaagggcaagtttctcaaagcagattagggccttctcccacccaaatccggtggcggcggcgacggctcgacagtagttgtcgacgctaggccacgagcctcctcccacacggatccagcggcggtgactatcccccgcccgaatccggcggcaggagcggacgacggcgagagcagcggcagtgggagcggacggtagcggctcccgcgacagcaggagtggagagcacgacgccgatggcgggagcagccggtgtgatttttttttattttggatttttagttttacatgcagcccatgtaagcagccacatgcgaaaatcactattttcgcataccttctcgtgcagacaggtccggtcatccgcatgcaaaaatctgatttggccgtctgcaaaaatcctttttttagtagtgttcccctctctcgaatttttcgtgaattagaaacacaagaatgttacaaggaaaaagttcacttcttcagaaattctcttagaattcatcaaaatagagagaatctattctataccattgagtttgttatagttcaacaatttaccactaactttatttctttctacaatatatcggcgactttataaattattctacaatatgccattgggttgggcttatttttcaataatacctaaaatacccttatggacatataagattaacagttgatttatctcattagaagtttcaaaaaaatatgaaacttttatgtggcctccttacacagtataaaagtttgtatataagtttcaatttctttctatttatatttttataaaatataacatatatgttatatactatataaaatatttttttgtgttgttgtttttaatgtaaattatctttcatatgcaacataagatattttttgctgttatcttttgtgtaagctatttctctctggtataccacacaaaaatattttttctaaaaaaacaaaaataccaaaaaaaatgaaaatatgtatacatacttacttccctgttgtgtgaggaggccatataaaaaattttattttttttaactttttaatgagataaattaattgttaaccatgtatgtctctaagggtattttgggtattttttttaaaaaagagccccatctcaatggcatattgtagaacaattgataaagtcatcggtatattgtagaaagagacaatatctgtggtgaatcgttgaactgggataaactcggtggcataaaatagattctctcaaataggtatgcccatttaacttagctatgcatacgacccaaccatccgactaaggtacgactgaatttgatcaacagttgcaaatagctgtaacacacatatataaacatgctctactttaattgatttacggttgcatatctctagttgtaaggctgtatacatcctttaagagtagagaccggtttaatccattatctttaaaaaagaaaaattacgaattaccccccaaactatcgcggccgaccgaattacccccctgaaccacaaaactggacattcttcaccccaactatgcaaaccggatgaattaccctccccccttgatccaatctatggaggttttggtctacgtgacatgtggcagtccagtcagcattctatttataaaaatatcggacccacctgtcatactcttccactcttcctctctctcttctctctctcacgggcagcggcgcgagtggcagcggcaggcgtggctggtggagggtggcggcagacgggcgaacggcgcgcgaggacggacagtggtctcacggagcggtgccgtgacgtctcacttgggggaggccgcgacggcggcgggcggtgtgctcatcggcgtgggggtgggggtggncgcggcgccaaccgaggaccaccggcgcctccgcggccggttgcggtggaggaggtccccggcgcgagtagcctcgcaccgccagagatgcgggcgggggagatcctgtcacgtatgcaccacggcgccgccccacgggaagcacccgtcgttatcggcagcgccctcgtagaacccaatcctcctctcccgccgccgccccttctcctcgctggaggagctcgcctcggatccctcctcctcctcctagtcgtcgtcggtgccgtcggagtcggagtcatctccggagtagtaggtggagatttgggaggagatgacctcctcgctgcgggatcggaggcggaggatgagcaccagcagcgccgccatgctcggcccctggaacctccctaccccggtctccaccatcgccaccaccgccgtctccatcatccccacctccgccaccaccgcccaccgcccgtccgctccccgcaccactgctcgccgccagccgcgcctgtcgccgctcgctgccagccgcgcccactactcccgctcatgccgctgcccatttcctgcccctgcatcaccccttgagagagagagaggggggggcaggaagaggggaaggggaggtatgacatatgggtcctacattttttaaaaattagaaaatgctgactggattgccacgtgtacgctacgtaggacaaaccttgaactagcattcgtttggtattaaaagttcagggtgaacagtgtctgattttcggattcagaggtgtaattcggtcgaccgcgatagttcatagggtaattcgtactttttcctaaataaaaatatagcaatactcttagctaagctatgtgaattctgcactatatacggtgcccgtatacaagggagcaagctatggacctgtttaggtgagttttagattctgagaagcagttgtttggtagacagcttctgagaatcaggaaaagctctgaaacccagtttctccagcttctggcttcttagttcatttttcagaatatgtaactataaattctcagaagctgtggactgtttagggcagcttctagcataaacagcttttggaaaaagctgcagctttccaaagctgcagctgggatcaagctcccccaaagagggcctatatctacaagccagctacaacttattaccccgcctcgatcgtctagctcccttccttccgggcgttcgtgcaatcgtgcgtgcgcacgatactacacggtacgatcgatattacaacgcgcgcttgcatgatcgccacattaactgcatatatgcatcgatatatcagggtgattcggggatcgacagccggcgatcacgcgtatccgcgcgtaaatgcatcccatcccatcccatccatcgcacgctgtactcaccaacccacgtaccatccatcgatcgcacgccggaatcgtcgtcggaggacgacgacgacggagacgacgccgcacctgacgc

SEQ ID NO: 65798 - DNA, 2623 bp, Oryza sativa
acaaccactaaaaacatggcgaacaatgcacggatccgctaacacagacagagatggaaaggaaggaagcgagaaataacctcggacgaagaggcccgcgaacgccgtgggacaacaaggacgaagcaagtacgagaggaggacgagacagagaagacacgaacgagtcgatccagaaagcgaaggaaagataggggggtccgcactgaaacaaacaaagcaatgtaatcaggacatatgaagcacaaaacataggcaggggatacataggggcctgccatgcggacccaaagcacgagagggaaaacctaccgcgagctgccgccgcggaagacctttgctgtgctgatgaacaggttcaagaaccatggaagcagcgatccacgccgtgcaaatcccggcccctacgaatgaacacaacagacaccaccgaacaatcagccaataagggataacaaaaacagaaagccgacacagccgcagaaaagcggagcgaccgcggagaggaacccgctgcaagccagcgccttaccctgccatagcggatggaaccaaacgagaccaagcagcggcgaattgaacgcggcagcacaggcagccaaaagggagcgaaaacgacggtgtaagccctagaaacgaagagcaggaagaagcactatcgctggaaggaaggggaaaaagagtgtagaagggatgcagggatccggaatgtgaacaacaatgcacccaccaacaaggaagcaaaggctgtggggcccataggcaataggcccaccgaaagtgcacacaggctagcacagcctcggtgcaaaacgaaggcgcaacagccgagtcaaccgagggcagacgacccaatcaaaacgcaccggacaaactgagcagctgccaaccacacccacgcctgctcctccaaccacccagagcacggacgcgcaacacaaacaccggtagacacagcgcacaggaaagcaggagcaacaaaaggcaaaggacccacgcatcagagaggaacacatggaggaacgatcccaccagacaaagaacaaaaaacggcagcactggtgccaccgcagcagcaacaaaccatggacacagctcacagtaggtaagaaacgggaaccagccgcacggcccacacggcagagagccaaaacacatggaccaagcacacgagcgcgctgagctgacgagccgcacagaagcaacgcagcagagcgaacgcaaacgccgatcgcccagcacggcagctaccgcaggccgtcaacaccgcacaagctcgatcgaacggacagcacagcaggcaaggagagatggccagccccagcgctcccagcgccggatgacgtgccgcgccccgacagcatccacgacagcccgaaaagcggagaagcgagcaatcgggggctagaatgaagtctttaggtattcaaagattgtgcatggtggacagatgatatatacattgtgcagaaaggtgttgacaaatcattgtatatgcatgacttattcgaaagacaaccttggcactaacttttgttagggctattaatgaaaaagtttttttttgaaatatttatgcagaattgacaaatagcaggtttatcctatatttcacgcaacttgataaagatgaagggggtacatagtatggaactcatcttataaaacttatgaaacatacacaattttttcctcgcaagaaaataatttttcaaacatccaacatttgtgaacaacatgcaaccgacagaattatttggctgatatatatattaaacttgaagatgaattgaaagagataatggaagatacaaacaagacaatattggataatgatatcgatcgtgcagtgccacaatactcttaacgtctagctagcatgttagatagaaagctgaagaaaagaaaccgatggaatgcatggtcgtaaaggagattcgcttctcgtgccggtgtatataagtcgtctatcatgaatttgtagacaatattttctttctagatcaataattgttgacaatattttgacataggaaatcaacctgtacaatatgcgtttattgtgatggtggacaaatgcaacgttggtttacattcatggaaagacgtacaattcatccatatacacacaactcatattactgatcaaagacaacttcgacactaacttaagacttaagagatgctgtcgggaaatgatatttcagtgattatctgttgaggaagcctgatgaagatggtgggtatatatagagtttcatttgagataaaatttatgtaaattatttttccgtatatatgcaacctaaatataactaaaaaatggtagcatgtgaagtttcaaaggatatttgtgcatatgtaaaaaaaagagataaagataaaatatatgtgaccggagtcactggacggttcattttaggggtaaagctaggcatcaagttgagattcttgtgtgggtaattaaaagacctctgctctctagtagttaatgtccttgttgccatcagattaccggtaaagcaaatgcttcccctgcaaagtaatccaaaacatctccgtgccatgcccatcaaattaaacaaagccgaattgttaatcaaacaaggacaagaaaggcagg

SEQ ID NO: 65799 - DNA, 6423 bp, Oryza sativa
ccacccgccgagccagccgccgcgctcgccacccgtccgcgagccgccgccgccgcccactgcccttcaacgcgtgcctgagagagaaggggggagggggaagactgaagagaggtaaggacaggtgggccctatattttcttttatttttttttggattggatttccatgtcgacgccacgtgtatgtcacgtaggagcaaaaccgctcattattgagtcggggggggggggtaattcaaccgatatcaatagattgaggtgtaatataaccggttttgtggttcgggggtaattcgtactgtcgcaatagttcgggaggttcctaaagtttatgcatacgtatgtatatacatgtagtatatgaaagagactataggatcagaaactgaccgcgcggctgatctcacattagggcgcccgttcgcgctcctctagtcagcgtgcaacatgacaaaaattaacctacgtgcggccgaagacacgtgttcagcccatgaagcattatagcccacgtactatcctttcctcgttcagcccacaaccgcatgtgcccaaatatatgcttgcatttggactgttgagtctactagttttcaagctcagtaagcaatgtgttgaaaaaatatataaaaactttatatatgtactccctctatttcataatgtaagtcattctaacatttcctacattaacatcaatatatctagattcattaatattaatataaatatgagaaatgttagaatgatttacattatgaagcagaggaactaaaacttatatgtgaaaatttataaatatatattttgtggggacaaactttatacacaaaaaaagtttaaacatatagaaagggtctacacataaactttacatatatatataaaacatattcaaatttgttttcgcaaataaataaataaaataaaacaaacatgtgggccatctgtcttcatcgtattcccacaccacattagatttggcatgctctcgcaaaggaaagaaattaagatgagctaagcacgaaaagaaaatgcatgcagggaaaaaaaaggtggatgagcgatgccagtcctttagccttgtcgagttccacggtacgacaagaatgtctctctctaaatctaacttagttatagtgtattatagtatcatcgaccttaagttggttatacttaccagccgcttacaccgatcgcttgttctacctgttccgctatacggtacttcctccgtttcacaatataagattttatattattgtctatatttattagatgttaatgaatctagacatatgtatgtgtttagattcattaacatatatatatatatatatagagtactataaagttttacattgtgaaacagagagtacatcctaagtatatctcagtcctagtaatcaactccattcatgtctatatctatctatgtatcatatatacttgaaccaaaatctcaacatacgtttaccacaacaccaaaaaaatcttgatcattggatcatcttggtaaagggctaggagaagatctcagctgatatgaaactgtctttaattctcttctgttcacattcataagtgcatttcatcatcgtaattacgggatgttctttcctgcagcttttaactgaagactatatatattgatgtcctaaatcatgcaaccgaaaaatcagtacttttatcctttttttttgtccctttttcttggggctgtttacggctcgggcgtccgatgatttcaagaaaaatcgggcgctgacgtcagcgtccgatttacgtgcaaaactactttaaactgatttttctcctaaattacttatccaaatcataattcgattgcaccattaaattcattgcaattaaatcttcaaaacaagaccacacatggataaattccgacgaaaaaatagcttattattgaattatttttaaatgttgcatgatgttccaccaggtatatcggaattgtttcactaactagatcgaaatgtttcactcgtttaaattgagtgttgtttcaccttatataaaaataatgtttcaacaaatagcgaaagaatatttcagttcactgcaacattaaatctatacatagtgaaacattgtgagtacattaggtgaaatattttttggtggaacaaaaaataaaccaaattcccttaatagggggtttccaaaatatgtgggttttttgttgcaatggaatgtctcgttcactgcaacattagatctatacatagtgaaacattgtgagtacactaggtgaaacatctttcggtggaacaacaaataaaccaaattcccttgatagagggtttacaaaatatgtggattttttgttacaatagattatttcagttcactgcaacattagatctatacatagtgaaacattataagtacacttggtgaaacatcttttgtgtaacaaagggagggataagtgggtgggtccagatggggagaagggagcgcgcgcatgggggagggggagcgaccgatttttcccacctcccccggtcgcccgattttaatcaatttccctttttctttagcttgcatatcttttcaaattcacttatgtgcccgctgcaactcacgtggtatcacctactatccaaagcaaactctaaccgaatgaggaatcgaatcaatcctaacctagtcacgacaggaaccaaccaacgtacgtaggctggagtttctcagatctatcaagaacactgtacgttgcgtggcattggtacgataaagcagcgattctaacaacaattgactgttctgcaataatcgattcatgattatactagatcgcaatatcttcctcctgttttgttttcaattatccggcccccagcttgtaagatatcagcagacagcaagttcagcacactgcacaccgacgccgacaccacattagggaatgcaggaacacatgggtttactggcgtgcagcaaactgaaacgcggctcatcgctcaccccttccatcgatctgtcggcgcaaacccacattaaacttacccagttacattgctggggaagagagctttactcccggttagtaatctttcagggaaccggaacatctaatcatggactaaagatgcatagcaagtcagaaaaatctgtgggtgtgggatttaaactcaagatttctcacctcattccttacgcacgttaccatcccacctactacacatatttgactttgatagagatgatttttttaaactaaccttggaaacgtttttagtctagattggtgacaccaattgggactaaaaatatatttagtccgactaaatattaatttttaaactaaccctggagacatcttcagtctgggttggtaacaccaattgggactaaaaatatctttagtttgacaccaaccagaactaaagatcaatatttagtccgtgttaatgcatctttagtccggaatagtaacaccaaccgggattaaagatcattaggggcctgacaaggcctaacagctattgatctgtggctaaaagtgatttttagtcccaattggtattgccattgggcttttgaattggggctaaagatattctttagtacggatccaattagaaccgggacaaatgtggtttttgccatccgagtaaagatcagtttttcattaatgttagttcttccctccatttcatattataagttattttaacttttttaaagctaaattttaggtttatcaaacttataggaaaatctgacatctacaatataatatgaaattagttttattaaaaataattaaatatattttaataatatgtttgtttagtgttagaaatgttgctatatttttctatatatttaattaatttcttttaaaaaaataataattttttcctgaatttttcattgataggtgaaaatatgggagttacagagcctgaggaacggtagcatcgtgcctttacattgatttagagttagtagggctagagaaagcttgtttgcaagcagagatcacaaagcgttccgagttcttaattctttccgcctagatggttgcttcatccatgcagcggcgaagcagtcggtgaaggcacgggggttcattcctgaagacaatatcgtgtcggtgatcagaacaaattcaaagaaacttataatacaaaatagatagtaacacgttatgtactttccccatcccataaaaataaacatgattcatagtacaaactacaaagagtactccactccctccatactcgtaaaggaagtcgtttaggacaatgtttaagtcaaatcttgaaaatataaatcatgaataactctctagttgttgggtttaaaaatatttgttgggtttaaaaatataaaaattatatgaatagatttgtcttgaaaaatactttcataaaacaagaagtcaaaattgtattttgaagactgtgtcgccgtgctaaacgacttcctttatgagtacggagggagtatatcgttatctcgttctcgatttaagcctgtttagttggcaaaagaatttatccctacatgtcacatcagatatacggacacacatttaaagtattaaacgtagtctaataacaaaataaaattacagattccgacaggaaaccgcgagacgaatttattaagcctaattaatctaccattagcaaatgtttactgtagcaccataatatcaaatcatggtgtaattaggcttaaaaaatttgtctcgtaatttcctggcgaattgtgtaattaatctttttttctacatttaatactttatttatgtgtccaaacattcaatgtgacggcgtaaaataatttggtttaagaactaaacagacccttattttttaggcaaaatttgctataggacatccaaaaaaacgtgtaattagccagtggacaccgtaagatcacgaatttactgtagggcaccaccaaaaagtgataattagctagtagacactcaagacattattttattatttttaaaggaaaagaggtgagagaatttttgaattgccgagaatgccctggtggcgcatcacgttatcccgactaggtccggtcgagccgacccggctgcaatacagctgcgcccacgccctccttgccgccggcgcgtcgtgaacaccatcacccgctcctcgtctcagcgcgcggaggtcgtcgctgccggcgtgggagagatcgatgtcgtagcccaagaaccgcgccgacgcccacctcggcatcccggtgctcccgtccatatggccggcctcggaacaggctaccatgctccagttgcacgggccgccgtcactgacgccgaaaccagcgttccagtcagcgaggacgttggccgtgtcatgcggtgctgccttgacggccagcaacgcctccgctgcaaggcgcacgcgaatgcagcaagaaaaaccgggtgagtgcagcaagaagtgaaaattttcatttgcaaatttgaaatatatcaagaaaagattgatatatttggaagaacttttatcatcatgattcaagcaagaaagaatggtatgagctaagaaaccaatcaaagatgaaacaagatgagaagacacggcttgcgatcaaagaatttttttattttctttttttcgtgttcagcaccttcgccggcggcggctggggaagaaagaacctccggcggcgtgggcgccacaccggcagaggacaagtcggacaccacgaggctcaaaaccagcacggcgagcaagtaagcagcagaagcagcaactctctgctcgtccatggcgtcagcgtcggcgtcatgcgtgctctcgttcgtcggtgactcggtgtcgtcgcgtccacgccgagagagcgctatagcccaaagcgaaccgctcgtgcgatgcgaggagaaaaaggagacgagacgctcgcgatcgaacactacccgctactggacgcgacatgaagcggaagcgagagctacaaccgcagtgacgatggcgagacgcggttgacgccatcgcgggctggccacttgtcgcgccgccgctctggccacgccgctcggcaagaccgactgggtctggttcgaccggaccgatcgggataacgtggtgcgccaccgggggcattctcggcaattcaaaaattctctcatctcttttcctctaaaaataataaaataatggtctaagtgtctaccagctaattaccactttttgatggtgccctatagcaaattcgcaatcttacggtgtccaacaagctaattacacgttttttagatgctctgtagtaaattttgcctattttttacgtcactgataaagttggttgtaggtacgcaggaggcaggccgaccaacgccgagggacgtgacccgatcgacggggcccgggggctcacgggcgacgcgcgtgatgccacgcgccgaggccgcccc

SEQ ID NO: 65800 - DNA, 26909 bp, Oryza sativa
ttgttgtcctatactgtacagcatcaaagctctaagtatttaattagctgattaagtagtagttaatgaggagagaaactaatctgtcaacgacaggccggtcattccttcaaaagatagcaaaggtcttagcctgcaatagtcaacaaaacttgatctggtttcttggaccaactacgtacatgaacacaaaactattgacagatcttttcactactccatatcagatattagtactccatccgtttcataatgtaagttattttagcatttcccatattcatatggaggttagtgaatctatatagatatatatgtctagattcactaacctctatatgaatgtggaaaatgctagaatgacttatattatgaaacggagagagtagtatatatggagaaaataaatggtccctagctttagcttaaccaaatcaacataaggccggccatttgtcaagtttaaccaatgcttacagcaggcccgcaggtcaatttgctccaactacttaatttggcatatataaataagtcagatgtatatatcgatcaacgcctgtgtaggatcaggggttatttaatatatattcggctagaacttgaattctactactagtagtagtattttagtatcaacttgatgtatcacatatcctataaataaggatccaaaccataataatttgaacggggggagtcattttacaacttaaataaacatccatgccatgccatgcatgcataatcttctatgaccaaactatatatatacgcctagtggtgtggtttgagcgcagtgatattacaaatgggatagaatgatgaaaaagggatgattaattaattaatttaaccacaatgcatgtacataaagaaatactataatgtaagcacatatctatggtctatcactagcaaagtagcaaactttaattagtgctttcatgtttgatgactagctagaagtactaggccgtgcaaatgtctgccctaaactttctcccatcaagatgacaagaagtaacatctcaacaaccatgcaagaaagcatgaatgtttgcaagatgctagctactagctagatgaatatatataggtatgatcagatcgatgcaggtacgcatgataaaaaccatgcacgtaaaatttctccagagtgaagaaaaatgtcgttaacccttacaaattaagaagaaacacaaacgaaagggggaaaaataaacaagaagatggaagcaagcaaatcaaaatcatcttctcgccaagaacttgttggcgatcgatgaataaaaatggatgcaaatctaggaactaaaactatcatctccctcctcgatcgctgcaacccaatgtgtacgtacgtacgtgatccatttctgtagcttcctacgctgtttcaaaaccctacatgcctttgtgtgagccgccattaatgtcgatcgtgacacacacgagagagcttgctagcttaccccatgcatggtggatatgcatgcgtgcttgcttagctatggagctcttttcttccatgctgttccactcaccggtgagctttgatccatcgatcacgacgatccgatcatggccgccacgcgcttgcccacaccagaggctgctccttccacgcgaggaagacgccggctccggccgccgagtcgtccgtgccggcctcgcgcatcgaccacccttccctgtaccggcgcagcagcgatcgcacgtcgtcggcgacgtcctcgctgaatgccaccggagagaacccggccgaccgcatgcgccgcgcccacgacgccgccgtctcccgccgctccatcgactccgacgccgggcacgagaccaagtcgacgatggcgcgccctgctcccctctccaatgccagcctctcgttgctcgtcttggggaagctctcctcgagcgaatccatgtacgccgagaagaagcgcaagccctcgccgaacaccttgaggaacgccgcctccgtgtcgccgccttcctccgtcgccgacgacgcgtcgggatcggacgccaccaggtccgcctcctcctcgacgacggtgacgacccgcgggtccagccggcggagcgacgccgcgaacgcgtcgcgccggcgggccctgccgggaaccacgccgcgcagcgagttgacgcagttgacggcgagcgcggtggtggcgccgccctcgcggaggtcgagcgcgtcgaggtcgagctccgcgaggtccccggagtggtgcacggcgcggaagcggaagggcacgcccatgagccgcgcgaacttttccatgcgctgcccgatctcccgcatgacgcgctgcaccgccgccgtgggcgcggacggcgcggcggacaccacggtggtgatcgagaggtgcggcgtctcgtcggcggaccgcgtggccagcgcctccagcagcgtcggccactgcgtgcagaacgtgttgctcaggtcgaggatgtggaaccgctgcgtctccgacgacgccgcggcggcgacctccaggaaggactcgaggatggcgccattggcggcgacgtgcccaaacgaggaccaggggctgagctcctggaaccgcagcgccgtgcgccgcgtcgagtcgaacgacgtgttccggtcggacgccgcggcgagcgtgcgcagcgtgcgcggcccggacgccgtgagccgagcgaacagcccctgcaagaagtaggaagccagcttctgctccacgtcgccgtacggcgacgcgagctcgttgagcatccacatgagctgctgcacgcgctggctgtcgcgggcgggcaccgaccgcgcgcactccagcagcagctggctagcccacctcccgccgccgccgcccccaaccgcgcccgacgacgctgtcccgccgccggacgacgacgccggggacgagaagtcgaggttgaggtccggcgggaacgacaggtccgccgcctcgaacaggccgtgcccggcgcccgccgcggtggacgaggtcgacagcggcggcgtcggcgccgtccccgtgggcgtggacgacgccggcggctgctgctgctgcacccgcgcgccgtggtggaagtgcctcgacgacgacgaggaggagaagtcttcatccatgtaaagctggtggtgtggggcgttgccgcattcttcttggtacggctccaggtagtagtactgcgacggcggcgggtgctggccgccgtagtagtaccctccgccgcctccgccgccgccgccgctgttgctgctgtggtggtagtagctgtagaacgcgttcgtctggtgcgacgacgacctggacccgctcgacgtcgtgctcctcgagttgtaggacgccgactgctgctgctgctgctgctgctcggaggcggcttggaggctaaccaacctaaacagcgtatccatctaagcaacggcgacgaggaggaggcggcaacatatggcgcggtacaaccaaacaacgcgcggtaacaaggggattttaatggcgagccgagccgagccgagctgagctagctagtagcagctacacaacctagtaggagccatgtaaattgcgaggtgtggtgagtggcttggtgtttgtgcttttgatgctctctttctctttgcttctcttttggtgagatcgataacatttgagtagcttttggccggatcgatgagagaaggagaggagggtggagagggagaggatgagagggagggggatcgatgatgcctcgctctgattggaggggttctttaaatttaccgggggcagcagcagcaggcagcggcagtgggtgtgggcgccttttgctgcctctgcctttgctttgcttgctttctccatctcgatctcactgccgaggctcgccttgcttttaggttttttttggttggctttgctaacgaactcagagagagagagagagagagagcgctcgcgacagtgtaggggatggatggtggaggtggaccggtactgtcaccctgcaagtaggagcactgtttattatttccccaccactctcaattcaatttatcaccattgttttaaaaattcaatttatcgcctttagttagtggaagagagagacacaatagtgtccaatcgattcaaataccgcgagttactatgcgagcgtacatgatctcagtggtggagccaccgctcgataaccctaggcggctacctgacccatcgacgaacacattataaaatcgttatgttactgttactatagggaataagattttcataacaaatactctctaaattttttttggccccaccgctacatgatctagacctagagaaatagtcttctgtaggactaaagtaatagagacaataaatccattaaacacgcaatctataaaaagtttattggttgtggctctctcacaactatgacggacatttagctagagcatttgtcttttaccatgtgtaagaatctagtgtaaaacacatttcaagcatccaatattatcttgtatcctaattcttttttttttctcttttggatgaactcctcttgcttgctttggttaggtttgacttatgtcttttccttttgttttttttactcaatgtgatagtcctatggtagaagtacaaatcaaaatcctatgtaatagattattaagaaatgttgtaacatttactctagtacatggtttattttttcgatggattgttggatcccaacctcggcggtgcaatggttttgtcaaattttgatgaaattttgctcatatatattgtttgaaatttgaatttataaaagaccattcaaattttcaatcacaatatactttatcctacgtggaaacctcataatttcatgggttttgacccgttccctttggaaacacgaaccctgctcttatactccctctagaatggagtgcgtgaacatatgcttcgtgcctctatactccatgccagacctaatattgcacacaatcgtaaaaactgttacatttctaattttttaacgtaagaaaacaactacaaaaccatttacccatttttatctagaatggtaaaattaattgtttctactaaagagacgtgtttcatatatgaaattaaggttgttttaaaagggaaaaaaatcaggatttattgctcatgtagtcatgtgctacggcatttgggatatgagtcgcaaatcttgaaatgtcactaaaatcttgatcaaattagtacatatgaacaagacttattccccatataccctatttacatgttgttcgattaatccttttcacatggcaattggagggtattgggcaatcaattaatttcacatgagattaaggagattaatcccacaccccttcaatcgaataaacccttaagataggagggatgtgagctgggttggctaatcagattgtggtgttagccaatagaccctaggagaatcctatgaaaattctgttgagaacaagtagaattttggaagggattgattaaagaaattgaaggacttctacggtacaatacactagcaatatatatttttggcatatacaaagatacactaggaatttccatgtacaagttcgcgtgagcatggtggagagtggggagttgggcatcattgctgctgcctcctccaggtagaggaactagctagggttttgggtgggtcggaaattgagaagacgaaagaaaggcaattcgaattaatttacaggcaggcaggcacaatagcgtggtgcgcgtgaacttgcagtgcgtgtggcgtctctctatggcggtatggcctatgatggacgacaactacgggactggggaatgaaatcaagtgaggaacacgtctagcattgtgcatttatgtacaacagttgtctgcaagcaaacatttagaaagacaattatccccttttcaattttatactacaattaatttaagttggtaggccagttaatctacaccatctgatcattcatactaataaaatgtactgtttgtattgatccatatgttatgaaacgaaggtagtatcgtatatagatcttctcagaaatttatgtcttctctctgttccaaactctccaaaattcctgtaagaaccccacgttgaaaacagggcctttaatctcactaatcatgctctcttaagcagcgcaactccaacatctgatcaaaaactaacaccgcacattttggccgttccaatttctggacaaaagcgattcccccgtcgccccaacaatcctgggatacatcaaagaccagctagtgcgcgcctgaaatgaccgttcaggccaggacgacagcaacctaccttggaggctttgtcaggcatcagctgcatgctgatatgagttgagaggaaagaaaaattattcccttgcttgctgcatgccattatattgctcccaatctcccatcgcattgcccatttgccctccagttgtgacttgtgaagaaggaattatactctctacacaacagcagcagcagcagcagcagcagcagcagcagcacgcagtacgtactgctacgtagtagtacgtacactggcgagcccatcagtaggctgtacacatgcgcgacacatgaaagaaaggctaaaagaatatggagatcagatcgaagcaagcaaaggcagcagcagcagcaagcagcaagcagcagtgtgatgcagcagctagcaactagcacggctgaaaaacaaaaggggcttagctagcaagcaaaaaagctggagctcgcaccgagagcacggcgtgcacgcggtggccatcatcgttcgtcgtcaaggccggccggccaccaccactactgcaacccaacccatatacaactatatactggactagtacattctttgtgagatctcccttttggatagtagagaaaggtcctagatacacggccttcttttggattttgccacgaatttatcgcccggtttcaattctctccttttggaaggccaaaaagacagggccctgcatgcacatatgactatagtgagtgactattataccaccaactttccttttctcttttctgaagaacaagaacctgtctaacatatcgtttgattaacatatataattattatatcacgtactagttgggatggacgccggccggccggccggcactgtagctagtctatagcttaagctttgttgctccaaaagagagaaatgtgctcgtgtctctttcttgctatgcagtgctaccgctgctgctgctgctgcacacagctgcatgcaggtttagctagcagctgttgctactgctagctcttctctctctttacctaatatcatatgctagatcgtgcagtgatggggtcgtggaaacgcagggggacctttgcactgtccggccgggtaggtcgagcagacgagcactgtactgactgatagagaagttgtgttgtgagttggcggtatttgactgttgagctgtagcaaagcatgcagtacgtgcagcggcagcggcagctgatggtttcggccatgatcaggggtttgaaagagaggggagaagctaggcctggtccgtttgttgattgatagatcgatcggtagctgatcactactgaactttgattgggaaaacttctgagaattatctgaaccccggcaacttggcaccattcttgcagagcgtacctccaattagaacactagctagtgtctctctttcatatccatggtccatgctcacatctcacatgttaccttttttttaagttttgtataacggttccagcttgtcctgtcagtcacaaatgttgacgaactgttatctcggaaattaaacgtgttcatgtggctccatatggtggttctctgaatactactacagctacaccctgaaatatattacgcagctagacggctggatgaaccgagcagtacttcgagaattgcagacatatggtaatacgtacaatttcatttcgtattctagttaacgtatgcagccagatataaaacaaattaacatgtacatatacaaaatctgaaactgaatatctggatcaaagcatgcttgaataggatgatctctatattgatccttctcctgtaacttggaaagctatgcttaaaagattgatgagttgacgttaaggctcagaatttgagatagacctttgtttcaatcatggattggcgctatgtaattttcatgcctcacataaaccctgtaaatattccttaatttgatatttaccgtgggggtcctcccttactgttctcctgtaaaaaaagtctaaatctctgagttcaggtgcaatcaccttagacggcgagcaactcatttggaagtgggaagcttcagggcaatactccaccaagtcagcttacataatcctcttttttggtcgtgaaatctgcccatccaagccattttgaaaagaaaaaaaaacacgtgccgccgtgctgtatttttcctattggttgcttatcgccgttgttggacggcatacaggctaagcaagcatggcttaattgcctcatcagagcaaatgtgtcttctgcgactagcaagaggaaacgatcaactacatctagattggttacccagagacctttttgggtggattatcataaacaccattggccaatcttggtgcttcctatccaatccacaatcgttctcactgtggcggtacaacagtaggaagttggttatcaaaaccccgaggaaaggatataatacaattgtcatcctagccacgttaatttggaaagaaggtaacaataggatctttaacaaccaacacaaaactcggagaaaggtggttggcgcagctgcagaggaagtaacacgtttacgccctatctaagcgggtttcccctctcctctacgggagtcctcagggatgctagccttgtgccaaccgatggccctgtcgtggtcacaaaaccatatatatcgcaagatctagccatacatttacatagcctttgcttgtgtataagtatctcggtcttaatataaagatatgtaattcttttgtatattttcgaaaagaaaaaatctgaaaccgaaactgcgatcgatctcatgtgtcatgtgtcgcagaacgaaacaaccatctctctgcgtaggtagcgccgtgtcacaaacgaagggggtgtgaccatcaataatttaggccaagaaagcaatattaaattgcactcatgctgtaaatgtgcaatatatctgtgtgaatgtatgtatattcagatcatgcatggggtcgacatggggtaccctgtaccaactactgtactgccgccgtagatggagcagcaaaagtgacaaaattctcatactttgtacgcttccgtagcagcgtgcagtgcatagcatggatgccatgtgaatgaatttggcctgatttcgttttgcacccccggtatggcacgataatactgcagcacatggcatgtatgtacaggtatataccctcaacaaatagaattttcagtccaatgatgatcagtgtgccccagctagcatccatatatgcccagtttggtttgccagaaaaatttcgcaagccaacaaaatggactgaaaaaatggcagaagaaatacatccataacatctcagagttgccactgttgcagtagctgtagtttcttatctaaacaccctgttttttcgtccagtttcagaaaaaaaaaatcgcatgtttgaacgagatgcatctttcttggggaaaagtcggaaaactaaattaaccagctttgcaaccccaatgatgaagagaatctctgaagtggattcatccgggaggctcagaatttgcctttctttttctctcttctcgacgcgacgacgcagtcataagtacttgtagctttgtgctgccatgtatgccgggaacttcttttttttctttctttctttcattcttccttctcctcatttgaatcgatcgaacaagcaggaggccaaagtacgactctagacatcatgattctgcactcgtctcaggactcaaagcaatcacgcatgcacatataaaaaaacggccgctgttcatcactgtctttttctctggtttgtcgtctccccgttcttcgatgttcaacgacaccatccatcgcctttcctaccaccggccgtaaacccgcgctcatgcgggcaaaagacctacacaattaactagagcttgttcggattgagaccgtcgtaaagatgaccatgattcttggtaatgataaatttacactttggacattaatttgagctgaagctgataagccgtgaaaaaaaataaacgaagcaaactaaaaataatttacgaataaacttttatatctatgctattagcattgtaaaagtcaaggattgataatctagaccacaataaaaaaacccaaaattaactctaaaattgtctttcaaaattttaattttggtcacaactgataggccaacaactagatggggattgatattgccatttttgtttcctttggtatggttaacataggcaacaaaccaaacaactcatcaacacaattttttttctaaggaattttggggtagtttactcgccatggtatgaaaaaacatgaactcaattaaaacttctccaaagcgccagcccattttcataagaatttcgatacagtttgtgtaacccaataatcttttgtccgaggtcatccttgcttggaacaatggtgtgtttatgtttttgaaaaattggtaggaaccctaaactacttaaactttcaaggtgatattaaaccaccaccattacaccgtaactgggccacgtggaccaacacaagaaccactacggactccaaacgagttgggtgttagagcaggtacaatagcaggctatcagccagctgtaacatattttaataagataaaagatgagagagaaaagcagcgtactacatatctgtagccagctgcagcgcggactccaagacacaatgtgtgtatgacaggtgggaccatatattaatagtatagtaagcaactattatatgaattacctattaaattagctatagatgaattggagctattagtgggctatactattaaacttgctcttacagtcgactgtttttttttcagactttagaggtatatatctatcgtcccttgccaaaatttcttataggatttatagcctccaaaatatccatattttactatattttcattagagtaaattacacccaaggtacaacaacttgataggtggatgcgatatagtgcaataacttgagaattgaacagtcaagtgcaacaacttgataaattggtgcgttctagtacaggaacttgataatttagtattttggtgcatcaacttggctaagtatggtaggtgaattttttttcgaagatgtattacgtcaggatctgttgctcaaactgaatcacgcgagacaagacccgctagggattgattcacggatgagggaccaaagcgtgtttcaactgatattaacacgcccggggtcagttcagtaaagtaataccttttttcctggtcgcacgatatcattatgccattacatagtaatcctacggatattaccttatgctagttgttgtatttatgtgatcacttataaagtttttatactaaattgcacctacatgtcaagttattgcactagatcgctcatttctcaagttcttgcactaaattgcacccacttacaaagttgatgtaccgtgagtgcaatttactcttttcattacaagtggggcttgacaatctcagtcatcttcggtgctatgctaaaaaagaactcattctcattttcattttaactgctgatgtacagagtacccaccaaatcaaagcctttacagctaagagatccatgtttttataagaatttctaacatgttttttttcatttgtatgaattattaaagtattactattccttatcagctgcaaactacttgtgacaaactttttgttggtagatattccaatgacggtgcttcgtgatgcattagtcaactcattatttcatcttctccaaacagaaaaaggcagaatttactgtccaatcaaaatagtctagacctggaaaaaagatatccatgatcccccatctgtccttgcaaaatgggacatgatcccctacatttcctcctcccccagcttcttcccttgtgccatggtccaagatctacaacaaggtggtggtgtaatgggccatgatgcgtcaagctagccccccatagagcagtgcagggttttgccttttcgttttagaaataaaaaccgatcctcaccggtttatcaaaaaccaacaaaaaccgaagactttctttcaatgtcatatgaaaaccagctaaaaccgatatgtttctataaaccaagacatagcggttttacaaaaatcggttggttttgtaaatcctggtgcagtgcagccacactctcgagctgtggttagtgatagccagctcaaagctgcagctagctgaaaacaacactattcccggcctggccctggccatgcctcccatgatgcggctcatctgcagacagcgagcattgccatgcaattggttgctttgctagctgagctttctttcgtgtcacctcacgcccctgttcctgcatgaacgctgaatgcatatgcccaaattattctgttgccactgttggtagcaaattgttgttggccattttcggttgtcaggcggccaacagtgtgtgtattaattggggacaatgcgtcatagcttagctggagaaatttggaatgatggattggtcactggtcaaaaactcaaaaggtgtgatttgtgttttctcaggggagggggaaacctgaaatgggatcatatgatggctgaccagtgctagcttatgataagtcagaattttcttaacgatttttatggaaggaagacgcacatgcgcaccacacacacctgcaaatgtgtttcctaacacggtctcaatgagatggaggtcaacctcactaaatttctattgaaaacacaccatatacgtaatattcgtgggtataaaaattgaacattagtgaactatttatccaaccatatgtgtaatctgatcacatactttacatggtcgaaatggcatctccaaaatatttgcctaatttgaacaggggactttttgcatgataacagtgcaatgcctgcataatttataactaaccagccttgcttgatttagcagcaactgatctcaaatccatctctcgtacgtctttacaacttctcttcatcttttttagggtgccagatatcacatgtatggtggattggtggcccatccaacaccaacagaagcaaattaaagaacagaaaggaaagtattggtggcatattaattaaagagattcgtttgctttgatttattgcaatgccacctgcaggagtctagtacattcatgtacggacgtaccatatgcattgagttggtattgatttggtgaacacatcccctgtattgaagtttctgcaggcactagttcatataaggccgtgtttagttgcaaattttttcttcaaacttccaatttttccatcacatcaaaactttcatacacatataaatttccaatttttctgtcacatcattccaatttcaaccaaactttcaattttaacgtaaactaaatactccctaaggtgacaacattgctcaccggctcaccaagtttggaagactggaatttccttttattcagaaagaactccagaatgtttcggattcttatgaaaaatgatttgggagagaatcctaagtagactgaactgtaacgaaattgaccagacgtgatatagatgagccgctgttggaatggtggatcagaagggcatctcaaggtgaaaaagacatagccaaagaaaaaaaaagtttacatgctagtagcatgggaaaatggtgtgagcggaacagacgagtattccgaaatcaggaaaaatccctgccgcagcttctagacaagatacatgatgaaatcaagctatggaagatatgtggagctacaaatattgtgagattattggcctaggatgtattcattgtttagtagcttcttgtttcctctctctttctctttcaccgttttggtaatcttgtaaatacttttttctcccctacttaaaataacaccagctttgctgacttcggttttcaaaaaaaaacaataatttatccatgcacagtttcttaaaaaaaatgtgtgaacttcattctttccaattggagacccgttctttctaataatgtggatgaaggctaatagatgatcaacttgtttataggaagtagtactatcatcaaccttgtaaatagcttagaatggatggactaaacaatattgatgtttttttttttttgagaaatcatacttttgaaagcttggcataaataatatgcgaataatgttggcccaataaacatttagaacaaggcctcaaatacataactgcactggtcccctaggaataagtccacttgagccccccccccccccccacctcaactttccgtcgagtttgtttaacatttcttttctccaatatcataaatcttcaccctaaaactatacaaaaaccgtgtaatttggatccaatagaaatatggatgtctgagtttgctaaagtgacatcgtagccagcaaaaagaaaataataaaatatgtggtgcccacatgttagtgaaaagaaaaaaatatatgtggggcccacgccacggccacacgccgtgcacttgctcgcgtcgtggttgggaaaggaggagaggcatctctgtggcggtgccatccaccatgcacatcggaggagggggggttggggggtggggatggtgacgccgacagtgattggaggcacgcaaaattttccatatctgcaaagacatggacaagcacaggtttaggttccgtgatcccccgcctcccgtgcgacagcgtccacaaggccaccatcgactcgtccgaggccacaccacgccgtctgggaagcaagcaagtagcagggggaaaaggagagcatgtaaaccccacatatatttttcctctcacttatatgtgggcctcacatattttttattttctttttgctgactaggatcccacgtcagcgaaacgagacatccatactactatgggacccaaattacacggttttatatagtttagggttgaaggtttctggtattggagattgatgtcaaacaaactcgacgcaaagttgagggatagcaagtggacttatatttcatagttcacatacttagttgagttggatggtattggtgtaccggagaaggcctaattctgacccatccaacatctaacacatttttacttgctctaagaggcgtacaaacttctggcataacagagtgttgcatgagtctgaactccattgttctgcggataagccatctcaaactcgatcaggcatcaccaatattctccacacatattcctcacgaaaacaaatattctccttttatatagttgcatgcacctggggataaacaggaagcattacaactttaatactttacattgatatcactttaacttaatcttatcttcattgtcataaaaaaaattaaacttatctttccagcacaagaaaacacactgcttcgaaggcacgcgaaactcctcgtcggatcagggtttatgagttagtagtcgagtctccatttttggatgagtttcagataagccattgcagcttggatcgatcagtcatcgtcaatattctccagacatattcctcgccaagataaatattctccttggacggttgcacctgaagatcaaagtactgttaccactttacattcatctcactttgtttcactttaatttagtttaatcttatctttacagcattagaaagctacctagacttatacttgctcctgattagtccaagcttgttgcactagcacacctatactaccagagattactttctaccatccctaaatgctactgcatttctactcgttttcttcttagccgaacatctcatcaacatcatcatgctgatcgatcgaatacgcatttcatagacaagagtagctagacaactttgagaccttgacaccaatgtcacaacagtgccctctcattaggggaaatctgatatcccaaacatccaatccaacaatttcagattttgtttcaggcagattcttccttaccacttgcgtacgaaggcataataacttttggttcatctttcttgaaagaaaaaaaaaccgatgccaactacaaaggaccactccactgacactctaaggaggaagtgaacacacagagtctagcaagagataagcataagattgataatgtattctattgaagtttcatgggtccaaatcacacttatatgattcgtgatcatgctttcagtttttaatgcccagtgtaccgtctggtgatcacaagctggcaatgcaaaaataatgagttatagattagtactttatgtttatatagcacctaagggctgcagatcgaccgtaggctagaaccaaagcccaacaagattctcattcccagtgggtttcaggattaatatgccgatctgtttgatggatacaaaaggtgctaataatgtgaagtaatataatatttaaggagcagtggttataacaattctgatgtaaaaacaacatggagctcattggaaatatatatatgaaacacacgctccaggaaataaaattgccttgattaattactagattcctgctagtgttgttaattagttcgtgtcatctaacgtgagacgtggcccagttcaacatcatgtagtgtgtggctcaacgcctcaaccactcaacccagcttggctctgcaagcttcagcagcccgaacccggcctgtttatgtaagcaacaatagctgggtcaaccgggcggctcgggcccttttgagcattcaggaccagtccaagcccaaacaaaggtcccgttcggcaagctggttgtggctgtggccatgccgtatgcgtgtgcactattggtgccggttgtgccacagccgtaagacagcagctgaacaggtacaaacaaaaaataacctgtgctctgctaattaagtagactagatagtaaaaacttcataaagaaacacaaaatggtggtttttctatgcccggtatgaaatagtactatttgtctgtaaagtagtgacttttggatacaaggtttgattataagttatatataaagtaccggggggccttaatgggcgatcgatcgccaggcgatcgcccaggcaatcggatccggcccccctccccctatactcctccctcctctcccctattcctcctccccttctctttctactacagtagaccacacaaatttttttgaaaaacaaaagttagaaaaaattatgtatagaaatactatatataaaaaatttgaattcaaatacaaatttgaatcaggtatgtaaacttttgacttataaactttgggtctataaattttaggtgtataaactttagatgtatagaaatactatatatagaaaatatttgaattcaaattcaaatttgaatcagatataattcaaattcaaatttgaatcgggtatataaactttaggtctataaactttagatgtatagaaatactatatatgaaaaatatttgaattcaaattcaaatttgaatcggatatttgaatttaaattcaaatttgaaacgggtatataaactgtcttataaactttaggtctataaactttaggtgtataaactttagatgtatagaaatactatatatatatatatatatatatatatatatatatatatatatatatatatatatatatatatatatatttgaattcaaattcaaatttgaatcggatatataaacttttgacttataaattttttgtctctaaactttagatgtgtaaactttaggtgtataaatttactaaaatagaaaagtaatgcggtgccaaaaaaggaaacaaggtggagatgtggagggagggaggggggtgtgcaaaactgatcgccctgggcgagcgagcggatcgctcgcccagtagcattcccgtaaagtacctagctttaataataaaataagtcatggtaaatacttacatagtttttttcaataaggtgaatagtcaaacatcatgtctaaaattcaacaatgccatatattttaaaacatatatagtatattgtaaaattgtaagtctaacctaaagctcgtagttaagtagccatgcgggcttgagatggtcttgctctgcattacactagggtttaaagtagatttgtgtattctcatgttctatgtataataagtattaacttatttggaaaataaaaccgatgagtccttatttgttattggcatattgcgataccatattcgcattaatatttcattgaaatgtaaaccctgtacacacgtctttgaaatagtagggggaaataacggaagaggccaccatccaaagataaataaagatttttatcaagattaaaataggataaattgtcggtgaacatccaagaattaaaagttaacgcagcctcagtcacatgattagcatgttcacattcaaatgtgaaaaaaaaatctgaaactattttttgatgaaggtgctatgtgatttatcaaacgctctccttctcttagaacaatggatgtgtttagttcagcgcaaagtttagattttgattgaaattggagatgatgtgactgaaaatttgtgtgtatgacatgttgatgtgatggaaaaggactgaagtagccaatgtcatgtttccacgcacttgcgtgtgaacgaaatatgcatattccccgtaactttttccaaagaaaaccaaggcccccctttttcttaagaaaacaagaaaaccaagcccgtataagcagcttgactcccgcgtctaaccattacgaacgagaagaaaccgcccacaagccagcgtgtgaacgaatcaacacacgcggagcgcgaccgaattaaccccccttcccccaacgtcatcagatggaacaaattcccctcggtttagtgttaaacgtgccacaaatcacctcctaatcactaatttttttctctcccatcctctcgccgaaaccacccaaaacccaaaagaaaacggaaacataagagcaggtacaataacgagctattagctaactataaacatattttaataagataaaagataagagagaaaagcagcagactacgaatctgtagccagctgcagcacggacttcaagacgcaatgtgtatatgacagatggactatatatgttaatagtatagtaagcaactattatatgaatatgctattaaattagctatagataaattaaagctagcagtaggctatactattaaacttgctctaacaaagaaaaagtaaacgacccaatcttcggcactaatcaaccggaggacgacgaaccaaccaaccacccttcctcctgacaaaagcaaccccactcctcctacctgtccccgcacaatccccaaggcgcaaacgcgtgccccacctgtcacccacacgtaccctgaggctgtcagattcgatccttagccatgttaatttagggcaattaaactacaccgagacgaacgaacgaactataagccatggtccagtgcttagccgtggcgaatatatgctccctcccctaaataaagctcgcgaacgacgtacaccatccgatcgatccatcaaaccagacggctagctggaggcgactattgtgaacttgtgagagagtgagcttacgacccacgggctgcacgttgccatccatcggtcggatcgttgtgatccgtcgatccagtcaagtcgcaggaaccgtgaaaagatcggccgatccgtcggtagcttagctcccgattcggtggctttattcccgccattaattagtaaaaagcgaaatgaattcggcttgatcgatccatccagcttgccttccggactccgcgtatatatttcccgccacccctgcctcgccttccctacgacatcgagggcgtcatcgagtgagtagtgtgagagctgagctgagcttagcttagcttgcgatggcaatggcggcggcggcgcaggtgaacgtgtcggtgtggagggacgacgactacaggaggatggtgatggcgtgcttgatagaggcggtgtacctgctggagctggagaggcaggagaggagggacgcggcggcggtggcgcagcagtggtggaagccgttcaggtacaggctggcgcacgagctggtcgacgagagggacggctccgtgttcggcgccatcttcgagcgggaccaccagccggcggccgcggtcgacggcgaggcgccgcgggcggtgatcgcgttccgcggcacgctgctgcgggggccgaccatccggcgcgacgtcgaggacgagctccgcctgctggcgcgcaacagcctccgcggctcggcgcggctcgccggcgcgctccaggcgctcagggcgaccatcgagaggttcgggtcggagaacgtctgcctctgcggccactccctcggcgccggcttcgcccgccaggtcgccaggatgctcgccttcttcttctcgccgccgtcgccgggccaccaccaccacgccgccggggcgtcgctcgagttccacctcttcaacgcgccctacctgtcgctgcccatgggcgtcaggagcgtcgtcaagacggccgactgcctgctcaaggcggtgcgcaccggcgtcgccgccgtcggccggtggcacggcaaggcgctcaagaacgtggcctacgccaactgcatcctcggctacacgaggctcgagagcagcaggaggttgtgagagagatcgaccacgaagacgacgacgaatgatacgtgtacctagctatccatcatctgatcatccccatggaggaattcaattcgaggagaacaataaaaagcatctggcacacgaggatgcacggtttaggctgccctgcatgcttgcttgctctgtaaatgttaaaaacgcttttgctaattgtgaattatctagctactactgttctttttgtcatggcctgttgactttgcccagttccatgcatgttaactagttcaaatgttcaatagatctctacgcatgcatgaacggtttgagaatcatctttctcagttaattaagtcgtgtatgctagtacggtgtatagatgtgttgaactaaaacctttgaaatggaggaaatttaaaggaattttagacgagttgaactaaatcctatgaaatttccatgaaattcttatgatttaataaaggagcatgaaccaagtagagcatgtaggttaacttgcaaacccactctagttcatttttttactagtacggtgtatagatgtgtaattttgactacaaaatagatgcatattgaaccattagttatgagagattgggttaatgggctaagtgcatatttaacacatattttctccatctcatagaaaaccaagtacatcccgtactagcttggtttttacggaataaaaatagctcataacttagcaaaaatataagatgggggagagatataaaagaggtctctttgtggttgacttgtgttttggccgagaatattatgcggacaaaggcgatggtgtagcctcgctccccaaggcccttgctggtagatagagtagacctagataagggcctcgctagctagcactatggctccaaacaggactaatcgagtactgctggcaaggtcagagatactacctccatttttagtgcgtgataacgttgatttttttaaaacaaatatttgattatttctcttattctaatatttttgtaaatataaaaaaataagtcatacttaaagaaagtaacaataaaataaatgataattacataatttttttaaagtaagatgaatgatcaacggagggattactgtgttatatatatttttgcaaatataaaataataagtcatacttaaataacatttaacgataaatcaaagtaacaataaaaccgttaatatatatatttttaatatatattaacagtgttatatttttaaaaacggagggagtactgtatacggtcatcaacaagctcgatcattccaaatccgcccaaaggttggaggcgccaaatctaacgattggtgacacaatgatgccaaatcaggtgatcatggaggacaacaattgcatttccatagtctgaggctggcaacaatcgttttggccaccagcaaagtgagcagcgtaggatctagggacccacgaagtctaagtgtgaatacaacagctggagtggtcgaccaacaagcttgagaacattatggcgatcataacacgatgacaacaagatgacagtggtcgattggtcgaatgaggtgattgcaggcagctggtgtccaaacaagagatgaaaaaaaaaacttctaggtacgaattttagatatagcatatgtccagtactgtaattggaagattgttttttctttgaaaaagaggaagtcgtaggttgtaagagaatacaatgataaaatataatcacacctaattgttgagtacaagggaaaactctattcatcccttaaataggatgtctcgtcgtttttacatgtcacttaaaaagtatcaaacttttttttaaaaaaaaagtaatatcttacttcacaaagcatgaatattcaaatttaacaggtagaaaaacaataacaaatttaattatgaatagaatacgtaattcattgtcaagtttattatattttatttcgaattgtattagtcgaattttaacttgcatgtttttgaaaatatattatatatattgatctatcttgataaatatttttaaaatttttgatgactttttcaatgacatgcacaaaacgagtgtccctcgagagacaaaaattcaattccgcagttcgagattatattacatgattgtactgtaacactgctgtacgacaacatgccctaacccggctgtatccgtaccggcaactgcaaggacgcacacggggacgcacaattgacggtgaaaaacgcaacgcatgccaccaccaccacaccactgacagcaaaggcacccaactatgttggggttgtgcatgcattgtatgcttcctgcctgtacgtcgcaaggcaaagcgaactgccacttcaccacctcctgtctcgcaaagccaagattagatccaacaggtgaaagaaagaaagaaaggaagaaaaagctgagcctgagagagagagagagagagagagagagatacagctggagacgggcaaacaatggctcacaataatactaacattaacggccgggggggaaaagagatggataccctgcctgcctgcctctacgttgtcgttgtgcaggcttcctaaccttaaaccagctgtgttctctcctgcgtggcctgttcatcgcaacagcacacagcatgattaaccttttcttgggcctccttgctctgaacaaatagattctctcttcgttcagaaagaaagcatctctgttgtgttgtgtttgtgttctctctctctctctctcgtttcgtttgatccgtcgcttcgtcgcaaagcaaacggcgatatgcagcaccgggcgagcagcttgcatcacgatggagcaccaggtaattaattagtaattctacaaatctcagatatatgctgtttcggcaaacgtctattaaattgcattccgcctttggcaaaaagaggatttggctgattaatttttttttgaatgccttcttttttttgaatgccatttggctgattaattagcgtgtgctttggcaaaatttcgttcaatcgatcgccttaattttgtggtttgcaattttttagggccaatggcgccgccgtcggcggcgtacgacgagcccgcgccgccggagcatcctcagcccaaatgtggattcatcgcaggattgtaagatgctagaaattcgttttcttggggctatgaatttcgtgtagaatttttatcctcatgacatttttcttacgtgatcatgcagcttcatggcgctttgctgttgctgcctggttgacgaaatgctgatgtgacacggtttgcatggtatcagcgattgtacagctgtagattttatattgtgctttagaattaggttgtatataaaaatcgaatgacgggaaaattgatacatcatgcagtgcaaaaattccttgaaagtttgagttctcgggtctgtttaagtttgtagccaaattcaatctagctaaagtaaatttgacagtgcaaaaatattagtcatttatttggtttgtagccaaagaaaattgacactgctcaactaattgcttactttggtagcaaactaagcgaaaggctaactattttttgccaaaaaaaaaagcaatgaccaactcttaccgttgccaaaaaaaaaatggcaaggttaagaataggaatgaaccaaaaaaaattcctcgcagtacaatttccacgaatgcttagaacatcttcagtaaaacccctaaatacagtccttaaacaactttgagaggttgagactaaaaaaataaagtacaacagggcccctacttaaggccctaaagtaggaaggctcccaaattccctcctacagcccctaggcctgggggctctatccccagcccctatccagttttctttggcgcgggggaatgcttccacgacgcgtgctccttcccgtgcgattgcttgcacgctgccgactgtcttgttgcgggtgtttctgctctaatccggccatcgccctgctatagtattggtcacctgcatggatgcacgtatgcatggatttttccacatatcgatgagacgtggtttggttcctgttaagtgtgaacagccatctgccgccagtggccaactgagatttgatgctgatctagaaggagctactactatatctccttgcatatatgcatgcagttttgtgtatgcactggatataatatatcttattaatattgtccagctcatatatgattatatgcatccatatatgcatgtatatcattggatactgagtgtaggatggatgaactgctactgctactagccgcaacagatgcactaatcgagcattctagtgagtcatccatgcactcacactagtgtacgtatatgcacatatcagtgtgatattagaaaaaaaaattcaaatttcaattgaattgtgttgtttgaaattattaatttaaatttgattaaattctatgcgttggaaatattaatatttacattattgtaatattaaactaaacataaaatatggattataagatgaaatagaggagaaaaagaaataggggctaagaaatagacgttgttgctggagttagaaccattcttagagtcctgaggaaatgagggcagcccccatttaacctttagggactctaaaataggagctattgctgaagatgcttaccaattcaagtaaagcaataaaagtctctataggacccaaggtaaagagagaaaatcctgttgtggacatggcttggacctaagacctgaacacattgattgcctagactcatcgccaggcctccccatcatggctatattatttttaaacaacaatattcatttctatctttatttcacaaaagctacaacaattattacagatgttacaaccttgcaggtcgaacaactgcgaattacaaaatcgtaacttgaaagcatagacaacaagaaaactatttagaacaccaacttaaaggcatagatagcacatattgttaaatatccatatatgtttgacaaaatatgcataaccattgttgcctcaacgggttgcaaaacagttattgtcttctcctgaaaacaccaaggaaacaaattaaaatatcttaaatcagcgaccgattattgtgccgatcgaatttcgcgtacatcaccatcaatgattgacgttaaatcatagtggaagataatatcgaagagtaaataaaatgtaaatcgtccactcacccagattctactagtagaaataaacaatttttttaattgattgagattggccacgaaccaaacaagctatatatatatatgtgtaagttcggaactaggaaattcatgtccgtcgctggttacagaaaacatgctacatcatgcatgtcttccatgcaaaatggggagggagagacaaactatcatttcaaacttcaaagtgctatatgagggacatggggaattcatgtcaccaattttttctcaacatgtttctccctcaatctgaggcaaaagaagagaatgtgccccctttaattcccctgcgaggaaaatatgtaatgaaaaccacattatagtggaaaaaaactaaaaactatcatagcatagaaaaataaatgtctcggattatttatgtcattatgagtaaaacttttattcatatcgacgtagacaaatctcatacatatatttttacatcctacaaaagttttaagttttcactacatatttttctctaataatatatagtgaaaatctaccacaattattaccgcacgagttgtacacagtcacactatagctcgaatggcttggacagttagagtacctgacaaatgaaaccccctttgtttttccaccactcttgatctggactaggatttaccaaaccgtttgaggtggggttaccgtcaccccgcagtttggcgattaccgcgcggttatcacgaggtatatcgtggttttccaaactgaaaagttaccacatgtgataatcacaataaccatacggttaggtaaaccctcatccagaccatcggatcgtcaatccaacggccgagcgcacacggccaaaagctgtttcccacaaccccaacacaaacagcgcccaggcccgggtcggatcgagccgcgggctacagggcccaaacccagcccaaaagagaacccgag

SEQ ID NO: 65801 - DNA, 23974 bp, Oryza sativa
cccccccccccccccccccggggcgcccccgcggtctctttccacgcgcgagcatgtcacggcccacgcgccgcgcgcttccttttccccaccacgcggaacacgcggccgggccggcgcgtctcgtcggtctcgatcggtgtccgatggaggtggagcccctgcaggctgcacagcgcgcgcgagaggcgaagcgatcgagcatggacgcggcgcacaacgcctcgccgcctcgcgccgcgtcgcgcgtttccgtatacggtacacgcatgcgcgaggtgcgcgcggcggtgtagttggtgccgtaggcgaaggcgattggcacgggcccggccggtggtgcacttgtcgccgcgcgcgcgagagcgaacaacttgttggcgcgcagagccaaaaccgccggaccggagaacgtctgcaactttccgttggcacacatggcatgcagcaaaggcaagcagcgcggcactcatcggtcatcgctcgtcagtggcttttttttccctcgattgagatatagattttacatcggtttttggtttaacacgtttttttaaatggttaaacggtgtgtttcgtgcaaaaactttttatataaaaattacttagaatatcaaataaatttattttttaagtttataataattaaaaaccaaaattggataagacacatttaaatccaacgaatctagatagacatacttatgatcagattctttgaaataggatgtatgtcctgtgcagtgctagattgctatattttaaaatggatggagtaattaactatggatgtgtttggagtatggatgtgtttggaggagatagttgtggctgcacagcgcaacagctacaaattgtgcagtaaattttatgctacttgtattgttaatacagctggctcagcccaacatctgtaatatacagcacaaacgaacacacctatatgttaaatggttttttctattttacttgctctaaccttattatcttttatcttcgttaggaaaaaaaaaaacatcaccgtagttgtgtgagatatcgagtattctgtttagctagcagagtatatagcatcaattattcaaagatgattggaggagggttcagttgatctcatcaatgacgatattaattaagcctgaaccagcccaacactgctcgacagggagcattattgtttcttcttattattgtccggctcaatgggatcagccagcaatgatgcacaggtactgaggtacacattcaatagtaatgcagcataattcatcacgccatcatatcggtcatcaccactgatgcacaaatcacaaattaaccagctgaaagctagactgacgaaacacaaatctggtggccagccgatcgatctcgtgatcaatccgaaattttgtggggctggatcagtgcctcttgaggaagtcttcgatccagtagctggactccttgcggtagcgcttgagcgtcttgcggtcgacgtagatgaggccgaacctgtcaaggtagccgtcaccccactcaaagcagtccatgaatgtccacgtgaagtagcccttcacgttcaccccattcttgatggcgtggttgacgaactgcaggtgctttgagtggaactcgatcctgtgtccatccttgagcgcctctggcagtgtgctgttgttaccctcatcgatgcctgtacacattgcacacaaattttacgcctttcgatgttcgcgaacgatttagtatatatacatgttaattgagttaattgaggatatggttcttttcgatcaacctatatttaagtttaattttggatgaattttgtaggaccagtgttgaaagattatatgttcttaccgttttctgtaacatagatggtcgggttgttgtatctcctcttggtgtagaggaggagctcacggagacctggagggtagttgaagaagatcggtgtaaattcctagacatgacaaggattcgcgtacgttgaattcctcagtaaaatggatggatcgatgtgggtatatgtgtacacgtagtcacgtacgcacctgtggaccgatgggtttgccattacggaagccggtggtgttggcgcggttgtcgaggtcgtaggatagctcgttggagttaggcggcggtatactcttagcgtagtaggtggtgtagtaattaactccgatgaagtcgtaggagcccttcaccatcgccgactgttcaggcgtgaactctggcagccgattgccgagccaacctctcatggtgcctgggtagtcaccatgcacgatagggtccatgaaccacccatagatgaagtctaggctccgttgcacagcgccacggtcagcgtcggagttgtcgtacggcacgaaccagtgggtgaccaccaccatgccgatctgtcccttctgtgttggctggtacttggtgcggtaaagctggacagcggcagcgtgggagaggtggatgtggtgtgccacgaggtagggctcgcgactggagtcaccgacgccgcatgacttggaaacatatgaagagcatcgtcccggcgcaaacacgcccttgccgtagccgtaggcgctatatgtgaatggctcattaaatgtggtccagtacttgacacggtcgccgaactcgcgaaagcacacctccgcgaagtccacgtattctttcctgcacatgttgagcaagggtgttttaaagtggtattttctaatattaaaatcaattgaaagatagtttatatttttctaatataatgggtcatatctatttataatattatctctaatgatggtataataataatattacctatttataatatcatctcaactattgatatataataataatattttctattagtattagaactaaatgaaaatcaacggttgagatcacttgtattggtggtgataatactgatagtaagaatagtaaaatactatcagtagatactatcatccttgagaatgtatcgtgaggtgctatattttctagcgtaaaatttggtatctcaaggtattttcttaaggaccataaaatttctctaaatagtattgtaaaatcactcgggaattaaaggttttttctcgagagattgcaagaatgtttgtgaaagtacagtaagcaagaaagaacttacactatgtcttcactgaggaatcctccgtatttgctttccagagccaagggggtgtcccagtggaagatagtgacaaatgggatcatccctatgtgatacagaaatgttgtcaaaattagttcatatttttttgcgtttttggaataaaagttagtgatcaccttttgctatgacatcattgatcaagctgttgtagaaagcaaccccttctttgtttattcctccactcaaggatccatctgcagtaattacaatttgcacgcagtggctatgtgattaacatcaagctttggaactcacatgtctgcgtttatattgtgtttcgcaaaacaaaaaaaaaaaggggagaaaattttgagactcacttggcaggatcctggtccacgcaatggagaaccggaaagcatccatgttcatgtccttcaggaggctcacatcctcctgaaatttgatcggatttgtcaaaacatgacccgtttcagagaattcagacactcgatgttaatcatcgtcagtcagtcaaaatggaaggtcaccttgtatcggtgatagaagtcatttgccacatcgccgttatcattgtttaaaattttacctgcagtcatatggattgttaatttctgtctgtcagataaaccggaagaattaattacaagctttgtgatgcacttcctcacgaattaacctggaatgtgagtgaagttgtcccagacgctaggacctttgcccccttctttgtaggcgccctcatactgcaagtaatcaaaaccaatcccaggataaactgatgagtatccagctacaaattacatcactatataacataaacatggctagttgagcagtgacacaactgatattgagcttcagaattccaacatgtcatatgtacctgataagctgctgaacctgtgccgaagatgaagtccttggggaagctgtaccgggtaaacttggcgtaaacgccattgcagaacagagctcccaagaacaaggtgaagaggagtcgccttcccattctgatccccattccagcgagagatggggttcagaatgagctagctgaattgcctccagtagctgcagctctaacgggtatttatagagtgatgaacgggaggggtagtagtggagtactcccgatgtttaggacagcgacacggtcttcaaaacacaactttaactctttatttctataaaaatatttattgaaaagtgatatatgtatacttttatgaaagtatttttcaagacaaatacattcatataatttttacattttcaaactcaagaaattaagagctatttatgatttatattttcaaggtttgacttaaacattatactaaacgactcctttagtatggagggagtactaaggaccatactgcgtgctggcaggagacactccatcaattcagtgtagtgttttctctgcagacatggtaagctggcgtaattaggatctcacttcatcacaatagcgatcgatgaggaagaagatggaacaggcgctgccgaaatccacacgaggaattgtttattaaacacatgaggcgcgtgctaacatgtctctatctaatataaattctactgaataatgcaataagggcatgaacttacaaaatgctccctttttttctcaaaacacaattcaaacatagaagcatatacatcagaccgacatgtattgagattgacgaaatcaccatggtcatatcattatcgatgtgtgtgtcgcctaccactatgacttgaacccgagttgactggttccaaaaaaaaaagtctaataagttaaactacacttaatttgtggtgcgtgtaaaccaagaccatacaacacatctaggatgggaatggggcttgtttcccgattctccacgggaaattctccattagagatgaggatgaaagaatggagatggttacgagtaatcaaatggaggaaaacacgtccgtgttgggtctggcggtggcgggacggggatgatcctccatccccccgttcctgtggagatacaattaacaggcataggagtctaaatccaatgcaaatcctatatatctataaagttcatcccactaaatatagttaatgatatttctcttttctctcgttaagtcacatggtctcaattatttctaattcttaaatgattgatctacggtttaaattatctctatttttttaaaaaacaaaaacaatgaaattgttgacggcaatgctctagagttagtacataggtgatgtataggtgatgtattgtacatgctaagtaggtggataaattaaatggtagaatattgtaattgtttaatatgacgagataagttgagcagctatattttaaggcaaagttaaatactagaagtagttatattttcaaacacggaaagagtagtactatatatatttcctacttactcggttttaaatataactagaattcaaaaattattttacaatataatgatttattcatctattctcacattttagttgatcagaaccatattttatttaatttcttcttatactttgttttgaattttttcccatttaattctacatattctcttaatatctatgactaatttcgaaggttgttatattttaaaacagaataagtaggattgtagtataatttgattcagtattactttgttacaattctcaatacctttgcaccagaaaaacactttaatttattttatcgattactgaaaatacctcaaatcaaacgatacatttttttctttcaattaaacggtagcatagccgtgcacaatcacgtggaaattagcacttaagaggagccaacgtttgctctcaaggactaaaaactaccacgtgaattgggaaagaaaaaaaaagatagaaaatttctgcactgttatctgaaatttaagcttagcacctagcagaagacatgatattcgtatttatctattacatcactaaaacaaaggctaaaatgagccccatgtttatactcaggaagctgtcaattacgaccttatttaaatggttcctatatatttgcgctgctgactttatccagttagtttgtaattttgaccactatttgctttactaggatataatgataatatcttaaaaagtaatatacctaaacgatttttatgctttcaaactaaatatattattagaaagcttcaaagttttaagagtttaaccgaataaaaataaattatatatttaacaacggagggagtgctgtagtcaccaaaaatctaaactgttaattgtgtatagcagtataagttgtattagagtattgttataaccgtattataaacccaaatgtgttttaataaataaaaaatataggacttgtctatcaaacataattgtattgatctctattgctcgataaacatcgtggtcgaaaatttattatctattgccagataaacatcaagtcggatttgtattgatctcttaattgtcctcctgaagaatgccctctacctaatccggttgtccatcagaaactgatactctgaactcatatttgtcgaaaccatcgatcgttagcgtattttcggcaataattaattggctagctcattgcaacgtggaaactgtaaagtaccaatgcagtaactgttgcactgaaatataagggatatttgatttggatatcatagaggtggaggttcagatgtgcacttcagagaccgactgatgtatatatgcaactacggaattacttttttttttaagagaagggttttttttttacccggtctttatatccaaccggatatatgcagtatttttttagcatttttttaaaatatgaacttagcctatagaacagggaactagccctcaaataacccaatctaaaattcgctcctatggagatttgaactcaggaccttagggtgctactcaggtcactgcaaccactaggctacatgcactttcacactacgaaattacttaagggttaaggcaccactaggctacatgcactttcacactacgaaattacttaagggttaaggctgtgtttgttccaagtacaagcatgagaaaaacccgtcgtttttaacacgtgtgttgagttgtgatttgaattcatttacacataataaaagacagcttctgccggagcaaagcggaggcccgtagatgcccgatgtgttctttacaaaaaaaatcctatataaaaattgttttaaaaatcatattgattatttttaaatttaaaataattcatactaagttattaatcatatgttaattatccacctcattttacctatcttaatcttcttctttcccctccgttcaaactaatctatctaaaatatatcgaatgttgtataactacacactacatgcaaaggaccacaaattgcatttctgttcaacatactacgtttttttccctaaaaaagagaaggggaccaaattgttttgcttttagagcctgctggttttgtaagttgcattaatcctgatttttggagttcattttataattgttgcatgtttttttagtcgttttcatcgctcggtcttgacttttggatcactattaacgaccaaatttggcaatatcagcatcggaaaaggagattagatcaaggtggagtcgaaggcgaagattgatccgagaatagagcaagaatcggctgaagtccagatcggctacgattaagatcggctgggtctaagtcggactaagtgagccgatgtagccgattctaacagtataatttggtgtttgacattgggttgaattgaggtgcttcaagatgattgccgcacatggatagagtcttgagaaggcaattgtatctattaattaggatgttttatgtaacttccttagagatatgtttgggcaaaagtctgccgcaaagacttatggtatcttagagtttgttagagatagtggtcgtgtccggtatggacatatcttataattctcgggtataaatagaccccgagccctatgtaattttgaacacacacgttcaatacaatctcggcgcatcgccacctttttgctttagttttgtttcgacgagttcttgctttcgggttgagctgcatcggtttcgatcttcaacaagaggtaaaacttgttatgacgacttgtgttctcgtgattagcgcttccatctttatgacactctaatcttgtctatataattcgtcaagttatcatatatcttacataatccttggcaatatcgtcatctaatctataatcggctaacatctgttaatagaaggcagccgattaggttaaatagcgacgttgtcctagatcatataagatatctaccactttatgaaacgcccaacggcttgattgtctaaatattgttcttcttttcatacttaatgctgcatcagttgagtttgatctattaagtcgtgcttagaatatcaatctctagcctgttctctggttgccgattagggtagtatcggagtttcagccgatcttatctgatttaaccatattcgatctatatgcttcaatgacatgttaaatccgccctttatgtcaggatcttattgcatttaagtatattaagcttttgtttggtatattatatttgttttgatatctttatataaagtagtatcggagtattagccgatacatgctagatctatctgatcggctatgctataaacatatataatcctgttattaatatatatttcgatctaagtgatttatactgtctcggcatggtgaccgatccatcccaatcacttgatttaagtatatattaatataagaactatatatcgttaatatctacagccgatcgaatagatttagctccttactatctatttataaccgccgatcgattcatatatgacatcggcttaaagataaatgatatgccatcagcacctagccgatcggctatcatttatagatttaaccacgaattctttgtctctatttcttgttgattacaggatcaaatcaactggcacgctcgtacatttgaaggcgagctttggacctacactggagttaagcagatctcccaggcctcatgttttctgtcaacaatcacctataatataagtgtactagtactaacccaaaattaatttttattgcatcgatcatgtatcttccgtgtataagcaatggtcatgaggaattcctatcaaatgggcctaatttctcccttccaaaagtcaactcaagtacagaatattttttgaatagctaagtactactacatcacttatatttaatgaatcacttatattaatttgatggtctctaccatgattatattcctttgatcattctttaaccttgctctgattgctttgatgccttgacttcagattctaagaacctaaccaaatccagccattgactaatttaggagcaaaacagcataaactctagtgatcaaagatgactagatgaggacctcaaatgacgtataaactctagtgcctggatggttgattttcggcccgaaaccaatgtaatcttccgggtttattgagcccaactacgaaaattctactgccttctttttaaagtatatatgacgctatttttcgtataacatttaaccatttattttatgtaaaaatttaatataaatatataaaagaataagttaaaattatattttatttaaagataaaacaaatcacaacaaaataaatgatgcttattttcttgtaagatgcatgataaaacgttatgtcaaaaaatcaacgataccgcacatttaaaatggaaggagtaatacagtattttctccgcacgagtactatctcgatcctgcctcccagtccctagcattgatccgctcaaccagtctctgttcatcgtcaatgtccttggctagtgctctttcggcgtcgatccgcgcggccagtcaatggcgagcaagagccagcaaacaattcatcttcctcaaggaggtcaagaattccctctttcccctccgattatctccctctgttaccgttcaaacaaccttgcaagcagataggaaaacatgtgtaatggttttacaggggaaaagaaatacaaatttcccaagcaaggctcttagtattaagcagtaaccatgcgctgtcacaccatcctattacctccatcccataattaaaaggattttgtgtgtgtatctcacacatggaccctatgatttttattatttttcagattgaattgccacataagcatcacattaatgacacgtgggataaagactttcaaaggagccacttcaaccaaaaccagagaaaatattataaatctcgtttgcactgattttataagtttgaggatacgttgtatctggttatgtggtctcgggatgcatttcggactcaacaaaaaatgggggacctagtgaacttgttcttattgagtaggaataagttcatctgaggtcccttaattttacgcaaatccgattttcatccttaaaccctaaaaccagatataaccggtccctaaactatcaaaaccggtgtaaatgagatccctcggcggttttgaaggcggttttggctgacgtggcgtctacgtggctggtggctggtttgactaggtctccgtcccacatgatattgacgtggcgcttacgtggcaattatatctaaaaaaataataaaaaccatgggcccacctgtcagctaaaaataataattttaaaatagcgtggcccacgtgggccccacatgtcattccctctcccctctcagctctccctcttcctcatcaagccatctcctcgcgccgcggcaccgcctcacagccggcaggagcatgccgacgaagcggagaagcggcggcggcggcggcggcaggccgcggggtcggtgcctactcccgcgccgccacatcatgttagatgctgcacagcggtgaggaggagaggcggagttcgagctcagtacagcgaggattagtgtacagatcgagctaaacagccaacaggattagtggcaggcaccaacaagcagttgctgctgctgctgctcgagacatgcatgagctcgtgttcactacagtgaggccggccatctgcaagactgcaaccatgtcagatttggcacggagacgaaaaacacacatgttagtgacccaagttgttgtcgtcgtccatgctcgccaaggccgccgccattgccgccggtgtcaatgactgcccgactgaccgtctgtcttcaactcgttcttctcgttggcagagagagaagctgggagagagggggacagaggaggaggtacagccgcatcacctcgctgatggtcgcgtgcagccgtgcaggtagtgcatccgcttcagctcgtcgtatccgtcgcagtcgccgtcttctccggcgtcggcgcggcgagcgtccgcgtgccgcgacacctcctcgtgcacgcgacgctcgcagcgcgggttcgcggcgaggagccacaagagccacgtcagcgcgggtgctcgtgctcgtcctccccgcgacggaggcgctcctccgacgccacgtcggcgggagaggagggagcggcgcgcggagatgtcggcggtagaggagggagcggcccctcctcacctgcttcctctccaacctcctcatcatccccggccgccgcctcctcccttcctagttcctccgggctccggccccctcatcttgagcctcgtcctcctgctcttcccttcgccggacgccgtcgacctcgcttcctggtgccgatacacgcctccgcccgcgcgagccaacccgacgctgctactcctcgatgggacatggaagcatgccaaggagatgcaggccgccagcctcccgtttttgtcctccttcgtctcgtccccgtgtcattgctcgtctactgcgatgtcggcgccggcggggtcgaggtggtggaggatgacgacggtggtggaggcgggttgcggcggagggcgtgcgctgcgccctctctgttgcgcctgagagaggagatggggagagaggaggaagaaggggaggggagtgagattgacatgtggggcccacgtaggccccaccattttttattaattcatgtgtgaaactgacatgtgggtctcacgggtttattatttttcttagatcgaattgccacataagcgccacgtcaaatgaagaacgagtcaaattagccacgtaggcgccatgtcagtcaaaaccaccatccaaaccgctaagggacctcatacgtgctggttttgacagctgagggagtcgttgtatctggtttttcggttggaggatgaaaatcggattcgttgacaagttaagggacctatgataaacttattcctattgagtatgacaagcttaccaccaatcgcattgtcgattccctacagcccactaacctggcccaaggtgatggaggaattgaggcctaactttgccggcccacccaacacatgcctctagttgaacacggcctacaaataatctagcccaaccaaaacgtagatccaagcccagatccacctgcagtacaatgcctgccacaatgtacaaactattgtacaaagcaaacagtcagctacttgtattcctagttggcacattgccgtaggtttttcacctcaactaaaccatcttaaaacaagcaatgcaattcacagtaacaaaataattacacttcaacgcaacatgtcgatagatcaatgaacaatggtcagctcacgctgtgcacgtaaaactccaccgcaaaaccatcaacgagacttctctgacgcagatcgctgaaatgtattccctccgttctattaaaaactactaactactccagtaacatacatctgtacagattcatattactataatgtgttacattttattctagattcgttttttatgaaacggagggattatgtccgtcagtagtatggtttatacgtcagtaagtcagagaatcgctgctacatgttgtagccttggtgacacggttgccacccttgctgccgcctcgtcgccgcggggggagccatcaccagcgccgccgccgccgccaaatccacgcgctcgccgcagcagccgcagcgaacgcactgttcgcccgagacgttggtggattccaccacgggcacgacgcagaagttggacccgcaccgcgcgcacgcgccgcgcacctgcgcggccagcgccgactgcacccggcggcaccgcgcgtcgtcgtggtggcaacccccgcgcgcgcgcagctccacgtactccgcggcgcggcgcaggtgctccgccgcgcgtcggcggcgcgccatggcggccgacacgggcgccagccccagcgcctcgcggatctcatccacggtggcgtcgatgccgtgccggagcggcgtcgcgtccaccccggtccacggcgcccacgacgagccctcgccgcccgcgtcttcgttgccaccgcgccggggcggcgtcgcgtccaccccggacaacggcgtccacgtcgagccctcgccggccgtgtcgccgttgccaccgcgccggggcggcgtcgcgtccgccccggaccacggcgtccacgtcgagccctcgctgcccctgtcgccgttgccaccgcgccggggcggcgccgcgtccactccggaccacggcgtccacgtcgagccctcgccgcccgtgtcgccgttgccaccgccaccgccaccgccaccgccggaatccatcgtcgtgtgatggcgagttgcgtctcacacggagtaaacggagactcacgatggtacatatcgcgccgcgccacgaggtgttcgacacgggaccgaggcgtgtgtccgtgtcggagaaggattctcaaccagaggaaggagaccaagagtcccaagacaggccccgattacctttctcgtaatgttttccagtacgtaccgatttcaaaaaccaatttaagatgaatccgagattaaaataggtcaagtaaaacacatcaattctcccagtttatggagttctacaggtagtggatctcttcgggtgttttgaattcatggacacatcaggctcaacgagaggaaattactggcctaatcagttacgaattccctctccatcctgaaaacctaaatggcaatgttaaggagcacaaaactaggctgcccaatgttccatgtctcttggcatgaaggcgcagtgacggtggggaagaagatgatcaatggtctctacagagaccagttcatggcattggtggagtggctgaaggcgccgctgccggagccatgctcggcttccggccggttggacggggcacctccctgcagtgcgagctcgagctcgccggagaaatggccgtggtggacagagcccggagggacctcgttcagcacaaccccgtgcggtggcggcaggtgcacgttcctggcgccgtcatggccccggctggagctgttccagccggggctcgccgccatgtagttgcttgccatgaccgagggcgacaccgggttgttgccgcctccgaaggcgctggccgttgacgacattggcggggaccggttgtggctgctggtgctttgggtagtatcccatggctgagttgacagaagagagagagcacagctggagtcggtggcgactcccgcgagacatccacctgaggtgagctcaaaggctgggtggtggagcattggtgccccagccgctgagccaccatggctgctgaacgcatggtgatcactgtatcccgcaactgcgctgcggtgaggatggagttcatggcccccttgccactggattgaaccggacatgcgatcgctgggctgaatagcaggccacgcatccctcacactgcttggaacccttgggtatgagaaatctaccacaaagcttctggacctgcctggctcttctgaaacaaaagttgcaggggcaacaagtcaatacactcatctgaagttcagagtaacaggacaaacatgagccacattttaccatgaaaggatgcagcaagccggccatagcgagaagaaagaggtccaggtgtcggcttcctccggcgttcattgtgacctgcaaggcgtctgcggcagctttttttttcttgatcaaattcaggtaattggtggaacctgtgatttgaagtggccaaaatattagtgaattaccacaagcgtagtgacactgcaggatataattgaatacaaggagttttcctaatgaagaatgtcatgctataaaaaatactctacactgacaatgaaaagcaataatcaatttaactcaataaaaaaaaagcacgctgaagagcatttttggtggggctattgcttattgtagtgaccttactttagaaaattgcaagcacatgaaaagtaggagtgccaactctgtaatcaagaatcagctacccctgctgcttatcttaatacggagcgtgcatcagataaataaatcaaaccacatgccatgtgaaaagctgcgtcgatgcaagcataacaacttttttttaatcctagactaatgtgtatttgttctaagtagcaacactaaccaaagacacgcctttcatgattagatacacatacaccacgaccgggaaaataaaaaggttacctaaccatgtggacagagcacctgcaatcattcccatagtactttagcacaaacaaaggctttagttagtacatcaaatagtcaagagatgttttatctacggcagagcagatttataaataacacaacagtcagaaccttctattttccggtaatgcatatgtccacaactccacaagccaccaactatgaaatagtatgcattttttccaaacaaattgttggatgcaatatagcagatgatgttatttcattttgatattttagattatgtagcataagcataagtgtttgtgttctagtatctactatacaaaatgaaaacatataggacaaaattagagtaagtatatgggatttctgatgaaccaaatgagaattattggttagcatgattgaccaacttcgttattgctgggcatgttcaaaggtagaacccatatagtcttttaaataatacatgtttattcagagactatgtccttacaactgttgagatcgacaacaaagactttatttaaacaatgcattcataaaaacaaaattattactattatttccttgttaaaaccctcatgcagaaaagtttccattctatagaggttaagagtcgttgctaagcggttgtttaatcgaagctaccatgtttgcatctccttgcttctctctcatccatgtcagcaaacattcctaattagcaaggttttgtagttactatttcatccgatttgttttccacctcaatttctctgctgccctacttccattttagggcattaaatagtgcatagtagtacagtgtagtaccttactactaccccatatatacttcatatcctaccacattccacatactactagaatagaaaaaaaggagatctagacttactatatgtgtgctcctcagacaagatattctggatggacacttttatgtcccttactattctagtcaggttccacatgtcctaaatttcacattgatcgctactactatcaaacccagcagcagtacactacacacagggcatgaaaatctctcaatctggccagggacaaaacggcaaaatttaatttgcctgaaatccaacgttgctgctacgtttttgcaagttgcagaggttgtttcttttttcttgtcctaaaatcagagcttgctgaggtagccaaatctagtggggagtttttttgaattttggcaggaaccgtttgaaagttgggcgaatcacacggtggattggtgagtgtctgtcacactcacgcgctcacaggtggaacagtagagcagcagaggaagcaggggcaatggctggacgacggcgacgaggaggaggaagaagaagaagattttggttttggtttttggttttttacctgctgcactgttggcagaagcgctgctcgaggccggcgacgacgacgatgggctccttggcgtgcatgtagcacaccttgtggcggcagtagtacggcttgacgccgctcagatccacgccgcaaccctccacctggcacctcggcggcagcggcggcgggggagccgccgccgccgccacgcccttccccttcttgccgcctccgcccgacgacgtcgacgacgactccaccgccgccgccgacgccgacgccgccgcgtcctgctcgaagtagatcttcttgccgaacttgagcccgtggacatcgtcaccaccacctccacctccgccgccgccgccgctgccgccggtcgccattgcggcaggcggtggtcggtcccttcctcctcctgctagctgcctagcctctctctctctctctctctctcttctttttattgccgctccctcactctctctctctctagctagcgagcgtgcgcgtgtgagtgaaaaggaaggcgagctgagctgagctgaggaggcgacaacagtggtggcacacccctcttttaaaaggagtagtaaaataaaagctcagctgctgctgctgctgcttgtgtgtgtgtgtgagtgtgacgcactagtgcactactactactaccgcttcacactcccagatgctactgctagtactactactccgagtagctaccaccttcaaagctcaaagctgcctactagtggtagtaggaggaggaggaggagtagcggtttaactcgtgtgttgcggggtttctgggggtgaaagtgaaacttgggttggcggctccaccccatatataggcgccacaggccggtgtggaacagcggcgcgcgcatgctctcgtggaaattttgtgccgtgtcgggggctcggccgcggcggtgtcgccgatgggggaatctcgcgtatcgactatactcttacttctaagagcaaggacaatagcagtctataagccagctgtaaacatattttaagaagataaatgaagagagagaaaagcagcgggctacagatttctagtcagctataacacagaatttaagacgcagtgtgtatgacagatgagaccaggtattaattttgtagtatgtaactattgtatgaggcttccatccaatggtccaataaaccaaaaaataagccaaattttgaattttcaaacttaattttgaaatattttcaacgtaattttttttcaacattggcttttaagttacaaagaacacatatataaaagttttacctacaaatttatttttattccctaataagccgttttggcttattagaaaaaaaaagtcaaccgatggaggcatgaatgagctattagattgactatagataaattggagctagtagttggctatactattaaacttgctctaattagtactccctccgtcccgtaatataagagattttaatattttatttacactgtttgatcactcgtcttattaaaaaatttatgcagatataaaaaaagttatacataaaatactttagataataaagtaaattataaaaaataaataataattttaaaatttttaaataaaatagatggttaaaaatattaaaatctgggagggagtactgcggtagaggagacggcagagaacaggagcacggccacggccacggccacgggcgagagcgagtgacaagagcagcagcaagcacagaggccagcagtacgctgtgcatcccgctgccgcgctggacggacgctgggccacagtagctgacgactcacatcgatgtgacgatggagccaacccgctcctgcctccgctcccgctacgtccacaccagcagctgcagctgcagctacattgggcgcgggacgacgaaggtgggggcgcgcgtcgatggcgattggtggtggaacgggcggttccgggctattggggagacgtgcttcatcacaggttggaaggggggaagaaccgaacaagggttgggcgtgtaaaaaaggtggctcttttccggaggtttccactcaggttggttttgattcagtggctgctttttagcgtcctttctttctttttagcacaggtacgaaccataggttattcgaggaagatatgagttgttctatgtactactacatatcagagaaagatctaaacggtatcataattaggtggatttatatcgtttgttgtatatgtttgtcgctattaacgtccggagaaaaatcataattttatatcaactttcaaaaataattattcttagaaaattatcaagaaagtatagaattatgtcaccataaaacaacgtgataatccaaacaatgctagcatataacccattaatcgagagtacttgataaatgtagtgctaggtatacgtggtttgcttcaaagcactagagatgtgttagtggatttgtagaagcatgtttttcctagtgcctacaattacgcacatgtaagtataatttttatggatttacttctgagtcattagcctgtattaagagtgcacacccatgtgtttgtgagtgtggtgtgcatatgtagtgatgtcgctacaccaagatataggtacataaatactttgatctgttggaataagtagcttttagtggcaaactatctgttgggaaagataaagtggcatagtataatttttttctaccgacagacaattgtcttctttttagtgttgtagtgtagtgtgtgtgcgcgcgcataaaacatacacatatagttctagctcatgcatatgtatcttttgtttgatgcatatgttgggttcaattccattatctaagtaaaaaggcttgtatattttgagaaattatttgtaattttaagttgtatgtttgactaaatttcgcataagtgcatatgatatgatcaaattataacaaaattacgcatctaatattgtgggtatatatatttgaggtgatgtggtttacgagagatgaaaaacaacttggatcacagattaattatcaaatgtaaaaaaaagaaattgaggtgacgtggttctataaaataagagagaaaataatttagacaacagattaatcaatagtaaaaataattgagattgtatgaattaacaagcgtgaaataaggtaacagtatttcgtatattggtatctgccatattcttttctttccatatccaaggtactccctccgtctcataatataagggattttgagtttttacttatactgtttgaccactcgtcttattaaaaaaatttaaaattattatttattttttgacttactttattattcaaagtactttaagcataattttttgttttttatatttgcacaattttttttaaataaaatgagtggttaaacaatgcaaataaaaactcaaaatccgggacagagagagtagtactacacagattaaaaaaatggtgttatacaatgtgttactagcaagcatgcatgccttatatatatttttatactagtgtactgtacttaccagtacaaggataagagctgacattttaggatttttgattccttaatcactttaattagcctcagtggtctactggtactaggagtgcctcccttccctcaagctaaaatcatgtggacaaataggggctgcagtgttgttgggagaaatggttgaaattaacgaagcgtagggtttcatgcgtggaggcatggagcatgcacgtgcttgcctgcttaattggtctctagccttccacttttgagttggacaagacggctattgggttttcttttaaccgttggtcctttgcctggggccgagttacgcctttggcgtgttaccattgctgaagaatctttcgtcttgagcccgagtttccactggtggtgaagttttggaattgcctcggaattcattagggatgttaattttcacacatgatactcacgcacacgctctcatctgtcgtctctataaatttagaccgtgttttgtcttggtgggactaaaacttttaagtcactatcacatcagatgtttggaaattaattataaatattaaacatagactattaataaaacccatttataatcttggactaattcgtgagacgaatctattgagcttaattaatctatgattagcttatgtgatgctatagtaaacattctctaattatggattaattaggcttaaaaaatttgtctcgcaaattagcttttatttatgtaattagttttgtaagtagtctatatttaatactctaaattaatatctaaatacagagactaaagttaagtccctagatccaaacaccaccttataaacaccccttttgcccctatcatatgcagtatgaataaatctaaaaattgagtcagcttatcttaaaattcacaaattctccatagacttctaccactgagaaattataataattagttataaacatgagtgttttaaaactgagtgttttatcattaccagcataaacttaatatgttttttaatcctaaaactaggcttctatgtaaaagaaaacctctaaaagttttcctacgtagatgccaatgaattaaaatccccaaatatgtatttctcgctctctacatcggctggagggcacttgctcttagtcctgattgtgcgaagagagggatgcgctctcgtgggaagaggggaacaacgaatttaggccatattttcataccggtgttttgctttgtatcacactttaaccaatgtttttattttagaataggtaatctttttttttgcagtttgaactaccctaactcatttctcaagtatataaacgaattcgagtatgctagctccgattcgtcaatgaactcccaccattttatatagaaaatttatttgatatatgatatagtttgatgtagatagataaaagagttgagagtgatccaaggtggtacaaagataagatttctagttcaaaattaaaaaaatggttaaagatgacccaaagtaaaacttattctttttaatttagggagctgagtgtatgctctctctcggtgagatgtataacttttaatctttaaattctcattatagatttccaagaaaaatttaggggttataattttgggcaaccttcattgatgatgctcttaggtgttgtttaatttggctgtcgcgactcaaagtgcctaagtttggctcaaaactgagtgtatgatagtatatcatatactaggacaatataaattagtaaagtattgattgttatagttgtaataaccaacacatggtaataatatatgacatgtatagtatttctcgtggcgacttatagcaggaaactaaatatgctctttaaaattcaaacacttcattaataaactacacctataaaattttggtgatatttagagtattagttttcataatcatgattttatattagcacaaaagaaaacatgtacttcctccgtattttaatgtatgacgccgttgactttttgataaatatttgacctttcgtcttattcaaaaaatttatataattatcatttattttattgtgacttgatttatcatcaaatgttctttaagcatgacataagtatttttatatttgcataaaaaatttgaataagacgaatggtcaaaagttggttaaaaaatcaacggcgtcatatattaaaatacggagagagtatactagaatctgcgttaattaaataagttattggtattaccaatattttagtaactccaggcttgttaccgaagtttttagtatgaaacgaaccaaactattctactccctccatttcaaattgatctacatatttcgtaggtacaccaagatcaagaaaaattaataactctctcatactatatttactctagcaataaactcaatgcatgcaccatccccactattttctactccctctgtcctaaaataagtgcagttttagcactattcatgtccaacgtttgactgttcgtcttatttgaaaaaagattatgattagtatttttattgttattagatgataaaacatgaatagtactttatgtgtgactaatttttttaaatatttttcataaaattttcaaataagacggatggtcaaagcgctaattatggatatttatggctgtacttattttaggacggatgtagtagccaatagcaaatcaagatattgcatgtgggttataaatgcttgtgagcatggatgcatgtatcaatgtctatttactccaatgcacaaataacgaatagacttaataaataaatataaatatgtagatcaatttagaattaagagagtataattaagtaacgtagagaaacaaggccctagagagtttctggcagctttactctgagaataattaacactctcaaacggcctatatttttagtttagagtttgaaacggctagataaatgtacgtagtaacacttggttctcatatcttccccctattattgcaacctcagaatctccagacagggaccaagttttagttctgagatctgctcccctgttgcaacttcagaaccaagttgtactactggcaaccttgctcccgtcgctactcccgtcatgtccaaacgaaggctgatgatggcacgcatcacagtttgatacccttactgaggggtgtttagatggggctaaaaactttttagcccatattatatcggatgtttggacgctaatttagagtattaaacataaactaataaaaaaaactaatttcataaatgagagctaatccgcgagatgaattttttaagcctaattaatccataattatcaaaagtttactgtagcatcacattgtcaaaattatggcgtaattagactcaaaagattcatctcgcgaattagtccaatattatgaaatgggtttt

SEQ ID NO: 65802 - DNA, 4259 bp, Oryza sativa
ttttcgcattcatttctcaggcggtctatatatatatattccttttgcaaaggttttgcatttgaaatgtttcaaattctgtactagtaatttcagtataaaaacagagagaggggagcttaatttggtaccttcagttctcaaatcaaagtcaattcaaatctacagaagaaagcaaatctgcgccgcattgatcaatgatcatcactacccctgatacgaattccatatagctttgttgtacaagattttgaacagaaaccacctttcaaaaaggttgaacagcaccagacaacttcacaccagcattcaaactgctagccaatatttgagcacacacaagaacactgcatctctgcagctgtagcaatcaattaaaagatcaaccgagtagacagtcgcattaacaaactataaaactgtgatgagatcgacggatatataaccaccagattcggtacgtacgaagcttccagctgctcatggttttttttttaatcatctgagaaagagatccccagtttttaatccctgagatcctactgggtggtacaccccagaacattcatccccctctctgcagtaataatacaagttactgtagtagtagtacaaagaaaagtatcatcagcagattaatttgtcgatctgggtgtagtacttgtatcatcaggctttgatacggcaacatcgtttcagtttttgtttcttgaaaagattttgattctgaaatacagtactaatagtagtagtacttcgtatgttttagagtagaaatacaattcgagaattttgttttgtgtcattgtgtgtccacctaattgaacgaattgtcgctgtttaaatttcataattcatttatttatttttgtgagtaacagggcagcacctctatttccatttctgcaactgaagatcacaatgtaccttacaaatgactgttcaatgtcgtatataaatagacagaagattgctctgacatttcatcaacccttttctaccaaattggaacagaaatgtggcaaaataccaaattccgacttgagatagaaattttgattagtaaaccaaggatgattttcccacactgtcagccagacaaaatgttaagctagactgaaatgtcatgaaaaagaagtcaagatcaccaccatgatttcttcttcttttttttctaacatttcaccaccatgatttctcaatgagataaatcaacaaacttcagttttcttctgtaatcaaatacaaacagcatcatgcatgtcctctaatctcttgcctaataagcatttgccttttccacacactaaggtgtactaaaaacaaaaaatgcagagtgtagttgtagttgtagtgtagtgtagtggtggaaactagagccacattcacaaaagtctcaagctgacattaagttggaagcttgtgggggtgtgaggtccacacttagcaacaggacattgtatcatatgcagccttgttgccttgtcaccagtcatcagtccactcatccccatgcccccctcattctgatcctttataaatcagccacccagcaagacattcctttccaacctcactcaccttgctctagctcagctagctcttgctgctagtagcttcagctttgctactgctactaccactactactactactactttcacctccaagaaagtatagattgcaagaacaatttctgctgctgttgttctttcttgctgttctttctccttgtgtagttgtgtggtgtggttgagctgaggtgtagttaggacagtggctggctttgcttgcttgattggtcacctgggaaggtcgctgtctctgccttttgttttctttgccatctctttctttctgggctgctttcaccttttgctttccaacctcttcttgccatcaataatgatggaggagtaagatgagggcttgttcttgaagtctctccaatctaatctcatttcatcttcatcatctccacccggtccaaatccacctactactgtttttcttttgtcccttctcttttttttcttcctctgatcttttcttttttcaggtgttttgtttttggcagtaggtgcttgctatcttttcattaggctttggattttcctctcgtgttctttagtctcagcctattagaggtttgaggaaagttttccatttcttagctctttttgcttccagcttcttgggattgctctgtttcttgctgagaattggctcgatttgggaggcctcatcttgtgttagctttcaggttttcttgcctgaaattgaaccgattgggtaggtttttaggtgcttcagtttcagttgctagctcgtcaggcttgttcttgggctcctgccttgaattggggtcaaattgggatgcttctgggtgctttgaggatggaggagaggaagggattgatggggagggagagggatcaattccccgtcggcatgcgggtcctcgccgtcgacgatgacccggtgtgcctcaaggttcttgagaccctcctccggcgctgccaataccatggtcagtatttacagtaaccgcagctaattgtacttccattatcagctatccatgatgctcaacttgctggtttttttgttcgattctgcatgttaatgacagtgttgttcttttgcttctgcttgcattgttcattgttgtattggagtactgtagttttcttagaaatctgaaatgtcactgatactagcatacttggcacattttagaacttctgtatatcttataaatgcaatgcaatatgcctactatggtgcactgataagagctctcttatggtgatttttaacagtaacatcaaccaaccaggctattactgcgttgaagctgctcagggagaacagggacatgtttgatcttgtcatcagtgatgtccacatgcccgacatggacggatttaagctccttgagcttgtggggcttgaaatggatctcccagtcatcagtaagttcagattttcattttttccccttagtacaaacaaagttctagataggaaggatcagctgttgtgtaaaaatgtcttagctgaatttgagcaaaagaaatggagatgctaatcgggtataatgcctgcagtgttatcagtaaatggagagacaaagactgtgatgaaggggataactcatggtgcctgtgactatcttctaaaaccggtccgaatcgaagaactaaggaacatatggcagcatgttgttaggaggaagttcggtaatcgtgagcgaaccaatcttgatttctccaaagaatgcaataagccgcaaagcgcggatactgatcatggaccataccaacctacctgtggttcttctgatcaaaatgggaggtccagcaggaaaaggaaagaactacacggcgaggacgacgatgaaggcgatgataatgattatcaagaaaatgatgagccctcagctgcaaagaagcccagagttgtatggtcagttgagctgcaccgaaaatttgttgccgctgtcaaccagcttggaattgacagtaagaaagcaccccccccccccaccccacttttttgcctttctgtaaatgtccttgcaggtttgcagcaaactcatttatgtttgtgtcctttttttttttttacctcactgttgatgcacaagctgtaccaaaaagaattcttgagcttatgaatgtggagaaactcaccagggaaaatgttgcaagtcatctacaggtatagcatttacttccatgacaaaattatctgggtgccttttttttttcttttctttttatccattcatgagagctcttgaattttgctcaaccgtcatcctttacatgttcttctgtaccttcagttgttgatgcgtttttacttcagtttatgaggtcgtccatcattcattcattcatcaggcctgcacaaagtgacagaaaatctcttatcattatacatgttgcaaatgctgatgctgcacagcatcgagaattcaagattccaccacatggttgtctgaactctgaaaaactcaccattttatcacatcatttactcaacctgcacagaaatgtagtacaacaaacttcagatcaggattgatccacacagactgcacattttcttccctgatgcaaaattatcatcgatcccgatgaacaccatcgaatcaaagcttcatccaccatttgatttcatcaatgaaatggaggagtctgcacctgagcacacacggccacacagcatatgtagctgggtagaccttcact

SEQ ID NO: 65803 - DNA, 1620 bp, Oryza sativa
ccagacttttctagataaacaatcaaggccatccatctcccaaagggctaaatcagcactggcaacattaactgacctgtcggctggcacgatctctatcttgtcgccttgccattgaatcaagcattgatgcatgttgaaggaatgcaacaattggcgtgaatccaatcccttccaagcaacaagctgtacgaacccttcccatcgatgacaaaaaacgtagtacgaatagtcttactgccgactgtcagctccacatttaggacacatttggtttccgatggattaccaccatagtctttgagcaccatatttgtcttgatgagatcctcagcgttcctacccaacttcctgaatgtagcataaggcatcaaatttaccgcggccccaccatcgaccatcatcttagacatcggcttcccattgacgtagccatttacatacaatggtttaagaagccgattctctgtcccctcggatttctcgaatactgcctgttctggtgacagaaccaatttagccgattcctcttccacttcatcgacatcggcttgatcgatcctgaattcagctggcaatgtaaagaccatgttaattggtgccgctacaacactcttcccgtttgccaacctttttgcctcatcagctgcaacatcatcggctacaggaacctgattcttaacacaccactcctgtcttggatttggtttcctcagacaatggttaatttcttgttcaacctcctggaggcgctccctgttcctcaatctttgaacccttctcttctgattcttcatgaaaataccagaaggacaccattaattcttcctgattacctcatcctcttggccacgatctttattcaccggacccaatctttgatgaacagaaagtcttgcctgccttagccgattacccctattatatgaccggttcgagctctcgacgatatcactgcacccagggcagttttcgatagatggcaatctcatcccttcattccagcagaatctaaagaactcacaaccccaatgaggatcaaaaccatcatcgtattctgctgcttgtcatacttcctctgatatttgttgataatcttagccgaatttacttgaaaaccctttgcacggaccctatcggctgtttgaccagccgtatgcaccatattaacaggaaaaggattaccatcgactttcatcggctttttggaatcatcaaacctaatctttcccccctcaatggcaacttgaatttgctgtctaaaaaccttgcaatcgttagtagaatgagatccagaattaggccatttgcaatatctctttttgcttaattcctcagccgatgggattgtatggccaacaggaagttgaatttgcttctctcggagtagtagatcaaagatcttgtcagctttggtaatatcaaagtcatacttctcctcttttccaggactttttacccattggcatggtatgacctttttactcctcacccattcggctgcagctatttcagaatcatcttcctcatcatccgacccatacatgtatggaaaaacttgattaaccttcttagagcttttcctgacttccgccgacctatgctcatgcaaggttacct

SEQ ID NO: 65804 - DNA, 5986 bp, Oryza sativa
ctacttaatcgctgtcaagtctgataacttcatctcatgaaccccactgtagaggtagctgtggaattgcttctccaaatcggcccaactatggatcgacccatatggcaaagaggaaaaccaagtaaaagccaatccagataaaaataacctaaataacctaacctttagagcatctacagccgatgcttcaccacactaagctaagaatcggctaatatgctcataagttgacacaccatcttgtcccgaaaatttggagaagtccgggactttgaaccgattgggaagaggaactctctcaaaccactcagggtaaggctgccgatacaagcttccagtctcttttggtttaagcccaaactgttccctcattacgtcggcaatcacatcggcccatggtcgctgctgagctgctgcttgtggctgttgctgcatgggctcaaactgaccatactgagatgcgaactgaggttgagccaatccccctggctgatattgggcttgcggggaaggaggctaatattgataactcaagttacccccttggtaattatgaaggttgggctggatattgtgcaccaagtgctcaggaacaacctgaggcattactgtgccatccggctgtacatggtgaaccaaatgctctgggacgactcggtttacaaaatgttgtacaggttgacctccaggcgctgcgaacccggccgatgcgcttactgaccccgggtgctgaatcggctgaacgatttgctgcctcaacggagtctgttggatcggctgcagaagctgctgccttggtggtgtttgctgaactggttgcacgacctgttgctggattggttgcacagcctgttgctggattggttgcacagcctgctgaattgggggtgtctgctgaatcggctgctgttgttttggatcaaccgcatgttgaggcggcaaaaacatagcagcaacctgatcttgagtcggccgattcgcaacatgcccactatgctgtggatgctccctcgttaacaaccgagggttcatcggctggcctggcaccatggctgatgtagcaggtaagggagtcgatgctggcgccgtcggctgagttgtgggtgcaacggacggaactgcttgaatagatggctgaacatcggtgatcaaagatcgataatttgggaagacacctccttgcaaataaactgggcctgcagcctgatgctcagctattgaaccatcggctattgtcttcatcatgtttgacaagcatgatgcacagcgtaatcaacccgatctgggaagttattgaaaaaatcttgtgccacttcactattctgattaagatttcctccttgtggcccctgagcaccatcaccttgaacgccatgaactccttgagaattgtcgccttgatcgcctagagagccgtcggtagcacctttgatactcggctgagccgagccgcctggagcttgtttcacttctctatctttagaagaaccggtcccgggactatcagcaaccacttttattttatacttctgaataagtgtccccttgcgggtctgcatgaatgagttcaagaactgatcccgtgcttgctgcaacgttgcttcaaactcttcctttttctcaggtgtgaatttctctggatcgatcggcataacgttttcttcaatgatgtcagtcaatcccaacttcagcgccttgcctttaacggaacatgggctagatggtggtggtggttgtttctcggccatgaagaagaattgtcggctgacttcttacgagtcccaccaagcatgccaaaagcgtgttgacagaaaaaaagtggcctgggagatctgcttaactccagtgcaggtccaaagctcgccttcgaatgtatgagcgtgccagttgatttgatcctgtaatcaacaagaaatagaagcaaagaaaccgcggttaaatctataaatgatagccgatcggctaggtgccgatgatatatcaattatctttgagccgatgtcatatgtgtatcgatcggtagtcatgaataagtaagaaggaattaaatctactcgatcggctgtagatattaacaatatatactccttatatcgatatatacttaaatcaagtgattgggatagatcggtcgccatgccgagacagtataaatcacttagatcaaaatatatatcaataacaggactatatatgtttatagcatagcgatcagatagatctaacatgtatcggctaatactccgatactactctatatcaggatattaaaacaggtataatatatcaaacaaaggcctaatatacttagatacagcaatatcttgacatgaagggcagatttaacatgtcaatgaagcatatagagcaaatatagttaaatcagataagatcggctgaaactccgatgctaccctaatcggcaactagaaagcaggctagagattgatattctaagcacgacttaacatatcaaactcaactgatgcagtattaagtatgaaaagaagaacaatatctagacaatcaagccgctggaagtctcatagagtggtagatatcttacataatctgaaccaacgtcaaaatctaacctaatcggctgccctctttgatagatgttagccgattgtaggttagatagcgatattgccagagattatgtaagatatatgataactcgacgaattacataaacaagattagagtgtcataaagatggaagcactaatcccaagaatacaagtcatcataataagttttacctcttgttgaagatcgaaaccaatgcagctcaacccgaaagcaagaactcgtcgaaacaaaactaaagcaaaagggtggcgatgcgccgaaatagtattgaacgtgtgtgttaaaagttacataggactcgggtctatttatacccaagaattaaaagatacgtccataacggacatgactactatctctaacaaactctaagataccataagtctttgctgcaaacttttgcccaaacctatctctaaggaaattacataaaacatcctaattaatagatacaattgcctcctcaggactctatccatgtgcggcaatcaccttgaagcaccttgatccaacccgacatcacacatcaagttgtattgtcgggatcggctacatcggcttacctagcccgactcagactcagccgatcttttcgtagccgatctggactccagccgattcatgctctgttttcgaactcgatctccgcctccaactttgctttgatctgatctgatcttctttcccaatgccgatgttaccaaatttggttgttaacaacagcctcgagttaacaaggcgtgtatctattatgggcgtaggatatatgcacgtacgggactcgctgctttggcttcccacacgtaggtagctgtctacggattcaagtgaacgaccagcgaaactatttctatacctaatcttaactaattaaaagattagtatttttccaatcgtcaccaaaattagtattagtattttttcgtccgtatgcgctatttttttcactcgtctgtgtgcgatctcctcccaaaattttggttcgtcagtccacgcgagatcgagagactgcatcgctcccgtcccgtacgcgcgtacaagcccagaactatgcacggaaacaagagaaactgaatcacaaatccaacaacaataaagcaaaaccatcccaaaatataaatcaccggggccaaaaaaaggaaaaaacttcacaaaaaaaatcaagcattggccggctcggcgaggcaatggggaggaggagacgaccatcggcgactcggacgcagcccagtgcgcacggtccacccctcaccacggaccaccaaatccatggacccgcgcgagagtgggggcaaagagacgacggatccgtgcgggaagggaagaggtcgctggatccacccctcccatcgccgctgacggcagatccatgcgagaggagggcggagagatgacgggatccgtgcgggaggggaagaggtcgccggatccgcccctcccgtcgccgccgatggttgatccgtgcgagagggagacaaagagacgacgggatccaggcatcggtggtggatccgcacgggcagcatcaacggcttggaacgttgcatgaggaggccttgccgtcgcctccagtcagccactgcgcttcttcatcttctcgctgtcgcgcttctccatcttttgccggatcaaggagaggtggcgccgttggccgctgctgcagccagtaggcggaaggaggcgccgctactacaggaaggaggtgcaagggctgagtatgggaggatgtgagggcgcacgctggtggaggcgctggatgcctggatgacggcatgcgatgtgaatggggaaccagtgaggagggagagagacagagagactgggatagagaagagcctagagagtaaacgaagagcctagagctctcggagcagaagagctctcggagctggcaacctcctcggtaatgaagtacgaggttcagttttttcattaaaaaaaaactacgaccggtcaaaggtcctttctttattgtgctattgattttcactgaaaaaagttttttttaatacacgtaaaagtacttcacaactaatgatgatttttctttattacttttattgttgacatcaaaatcacttaaaaatctcttaaagtttcagttaaatacaaatatttgtttgagactaaaaaaaatatcgactgaagaaaaaataaaaagtttccacgagataagccaaattagaatatttgcgctatcatccacgtgtcacatgacctgtctccacgtgagtccacgtataattttgagttgacagatcgagaaagcacgcatgaccactagagactatgagtaaatatgcaaaagtgactatgagtaaatatgcaaaactattttttatctgcgacactactacatgatatattttcctggacactgcacccttttgtttccatgcggtctgtatgtagaaccgcatggaaaaataaggggacaggcgctgggctgtcgcccacacaggaaaacacagtatcccgcgtgggcggcttaagccaaccgcacccaaattttcacccgcacgggcccaccgcttttaaccgcgcccacacacatctccccctccgcccgctcctctcctcccacctccctctcccccactccactcctctcctcccactctcctctcctctcctcttttcccctctctcccagccggccggcggcgcgacagcatgtggcggcgcgcggcccctccctccctctcccttgactgcgggtgggaagaagggcggcgagagccagcggcggcagacgaccacggcggaccctcccctccgtccccttgcagatccggtagagggggcggcagatccggcggagggggtggtagatccagcggcgcgcggcccctcccctccctccccttgcagatccagcggaagggaggcatgggggcctggcagagcggcagcatgcgtcagtggccggcgtggaggtggggcaacggcgtcggcgaccggcgaatctatctctccctctccttctctctttgttatttgtgattctttgtgatttgtgagatgcgtttttgagttcatttgttgctgtgagatgtgttcttgtgatgtgagagttcatttgttgatgtgagatgcgttcttgtgatgtgaaatcattgtgtgtcgatgtgcgactacggatccggcgccgtcgaccagaagggaggttgtcctctgcatcggcaacgatgacgatgacctcgccctcatgacgtcacctaccccaagcgtgacgtggacaacatgcagtggttccgggaaatcacgctgctataccgtggccaccgcctctccgcacccttcgtcctcggcctcatcgtgctctgtggccacgccccgcccaacaactagtgcccatggggacgagaagggcgtgggctgcaggaat

SEQ ID NO: 65805 - DNA, 718 bp, Oryza sativa
catgtccgccgccttcggccggcattcccgtctcatatggcccctctcttcctctctaatctatttcttttcgtttttaggtcgtcccggtcgccgtccgccgcgtgtcgacctccctccgtcgctcctcgtcgccggtcgccgccgtcccctccggtgaggacttcctccccttccctttcctttcccgattccccgtgcgtcgccgccgcccgcgctcgccgtcgccttcggtcgctgccgccgtccgctgccgccgatcgctgccgccgcccgcgccgccgcttgccgtcaccggtggacgcgcgcgcgtgccgccacccttgccatggccggccggccggccttgtgccgagccgagccgagccgggtgccgccgccccgttccttcccaccccaagccgctgaccggtgggcccgcgtgccggcgcccttcctccctctcccgagccgctgaccggtgggccccgcatgtcggcaccgccccctccgtgctgacgtcagccctgggatttattgcgcaataaatgatttaaggtttttcttttatagtaatagacacagtgaatcttctaaaattcataactaattcatccgagctccgtttaagcccattcaagtctcagtaaatcaagaaaaatgtgtagaatccactaaaaatggttttgttccctgtttcagtagtcttatagcatgtttgcaatgtttgccttgtatg

SEQ ID NO: 65806 - DNA, 3548 bp, Oryza sativa
acacgggggcgggcgcgtagcagcggctgcggaggacggcgtcgtcgacgagggatgacgacgggtcggtgagggtgtacgggtggttggcctcggagaagacgaggacggcgacggccgcaccggtgaggatggagagctccgaggccttcctgaacagcccggcccgcctcttggtgaaggtgacgtgccgccgggcttgtcctcgatgcggcggatcccgatcgcctgccgccccttgctcggcctcccgcgcggatgaaccatcgctcgccggcgcgcggcggcgctgcttcttccctaaactgaaggatgcggcgcggcggtgcggtgatagcggcggcggcggcgcgcaaggagtttatgaagtggaaagtgttgcaaaaaaaaaaaaggcgggagggagggagggagaggcggtgaaaacggacacggagaagatttgaattgagggggtgaaaacgaatcctcctcgtacaaggagaggttagattttggaaagttttcctagtcatccgtaattccgtacggccttgttagttttgggcggggtcaggcactcggctcggcttggattaaagcccggccaacaaaaaaattgcgttcagttaagcctgggaaggattggatccaggcctaccccggcctttcccctcattctgggccgggaaaaacatgtggaaaatatccacgagatggcgcaggatgcagcgcgtgcggcggcgggcgactcaaaggcgacggcgacggcgaggtggcgctctcccctccggtggccaccttatcaccggtgagtctctcttccttcccctctcctcttccatgtgggtggccatgacctagggttttcttcgagcttgtgttcctggctcaccccgacaaccatcctcgctgctcggtactgaggatgggccagtgccgctacctgagcctgtgttgattagtgaaaaatcaaaagtgggagaagataatttaattctaaacatattgcaatttaattctgcttcgttctccttagaaaatcatttggacgattactgaaagtatagtagcaatatagtgggagaagatttttaataagtatttgctgcagatttcttttaatactatggtgagacatcctcaaggtatgtctctgaactttggccacatttgctgacagtaaaagtgcaatcactatacaatttgggcaaatactcttttttatgtaattaaactgggtatatactaggagtggcaaaataagaatttaattagataattatactaaatttaccagattgtgtatgagtggaaataaggacattatgcatgtttataacttgtgagggctgatgtgttccaagcaacttcctaggatgtcagtgtggaatagaactttttttttgttttgatctgtctgatcttggatgttttattttattggctgtttcctaggtcacttaattgaagcatgggtttttcttgctcaagcacaattttatccaactgtttgtggtaagcatctagctgaccttgacaactaataagatctttgttcatgatccagatgaaacgggctattgtgaaggtgatggggtgagtgtactggcttgaggggtttgtgaggcttatgttcttggatgaccagacattctaattatgagaaacgtcaagggcctaattgtgagggtggcatcctcaccctgtggcattaattgatgctgctgctatatttttgcatgaattcagacatgtttgtgaaatcattatctttgagctctaggccttgatgatactacaatatcattgttttaatgattaatccatagtgcaattcttgcactgagacatcagacgtggttatgttagctgaattgatgcatgtgtgaaattgatgcatgtgccaaatccctgccaaaacgaacgcatggttttaagagaggggtttgaaaaatgcaatggattcaaaccccacagattggttaatatggaagggattcacctaattcctcccctgataggttctccttgggattatttcccaagcaaccgaacaaggcctacatggaaattgctctagctagtcacggtaattttttatttttatgttttacgcgtggaacgaaacggtgatgtgagtgagctgccatacacgtacgtacaagtgttctactccctccatccttaaaaaatatccttttatatcttttaatttactagaaaaaatacccgtgcgttgcaacgggtgaagtctattttattcttattattgtttcgttaatataaaattcactgtgagagttcgcttagatattcttagaaaatcatatgatgtagttatgagtccgatcgtctcaagttagcattcgagtttttttaaacagatttcttatatgattccttctgtattaccaaaaatgaacaatcttaaaaaccgactgaaatacggatatgtattttcaaaagcaaacgaacttaaaaaccgactcatacacggatgacgtaccaaaataccggcaaaaacatctttaatttttataatagtagagatctcacagagagtattttataagttataaggtctaatatcttaatactactacttaatatttttcttcttattttagccatccaaccatttaccctcttctcctccctttctcctcctcaaccatttactctcttctcctcgtgttgttaccctccttgtttttttctctctgtattaatggagagtatgttttttatttctcgtacttaattgcctataactttctaaaactacttctttttgagggaatataaattctacaatgttgctcatattattatgtattttctacttatatattttttgataaatacgatatatttacaggtttaagaaaattataacgtgtaaacttgtaagaaaaaaatgtaattttaagacatgttccttataacgtgtttttttccccactaactaccgcaatccacagaatgtaaaagcaatgcacgacgattggatacccaaatgggaaaaaaacgcaacgtgcgcgagaatggacggatgtaagcgacgacataccaaattataccatgaaaacaactttggtagagatacaatttttctaatagtaaagatatattatgtatcagcctattttattactaggtccgaacatattttgaaatttatagttaattttagaggattttttcatcgttattgttgccaacatctttcatgattgttaaaagaagttaataatctacctaaaatcattcttcaaaattcgaactaacaacttcaaagccactttgaattataatccacatttgaaccaagcacagccataaatgatgcacattagctcaattaaaagtacattaaaataaaatatttaccgtttaagataagattttatcaaactataaaactttggcaacctataatttctcaaataattagcataaaaaagtatccatatatttgcttgtttgagaagtactattataatatcataaacttgttctcatataaagttaacagttaacggtcaaagttttcaaaattttaatta

SEQ ID NO: 65807 - DNA, 4222 bp, Oryza sativa
aataacgaatctatataatatgttcagattcgttgttctaggtgatgtccaatctcaatatagattggttctttttgggatggagaaagtacaccaattttttatttttatctcatatgtatcaattaaaaaacctagaataccatgattttctcaactcaaaatataattatattttgtctctttatctattttcaatgtatttactctctatgttttaaaatatcgatgcagttattaatagtaaacttattccgggataagcaaacgtagttaaaaataaatatattactcctatatgagacagggcgtgtaatagtacgggtcgtggttttggggggtgttactgtgggtgcacgcatgaatggccatgctggctagctaggtacgtataggtatagtgtggagcagcttggaaacaatcacacatgatgcaggaaggatgggagattctaccgttggcgctgctgccctggccgtgctagtacatctgacaccgtctaccgtgcatacgatgcggatgcaccgagacaaaattttaccatcgcctacggcaaaactgaaacaaaatttttatcgtctacggcaaattggtttcgattcatagtctgtgtagagctagcacgtgctcgtcgcgtactctcgtcatgcatgcaagttattaaaaaaataaatttaataatatagttcaatactgcacattgtctcaccagcgctgctacaaaatcctatctatgaaataaaaacttgagctaattgggcatttataagaaccaaataaaattagtggatatccatgaacggtgagacaatgtgcagtattgaactatattattaaatttattttttttaatttttttattatttatttcggcatgcaaagaatgaggaatcatcaccttataaaggataaatttaagatttttttcccatgttgtttctgccgttctacgacatgcctcttcagttttgacatacacacaattatctagttcaaacagactgaccaaaaaaaaaaaaactacatcaagagagttgaataccgatcgacattattagctagccttaatttgtcgctaaacaacctacaaattaaacctatgcacgtacgtactatcactacagtaactaattaaaccgaacactttcacatgtgtttagattaagtaaattaatcagcaccgtatgatagtactactcttgtaccaacagtgttacaggatcgtgtgttcgtatacatacgacaggctggttaatacggcctgttgcgagattctaatctctgaccaaacaataaaccactcttgcttgaaacggtagtatacaatttgaatcttggagtcaaatgcaatacatcattaaccatttctactactctagtcgtactcctagctacttgaacacttggagtacgtactggtgccgttcatggggttccattcaattcatcgacggatgatcggctcagtttgaatttttcacatggtaattaatcgccgttttagtactaatgagagccctttaatttggtgatgccacatgtgatggactaaaggtacgtgtttgattattgtctcctggtttgagcgcaaattatttacccagtttgcaacgcaaggttaattttaggatattatggctttccagtaaaaattttgaattattttgaagattagctgtacgtttaacacggaattgcagacgaatttattgtaattgaattgcatataaaagagcccaaattaatcttgctggaactatatacaggaaatatttctgtattgcaaatgtgcctagctaaaaatgttcctacatgatagtaccaagggaaaacgtttgtatttatttaattacaaagaataacaagccaaacccattttttttcaattacgcgcatacgtgtgcaaaccgttacgcacatacaccgcacttaaagagataaattaaagaccaacgacaactctcagacctccattggaagtgcactcgcgtgtatgtaatattcgtgggcataaggatctgaaccgtactttccaaaaacacgccaaagtttgagtagaagagaagctgaacatggatgatcagctgtacaatgatagttacattcaaattcaaaagagcgttgggctcaattcctccatttcaaaatgcgccacaattttgattcgataagtagtagtatttattcttgcttctcatagtaaggatcacaaaacaacaggcttaacctcatcaaaatcaaggctgctcaattacgcactactccatccattctaaaatataagagattttaggtggatatgacacaacataatactacaatttagataagcttactaaccagattcataatactagaatgtgtcacatccactaaaaatttattatactactctgttaaaaaaaatcaaatactatgtttgaatatagacaatatgtgtccaaattcaaactctgagtttgatttattctttttgggatggaggggtattttagaacataagagtactacaaaacaatgcattggatcaagcaatcagctatccagaaaagcattcagatttaattagctcttgcaatcaagcaatgtcttgcacagttggcaccgtccgatcctctgatccgacggctcgaggcagctagctccagctcccgaggaagatcctgccaacctagcagtgcagctctcttttccaaacagaacaaaacgacggcgacgcagtgctgcactgcactgccgtgtggtgtactacgcctatcctacctaccaccacactgcccttcactcgaaattccctgccggtgcagcccctgctctgccctgctgtgccggtgaggcagccacgcgcgggcggtgacagtggtcgatcagtaaaagttgcagaaatttttcacagaatgacagtgcccctttttgaaacgcaaaaggtaaaaatggaagcttttgtaccagcttcttcccctgttcatcccaacatgggttgctcgcgcccggagttaattcccccctccctgcaccctcccaatcactccccccgctgggaccatccgtcgatcgcaaattagcggttcatgcaacccaaaataatcgcattagaaccagccatcaaacttcaaattctataatatggatgatcatatttatgaatattccctccgtctcaaaataaataagtgtagttttacagtgttcatgttcaacttttaaccattcgtcttatttgaaatttttttatgattagtatttttattgttattagatgataaaatatgaatagtaatttatgtgtgactaatttttttaaaatttttcaaacaagacgaacggtcaaacgtcggacacggttccccacgactgcacttattctgggacggaggtagtattttttctagttggtgatataaccgtcgacaggaaaacatccgtgatgaattcattaattttaagatatatatgatggccaatccttcgaagttattcatagaagcagaatttacgtgtgtctatttacaattgtgcgtatattatgagcgtctgtctttgtattgtgtttcttgaagagagagagaaaaagatcgtatcgattagtagtagtagcagcacacaagcatttaatcttcttttgtgtgtgttgttttttttctttttttgaaaagaaaaagattggaaaagatttgaacttgctgcgatggcgcaaggtttgccgcgcgtttccggggcgtgctagcgatggactcctataaatacgtgtggattttctcgccggagttatcacgagaattcgagttgctctgtgttcgacgctagcttcgatcgtgttccgcgcgggcggcaatggagggctcagcgagggttggtagtaggatgggggcgatggaggcgctgccgctgcctccgccgccgcgcctcgcggcggtgtcgtcgccgtcgccggcggcgtccatcagggcgcacctcgcgagagccgccggcgcaggcgggggcgtcgagagctgccagtcgccgcgctcgctgctgtcgcgcatcctgcagcgaggcggcgacggcggcggcggcggcggcgggaagttcgggtgccgggtgcggctgccgcggcggtacagctccacctccgccgccggcgccggcgccgaggcgaaggacaccgcctccgagcaggacgccccggccagggtcaaggtcctcgggagggcgccggatctgtcgctccacacgccgcgg

SEQ ID NO: 65808 - DNA, 1297 bp, Oryza sativa
tgagaatgtagatcattttgtaatgtaaaaatgatagttttaaatttgatttatatgtacaagttgaaaaaaacataatatgaaaaaaaagaatttaatttgtttttcttctaaatatgtatattaagtttaattaatttggaattgaaatttagtgatataatatattgctatcgtatcaatttttttttggagattttgaataactaactgattcatattatatttggtagacaaagtaggaacaaattaacaaggggatataccatacaaggaagcaccgttcctacaattccttcccctcctacaataaacgcaatcctatttcgcacatgtgaaatatggaaatctatagagttaagtctaggtgaaattattcaaaagaattttgagtacgatgttggcaattcattcaataaacacaaatttgatgattttcagagccatatgtagcaaacacacaaaggaaagttacaaaatctattattatatattaaaagtctattaaactttatataaacgctcccatatcgacacgtggcattcctatgaacgctcctaaatttcctatgaatgctcctaaattaccacatggcattccaataaattagtaaaaataaaaaacatactcccttgattttaagtaaattagtgggtccaatatcctaaaccatcatatctaccctataatgcaccgactcattttactcatctttcactcctacactattacatttatcactcaacggttcagatcgtccagtgtaaaatcgaaggatcgagatcaatcccacctccacctccctgaattgcgcactccccccctctctctttcttgccttccagatccgcgtctcctctccatcctcatcccacacgcacatccctctccccgcctctttctctcgcactgccccatctctagcatgtcgccgccgacgaatctcctcaccccgccatcgccccttccctttccccccaccgccgacgaaactcctcaccccgccgtcgccccttcccttcccttcccccccaccgttcatcggcgacgatcccaccttcggccctaccggatccctctccaccaacggtagagaccctcatgccctaccggattgatttgataactacaagctccatccacacccagtgctccactcaggtttgatcccaattcgctgcctgctccactcctttgatccctgttccccccttttgtccagataatcgcacacttgggcaaactcaaccaaatttcgattttcagatatattgtcatatagtgttacacaatgag

SEQ ID NO: 65809 - DNA, 3650 bp, Oryza sativa
caacacctcgccgcaggagcacggttggtcacgccgcgcagctccacgcgcgcgcgctctagcacgtcccgtgtcgcgccgcggcgcgactgtttggcggcttggcgcgacgcgctggcgcgctggcgcgcgcgcgcgcgcgggggcgcagaaatggcgggaaggatgtgcaggagtgacgcgtgggggtgggggtgtgagtgattgtgcgtgcggtgtagtaaatgtgcaatgatcctgctgtctctgcggcgtttttcagaaattttttttccagggaatccaatccaatccaatccaatcgagacgcattcatgtgtccactgtaaacttgtctctgcaaattctgttggattctgttctttgcattgcccatgctgctgctggtgtttctcgttgagattggccaatacttgctgaagttttcccatttttcctgcacaaaagtttgccctgagagtactcataactaattcataataaattttgaaaagttgaaaacattgatcttttttgaaaaataatgcatatatatttcgtatgatatgcaagatttgaagtaaggatgtttgttgttgtttcaaactcttctcttgatacaactatgcacaggtcttttgcgtatgccggagaaaaaaattccatttcaaaaatgatactcgtaatttttcagcgcgattgattcgtggcacaaaaccacactgatcatctgcaattcgtgaatgcgttctaaattcagggagggaaatgtacatttgggaccaggcgagatgaacattatctcgatgagcagtaacggttctgtgctgaattctgaatttctgatcgaatttacttgcaggctgcagtttgcagacgccatcagtacactgcggctgcattaaccccagcaggctagcgatcgaaagggcaaactggcgctgtgaaaaaactgaaaattcagaaggctgcagtgaacagtggcagcagtaagaacacgagggtagaatagaaggtttgagcagagcagtggcaggcaggcagcgcgtgcaaaactgaaaatgttcaggcaaattttgtgataaaaactctgcagaaacgaaggaaacagtaggcctacttcagcgagtttgcaggctttgaatttggatttcgcgtttgaagcttctggtccagctgcattgcagtggcacagtgccaggctctagattttcgaggtacaggctgggacatggtggccgaaaattgtacgtaatttgggatttagtagtactgctttaaataactgaattcaaacttcagggtctgtagggttaaccacggaccctggctcagtgttttagtgaaattcagatcataccctcatttggacattttgttctagatctacgatctaacttttgattactttactaagccctttttatttgggcttataagctagcttatgaactgacaagccttttctgtctaaacgtgcaggtgtttttttttcttttggcttttcgaatgtgcactttcctaacttcacctcgctcgtttgtcatgcaaacgttttctaaactgctaaatggttatgatttttgaaaaaaaatatataggaaagttgtttttaaaaaatcacataaatccatttctcgcataaaaaagctaatacttaattaatcatgagctaatgagtcattctgttttacatgcgtgagagattagtttccatttcattgtgccgaacatagcatttcaatcttaaaccacaaactatgttggagaatcttttttgttttatatttttttagataattttttttgttttatatgagatagaggtatgactctactattaaacttagtattttaaatccacgtacttgtaaaatatacttcctccgcttcacaatgtaagtcattatagcattttctacattcatattgatgttaatgaatctagataaatgctagaatgacttacattgtgaagcggattaaaagacagcttaagtcaccaagaggggggagttggaaatttgttgtcacctgttgaatgttattaaaagacgcgaatattaggagaggacctaatatcaaataattagaaggggtgaggcttcgaactcaggtcatctagcccactaccttgtggagctagccggaagacccctgacctttctcacctgttgaatgttattatttggtagcttggtgcaaaagatactagattgaattctattttttgctatgcagagaattttgctgtgacaatcttttagtatgctcaatctgacaaatacaaatattcgatgctattgcttgattcaataacttttgttctgcattccctcctagagcatgttcacgtgtatctaaagaacatgttaaacatgctgagcaatacataattacacacaagaatttttacagtacttgagaagttgagaggtatgtaccaaaattttcgtacctaagtatcggaggtaccaaagaggtcccaaattgagataccaagaggttccaaattttataatagtaaatgtagaaccttctcgagaaccctaaaaccactctaattacactgtcaattttttctggtgggctaaattacacagtcaaatttggcccagagacccacctcaccaaccaaatcctacggcccagaagcccatacaagttttcaggctctcggtcccttctcgtgccgtctccccgccgccgccgtcgcccagcgccgcgcctccccgccctccgttgccggcgacaagcccccgcagggagcgggctatctggagtccaagctgcagcctcgccctcccgctccgtgcgccgggcagcagcaagcgccgccccaagccctagcctcgccgcctgccaggtgcctgaagccccctcggcccgtgctccccttcctgtctgcttgtcggattcaccgattgtagcccgcaggtagttagctagatcttgcctcattgtgaatttgtcaatttgtgcatgtaagtttaatttgtggtgccggttgtatgtagtctgtagaatcgattctagtgtggtaatactcggtagtttaatgaatagcttggctacttcagcgctgaatctagtgagaataagttgagaaacaaatccgtgcggtaaattgttggaaaaatgtttagccacatgattgagtgcgatgtcttcttcagagttatgtgagcatggtgtaatgaagatttacttgggtggctatgagaaagcttagagttgagtagcagaaagcttagagttgagtagcattgcattcttctatttatgattaagatccatatttgtaccaaagtacttatgttttttttgtttagtttttttggcaaattttgaacttcataattggttttagtcaattctaccaatgtaccgtgttgattattgattgtttgcttagtaccctacagtactattttacaagggaaataacattcaattttgataagggggtctattgatgcacagggaaattactactgtgatgtttctagaggtgcaaatattttacttacaagttacaaccatgctaatagagatgagcttatggttgtcagatgtggtaacctaatcttttgaataatatagtgtttagcttcatgaaatttctttttgcagctgttgattttgaattccataaagctttctttttattt

SEQ ID NO: 65810 - DNA, 1909 bp, Oryza sativa
aatggggctataaatagccccctagggccatgtaatagggggatcccaaaaaatttggtcaaagtaatacaattgttcttttatttcccatccactgttgagagaaccacgtctttcgacgtgacgcagttgtctattcgacaacacatactttcaatatacttatctataatatactaagaaaacattaaaattcctagaaatgctctttagccatcacatgagacttctaaaaatgctcctataccaccatatggaggtaacatttagccctcgatttttacttaaataggtggtctattattattttagaccattaggttataataaaaaagaagttattcctccctctcatctcacccgcgtgtacatacgcctttcttattccgttcgtatgcatgtaacgtatatgtgccccactttttttactctccatttaaccttttctttatttagttttatcttgaataccctacaatacatttgtctcacctaagattttttatgctattgatatttgagcatatatttaatcattcattttagtataaaaattatgtaattataataggagatcctaaatactccgagaaaaatacaaaacattcgacccttgatttttactttaaatcgatagaccatttttttataccattagatcatatctattaggaaaataacacttaacaaaccgggaaaaaaaatgtcccatgtacgtataaatacatagtactgttcgctgggcaaaaatgccaaaaaaaaagattatcctgtgtacgtgtgtactcctactattcgccgaataaaaatagttttactatgtaagatgtgctttaataccccttattaaaaaccgcatgaattttaaagaagatgaatggactagatcagaaggcacctaacatcctaacactactacagaagatgccatatgtgccggttcgtaaaggatcgttcatccggtaccaatttatcggtaccaataccagcaaccaacacctatgaggaaaatagaaccgacatctttagctttgcacgagaagaaaaaaataaagctagctcgagtcgaaccgaactcgccaacaacgtaccatcgctgccatcatcctcctggatccaccgtcgtcgtcctcgagcccatttccctgctgctgaggccgatagggagaggaagatggggagggaaggttgttgccacaccgtcatcgttgtcaccacactgtacccctgccgtcgctgcaccgcgccccgacgaaacagcttcggtcgtgcccccgctgtcgttgcgccgtgccaagcaaacaactttcgtgctataccctcgccgtcgtcgctccgtgccacgaaacgtacagctgatgcaccatgctatcgagataggaaggggagggggagagggatgtcaccgctgattgggggagagagaaagcggaggggcagaagggattatgattcttaccaccgagatattttaagggattatatatgatacacattttatgactcacgtttctttacaatgaaatggccgaactatagaactcttttcccagctagattaatgactcgtgtatagagctgtttatgtcgaccaaattaaccaaaaatggactgcaaaatgattggagaaacggccaaacgggagagtaaaacttgtctggtagttcttggaaacaatcaatccccgactgttatggacacacgttatttccacgcgtatacgtccatggaacgccaagattgaacgactattattaatacggatacggatctagcttcttacataacctctgattcatacagatacttgttcaaggttgtctaactattaacaatcttgaccatcccacgtcattatgtaaacatcaggacaacaggactacctatatatatatagtccacccgttag

SEQ ID NO: 65811 - DNA, 1696 bp, Oryza sativa
gctctgggcacaggacaactcatcaatctggcaacatgttcaattatgtttgatgatgcttcttccccaatagtgatcgattccatcagaaacatactacatattgagaaagatagctttgaggaccgatacctaggtttgaaatcctcgaaaacaacttagaaacatgccggccttatacttaaatccaaacttctcggtcaacatgatattccatctttgagaatacaagcttgggctcatcgactccaataggcaatatatcaccatccgtaatcttaagaaactctgttttccaaacttttcaagataaacaatcaatcccttccatttcccaaatatttaaatcagcactagccacttaaactgacttatcggcttgcacgatttcaacctggtctccttgccattgaatcaaacattgatgcattggtgaagggatgcaacaattagcatgaatccaatctcttcccaacaacaaactattagaaccctttccatcaattacaaagaatgtggtaggaattgtcttgctacctactatcaactcaacgtttaaaactcccatggtttcagaagaattgcccccaaagatcttcaatacaatatttgtcttgatcaaatctctttcaaaccggccaaactttctgaaagtagtataaggcatcaaattgacatcaacacctccatcgactagcatcttagacatcggcttgccattgacataacctttgatataaagtggcttcaaatgtcaatgttgttatttttaaggcttctcaaacacggcttgttctgatattaattttaactcagtcgatggttcgatttctcctttatcggccgtgtgtatgctgtattcggtaggcaacataaataccatattgatcgaagttgaagcaattgcttttccctcggcagatgttgaaattctattcctttccttatcgttttcaacctcattggctatcacaatctttgattcaactcgccactctttccttgtacgtttcagccgatgatcgattttctcattaacttcctgtatctgctctctatttctcaatctctgaactctccttttctgactccttgtaaaaattctagttggacaccatcgagggttctaagcttgatcaacttcgtcattttcaacttgatcttccatatgatcttgacgaatcggcccaatcttcaatgaactgatctcctgggttctggccgattcctatgtgatttaagactgttaccctgggaagactgattgtaagaattcgatccaccacacccagggcaattgttgattgatggcaacctcattccatcgttccaacaaaacctgaagaactcacaacttcaatgatgattaaacttatcaccttgataatattcttcatcttggtcatcttgataatatatatcatcttggtgatgactacaattctgaaaattcctctgaacttgatgtcatgcctcttctggtacttgttgatcaatcttctgctgtcaatcgtggcatgcaccacatttacaggaaaaggatgttcatcaatcttcatcggcctttttccatcatcaaacttgattcttccttgtttgataggcgattgggtctgctacctgaacactttgcactcattggtatgatgagatactatattgtgccacttgcaaaacttcctctgggctgcaggaa

SEQ ID NO: 65812 - DNA, 7955 bp, Oryza sativa
catgccgcccatggccgcgcctgcaccgccgcaaaccaatcccccacgacctgttcgtccgccaccgccgccgcccccgccgaggcagaggctgctccggccgctcccggcagaatcgccgccgcccgccgcgctggccaatctggaactaaccggttcccccgtcaaacccgctgttgaagacaggggaggcgagaattccggcgccgcgcggccgcccaagccgccgcacctgaagccgctgcactgggacaagctccgggcaatctccggccgcaccaccgtgtgggatcaggtcaagaactccgacacattccggtgcgcccccctctcttcaccccccccccctccattcttccacattacccccatctctctgtttcaactgagctgtctatcgatggcgcggcagcgtcgacgaggaggcgatggagagcttgttcctgaacagcggcggcggcggcgcggggagctcggacccggcggcgaggagggggggatccgggaagcaggagaggcggttgcttgacccgaagcggctgcagaacgtcgcgatcatgctcaaatcgctcaacgtggccgccgacgaagtgattggtgcactcgtgcgtggtgagattgtgctctcaatttcttacttctcgcatgacgtatgtggtgtttggtcccctactactgtgtcattgtggaatttatcaattactactactgttatgtgctatgctctctgcaattccggtggccacatgtcattgcacagtagtacaatctagtcactgttaaattaagcacacaaacatatagtacctgacaagtgatttggtttgtttttttttttggaagatgagtaagcctgtttggtttctggggcaaaaaaaattctcagaattaccttactgctatcagagaaggaaatgaaagatgagctaaatgggagaaattccagctttttgactgtacttaattttctactagatgctaggttagcataatttatcaattcactctgtgctaccgttgaatttctgactcttctattcatctgaaatcgacaatgaaagtcggggcatctgtatgccacaaatcataaatcacatgtcagtatgccaccaagacctcaatgtccttacaaaatcatatttttagtaatcttgttgactgaacggcagtttttgagatatttaactctgtactcatcactataatcagtaaatatttctagaagtgtcacactgttctacaccaacgcacaaattatacctgaaggttctcgaaatttcaggcataagcaattgtcgtattgctcacctaacaaatatgggagtacatgcctagcataccagggaatctctctccctctccaatcccccaacatgacaccttttcctttaattttgatgtgaactgatagagaaggctcctatacttgtcctgcattttgacctccattgtcacattcaattatatttttggtggggggttactttcataatcaaattttctggatgtaatgcgttccaacaaggataatttgtgcaccataagtccgatgattacatggcaatgctgtgtttgttccaaataagcttctattggttgatgttaagtttctagagctgagatcctgggactgtgggtgcaagtgactggactggagtatcactatgcgatgaaacatggacgttttctttttgttatgtaacttttaatttgttggtacatatacttttgtgaatagccagtgatacagtctgttgccaaaaatatatttttaaagaaacagtgatgtagcatcattggtcatgtcatgttaggccatggtgagatcagtaggcagattgtgacatggatagaataggcgagatgcatctttcacaaagacactagtgctttaccttttcgtgtctgttctgtattgggataatgttatattacatgtctgtattttcaatgtgataatagctgcatttactagtggcatgcacacagatgagctgtcagttgctttagaacttctgcactattagtttgtagaacgtagattatgaggacttccttgccaattttcattatccaaattaaacttacatcttcatttcaaggtttgttttctcattttattcatcacaaaccatcaacttctctcttatattggcctacagacgtgtcactcgtttatcgtttgagctggaaataattggtgatataatttctattattttttattgtgaatatgttaacacaatattcttgagtttatcatgtccaatttgtgaaccaggattctataggttttgtgagttactaatccattcttaaagtaattgaataacaaattaacttggttgatattacatacattgctcattgttaaaaaaggacagttgaaattcttgtacaccgaaacaaatctggttgaattatagaagtggttgtagtaggtctaaacgtctagtttcatcaatgccttactgtcaagggacatcccttaccaaacttaggtgttttattgcctgatcttgaatagtacaatcatctttcaggttgttatttgaccatctatatatgctaagaaatatgttttctttttgtagataaaggcatattgcattccgtactaaaaactacatatgtcatcatgataagcatgtcacattccgtgctataaactccatcatatgtcatgagtgataagttgtcagagatcacgactgtgttgggaggctaactaccagtgaacgctattgattattgttgttggtgtacaaataaaattcagtagaaaccataactgaattgttgcttctttacccatgcacagtgacttatatccccagattttcctattatttctattgttaggcgtctcgcccggcgaaaaaaatttttgcccggcgaaaattgttaggcgtctctgtatgtggttggtatacatcaactagaattatgaatgctgtgaacctttgtgggattatttaatcatcactgttacgtgcatgcacggtttccttagggaattcctattatagaaaaggttaatgctgtgtatgctacagtagtgggcctatgatgcagttgttttcttatgatgtcacatggaaacattcattggctatgttggatacttggatccaacaacttccattccaactggagtatttgtttattgtccagagccaacatatctcatcaatagttcaatacatttggcgtgatatttaaaacatagttgacagtactcagtgaaaactcttgcataactgcattactttttggagtatgaatgatgcaacttttgcctgatttagttataaatgttttaatctgtgttaccaggaaatcctgaagatttaggatctgagttctatgaaacactagctaagatggcaccaacaaaagaagaagaattgaaactaaaaggttatagtggcgatttgtcaaaaattgatccagcagagcgctttctgaaagatgtacttggagttccttttgccttcgagagagtggatgcgatgctgtacagagcaaattttgacaatgaagtgaattatttaaggaaatcttttggaacattggaggtaaaatagctatgatgatcttatcattccatgaagcttacaatacttcctccattttacctaccaattatatcaaattaccaactgtttagatattattctcttctcttaaaaaatgtaaatttaagataggtgttttcatgcttcacaaaagatatgccacacattctaagtttctcacccgtgatctgtccccaaaaaaaaaaaaatcaaatagatcacttatcaaacttctgaattctcaattattttggagtaaaatgtaatattccttcagaaatctttcaggcagcctgtgaagagttaagaagcagcaaactttttttgaagctgctagatgcagttctaaaaaccgggaaccgcatgaatgatggaaccaatcgaggcgaggcgagggctttcaagcttgatactctcctaaagcttgcagacatcaagtcaacagatggtagaacgacattgcttcacttcgtggttaaagagatcatccgatcagaaggcttcgattctgatcagagcgcggttaatcctggcagcggcagcaaggaacagttcaaaagggacggcttgaaattacttgcagggctcagcagtgagctctccaacgtgaagagagcggccacactggagatggacacactgagcggcaacatcctgaggctcgaagccgatctcgagaaggtgaagcttgtcctacagctcaaggagacttgctcagatcaaggcgcgagcgagaacttcttccaggcaatggttgtcttcctcagaagagcagaggcagagatcaagaacatgaaaaccgcagaggagaacgcgttgcgcctcgtgaaggagacgacggagtacttccatggcgacgccaccaaggaggagcctcaccctctgaggatattcgtggtggtggatgaattcctcctgatactggaccgtgtttgcagggacgtcggcaggacgccggagagggtgatgatgggctccggtaagtcgttccgcgtccctgcaggtacctcattgccgcctcatcggaatgagaaccggcgagttcttagctcctccgatgaggacagctcgtcatcttaggagcaaacatttttggtgcataggttagctgataagatttgagagtagtgattcttccggagctgaacattgtggtgtatagactgtaatcaccgtcagaaataagggagtcgtcactgtctgtcactgttaaaagtagatgtttaccaaagctaaagaaaggtagctgtacaaactacaaaggcattcagtattatggtagtatgttcttaccattcagctcaaatagcatctgtttgagaattatcatattaagagaaaatatatttgttggaagtgtaacttcagttttcttttcaatatagtcatgttaccgctgaacaaatctatgcaacctttgaacaagtcatgaacagatttcgtggtcgaaagtgacaattcaattatcagctcggtagcgtcattttagagaaactagctgttgcgcggccactacccaaacaaaatcatatattttttagtatgattttacttaaaatttattaaatagctatctcattgtcttaagactttaaaagaccaaaccttatcatcctcgcgtttctaattatatagtttttaaaagtcacaccatttgctaccccttatgtcatctcattctttatttgcttgctcgatctaccactatttctattcattcttcttggaacctttaaaaattggattttatagtttttagagtttattgtcatgttgggtttcgtttttataatttctatatgtcccatcaaatgttgccattatattcctctacggcccgtccactgtttcttctctttgttgttattgagattttaaaaatcgaacataattatcgtttgggttcatttttactttctagaagtcccgccaaatcatcagcggctttgccattgtactcctctacggcttgcccgctgcctcccctctttattgtcattgagattttaaaattgaacatgattatcattgggtttttttttacttttttggaagttccaaacctttaaaaattggacttgtagttttttttataatttttagaagttccatcaaacgatgccactatgcccctctacagcccgtccatcgcctactctttattgtcattgtgattctaaaaatcaaacataactatcgttggaatttattttttattttctagaagtcccgtcaatcgtcggcggctctacaactatactcttatacaccccgcccgctgcttctcctttttattgtcattgagattttaaaaatcgaatatgattatcaatagggtttattttttttactttctagaagtcccaacaactgctttacttgtttgcttcatggcatgcctggcgcccctccttttaatcgtcattaggattctatttggtgttttattaataatttttatatgtcgtatcaaccgccaccactctactcctttataggtatattacttaatttatctcgtcatgtgttttatatggttttttctttcaatagtctttatttttatcacaaattttagttatttataaattgtattcctaattgaaatcttatttttcttttttctaatttcagaatttattttttaaaaaattagttaataccgtattgtgttcttttaatgtttttattttttattttcaatttcagttgtttcaaaattgtattcctacttgaactctcttttaatttttctaattttggatattattttattttttattcaaaattttaattaatttcatattgggttcttatatggattcttctttcaatattgcttatttttaattccgaatttcagctaattttaaattgtattcctacttaaactcttcttttattttattttgctaattttggatttatttttatttttattctgaattttaattaatcttgtattgggttcttatatgggctcttcttttaatattctttatttttaattccgaatttcagctatttttaaattgtattcctacttggactctcctttccttttctaattttagattttattttatttttatttcaaattttgattaatctcgtattgggttcttatatggaaacttctttcaatattgcttatttttaattccgaatttcagttatttttaggttgtattcctacttggactctccttttcttttctaattttggattttattttatttttatttcgaattttgattaatcctatattgggttattatatagaaacttctttcaatattgcttatttttaattccgaattttagctatttttagattgtattcctacttggactttccttttattttttttctttttctccgattaatgtgggaatttctagcctccatagcgaatgtggtgcctccttttcgagctgtcttaataatataatagattttcagtcagttagtgctatttggagaaattttcagttgaaagaaggattggggtgcgtttggttctttgccaaacctaaccaggtaaccaaaatttaagcattgctatttttttcggtttggttgattttattgagttacatttaccgatcactacaatccaaaagattaaggaattaaatttgaaaatatactattcatttaattttttctcagtaatattcgggatgtaaaattttttagggaaatataccgtcggtctctaaaagatctgcgatttattttttccaaatcttcgcaaaagctttgccactgtgcctccatggaactgcaaacctgcgatagtagtacaacaaatgcataatttatccacttcaagccctgggaaaatcccatattacaaaagggtccctcccttcttttcgatgcccataccggggcttcccctcctcctcaagatcgcctacgcgactgccgccggcgcgttggcgctcattgtcgcggcggggctccggcgggatgacgccgtcgcctccctccggcgggagatacgcgacgccgtcgccgccctcgtggcgagcaacgaggactgcttagtcatggggtaggtccaaggacaagaaacctcctctgacccatcctcttcactacgttagattcagtattgcaacacgaggaagatcgttctagtgattatctacgtaaaatctcttcctactacttttgttaaataacttgtacacaactcagccgcttctaaaagatacttccttctataccactactagtggactcgtggtaatatctttaaaactactactgtactctccaatttctcaattccttgtcttcagccataatactgtattacttctataaacatctttatttccccttcttcaacctcacacaactcact

SEQ ID NO: 65813 - DNA, 61400 bp, Oryza sativa
  unsure (1)..(61400): unsure at all n locations
gccgccgccacgcccttccccttcttgccgcctccgcccgacgacgtcgacgacgactccaccgccgccgccgacgccgacgccgccgcgtcctgctcgaagtagatcttcttgccgaacttgagcccgtggacatcgtcaccaccacctccacctccgccgccgccgccgctgccgccggtcgccattgcggcaggcggtggtcggtcccttcctcctcctgctagctgcctagcctctctctctctctctctctctcttctttttattgccgctccctcactctctctctctctagctagcgagcgtgcgcgtgtgagtgaaaaggaaggcgagctgagctgagctgaggaggcgacaacagtggtggcacacccctcttttaaaaggagtagtaaaataaaagctcagctgctgctgctgctgcttgtgtgtgtgtgtgagtgtgacgcactagtgcactactactactaccgcttcacactcccagatgctactgctagtactactactccgagtagctaccaccttcaaagctcaaagctgcctactagtggtagtaggaggaggaggaggagtagcggtttaactcgtgtgttgcggggtttctgggggtgaaagtgaaacttgggttggcggctccaccccatatataggcgccacaggccggtgtggaacagcggcgcgcgcatgctctcgtggaaattttgtgccgtgtcgggggctcggccgcggcggtgtcgccgatgggggaatctcgcgtatcgactatactcttacttctaagagcaaggacaatagcagtctataagccagctgtaaacatattttaagaagataaatgaagagagagaaaagcagcgggctacagatttctagtcagctataacacagaatttaagacgcagtgtgtatgacagatgagaccaggtattaattttgtagtatgtaactattgtatgaggcttccatccaatggtccaataaaccaaaaaataagccaaattttgaattttcaaacttaattttgaaatattttcaacgtaattttttttcaacattggcttttaagttacaaagaacacatatataaaagttttacctacaaatttatttttattccctaataagccgttttggcttattagaaaaaaaaagtcaaccgatggaggcatgaatgagctattagattgactatagataaattggagctagtagttggctatactattaaacttgctctaattagtactccctccgtcccgtaatataagagattttaatattttatttacactgtttgatcactcgtcttattaaaaaatttatgcagatataaaaaaagttatacataaaatactttagataataaagtaaattataaaaaataaataataattttaaaatttttaaataaaatagatggttaaaaatattaaaatctgggagggagtactgcggtagaggagacggcagagaacaggagcacggccacggccacggccacgggcgagagcgagtgacaagagcagcagcaagcacagaggccagcagtacgctgtgcatcccgctgccgcgctggacggacgctgggccacagtagctgacgactcacatcgatgtgacgatggagccaacccgctcctgcctccgctcccgctacgtccacaccagcagctgcagctgcagctacattgggcgcgggacgacgaaggtgggggcgcgcgtcgatggcgattggtggtggaacgggcggttccgggctattggggagacgtgcttcatcacaggttggaaggggggaagaaccgaacaagggttgggcgtgtaaaaaaggtggctcttttccggaggtttccactcaggttggttttgattcagtggctgctttttagcgtcctttctttctttttagcacaggtacgaaccataggttattcgaggaagatatgagttgttctatgtactactacatatcagagaaagatctaaacggtatcataattaggtggatttatatcgtttgttgtatatgtttgtcgctattaacgtccggagaaaaatcataattttatatcaactttcaaaaataattattcttagaaaattatcaagaaagtatagaattatgtcaccataaaacaacgtgataatccaaacaatgctagcatataacccattaatcgagagtacttgataaatgtagtgctaggtatacgtggtttgcttcaaagcactagagatgtgttagtggatttgtagaagcatgtttttcctagtgcctacaattacgcacatgtaagtataatttttatggatttacttctgagtcattagcctgtattaagagtgcacacccatgtgtttgtgagtgtggtgtgcatatgtagtgatgtcgctacaccaagatataggtacataaatactttgatctgttggaataagtagcttttagtggcaaactatctgttgggaaagataaagtggcatagtataatttttttctaccgacagacaattgtcttctttttagtgttgtagtgtagtgtgtgtgcgcgcgcataaaacatacacatatagttctagctcatgcatatgtatcttttgtttgatgcatatgttgggttcaattccattatctaagtaaaaaggcttgtatattttgagaaattatttgtaattttaagttgtatgtttgactaaatttcgcataagtgcatatgatatgatcaaattataacaaaattacgcatctaatattgtgggtatatatatttgaggtgatgtggtttacgagagatgaaaaacaacttggatcacagattaattatcaaatgtaaaaaaaagaaattgaggtgacgtggttctataaaataagagagaaaataatttagacaacagattaatcaatagtaaaaataattgagattgtatgaattaacaagcgtgaaataaggtaacagtatttcgtatattggtatctgccatattcttttctttccatatccaaggtactccctccgtctcataatataagggattttgagtttttacttatactgtttgaccactcgtcttattaaaaaaatttaaaattattatttattttttgacttactttattattcaaagtactttaagcataattttttgttttttatatttgcacaattttttttaaataaaatgagtggttaaacaatgcaaataaaaactcaaaatccgggacagagagagtagtactacacagattaaaaaaatggtgttatacaatgtgttactagcaagcatgcatgccttatatatatttttatactagtgtactgtacttaccagtacaaggataagagctgacattttaggatttttgattccttaatcactttaattagcctcagtggtctactggtactaggagtgcctcccttccctcaagctaaaatcatgtggacaaataggggctgcagtgttgttgggagaaatggttgaaattaacgaagcgtagggtttcatgcgtggaggcatggagcatgcacgtgcttgcctgcttaattggtctctagccttccacttttgagttggacaagacggctattgggttttcttttaaccgttggtcctttgcctggggccgagttacgcctttggcgtgttaccattgctgaagaatctttcgtcttgagcccgagtttccactggtggtgaagttttggaattgcctcggaattcattagggatgttaattttcacacatgatactcacgcacacgctctcatctgtcgtctctataaatttagaccgtgttttgtcttggtgggactaaaacttttaagtcactatcacatcagatgtttggaaattaattataaatattaaacatacactaattacaaaacccatttcataatattggactaattcgcgagacgaatctattgagcctaattaatccatgattagcctatgtgatactacagtaaacattctctaattatggattaattaggcttaaaaaatttgtctcgtaaattagttttcatttatataattagttttgtaagtagtatatatttaatactctaaattagtgtctaaataaagagactaaagttaagtccctggatccaaacaccaccacagtcgtacgctccgaaggcaaggggacgtataaacaacaaagacatgtgtaaaatgctctaaaacacaatgcaaggacaccactaataacaaaagttggcagttttaatttagttttgtgatgatgtgtatattattaaagttccgatgcaaaccctcttgtcgctacccagatgttccgtttcaggacaacacattctagtaagggtcaaaggttgtacgcattttgatgatggctagttgctttagggctcgttattttaatgtaaaataaatcttaccaacttttatcaacaccaaaatttagttaatttgctacttttgtcaaatattattgtattatgtgaagaagtttctagtaatcactaaatatttgtacagtaggtatggtacagtatttggaatttagttggattgctgccttattaaaatttacaaatgctaaaatttgacatagttgaaaatggtagcaaacggataaacgcccttacctcccacttgattgaaaatggtcgatcccgtcgaccgccagcacagacgacatcacccataaacccacttgactgtgtgttcggcgaccccattcttgttccactggggaatggatttgtgtcgggtcggtttggaagttggaaaacagatgaaaaattgtgtgtggtaaactccgggtacatggacgaagggacgatgatgacagaaaccgaaaagcttttgcatccccacggccgccgcaaggtcgttggctgggccggcaggagcagatcggttagttgacgagggagagcggtagcgaatgcagccgctgcacaggtccgcccgcaattggcctcgcgatggcgcatagctgattgcgcaagatctccccactgcgaacaatctgaaaacgaaacagattctagtgcacaaattatttggcccgaacgacagacagaacgacgcgcgtgcttcggactcgtagggggtgtttagatcaggtgtaaagttttgacgtgttacattgagtattatataaggtgtcgtctgaggtgttcgacactaataaaaaaaattaattacagaatccatcagtaaaccgcgagacgaatttattaagcttaattaatccgttattactaaatgtttactatggcaccacattatcaaatcatgaagcaattaagccgaaaagtttcatctcgcaaattagtcgcaatctatgcgattagttattttttagcctaaatttaatagttcatgtatgtgttcaaacgtttgatgtgacatggtaaacaaggccgaagatgacggacgagggtgagtacgtatacgacagaccaaatatttttggatgacgaaagtaagagtatcaatgtttcaattaggtagagatagaagagttgcggcaggtgggaaaataaggttgagtccatgatataggccattcacttgtgagaatactgtattagtcatagtctgtagtacatattaatggaaacatcatatccagtttcctcacaacaaatatagtgtttgggtttacgtgtgtgtgagtgagacatcctggtggtgggcaaaattaaaatcaatgtaaaaattatctactctctctaaaaaaaactcaaatctctaggatttatttatttttttgatacagaaagattgtggccgtgttaagattcaaaattttttcttcaaacttttaattttttcgtcacatcaaatatttggacacatgcatggaacattaaatgtggacgaaaaaaaaatcaattacatagtttgcatgtaaatcacgagacaaatctttttgagcctaattaattagacttaataaattcatctcgcagtttacaagcggaatctgtaatttgttttattattaatctacgtttaatactttgaatgtgtgttcatataattaaaaaaattgacatacgaaataaacacaacctgtgagagtgagtaaagagcagccaaaagaggaagtatgtgcgagtgagtaaggagcagccagcagtaagctactgaccaaggtttgaagccaggtgctcaccgtctcaaaaataagctcttcctcggaattcttatacatattttaagtttacttgctgctcgtatatagtgtcggggtgtgcattttaatctagtgctcgattttttacacactcattttttttagttattcaatattccgtactaagtttttccgttggtcgttagagttctttctagaacggtgcatagcttagccgatagagagctactagcgtagtcacttacatgggttagaattcatatgagctcaccacctactaaaattaaattctagacaggattagtgttgcttattttttgataaaacaatgcttagggtctgtttgaagtagtttctagttgatacaactcctccaaacaatccctccaaacaatcctttttttttacagattctgagaaactatagttgtagaatccagacaataaactactccctccatccaaaagaaacttaatctagaaagggatgtgacccctcctaagattatgaatctggactaccctttgtccagattcgttgttctaggaggggtcacgtcccctcttagattgaggttttttgtagaaggagggagtagaagtcagaagcaggaaaacttaattttttttccagattctcagaagttgttaccaaccagctgtttctcagaaatttaaactcccctaaataagccctaagcttcttagctggtagggagccgctgggaggaaggcaccgatctcggttcaaacctagccaataactttttttttacttagttctggatgtaacacaacaacattttaggacagatgtgtgcacagtacgcccttccgagaacatcacccacgcccttctaaaaaacgcatatgctcctgttacaacagaaaactagcagaactatcgccccgacgtactacacagctacccgactcacgacgactcccaaacagaagccccccactgatcgacttgacggactgactgagggtctgtttagttactaaaaagtttttcctaaaaatatcacattaaatctttgaagatatgtatgaagcattaaatgtagataaaaaaactaattgcataattatgatggaaatcgcgagacgaatcttttgagtctaattagtctataattagccacaagtgctacagtaacttatatatgctaatggcggattaattaggctcaaaagtttcgtctcgcggttttcaggcaagttatgaaattaattttttgattcgtgtccgaaaaacctttccgacatccgatcaaacgtctgatatgacaactaaaaatttttatttcaccaaactaaactggcccagactaatcctatttgcagggacgatcgacatgtcgtgaactcgtgatcctccggtttcccggccgtatacatgctaccgctagcaagcatcaaaactttctctccacagtggtgccatggcaggtgtacgtgcgatccctactttgattggctactcaccgtgacgtcgtctacaccgacgtaatacggcgcgggggagtgcagtgccggggacagcaccatgcacacgaatcttggccgggtcgccggccgtcggcatcggccggatcgcgaagtcgcggctacaggagaacgtgacggatcgccgagagagcgagagcgagtactccactactactcgagacaggccgacgagacgagaggaggaggccgtgggctctcgttggacgctggtgctcccccgaactgttgctgatgctaccggtgacacgtactgtgtgtgagcagctgctgctgctgctgcgtgtgtagctgtgtatgctggcgacggacggggtgagtggctgtgagactggagtatgcctgtgagcagtgtctcccactgtgtgcctgtgactgtgcttgctttgcttcttgcttgttgggccgagaagctgtgacatggctcctgcagtgactgtatccctcacgagtactgtagctctgtgacttcgggttggtttggattttgataggccgagagttttccactgataaatgcaagagttttttttttgtttgatcaggataatcttgtgtaacgtttcacaggctgagaattcagcgtacaacagtagttgccgcgaccacgaacatttaaggacagaccatgtgtgtgagaggtacttttgggatttccatcgtccttcacgttagcctcggcgctcgctttctccaactcacgaacgatgtttacgtgccagatagagataggtctaacacaagtagcactctcttaacccctgttcgtgatgcgtacatccacatgtgtagccagatgatcccactcctcccaatctcaatcgtcgtgctgagcccggcggcgcccacgacgcggacacgtacgccacccacccaccccccatcatcgcccgcacgcccggctcgcgtcgtatccgtagcccgtgttgcgcgatggcgcacacgccggtgtccccgcgcgaccacgcgcacgcgtggaaaagcagcttccnnanncccccccccccccccccccccgcgctagctgtcccggctggctggctggttggttgggcttcccatttgcagtgatgctactgcgtgcgtgcgtgcgtgcggccggcccagcggagggcggctggccggggtccccatccactactgcggagtactacggggattggatggcacacggaagtgaaggggttaccggttcggtcgcatttacagttgggctagggggtacgtgcacgtactacgtgtgttgttgtttgtgtacgttttctgggctgcgtgttttcttttcggtctgttactcctgttgggcctgtaccttgtgggaggacggggaacagtaatagtagcagtgacgggagcgagaaggactccgtcgtccatccatcatcatgctcggcctctcctgaacttatgagtttcactgttttttttaatggaaaatcgtttaaagttggttttgtgatgttgagtttggtgccaaaattttgtcaacagggagagaatgtataaggcgataccattattccgatagggcgccatgttttcaaaggacggataccgaacctttgctggatcaccgttggatcacagattaccatggatgagtcgaagcaatcattgaataactgaatctctgggcaaggcggaacggcacaagactagttctcacaatcaacgagatgctttgctatggagatcgatgcctgttgcgtcagggtcggcatacatacaaattaagcactgttcataggatcaaagactttccggctatgccaatctgagagaaagcctacttgactagcgcctcacgctgcaggttcacttgggctagttgcacgccgatgatctgtgacaaacgataggatgagaaggagaggattacctaatctcagtaattgcatactctatgatcaacaaaagaaaaccatccgccacattcttatagcatgctcgaaatccctctaactttggtggatcatactaggatctatttggggagtgtttaggaactacaacaacttctaccagaatctccacgtacttcaaacagttcatattctcgcccatattatgagaatatatagttataaaattttaatctaaaaaatctaacttatttagattttcaccaataagctagcttcctttggtgcgacaaaatgaaaagaaaatattgccaaacatatatggcatcggctcccgacatagtggccatcctcgcaacttggtcgatttctctctgtgtttttttagcgtgaatatggtgctctttactggtagtagaaagtaatctgaaccgttgatcttatttaatcaaagatttggatctacttttactaccaccccagttagcggtagtagaaatatgaaggggcattattgttttaaaaaatatgtgtgaaaagggtataatcgttattttgcattgactaaaccttattcttcttatttttagctttttcgatggtaaattagcgatgccagcggaatggatgaccacgatagacagaagaaaaacgtaaatgacaaagctactccaaatcactgttaaaagttattttaataatgaaccggttcggatcattaacagagagcactacagcaccggagcatatcgatctcaaaggaaaaagggacaacagattgttcaatcggcaacaacgatcctggcgcgaagaagcgagcacggctgctgaagcgcgtggaggccaccatcacggtgctatagtacattgttggtttgctgccctaatgtatgtagtagcttggtcgtgcggtaattagccatatgttgtaatctttgtgtgtcctttttttctttctttgatctgtcgttcctgtacaaaactccatgtccatcgaatgaagtagcccatgtctggacaagcccaatagcctcattgtttgttaatgtctttttgaaagaaaaagcttattgggtctctgaactgttgatctcaggctttttaagctcgcaccagcatgaagcggcttggtgcattggcccaattggtaaaggccactagatcagattgcccaaatgtaacgtttttccatttgctcctcttttttttttctctgaacttactgccgtgtaaatgcctactctatgatctctatcacttatatacctacatgaatgtgaatggtagtatcaagttgtatgcaccgaccagttcaatccaaaagcttaagatgatgaagaaatccgggcaattcactttatattccagcacttctcatgcgaggccgtctcaagcctctagcgtggaatagaagtgggttgcaacttttatttaattatgcattagccatgattctaacttgagtcctttggctctgataccatattgagttgtatgcaccgatcagtttcaacacaaaagcttaaactgataagaaaatgtgggcaattcattttgtattgcaatagatagaaaacaaagtaaacaaacggagaaaggcagtttaagaagtgagatgtggtggtttttcttaagagactaacagaaaatttcggtcaactctcctaattatcaacatatttcttctctctttttgcatggtttccaatactttgattattaatttcttttataatatattatcaacaattacaaaattactagatatgaaaatattttcaaatacgagcataatgatactacattttataatatgtttttagtttaattattagtcaaaatgttcaaatattgactttgtggaaaaccaggatgtttttttagattatattttataatagagagagtactatgcatagacctatggatttacgaaacatcagccctagctgaactttacgatttgtgaactattaatatttgatcaatttaggatgttttggaagtcgtatgaaccgacatttaaaagaaaaccgctagcgaaagctaacttgtaatgtagtcatcgataaaagctcttatgtccatggtacgcacaatttacctattttcactagatctgattaaaacattctctccacaaacaacatcaagaatgatatatctggtagggacttttctcctgtgttagacgacgcaacatgcaacctggagtgaggcgatgcaacatcctgtgaccatggagaaagggatgttacgccctttctcgacctcaacgacggtggtgatgatgggtggttagatttggatttggcacctatatctacagaacgcacgacagggcatagacctcgacgatagtggtgatgatgggtggatggatttggatttagcgtccaaccctccacagcacgcgaaggaggagagaggtgggccatcgaaggcggtgtgagccaaatccttgctaggcaaggacgggtgtgcctggcccctaagatgatatggttgatggcggtttaggtggcggcggtctacaatgtcaaaggtgatggaccaaatgcacgcgtgaggagagcgatgtgctcggctctaccacgatttggcccgccatagagcgatatgatggttcctgttggcaatgttgatgttggcatgacacaccaacactggggaagggtgcttgtggtcgaccctcgtgacggttcaagctgcgatatgacggtggtggcatgtagggggtgcttggcatgcaaagataggcgaaggctagctagcggatgagtgttggtgtatcggtgtcttcacgccaacagtagtggatgctagtggagcaatgtggcagtgtctatagagggtggctaggcgacagctgacaaacaaaagcctagctcaaaggacttcttggctagcaatggcaacgagtgccatgatcactctttagagcgttgttgacggacctcactatcttcttagcaggacattcacagtgaaaaaccttgttaaattttcaagtcggacgacatcgtatcctttcgggaggcgttgcataggaagtctcatatctacctcttctgtcaattgagccagcactttttcacagcggtgggttatacaaagaataagtggatcttttttccaatggcgctctctctcgcacctcttcttgcaagtggtgtttggaaggctagtttttcagctttttggaggtttattttttaaaaaactgaagtccggtggaaaaccatctttgactaactgcagttgtggttttcttttgaattaaaaaacacagtcacacagatgccgtgcataacaacgaacatggaagcaaccaatctctcaaggtgaagtcccttcacaaaattaatgggggatgctatataccggaatcccgttcaaaaacgggacgattctaataccgatatgacatcgctctgagcaactgtcatccgccacctgcgtgcattgcagcaaaatgagaatgacgaccagcgcttgccaaacgccggcttccctgcatcttggagaaacctcctcggaagcgctcgcctccgcgcgcgattactcgcttcctcccgccagcgcgcgcgccatccaccggcttctccccatcatggcgaatcctcctagaaagcgcgcgattcctcgcttccttccaccgccgcgagcatcgtccatcagctcctctgcatcccggtgaaacctcatcggaatcgcgcgccattccttgcttctttccagcggcaccctcgccgtccgtcggctcttctgcttcctggtgaaacatcctcagaatcgtgttttgcaaggatatgatcttacaatcaaaatagtacaaggtttgacagagaaagcttgcatcaatgaacttgacaccagtgggaggacaacatgctgagaaggcccggtttaagaatcgaggtgataggcagtaaaaatctgtgaatgagagtaacaccatcaagacagtgagtatcttgactgctatcatggtgcctgcgggtttcattgatgatacattagtagaatcatgtgatacttgggaggtttcacgatccttctcggtatcatgaaacctgaaggtttcacgcatgatccctcgctaggtatatatcatcttgtgtgatacctgaaggtttcatacatgatacatcaaaagtatcattatgtgtgatacttatgatgtatcacatgatcctacttagatatcatgcatggtatcatggttcctacgggtttcacgtatgatacttgaggatgatcatgtgatacctaggaggtatcacatgatcatgtatcatgtatggtatcatgtatcatgatcctcctcagtatcatgtatggtattatcaggtttcactgatgataccttaggaggatcatatgatacgtgggaggtatcatgattctgctcagatatcatgtctggtatcatcaggtttcatagatgataccttagaaggatcatgtgatacgtgggaggtatcatgattcttctcagatatcatgtctggtatcatcaagtttcatagatgataccttagaaggatcatgtgatacatgagatgtatcatgattctgctcaatatcatgactggtatcatggctcctgtgggtttcacagattataactaagtacgatcatgtgatacttgggaagtgccatgatcctcctcggtatcatggctggtatttactccacaaaaagtctacacccatgtaatacacttcatttgttcatatatggggaaatgatatttgcttccgtcaacttccagatcaaatatatgtacatggagtggacatggataagttcatatcatttgattcgatcgatgtatcgtctgacactgcttagagcaagaaaatgaagaacctcctgttgatggagactgtcaaccaaagaaaacgcggtgggtgtcagcgtcggcgccaccaccacgctcacaccgctctcccgcactgacctcgtgtgcatcggcggtgacactgaagaggtggagctgccaccaccacgctcacgccgctctcccgcactgacctcgtgtgcatcggcggcgacactgaagaggtggagctgccgtcgtcggcggacgcgatgtcacaccccaatctgataccgccgtacaacggcacctgacaggagcgtgtcgtagggaaaacggcgtgaaccgcttcctacgaaaccgcgatctcggtaccagtcccaggacatagtgttggtacccacggtgacaaatatgaatcataggaatccttaaaatagatagaggatttatttaccttaacttaggttgcagctcagacagcccgagaatacaaccgacgacacggacgaggcgaacaccaacaacaacagcagcagcggaaccaacggtctaacacccaacaccacaggcgacggctgggaaccaggacgaaaccctaatcttcactttatcttctcttcagggcggaggaactatatatatatatttatatagagcaagggtgagtactttcgtactcagcaagtcacggaaacttaggtgtttaatgcaagcttggaagagaggcaaggttgtttagcaaatcttttatttgaagacattttgaaatcactaagtgatttatttcttcctaagtttgggctgaaaagagacttacgtctcgattcgactttaagggatgtttttcaacagctcatttagtaatgtaccgacctcccgagtcagatcattacttctcggctcccagagccattccacttgattaatcggctcccagagcctttttcattttctcggacttccagagtccagctgcccagcagcacaacaatccgcttccactcgggaagcctagtctatgatgcccgcagacatcccgaatcacacagattcgtttctgactactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccaacccagggttacctcatgccatatagaaggatcaaatcctcacgtaagcataggccattttaggcattcacaaatcaactccaaccaccttgatcggtaagtgagcaagcttctcgtccttgccttaccaggaacccggtttgtccgacctcgccccggcgttcccaactattggcatgcgaggtttccctgaaccgactagttacctagccagggtgtcccattccaccttgtggttgcactttgattatgtttgatgagtttcccacaggaatcggtccttatatgcgaatacgggacagtgccacataggcacaacccccgcatcgtgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtggtacaacctacaggaattagtgcgactactgggtaggtccgtcggtttggcatgcaaaccgaggccaagcaagttaaacgtgagtgattctaatgatgcaagttgcaaacaaaataataatgactttccaattataggagcaattgatcaaagggtgacttgccttgctcaaggtcttcacgaagcttcacgaatcttcgagaaaacccgcgatcgacgaaaatccgataaccgccactatacgcaaacaatcgaaaacctaaacaaaggaccaaaagaaagatcctatttagactaattagtagtgccattaaatagatctcaatttcacggaattactggaagtgaaacggagtcaatcggacgagcggttggggagatatgaattttggaagtttaattggagtttctggaataggagaaatggtttatggaatttatagaaataatattctcaagaatattattgacagtcactgtcatgcgggaccaaaggaaatgttttatggaattttggaatagggaattgatttatgggacaaaggaaaaaggatttatcaaatccctggaaaaagaaaaggatggagggatgttaattggacttgggccgagcgaaggggcgcggcccgaagagatgcgcgggcgcggccgaggcgagcgggccggcgcgtgggagggaggcggcccaaggccgaacgaggcgcggcccacgcgacgcaagccgatggacgcggtccaccgagtcgggcgcaaggcgggacccacaaggcgatgacacggctcacgcgagcggggtgcacgcaaggcggcgcgttggatcggtggaccgggagacctttgaccggtctccgcggggccgggcaggtagatgtggcgtcctcgtggacagccacgttggcacggcgagagaggaggccgggcggccaatccgacggctcacggcgtgtggcgagttccggcgagcggcggcgaaccggagtgggcggcgggcaccggaagtgagagggggtcaaggtgggatgattcaacggtgcggatgagggagaggcggcgacacggcggctgacgacggcggccgtgcggcggcgggatgggtggcacggcgcggccgcagtcagcgaggcgggcggccgcggtggcgcgccggggaggttcaagaggacacggggtgggtcacggcgcaaggaatcggcgagagaagggccgacggcggcagattgcggcggcggccttcgccggcggagagaaggggaaaatctcgccggggcaacgggagtccaattcaccggggaaggagcttctacacggctccgggaactcgtttcaagccacgggcggcgacgagctagcctagggagtcatggcgacagcgagcgacctccggggcagagcaagagcgcgtggcgagctatggcgagcggcggcgggcgcggcgcatcgcgcggcaggaggagtattatggtggggatctcaccaacgaagaggaagcagcgttggcgtcgcggtcggtgtcgcggcgaggtggtcgcgacgccgagacggcacggcaccgagagggcgcggccggggaagaagggagggagaggtggtgcccggagctcctcgtcacgcgtccacgcacgcaccggctcctccggtgctcggcaacggacggcaacggcgagagcgggacgagcagcaacaaggcggcgacggtggttcggcggcaatggcgcggtgggtgtgaggactgaggcgagtgaaaacgagagaggaaggggataggggtggcttggttttatagcggaggcgaggtcggtttggggaggggagaactgaccttggcggtcaagtgctcggctggcggtagcggcggtttcgtgggcggtgcgaaagcggcgacggtgtggatgtgttgagcggcgaaggcggtggatcgagcagcggaaatcgaaccgctggagcgcgggctggcgcggtcaaggagatgaggcgggtggcgcgagcggtcaagcggcgcagaggtggtgacgccggcagtggtcgggaaagggaaaaagaaagggaaaagggggcttggtcccttgccataatgaggagagggagagtgaggaggaggaggagagggagagcagctgcttctcccactcttggacgggtgcggcgtggagtggcgggggccaaggatgacgtcgacgatgacggcggcggtcggtttggcatggagcgggggcaaggcggcagcgcatggcgtcggcggcgaccggccggtcggccacctcgcgaggcgcgcgcgggaatgggcgaaggcggtggaggttttgggcggcgacggcgggaaatcggctaagcagcggtgcatagcgcggcgagaggggagagagaaaggaagcagagagagagcgaggaaagatagaggtagaagagaggcgatgcctctctctctcggcgcgtgcagcgcacgtgcggggggggggaggagatgatgggctgggaggggaaatgggccgggggaggaaaatcggtccatccaaaaatacagggaggtaaagtagacttttacagagaaaactgatttggatagaattggagagatttagggtttggattcgaattctattttgatattcgaactcgagggtttagggatgtatcaagggaaactcaaggagaagtcatggaaaggattcaaaaggaatacttgggtatttgttctcgggaacatagggtggagtcaaagaaaggattcgaggcgggatttgaataattctggattcgtagaagttggcgaggatttcaaaggaaggatttgaatttcagaatttgatttcagagactcgaatcggaaaaggaattttcgaggtggaggattttgattccgatgagagggaacaacgggattaaattgagatccctggcacaatttagactctcacacaaagaacggaaattttcgcaattaggattttgccgagttagtttttaatgactcacgaaaagcggagcgttacacgcgagcaggtgccgccgccggctccaccgccgcaaccgccgccgtcggcgccagcgagatctcacgcgccatgcccacggtgagagaactgtgagtgggggactcggataagcacaagaaacgttgtgtctctgttgagagcgggactcggataagctcgtgatgatttctggtgattcctagaaaatctgtcccgtcccgaccgtgcccaaacgggataccggtgtttagcatttccgaaattaattgatacttcctccgtcctataatatagtaacgattttgctatatatttgtcgacaaatttttccccaaaaatttgacagatgtaattataggacaatcgtaatgtaattacactgtaacttacatgtaattacactgtaactatagtgtaacttgtatttaactttcaaaaatctctccgtaacatgttatttcggtaaaatggagatcgtgggaacaaattctttcacacatgtgtgtgctatgatttgttttcttcctcaccaaaataaatcttgtaatagatctaacgattcaaaattatgtgaaacttacatatatgttacactgtagttacgtgtaagttacagtgtaattacatataagttacagtgtaattacactacgattgtactataattacatctgtcaaatttttggggaaaaatttgtcgacaaatatataggtagtccctatagtaatctaataccggataagacactttatagtacaatgaatttgaacatgcttcttgtctagattcgttgtattataaaatgtcacatccggtaataggttgctatattatactaggacggagggagtacactagtacttaccatttaatatagtattgtctgacatcaaagtctctttaattcatactgtcaaaaaatcttaaacactaggactaagctactgaattttaggctaaaccgctagtaaacaaactaggtgctataatatatataactacctactgccattaggcagcttatcattcgcacacattctcacaagccatacatacatagtactagcatgttggtgtgcgctaatgcagagatgtcaccatggacaacttcatctacatgtaacaaatggtgatcaccgatcaaagatttcagaaacttccatcacttgcaccccactccggcctcggcggctctccgcggcgtggagttcttccgccggctcccgtgttgccggaacccgttctgctgccgcgacgacgacggctcgccgccgtccttcctccggcgccgctcaatggcggaggcgctgttgctgttgctgttgtcggagccgcgcttcagctgccgccgcctcttcctccccgggttctgagctgcggccttggacgaccccgccttgctggcttgtggcgccgccgccgccgccgccgtcgtcttcgcggcgtcgtcgtcgatcttggcgatgtcgtcgtgttcttcctcctcctcctcctcctcggtcttggcgacgctgtcgtcgtcttcgtcctcgtcgtcgccggcggcgtggtcgtccttgaggtggtgatgcttctgttgttgtggccttcccctcctcttgtacgccgggatcacctcctcgccgccgccgccgctgctgctgccatcgtcggctttcgcagcttcggtggatttcctgcctttcccacccctcggccttcccatccaggcgaaccaaacaaacaggggatgaggtggtggtgatgtttaagttggtaactgcaaaataatatgataaacaaatcgaagttaggatatattttttctctctctacttatctgtaatatgtgtgctgctagtttcaactagtcacaactcacaaactcaaatagctgactagatttgcatctatgctcgtgtgaaagaatacgaagaactgattcttacagctaaaagctgcaagcctataagcatcacatgtttgaggcttgtggggtgaaagatttgagccagttattattacagtgggaaaagaagtttgtttgatggatacaaaaggagaaccaaccacagaaatactattggaagtttggaacaacctaacacaaaggcaagaaccatgtgaacagactcattcatgtcctgtaatcttctatccactgtctagaacttcaatccaaagtcataactacctcaagagcatgagcatcccgagtactaactaggtaagtagagattggaaatcagaagaacgatcaagaacaagaacaaaaatatgtactgacctgttatgatgtctggcaatccgaaaacttccctcgacaagccttttcctccgggattaataagagggtttcagtttgcagcaaagagatcttcagagactagctagctgagctattctacgattgctatcaggcaagaaccaccaaccaggacatgaacaagagagagagaaagaacagaggggattcagatatcaagaagaaggcggcgagatcgagtcgagagcttgagatcgtgcacaagactacacgagtttgtgcacacagaaaagagaggaaccaagagacagcaggaagaagaactggctacaccatttctgcagatagagagagagagagagagagactgtaaagagataggagaagtagaaaagatggagatgggagtttgcttgcttgcttggtttggctgccggtggtaacaacgtgcagcaggaatgtacggccctcaggtacagcaatagcacagtgaaagcatttctgatgctcgcttactttctttctttcttttttttttgggagtggaatctctgtttcaggttttttcctgttacaaccaggatgaaattcgtagagctccagtgtctggccctattaaactattgatgatttactgcgagatgtaataagagtacaagtgtgtgtacaatggcgagttctaacttatacagacacagaaattatgaaatgcaccccctggctcagtacatatgtacactgctgatacacctgctggtttcttgtttggtgaaagggcgagatcgatgaaacggtgaagaaacagtagctaaccctggcatcttaatttggtggtactagggatgaaaacggtcagaaacgatcggaaaacagcctcaaccatttccgtaaccatattttttctcggaaacgaaatcggaaacggtaaagtcagaaacgaaaacgatatcggaaatatcggaaaaccggaaacggaacaatacggacggaaacatgtcggtacagatcggaaaccggtaacaaatacggaaacattaaactataaaaacatatatttaactttacataagtatgttatatatatacataaattcaagcttatactatataaattataaattaacttcattttagccatgtacaaaagttagagattttattgaagagtcattcaatctataagctatgggtcaagtatagacatgtcctataatatcgacatatttagaatacggtaattaccatattataagaaacgataatttccgcgagaatacggtaaatacggaaacgatcggtataacagcaaaaccattttcattttcatttccatattttttaccattttcatttttgtttcggtcgattaccatttctatatagctcggccggtagaaagtcgaaaaccaacgtcggtcggccggtaattaccgttaccgttttcacccctaggtggtacacacccaccaaatgcatgtgccgtaagaagccagttaccatctctgcccgatggacgaatcgaatcggtgatggtttcgagcaatacctggtgctgctacaaaaccgggtttattgcatgtatcacagacctgtgggccaccttgtgcagccacacagaaacaccagtgtactgtgtaataatgcactggtgcaggtacactggctgtttgcaaattgcatgtagtggaacttatgctaattatgggccacttttttggctatttcttggtgattttctctgtgaatgatgtacagatgtgcagtgcagtgatacggtgtggttagttgatggtcctgcctgtcacggaagatgaaaatatcaacggaacgaaccacttctctccaacacccgaccaaacgcgattccctctcgcatgcgagtcaaagaaaaaaaaaaacgttctcttttggagagaaaaagggaagcggccggcaggcagcagcagcagcgaaggcgcgcaccgcaccaacgacgcatcatgcgatgctgctgctggtgctggtggtggtgcgacggtcgcgtccggcgcacggaaagacgccgccggtgggcggtggcttcctcctcactcactcgctgcgctgccgagcccatgccgcggcagcagcagatgcactcattcatttacgccgctgcctgcctgcctgccatcgtgacatgccaattgaaacatgctgcagcgagaggtacaggggcagcagcagcagcttcagcttcagctcgtgtgggtgtgggtgtgggcggcgctggctgctgtgacgtgctttccctttctcgcctccgttaggaacgatcggcagataaacgatgaataacaacagattaatcacataagatacgagatttaacatgaaaaaccattctaagataggaaagagagagccatggataccagccagcaaatcttcactatatcagatgagattacaacgttgaacggcgacttacaatatatatatatatatataaaggtaaaacctctaaaagtatgacgatacatactgccgtgtgaaaatgaatttggatcctgactcaacagcctcgcagaagatatcgagaacgtacgtacgagtctacgtaggtacagcgaccgagcgagcgcgagtggcgagcaaagcaggcaagcggcagcgttggtggtgttggtggtggtggtgtgtctgcctgcctgccgcgtctgctggcgccgggccggccgacagcctcgtgccaacgcctgcagacgcgctcgtcgcgcgatcgccgattcgctttcccggtttcaaaccaaccatcatacgcgcgcgcgcgcgtacgtacgcgtacgtgaagtggtgtgggtttgctgctgctgctgctgcggcagcgcgtggccgcgcgcgcccgtgttcgaacagtggaggaggaggggagggctccaatgatctgtcagtttggtcggcacgacgacagtggggagaggaggggaaatcacggaggagctagctaatctctcgtctcgtttcttttgcagtcgtcgtcgtcacggtcacatgcggatgcaggggggggggggggggggtgaagtgaaaggaaggacaggatcacaggaatttactgggggatgattcatgaagcccatgaggagggtccgacaaagctgaaagggcattgggcttccggcctacaatgtccccatgggcctacatgtaggggaaccacgttccttttcatttttatggtatactcctatcttttaaacacagttttttttggcaaaattttataaactatcacaattatcactctagtttgaattttttttctttgaagcagatctcttgtgtttaggcgatccatgaagagtagccagagaaatacttcaagttttgcagtacatttactctttcagatgtgtgtcattggtatttctggctgtagatgagcgaagaggagggaacggaccttctttgatatttttttcgtattgctccaattgtatacccattgatcgtgattgctggttagagaggtgttcggtatgatgcaatgtaactcagaccactaatgtgcagcatgagttgagagagggaggtgaaagagctcagatatgtcgtgtgagttaaagagtgcagacatgtcgtcttcttttgcaaaatagaataagatttgaaattgatcttgtggaatatgtccatgccatttgtttttccaaagtgtatcttttacaagcaagaggctaaaacctataattatgtgataagggagatactcaatctatagtttcgtgagataagtttgttttgtgatagatttgtgcaaaatacatgtaattttatgaaatttattctttttatgattacatttgaaagtttcttttaaaagaatttatggtagctttataagatagtcgcatagtttttgagagagaccaaaagggagatatttaactatttatcactcctacaagtggcaattaataatttgtcactggattcacatgttataggcatataggaacccacatttcataaactatgaatggcaaattcttaattgccagtttgccacatcttaaaagtggtaaaaagttaaatgccccaccgaaagagcctccgcgttggggtgagtctactatgtaagtattcgcggacgacgaacggtttcaacagccacgtttgggctttcctatcctaattgatcattccaaaaagggacatttaacttcttgccgcttttaagatgtagcaattaattatttgtcactcactgtctatgatatgtgagccctcatgtgtctatgacatgtggatccagtggtaaataatttagcaccaagtggcaaatagttaattattcttccaaaagcacagaaacaaaagcagtcgacaagttcagatataacaacagccagtcagcaatggacgtacaatgcctgtcacactgtgtagatcgagctctaccatctctctgactctctactctctaaactctacaggccgccgtcgcagcagggaggcagcggggcaccacacaggcacctgttgcgagcgtagcaatccgcaccgtgcgccgccatgaacctccccgccggaatctcgccgcagagctcgttgtcgctgacgttgaggtgctccagcctgacgtccatcagcgacttggccaccttcccggtgatccggttgtggctgaggtcgaggtacctgaggtggtgcgggaacctcaccccggtcatgtcgaacgccagctcgttccacgacaggtcgatcttggccgccggcgccgcgatcccgaacaggtgcggcgacgggtcgccggtgaggcggttgtgcgagaggtcgacggtgtccacgtcgccgtagcagcgcggtatctcgccggtgagctggttgtgggagaggatcaagaacctgaagctgccgtgcaccagccccggcgggatggcgccggtgaggaagttgccgctgaggtcgaggtaccggaggttggggtggtcgccggcgagggacggcgggatcggcccggcgagcctgctgtcggcgatgacgagggtacggaggttggtggcgccggcgaggtaggacgccggcaccgggccggagatggaggtgccggtgatgtcgaggtcctcgagcagcgagaggttggcgaaggagggcgggatgggccccgacatgccccggacggacgcgatctggaggacggcgagccccgtcagctcgccgagcgccggcggcacgggcgcggcgacgccggcgagggagaagagcgccagcccggtgacgcggccgggctcgccggagcagaacacggcgggctcccacgcgcagcagttggtcgacggccgccacgacgacagcctgacggggtcgcccagctgcgccttcaccctcagcagcgcggcgcggtcgtcgccgttgcactccaccgccgacgagacggcggtgcaggcggacaggacgacgacgacgaggcagagcagtggaatccacgacgaggctactactgttgcattggccattttcttgggtttttagggttttttttggcagcaatgcaagctactgtgatgatctgcactgaacttgaccacctgcatatatctatagaaatcgccatgaaattcgtgtgctagcttctgcatcagattctcgtttattcacttcatgtaaaggacgttcttgtgttctgcattcaacatgcatgtgttagcagcaataaaaccgctcaaatccgtgcaggattctgcagagattgcctcaacatgtgcctcaaggtacacaaaccagaattcagttagcgatcagttactgccatccagagatcaattggattcatcagataataagcagtgcaagaacaaaattcttttctcaataagatacagattttggtggtgtttaaaacttatgtaggtgagatgaagatgaagattaagtgttatacacaaaatgaggtggatctcacccaatccaaatgtgggtgagatcgaaaaggccaagaaactttcgcaagtgagttggcttgtctgttgttatgcagttttctacagaattatgtatgatggagaaaagctccttatagatatccttcgtctgagagttgtgaggtcaaatggttgtccttgtaggaccaggagcagtcattactcgatgctatagccagacttgacgatgcatcagatagtgaaagtggtaagttactggcagactctacttgcactgttaacagtatctttgaagggtgatgagtattagccacattagtatatttggttttataatgcacaaccaaataattagaaagagtgaaacctggaacttcaaattctgcccaaacattgagaaattttggatgtgactcagtatgttttgatcgaaaatttgtcagtctttcgtagtactggccacccacttgtgtcgtccttgtctgatgcctcaaatttgttacagctatcaactattattctaactagtcattgtatatgacagaagatatggctgtcggggcccaaatggtttctgctggtgatcacatgggcaggaacggcgttgcttgttggtaacaactggcaaagtgttggattttgaagattgtgtttgtgaagcgcctgtgtagatcaccggtcaaaggaaaatcatcgatggggcattggcaatttggcatgccaaaagtggatgtactgaacatgtccctgatagggcctcttctttaggctgcgaaaagttcaggtcacaaggcgcagagcgcttttccttcggtgataacggtggctgtatttgccccctaacagacttgaaggaactctaatctgactattaacattccaaaactgttaaaccctttgccaccatctccaatcttcttgtctctctagtgcaggatttgtaaactccacctgaatgcaacgtgaaaacgaagactgtatcttgctttccagtgatcaggttgtgataggtaaacaactatagagaccatatttaatgcttagggcacatgaatgcggggatagctcagttgggagagcgtcagactgaagatctgaaggtcgcgtgttcgatccacgctcaccgcatttaactttcttttccttttcagcattgcattttttttctttcttttccttttcagcattgcattttcttttctgcattgtgcatagaactttcttttccttttcagcgttgcatttttttttctgaattgtgttctttgaatgcaccatttatttttttttccttctcttttcctctcatcttgatttcaacgttgcattttttttaactgcattcattcaatgcaccattttgtgtttttccttctctcatttaaagaaggataacgaattgcattctcaaggtgtgaatatattctcctttataagataactaaaaattatcttccagtaataaataaaaaaagtaggtcgactttcacaccaacaaaaccgttagcctactcccatccctgcgtgggcgcagttgtccccgatcccctcccgcgaacagtaacaccttcggagagcgggcacgcctaacttgtggagagctgagaagcatggggttatggatttcaattttaaatttcttcatagggtaactgttggagccgatctttaaaaaaatttctaaaatttagcaccttgagattgatggagtgggagggagcaaccatgactaaactcgtagagagcgagaaatatgaatgtggttgtggatttcaattttgggcatacggaactgttgaagccgatttgtttttctttcaaaaaaaaaacccaaaattttgagattgagaagggaataaaccaaacgatgtgagagtgagaccctggtgatgggtaacgatcaattcaaaccatcaatttgtaagtgatcaatggtgttgcttcaaacacatggtgatggggaacgacaaattcaaacagcaatttgcaagtgatcaatggtgttgctacaaagacagacgatcagttagtcgactacggaatgcaatacattagcctccaaatgctgcagacgcaaaactacgtaatttactcataccttgaactatccacctttgctacttgctacaggtcacatctgttctactagcttacactacactgcccccaaattggcaaatttctacctcctcccaccccgcttcgccgccgtcgccgtcgccgccgtcttctccgaccggttcaccttggccctcttcgacggcggcggcgtcgttgcggcggcggcacctcgcttcgacggtggccgccccacgcttctcttcggcgtggcgctcttgccgcccttcttggagccgccgcggccggcatccttcctgccgggccccttacgcgtcttctgcggctgctccggcgacgtcgccgccgcagcacgcttccgtgtccccattggtgagcctttcttcttcttcttcgacggcgacgagccctggtttagccgtttgaggaagtccacggcgttccgcttcttggcgggcgtggctgcgtcggcggcgatcttcttgtcgggcttcttgcttccgtcggtcgctgcctccgtcgcttccgagagcttggccattttccggccaccgacgctggccgagttcttgccggggccgcggcctttcttcgtcctcaacccccacgccttgtccttgctcgctgacgccgacacggagaccttcttctcgccgtcgtcgctcccctccccttcctcggcggcctcacccttctccgcgctctcctccttcttcgccgccgccgcggccttcgcgatggagctccgcttccggcaaacgatgagcggcttccctcccttctcgatcagcgacccgacgatgccagcgccgccgccgccgccgccgacggagacgacgccctcagctctccgcgtatcctcagccggaggggacccggccgccgccgccaccgcggcggcggcggcggtgccaggctcctgcttcggctcgcggaggcggagcgacgcggacacaagcgcgcgggcctccgcggcggcgccgcgctccggcccggcgcgcgggaagaagacgagcgcgttggcgcagagcagcaggaggtcgcggtagaactcggcggcggcggcgccgccgccgccgccaccggccggcgacgcgtccagcctccgccgcaccatctcgatgtccacgtggcgcctgatcgcgccacggtacgcgtcgctctcctgcaagtggattttaaaaaaaatgaaaaaaaagaaaaagaaaaaggaaaaaaaaaggagaaaatatctgtgggggcatctggctggaaggcaccccacccgcccaactgattgctacgctgcacccaaccaaccacgcagaatgattcaaaccaaaaatcgaacaaaaaactaggaactttcaaattcaccatgagctaatccgatttgaaactttcgcgttcgttcgaaggacacaaaaaatatgaggtgtgcacatgcgtctcacctacctaccacacaacaaaccaacccgaattcataagcaagcgatgacgcacacgaatttttctggtcacgtaattcggattagtgctagtgctatgtcatcatgccacatgcgtggccctaatctaatccataataatctagaggacccccgttaattacggatgggtcccaccctctgacatatcgtttgaaattcccctctttacccctcccctaacttttgaccggcggcggtaaaaaacaaagggtaaaaagggtaaattgtaaatgagcggtaaaattcatttttacctggctttcgtgcagccgctcgagcaggggaccgaacctggcggcgaacgtgtcgagcagcgcggcgagcggctgcgacgacgacgacgacgacggcgactgcgagggcggccgcagcgcggaggcctcctcgccgtcggcgtcctcgtcggcgccgggcttgtagcggcggcggcggcgcaggctggccgagctccgcaggtcgctgctctccttcgacgcggccaccgactcgccggaggcctgctgcttcgccgccgccgcgtcctcgtcttcctcctccgccttgacgctatggtcaccggcgcgcgccgcgggtttcagatctgtggaattggactccctgcacgaccggccgggctcctcgctcgacagccgctcgtcgccgttcgccgtctccggcttcccctcgccgccgccgccgccgtggatgctttgttctctctcctctctcagccgcttcactttcgtctgtagcgttctgagacatgaaaataataataataaaatagttatttatttatttaataagaattcaataattggagaccgagagatcagcatcagacggctcatgaaacgcgcggtttagaggctttttgaaagagaatttggtgattagattttttttttcttctggtgttttagtgttttttacccgatggagagatcgcatcgctcgacctcgcggcggagctcggcgacgcggaggcggcggagctcgtccatccacccgtccgcggcggaggcgtcggggccaccctcctccgcctcctcgtcgtcgtcgtcctcctccgccgccccgccgacggagaagcggcggtggaggtggcggaaccggaggcggcagctggtgggcgtgaggcccgggcgcgcggcgagggggctccgcgtctgcacctccatggcgacggagtcccagctccccgtgccgtgcctgctcacggcgcaggccaagagcagctcctccaacgtcccccagatctcacctccacctcctcctcccgccgccgccgccgccgccggagacacgtcggggccgtccgatccgtccgccatgtgctctcgtcgtcggcggctgcttcccccctttttcttctctctcgctcgcgcacgcttctttgttcgatttttatctcggagagatggatgggatggatagatagcctctgcctctgtgattcgagcgcgcggcggcctcgcgcacccaaaagacaatttcgcgtttctcaggggggtgttttggagaaggcgagcgtgctgttttcaaactggggcccaccttctgcctttctttttattgtacgatccccatattgcccctgattgcgcatactattatcccgtactatatatgagacgcaaatgtcgcaacaaaccgtgtttatttgttaggccttgttccattaatccctataagtaagggattagaggagatttatttcacatctattgtggcgtgaaattattctccctcaatctcctacaatcctattcaatcccctctaaattgaacaaggccttataggagaaaattcttgctctaattccaaaccgcaaatttgatacgcagtactctctctataaaaaaaaactcagcatatccagatttgttgtactataattccatcccaaaataaactcgttatgtacaaattcgttatactaggatatatctctatatccaattcgttgtaatatgtccaattctagtacgaggtttattattattttttttacagagggagtaagttttttttagaaaaaaattgattcacagtaaacgtgtaaacgatctaagcaaagtcagaccgtgcactttctttcttttttgacacggacggcaacaaaatgcttgatcctgaaggtgcatgatcctataaagtatgccaagaattcatcaggatgcggattagcccgtgagctgacacgtgggatctgaataattttggcccggattatcggctgcgttggattggtacgggtgaactgtttgactgggcctccttgatgattcgccaatgaacctgtccttgcttccgtgctgaacccgtgtcttcactgtgcggttacaagaaaaagatttgaacgaacagggcatgccactcgtcagaattcatagtttcaaactagtattccctaaattctcaaattcattcatgccgaatgcaaaagctggcactctgtttatcatcaattttttgtttaggaactttgatcaaaggtacaagcacagagataatgatcatatggattgaaattgtaataaggatgatctggaaaactaaagcgtttcatacatctcaatggagctgaaacttcaactaacaaaagagcgagtttatacatggcgaattggagataaataatactactagtagcagtctagcacaagcaacggcctggaaaataaggcgagattattacatcaccttatgagaattccatttgcttccctggggaagcaaactgcacctaccaaatgtattattgagcgcaaaattttaaccaagcagccatgtcaagttgcagtattgcagggggttgcaatttcagcaaattctgatacttcttcacttccggcgagcctccagtgccttcttcaactcctcgctcgcctcattcgacaccggcttcggtccactgtccaccatctccttgccgttcccgtggcgatctggcttcgccaggaatggttgtggtggtggtggtgccagggacgacggcatccttcgggcgtcgcctttaccgggcattgaggcggctctatttccaccgatctcggcacgcaggtcctccacggtacgccgcagcatgatgctctctgcattgagcacctcgagctgcctcttgacgagcgagaacccttcagtctgaaattccggcgcatccttcttcttccccttgtcggcatcggaatgtggaggattccgcagcgtgtgctcaattgtgatcttgttcatgaccagcagcggcaacttgttgatggccaggttacccgccttgcggccgtacccgtcgtcggcgagggcggccttcagctcgggcggcacgcgcagcccccactggaaccgcaggctcgccttgctccacagcggcagcacgctcctggtcgtgaggcgcatcccggacagcagcgcgccgaccccgccgccgctcttccccgcggcggccacgttcgcggcgaacccgttcccgctgaacgagaacgccctgtggtcgtcgccgccgttggcgaggtcggtcagcttgtgcgacggcggcggcggcggcagcggcggggccggggacgcggacgcgggcggggagatgacggagttggcgagcgagaagtcgccgatgcggggcttgaagaggagggagaaggccggcgggctggaggagaggaggttgaactcggcggatatggcgaacggcgcgcgggcgggggacccgagcgggccgaggccggtacggacggagagcgcgaagggctggagcgggtcgttggggcggtacgagaggcggagcgccgggccggaggcgaaggcggtggagaggtcgaagcggagatcccgcgagtcgccgccgccgccggccgagacgccggtgaggaacggcagcccgaggacgccgacgggcaccttggcgcgcaccagcggccggtcgtcgtcccggaacttgatcgacgccttcatggccggccacctagggttagggtttggtcgatgggggaattcgccggatttggtgaggttgcgggaggatagcggcagtggaggtggggaattttgaagtgcggaggtgagggatttgggggatggggcggaggtcgtcacgccatttcggaggagggggcgtcggcggcgggattgaattgtggggaggaagcggaaatggaagggggacggaattgggttggatggctctctagctggatggaccgtttttactctccttccttactccctttcctacctgtaataagtttatttttagctcctatgtttatttaaaataaatttatttttaaagcaattattgctctttacatttatttaaaataaacttattttaaagtaattattgttcgttacatttatttcaaaataaatttatttttaaaataactattgcattggagtttaggaaagtatgaagttattaaaattgaaaataggtaaaatgagaacatgttgtattgggatttgataaaattgactgcccaaactactcactctagtgcaggtttattataatataattcgtccgtttcatataagggtttttatgtttgtttaagttaaactattttaagtttgattaaatttagaaaataacaataatatttatgttattaaatgaaaataattattgtgaaatatatttcataatttacttttttatatagcatatgataatatttttctcaacaaaacctggtagcacttataatagtttgatttataaaaagagaaaatccaagaaatgttagtgataagcacccaatttcaagaaaatgtaatcgataagtatgagttctgtaaaatatcattgtataagcgacttttctcagaaatgtcatcgtcgaccatccgcgttgttaaatacatcattcatcctatagcacttaacggagggctaccaacggaatcctaatgatgatggtatttatagaacaagttgtttgtacgatgacatttcatgacactcacactcgtcgatatcatttcttgaaattgaatgattgtcaatgacatttcttagacttttttttctatgaaaaagatatagaatcttttatattttagaaacatatatgttcataatccaccgtttgcgaagcaaattcttgttttctcagaagattattttcgtaataatccacatgtgcataagttaattgtttagtttgttgttttggactctaccgtgcacatcaccaccttcttagttcgtgagtacatccctccatgatggtctaagaaagcctaatgacaggtccagtcattaattcctgatatggcctttaggcccaaaattgtactctcaaatagtcaaatctaaatctcattattatttttttccctataaaccatccatttttcaaaccttggccatccaactgaattttttttcttgggtgaaaaactgaaaatgcattacacggtgcagtcaaaactggcctaacatcctccaggaaatcaatcctaaacaaattatccaattgctaagcataagctacatttacaaagggatcaacaattcagagttcaaattatccaattgctaagcataagctacagttacagagggatcaacaattcagagttcactgggcatggcacgatcgcggcgtgcctgcacgccgccaacgacgacgacgccaccgccgccgccgccgccccggcgctccagaccacgccctcctccgccttccacaccccgtcgtcgaagttgcgcgcgtagctgtccgagtcgtactcgtacctcgccggcgcggcgagcctcctcctcgctgcgcgccgccgccgccccgccgcgcagtacagccccgcggccgccgcccgcctcaccgccgcccaccacgccctcgccgcggcggcggccgccgccaccgccaccgccaccgccaccgccgtgccgtcccctcctcctcgccgccggctctcgcacgccgtcagcctccggtacgcgatcgcacccatctccaaaaacgcgcctctcctcttccgactcgtgcgcgcgtgttttccattttataaactcttcacatcatcataaatgtgtttttccggaccagctggcatgtgggacccacccgtcggggaggaggacctgttcggtgctactccagctgccaggtgggtccaccaccagaggcagtttaataattttattgtgagctctaatccgtgttagtactactgctaaaacaaaagatttgggttgagtttagttcacatcaaaattagaagtttggttaaaattagaacgatgtgatggaaaagttaaaagtttatgcgtgtagaaaaattttgacgtgatgaaaaagttgaaagtttgaataattattttggaactaaacacggcgttgttatccgagatgggaggcatattggcattgtttccggatgcgtataatcaagctgggaaagagcagaagtacaggctgtttgattgcatttggtgacctgatcaaatcaaacctattagtgtgccagttgctgggcttgatctttgttaggaacaaaaaaggctgggagatgaataataataataataataataataatatagtatcagaacaagttcttccaaatcattggttatgaacggcaatgctttggatttcagaagttggcatctggtaatgaggggccatgacagcttcttaacagcagccaggattccagactacagagtgctggaataccgacacagtatcacaagactagttctatgttctggccaattagacaattagtacccataaacggatatatagctgctctaattggcaatcacctgttaacaacatagtagctgggatttagtagtaggcatcaactggcaaagcaagcttccatgatcttaacctgattgcagctgttaagggaactacccccaaaatgcatacaaatatgaaagtatgaaaggcatgtagccaaactactatggatattttactgagtttacgcacgtttcagaattccctgtacaaaagaatccaatttgaaacaaaataaggttttaccattaccatgaatctgtcttacacaactacttctcgatgcctaagttcatatctcatttctttgccttagagaaacgaaggcacctgtacttttcaccgctaacagtgatctcgagggcaccgtcttggttgtcctgattcgaagcagtgcccatgagcacgctcttttccttctctaagttctccttttccatcttcagccttgcctcttgccgcgcaatctcagcctgtgaaacatgcaattggatcaagtcatgctgcaggtcaagcatagttcactctatctgtcaaaacaagtttgtcatttcatttgcgaataaataaatatgagtaaaatcatcaagcatagttcactcttatatgtgaaaacaagtttgttcaagcttcaaaccatctgaaagaggaatgtgttctcaacttattatttctactaatctggcaaagatataatggtaacaggtcactctgcactaatacagggtccaaaatcactcggcatgacaaattgacaattaaccagaatggaaccaagtgattgttttggataggcaagaatcaagtgactgggagtttaaatttcccctatcaaataggattaccttattacagtcagaacaacaacatttaacaaatctcttaaccaacaacatagccttccatacgcaaaacatttatccaaatgaattaagatcagaatccgccaacacagccatattgcttatatctcaatagtagtctctgaatggaactatgaaaggattcagccatttttgggacttgctgacacaccataatcgatggacaggaggagggtaacatactgactactgagacaaaacgacatgataataggaacgccaacaaaacatgtaaagaagaaacaagccaaaatgtatgcaataaacttcggttgacataatataattcatgtaactgtacatgtcatgtgatgaagcaggtatgactattgaggaaagatcccaaatgtaccacgaactaacccacaggtctagattatctaggaaagattttgttctctcacaacatgattcaaacctattcatccttaaaaattgaaaccttgagaaggtattcataaataatacggcaatcctactcatacactctagtctacatatgcatattcttcacatttggcagcagttccaccaaatgaaattcttcaccattagcagtgtagtcagattcctatcggcataggagctaaactactgaaaaaaaaaatctaataaggcattacatccttgtccgcttagttgtttgacttgtttttaagccaaaaactgagaaaagaaaaaaaaacaaagaagaaagaacaggggcggatttggagtgatgggggaagcaaaggaaggggatcatcaacatcagatcatcaccgacctcgcggcgggagagctcggccttccaggcggcctcccgctcggcgacctcgcgctcccgctcctggatgtagctctgcatctcccgctccttcatgacgcgatcctggatgtccgcgtccagcgcctcctgcagctccttcacgaacctgtccaccaccgccttgatccgcaccgacatctccctcccccgcacttcgccgcctcgccgccgctggcgccggactccggcggctgggctagggctccgatgcggccgcggcgcggcgaaattttcgtgggccgctcgtttcgtcgtgggagagagcccagcctctgctgagtcagcaactctcctgggtccgtacgctttcgactgcgaaagcccgcagaaaacgtattccagaaaaccgtaatcatcaagtgaacacgtactctttgtaaacttgcaacaagccagcaggatgaaaacggttgggaaaacatcttcgtccttcgaccattttagtaaccatacttttctcggaaacagaaatggtttagaaaaatagaaaatatcaaaaaatcaaaatcacatatttaatttaacatggctatataatataaccacataaattcatttctatttttaccattttcattttcctttttcttttaccgtttccgacggtttggtaggtacaaataagaaacgggctttagtcggtcggttgagaattttcgtgactattttcatcctacctatgacctcctttgaaaattttcatttttgaggattttggtagaaattgagctaatttctaatgttccaaagaatccaaagtatcagcatctgagatgcggcataaaagagatgcctcttctgttggcatgtccttgccaaccgaaaacacatgatctcccaacttcacagacagtcacacaatgcaagacatacagtgacaaatgggttagcatcagcaacagagaaaaatgaaaaatgtgcagaacatttttcagcttcacacagagagagcataccagaaggtaaaagaactgagccacaagctaaccgcaacatgccaacatagttacatagaagcaatgagctttttcatcggtgtctggaagataaaaaaacaatttaaccacctaaataacacattgagtctagtctccaatagtaacagcacctacaccagaagagctagctagagatgcaacggctacagttttcttccctgattcaggttcagacattacactagataggggggctagttaggatccatggcgtcgcaccggagtacctcgagtaccaccgccacgacatttcctttcgcaagttctacggcggtcagacgggaccaaggtctggtcactgatgatgatgaggaggaggagctcacttccaggataagctgggtagccctggctggccatggttgctggccgtgacaccttggttcagcgggctccccgggccgcccgatgattcactcaatgtgccccttgatggcgggctgcttggccccgtcccgctcatcggcaccatctttagcggtgcagacattgggtctgaaggagcatgcagctttggcccctttttcccttcggtgttgaagcttcccaccacaatctgtggacacaggaatggtaattgttcattatacatagtgtgtaacacataattgttcattctgtagtagtgtgtcacacactttagaagatagaacaacctgacataagctacagcttcaaaagtaaatattctataaaaaatccaaagatgtccacctagcatcattcagataatatttccttttcgaaaactacatgaaagccaaaaaacttcaaaggaagtccaagacaatgaatgaatttcagcaaaccatatactatagtagttagtaaaaatagacaagatcataaaactataactaacaaacttacatacagagagattttctagaagtttatggttgatgtaagggggaatacctgcactggtgaagcagctgtcagaagtccagcaactccaccacccaagacgcgaccatcagggcctgctagagaaacactgagcccaccagttcgactacgatggcctccattctctgatagaaggaatgaaccggacagcgacagtatctcaaatcgtccctgttcacagaaaataagaaggtttcctggtttattcttcaacggaggaataagaatttccactgtggtaattctacacaaacctaaaactcgagctagataattcattaacacccacagttttaccatatacaaactcttgtattagtatttacagcttatgcagtggttgcatttgatgttgaaaatagattttctcgatatcttctgacggtcagaagcacatacctcgtatgttactgttccaccggaagtagcagcttgccgaagtgtcacatttgatatggcgccgtttgctgacagaacgcatactccacgagttccatgctgggagaatgacatgatctttgcagatacatcctgaaatgtagaattcaagtcatttccaattagaagactgtccatatttgatttctgcacccttatccttgtatctacacacaaccaaaacttgccaagtgcttctatagcatataatcttgtgatatgtaaagtacaataactaagataatgggtactgtagttaaaaaaaatctgaagatctcacaagatagaattccattcatacaccatgcataaagacacagctcacccgtagaaatgtaaaatggaactatgttagcatgagaccatatttttttcacacatttaattggaattaatagctacaagataaaaaaatgcccaggtgttagtatgtgctcaagtgacaataaaaaccagtaatctgatcaagacagcaacacaatcaacaacaaccaaatgtcctatgttgcatccaaaagcaagtagatggatgaaaagaaaaaaacagaaagcaaagactgaacattgctttacctctccagctttaacaaaaataacatgaggtgtgaatccagctcctgctgaccctgcaaattgcaattcaaccaataatgatcaaacacatttactgacctcgaaaagaagtgaaaaagacacattccaaaacaccagtcataaaaatcatagttcagtaatgtaacagctaaagagtaaccacgaagtggcacaaaaattactgaaaaaataaaaccaaactttcctattcaaattttgcactaaagaagggttcccttccatgctagaaacaaaagaaaaggtttcctaaccacttaaccaataatctgcatacagtaaatcatctcagatctagtaaaaacagccagcaaaacctgagcaagtgcagagttaagtactcctgacagtaactttttatcctctaaacaaacaataacaaaatgaaaaaccaaatgagtttcctctaaaacttcatctcctcttcttgaacataacaaaataacaaaaaatttagcaaaaaatggaatagtattataggtttagagatatagtgatataccgatatctccaattccgaaagagggcacgtgcttcttgttcgtggagccctttggccgccccctcttcttcgcccccggcggcggcgccgacgacacggcgtccggcgacttcgcggcagccgccggcgagaaaggcccggaggccgccaccgccgcggtggacacgggcaccaatgccagcgacatggagccgtcggggccgtacttccttggccggccacgcttcttcttgaccaccggctcgccggcgtcgagagccgccgcgccattgcctcctgcgggcgggtacgtcgccgccggggccggggccggggcggagttcaccggagcgaagatgggcgtgccgtccgccgtgtacgccatgcgcacgctctgcatgccgccggacgacggcggcggcggcgcaggcgccgccgccggcgggctcttgggcagcacgaacggctcccttcctcccgccatctccgacgacgccctcacctgagtcacctccatcattcccacaccttctctcgcagaagctcagctcagcagctcactcagctcagtgatttcttggaccgaaatttcaaggcgagctgaggaagaagacgagagctgcaaaaaccaccataaaccccgcgctgctcaaagctgtggaacaatttttttttcaacgattttacagcggaaggatggtgatttcttggaatgggtgagaaggaagctcaaatgaggggagaaaatggaaaagaaaatcggaggaagaaatggtaaacccacaatttcccaaataaaaacggaaaaatagctggaaggagttttaaaatccaaggtttaatttggttcggatttagcaagtgagcactgaaacacagatcccagctcgagcaaagtaagcagccaaaaattaccaagaaattaccaggaaattagggacactagcgagtacttaagaacaaaccgcaagaaaataatctgaacaaaaaaaaaaaggctagagcaaagcttgcaaagccttatgcggaaagatggaagctcaagagcactcgcagaaactcactcaaaacaactcgcgaggagaggagagaaaatttagggatttcgcttgtctcctacgtaaattcccctaactcgcccgcctctccaatttttctctctccgttttttttttccttctctttcttttcctttttcttaacgcccctactagcacgtaatctttggggaacaaaaaagaaaaggttttataatttgggaaataaaaaatgagcaggtgaggtgaagcacgtcaggattgcattggtaaagggtctaccttatttgaccccaggggactttattttatttactttgtgtccttcctttgctcttggctttatctgcttatgtatttcttcttcttttttttatcttcctcttttgttctgtttgtttttcactgtgctcatggacctaaccaaaaccatttccaatctgcccacaaactccagccaagcacatgccaactgtcttgcaacatctcataaaacaaaagagcatgccttttgaagttttgttttgaacagattcatattgaggtgaaaaacatgataagttgatgttttaaactggtatgtcattacatgtaaatatatatgccttcacatgtacactttgtatgcttgtaaaaatacaggaggtaatatttaatattttttaccatcacatgatttaatatttttatcatttaattataaatcatatggcatgaaaaagtcacgactatgagaaaaaaaatccaagaatactaatgatgacaatgaaatagggagcagtagtcgcacatatcctccttagaaaccactatatctcgtccttagatcctatgaaaataattgtaaaacatagataattctaacatcgttgttgaccagcagagttatgataaaaacatggttataacaacaagatacaataatattatatagtggtgagataagagatacctagaaaagtctataaatattgtattagtgatttctccgtaacatcccctgcaaagtgaaccacaggtttctatgacactacaaagtagatatgtagtaacatagattgaaatggaatttgctgggagagatgaagaatgtgggtggaatggtgaagtaatatagtgggatgcgaatggttatatatcatttgaatctttcagtttgttgatttacataaccaaagaaggaagctcttaacccataagctttgtaccaatcggatatgtgcaaccgttacgtattcacatattttttattaccctctccctatttcaaaatagcagtatgtgaatggatatatgccatatgaacgtttcgattttatcgattcaccaaagaaggaagctcataacccgttatttgtaccaaccaaatgtgtctagccattacgcattcatgtgttttagtaactgctctatgtttcaaaatagtaggatgtgaatagctaaaaatcatttgaaaacttaaaatgattttcgctcattaggcattacacattcatatgctcattaggcattcgcttttctgagcatccgctctcgatttcaaaattaaaacagaaaaaaaaatcgtgtggccaatacattttgttttccaaaaaaatattaaagtgaaaccatcggagtctgtaattgtatgaactggacaaggcacttgagattcctacaaacgcaccaattctttttattttggaaaagttgttgtgacataataaatctgtaatttgtaaaatcaatactcttcaaattaaagaagatgaatcaccaaccaagttatgcagtcctaaaaacatcattgatgtagtttcctcctcacacataacataatcatagtgtgtagaccacaaagaccattccagtaacgaatttacaaggaaattctagcctgagccattctagtattttgctaggtgacacaaaaaaagaaaaaagaaagaaaaagtcggcaccacaaccctggaccaggtcaacaaatccggatttaatttttgatgaagaaacgaaatcgaaataggacacggcatcattaagtcgagcacttttattcccctaaagatccaaacacaagcagtaccaattgctaggcatggcccatttttgcacccaaaatttctagcttttcttgtcccatgcaatgctccatcttcacggcaaagtaaatggagtatatttacatgaattttctcatgtccatgatgctttgaaataattgcagtcactagaggaataataattatttggaattaccaaaaagaaaaagaaagaggagggcctaagcaggagagattgagtgcctgctaagaattagcctgcaaatcgaataaagttctgcactttatttataccaccactctttatcaaacttgtccaccacgtgtcgtttgcatcgtccttatcgccgtctgtagattttttcattctaaaaactttaatttgtttactgtttgatactatcttcctcttaatataaaaagttttagagttaaaaacgattattaagaaagtagccaaaggccgtgtttagttcacccctaagtacctccaacttccaattttacacacaaccaaagttaaataggaagatgtgattggttaaaaagggtaggagaaaaaaatgaatggtgaataattataattggttgagaaataaatattggtgaagaaattattatattttaggataaattttaagtgctagaaattattatattttggaggcggaggaagtaactatttaatccctgtttgacgccttgacgttgtgagatgggctgttattgttgttgcatatatatatatattgccgtccaagctctagactgatcccataatacagatgtgctatgctgagaaatcgcaatttaggtactggtttggattatcacaccagtctgacatgacaagtaattgtttggaatatatatattagtatttttttcaacataaataggcagttgagatgtaataaatatttttgttcaaaatagtaggatggtacattgaggaggtgtgagtgtgacagaatgagctccatctgtacagagaaaaattaaagcagagtgacttcactattttcagttttgcaagcagtgacttcagctaacacatttgcacgtattaactgcattggtacagaaaaatgaagatggtgaatttatttacgtggagcaaaacacggagaaaacgatgaaattgtactggatgcatctgcaattctgcatcctgctgacaccttatcactggagccagcaagaatatactgaacttttcccgtgaaaagtgagaagaatatatcaatatactcagtgtttatctgtgttttccttgagaaaaaaaaacagaaggaattcactacaaaatgaactttgaagcaagatggacgtgattattatgatcaattcatgtataaaaaaattcatgtcagtactcatattcccaaaaaaaaaccaattaattcagataatttatttggctgggtacacaattcagattaattttgtactgcagggattagctaagtccaagctaacataacctaacctacttgtgaaaactaacaaaatgctcaacaagaaacaaaagacaaagaatgttttttttttcaataaaactgggtgaagaggatcactcagaattaatatttgtaagtgtcataatcatctttagatacatacacattaattcactgtaatttctagtgtgaaatatttctcttgccgaaagcgtgcaaccattgcatactgtgatgtttgcgtgcacttattgaccacttttttcccataataaacagcaaagcaaagtgagaacaaatgagcattgtaacttgctccaatatattttttttcttgatggccatacacgccatccttttctctttaatacaaaaaacaagccgtctattttcgtgtatcttcaccttctgactttcttctgttttagtgcggccaagcttatccatgagatagaaagaaagaaaaagaaaatctttatcaaaagtaacccttgtaaaataaattttcatttcttgaagcaagcattgagaagaagataagaacaagatttagccacaaatttccaaggaaaaaaatatcttcttcatgctagagaatggatggaatctttttgttattttaacatgctaagtgagagacgacagtgagtagatgtgtggttctaaatcctcctccactgtggtgtggtgttgttgccttgcaaatcaattattggtggggaaaactggaaaaggttggagaaaaaacgaccacttatattgactgtttctcctgtttatgttctgaatatttttctgaagaaaaataaaggaagggtgtgtttttgtgtctagggggtatgcacaattgcgcatgctaattaggtagtagagcattttctcctgttaggcagacatttgttggaaactatgtacttattgacaaatactagtgtggtgacacactattgagtcacaccctcatcaagaaattggtcctattaggtaaaggagaaaaaaaatgctatactcaattaaagtgatatgatattgttgcttcaattgagcacaccaatagtgtagggacttatggtggagccaattggcatgtcaattccacacatataaaaataaaacaaaatgcattaatgcaatacagcaaactgtaacagtcttttatgtttagaagaaatggacactcttttaagtagagggttattgtcaaatcacaagagaaaggaaaaaacaaaagcatgattactactggaaaagaaggaaaggaaagagaaagggaaagcagcaaggaaggagggctcaccccccatgtgagcttccccctgaaatttgataaattccacttatctttttttttttcacaacagccggccatccatgatggcttttggagccttgtaacctaacaatccgttcctgattttaataccactagactgctattacatatctcatttgaccaaattaatacaagctcaaatgcgattattgcacatgacacaaaattaaagcccttttagtttgttcatctgcaattttgtttgctcatgaactgtaaatttatctacggttttacttttaacctcaaagttttgtgttgctgctttttctgctcgtgagctcccggctttttattggtttgtcggtgtaaagatcaatcatctttcgacaaagctcccaacaaacggtacaatcttcgtttcacctagggagtatagactctactctacctgttactaaatataaatatgtacaggaatcaaatacataatataaatatttctgagacattgactccattatacaggaatccaaatatttttaggcaatcaggtgctcagtagagaaatccaagcaactcaaaactcaaaattaatcaataagataaatgcaatgaaatcttttctatctatcttaacgtttgccactgagagaggtagctaggtgggtacgtctgtacccccaaaatgttttacacaatactagtatataattttaatactgcaaaaatgtacttataattcatacacaaataagagctattcaagaaaattaaaaagtcatttgcatgaagaaagatttcaactttcacaaatcaatacaatatatattagtttgataatttattgataaatatcactattttcttatagcgccaccaaatcagagtttgaacccatgacgaaaatcctggctccgccacttatttttactactacaaaataacctataacctaaaagtttatatttaacacagtagctgctgaaggagtaattaccaccctgactgaagactccttgtgatcatctgctccaatgtgtttcaatgcggccaacctagtcgtagacactcctagctaggttcaccacttcaatgaacatctttgacagagagagagaggccgtgtttagttcacccccaacttttaactttccatcacatcacatcacatctaaaactttcttacacatataaatttttaacttgtttttttaaactttcaactttccctaaatttttagcttttttcagagactaaacacagccagagtagtagtaaatgcgagcggcagtgaagagggcagtcgcaagtagcagcagtaatgaaaggcgtttccaagaggaaaaggatgaacccgtggatgcaatcactcatgagatgagcaacgtagggccgtcgtcaatgaatgtcctttttctccaagtcgccaactgttttctgctccatcgcctccgatccggggaagacagtacagtacagtacagtatagttacagtcacaagccgccgcaagatcgtcgtcgtagtagttgttgtttcagtcttcagaggccatgtgagtgtggcccaattcgagttagatgaaaataaaaattaagattaagctgaagtaatagtatgcagacgagaaagtatgagttttaattattacaaacttaaagttgaatttaattgataatttaaagcaatttttatatagaaagttttttaacgaagcgtattgttcagcagtttgaaaatcgtgctatagaaatcgagatataatctgcatctcaatcagaaatgaacgggtaacgggtatatgttactactagatgttaatcgaggatttgtccggacctctgtaaattccgaatgtccttgccggatctattcgtttattcctgctacgtttctaaaattacaattttgaaaaagaaatatttgtacgaaatacattgcttagacccttagttctaaactactcgtccacttcagattatctgtcatcctagtattcagatttttttaatcaaaatatcacgttccaaagcattttttggtgtgaagcttgccaaacaacaaataatctgaaacgaaaggttgtacctggtaggtttataatttactctccccttccacttatatactccatgatgatagttagatcatttttgaactaacaaacgtcgtatataaataaaagaagggagtataatgtttatctattttataaacagatcgatcatctgttagccatcgtcctcatttcaccttagaaaaaacatgcctggaaggaatagactgatcccacgcaaaaaagattaaaagaaaataaaggaaatgggctgatggcctgatgggtagaggaagctgcaccgcaaacctgcacttgtttagcccaatcagacaggtagctgtagctcactccattagtggatagaaataagtccacttggagtcccttaattataaagatccataaccctaaaccgtaataccggatatcttgatccatccaactattaaaaccggtgtaatttgactttctcgatggttttgagagtgcttttcattgacatggcatgttgacctagtccgacttgtgctgacatggcaccctaatcacaaaatggaagtgaggcccacatgtaagtcacaaagaagaaaaaataaaaaattgtagggcacatgtgttagtccccttctccactctctagtctctatcttttccccaaccatagcaatttctcccacatgggcggcgcagctgcgcaaccacgtagctcaagtctggatccggcggcctcgtcctagcatcgtcgccgccgaagaagggggagggatccgccgcagcggtggaggatgtggtcatcaggcgacgatcggcggggagcacagcttgtggtaagagtaagtaggggtgaaaacggtacggaaacggacggaaacaacctttatcgttttcgttttcatatttttttcggaatcggaatcggaaaccccagaaacgaatattatcgaaaccgaaaacggagcgaaaacgaaccggcgcggatacggtaacggaaatttatcagaatacaaaaacccctcaaactgagcttcaaacttttgtcaagtccaattctcaagtctcaacagtcaacaattcatcataaaacacaattatatgaaatcgtcacaacagcaaaatatattcttctataacttcatataatttgcataacaaatatttaaaaaaaaaattacatcaaaacaccctttataagatatatagtatacactattattcagtgctatactgctaatctgctatgagctatcactccatcatcagtacatagttcatcaattgtttcggtcatcacacaacagcagcacacatcaatccatcagtacagtacttggatcaatcacaaaacagctacttgcatttgatgattccatcataaatctacagcacaaaagaaatcaaatcaatggtttaggctcgtcggctcgtcgctgggctgctggctgctgccgctgggctgttggctactgccgctgggctgctggctgctgcgactgcgaggcgaggcgtcgtcggctccttggtgtggctgtggcgtcatcgtcagtggtggtagcggcggtgaaacggtgggacggcgccgcggccgcgagacggcgctacgaaacggcgggacagcgtcgcgagatggcggcggtacgagacggcgaagacggtaggggcgaggtcgcgaggagccgaggacggcggaccagcggtgggcgctagcggtgggcggagcgcaatgcttcgccgccggctcgcggtctcgcaaagttgcgatgccgtgtggctgtctctctcctctagggttagccactatttgggtagatgccgcgatttgggttgggcttaaaacttggggacgagttatagactattgattctatgggcctttttaacttcggaaattccgataatttttccggaatttttccgaccgattccgagttccgacggaaactgctattatcatattcgattccgtttccgagaaaatatttccgttttcgattccgtttctgagaaattccgaaaaaattccgaccggctgattccgtttccgaaaacaggcccggaatccgaaaagtttccgtaccgttttcacccctaagagtaagaagggggcgggcagcctcaccctggcatcgtcgtcaattgaggaggtggagggattagctgaggcggtggaggatgcggtcggtgagtggcagaggatgcggtcggtgagtggcagaggatgcggaaggcaggcagcatagggcgtggtcgtcgagcgacagtcggcggggagcactgccagtggtaggaggaagaaggtacaacttctacagtggccactgctagataacaccgctacgcgaggctcgtgagcactgtggcagccatctgccgccccctcgcctccgaaacatcgtggcggcgggggaaggcaatgctcacactagaggaacatgcggaaaccaatggcaaggggcaacgggatgggtcaagggagagggtgggactcgtcggtggggggaggagaagtagggaggagcagcatgcgtggaagacctcaccagagcacgatagcttcctttttgtgttcgcagatccagtgggatctattctctctagctcatgatagtggacgagctcgaggagacttgccaaccgacggccaccacccaactccatcttctcgtctccgtgcgctagtccctccgtcctcccacctcccatgccacgccaccggcaggcgccacggcattgagctccatgatgacggtgcccatgaccatgctactctaggcgaggggcatgctacggcagtggacttggtgacggagggctcattgtagccgggtgcctagaggactgccctaccgtcgcccgccgttgccccactacatcctgcagatgctatgtagccgagaggaaatatgatgattaaaaggagacataagcaaaggaagagaagagtcactaacacgtggcccccacatgctgactctaacatattggactaggtcaacgcaccacgtcagcaaaaaccattgaaagagtcaaattatactggttttaatagttgggagggtcaaattattcagtattatagtttagggatacgaatcagattggacctgtatttaagggagtcagagtggacttagcggataaccgtttctcgctggatcctgggccatcccggcccggcccaaatatcgattaatttagccaaaatgtggcggcaaacacacacgccgaattacagatagtaatacaaatcacaacattatttgctcggaatgagacaacgaacacgaacgccatgaattgccttagctagatgtcgcgttgcatcttctccagcgacgcaaatgcgatgcagcagcagccgcgccgccctctcgccggcgtcatcttgcccggtcgcttcatcctgtctcgccggaggaacgcaccgtacgtctcgccgtcgtcgtctctgaaccccctgaaacctcctcacgccggcacgcggcgtccgatcgatcgatcgatctatcacgacagcgtccacatgaagaacgccgaccacaccgtcaccgcgacggaggcgagggcgtacacccacacgaagatgacggagcactcgctctcccccacgccgaacagctgcgtgatggtccctgaaccaaaaacacacacaccaagattcagtattaattcttcagttgacatgaagattcaagatgagtggggtaagaattacgatttgccccttcgcgctacagtgccaccttgaaacccacaaaatccctcgtctttttcgtgggttctagggtggtaccgtagaacgaaggggcaaattgcaattcttcgctgctacagggggctggctgtaaatgtgttgcctacgtggaatgccacatcggcggtcagctccggtcaaataagatttggacctactatagtccattaaaccaagatagtagaactaaatgtgcaattttcaagtgtatggatctaagtagcatttgctctcaagtttaaggaccggccatgtattttacgtattcaagattattccattctttctttcctaccaatgttcatcgccggcggcacggcgtactgaagcaataggatgaactggtagaggggatcagggtggatgaggcccaggtgaaccgccgatttgacgagcaaggtgcctagcgaagggagaagaatgtatctgacgacgattacgctcgctatcactgaaggctggacgcttgcttctcctcgtaatcctggaaaaaaagagttaatgtttcaggtcatcagattaatggcattgttcttttcgtcagtaaaatgtactggtatttctgtcaggttgtttagtgtgagaatagtagcatgcttaccattgaggaggttccctcccattatcagtgtgacagatggaattgctcctccactgtgcaggaaaaaaaaacacgtaaaaatgattagagatcggagttaatccaaaaggacaaaatgaagagaaaaaggcagcattatcattgatcaataggatttggaacaccatgaagaatgttcagaaaacaatagaaatgatgtggaggtgttaccctattagatcagctgactcatgaatgacacgaagaggagcgttttctccgataatagcatttctaattagaggcgttcctccaattataaacccaataatctatacaaaatgaaaaatgatactcagcatagttttataacacaatgttaaagtttgtaatactcagcataccacagcaatggttgaaggagcaaagatcttcttgaagtcaattgctccgaacattgatgatacaaatcgcttcgctctctctgacaatgtgacctatgaaaatttaaagtttataattcaacaaattgtcataacaacattgtgcactaaaacagtgtacaacttgaacttgtaaaaggtaaatatttcttccagcattaagagaccttagttttgcttgaaggtacacttgaattggatatcaaagggagtgtgcattgattgttatcgtttgggattgataaattctcttctgacgctgttcctgtactgctccctgaattggatacttttgtatcatttgttcgagcattaccttcatcagccacttttgaagtggctcgcataatgttatacgcgacagtccacagaaagacagcaccaagctgcagcaaatcactgacgattgtgacaccggtgttcttaatcacaattacagctcacaaacataagacagttgcatcgactatctgcagaatattttagatacaaaaaacagatatagccttacagccattgagagtgaagaatacgctaatccataagtgtgacaaacatcaggtgctccaaacgggcttcctttctctttgcaaagagcaggaatgatgatgagaaaaatattgccccaattgcctgcatccaaccaagggaaatgatcaacgttaggcaccggaagaaacaaaacgagggttgtagtattctaaggtgtgattattcaagttcagttagtcctctaaattgtcccattcaatgttatcaagtatcaattgactacagactcttagtaaggtgtaactgtccaagttcagttagtcctctaaagtgtcccattcaatgttggcagaaaatattgtacaaataatgttataaatcctcgacatgttcaatcatgatcttgtcctaagatctcctttttgttacatgtacggttcaagtccagcagaggtggttggttatcagtattatggctagtacaatggtccaacaggactacctgatctataccatctgaaatataaagacagccttgtctgttgtactcatattggctgatttgaattgtgtcaataatggcctagtgggatgctgggacaccttaagattggatcattggactggtactggtaatgacttactgtatacatacaattgattctcagcttttccatttggttatccatgaagaggtaatgtttttgacaatgacacttgcatgatgcgttgcatactcagattgacattgatttgtagtagtactataaactccagaggaataaccaacagaaaataaatataagagttttataactataagtggagctttgcataagcatgagaagctagcacttcataaagcaaagagttttccacactaacatacatgggcccaaacatccacacaataaatatgtatgtgaaggatttgtactatgtttatctactataagggcatgaattttaaaagatatgtgctgtcgatttacaagagcagaggaactcctagttaccagcagaacagcaacccaaaatgaggcctcttagcctagccggtgctctggtgacatgtaccacgatccatccaaggattaacccaaaggtacaagcaagaagaatattcacaggcatgaaccacctgcattgtgggtaaaaagaaaataattgttttatttcagttgttcaatgacagtttggcaaagaaacatgggagacttacaatttagccaagccttccaatgtgattgtttgtgctaaataggtcgcaacaagagatggattaaatacataaaatactatctgcaggcaaaaaagtttatttattcagagatgatgtatggcttgtattagcaaaatatttactacaattttgcacaattgaatttaccccaatcaccacaacttacattgtttagatatttccgtgcatctttgttcagtatgccaacaaaatcagttgccaggaatgatccaacaccagtaaccagaagcatgttcagaaccggcacacatgctgtaataaagagctccaggaggcccatgattgttgtagcttagttcaacaagcagtcactgttccctgtcctgaaaagtaaaaccatcaaacatgctaagtgcatcgcaactaataatagttctcatgtttcatgtcgagaaatgcgtatttgatcgtctaaaagataaacttctaaaataaaaaacgtttttttttgctacaatgatgagaaaggaccattattggaccaaatgtcatgtccatggtacagagattgcaaattgtacaactgttttacttcttccttgtctccaataattctactacatgcgaaaccaaacaagttttacttcttccttgtctccaaggattctactacatgcgaaaccaaacaagaagaagggcgaactaccagtctaccacaaggaagaaaaactaagggctagaggataaataaactaagaagttgattttttttttattttttagagaagggtattttttacccggcatctacatccaaccggatatatgcggccatttaaattaggaacttaaccccgcaaacaacttaatctgaaattcaacccaatctgaaattcgcttctatggagatttgaactcaaaaccttaaggtactgctcaggtcactgcaaccactaggctacaagaagttgatgcagcgaagtatcacaagattagcttttaaaaagagcaggtaactgagattctcccaaaggagaagaacactacaggagcatgtgaaatgagcttcagagtttcagacttcacatggtttcgatccacccctatatcgatatgctcatccatgcaaagtgcaagatcaaaacagctttgaactgagtcaatgcaaagcgcaagatcaaaacaactccaaggagtcagtcaactgtacaaaatactagagctcgactaccttatctctaaacgacttacagaaacagaatcgggagaatagggaggaatcctaaattcctagcctaattcatatggaaacttaattttaacaaactctaacatcaactccaagtgcatgcagctcattcgcacagccgtgcagcaaatgccatcagtagcctgatctgatcgtcgccgacgatggagcttgcactgtactatactatttactgacaaactaaactgtagcttacatctgccaatcatctagctctgactgatgactgatcgaatgagcacactccaatagggagagtactatagctttgactgaagaacaatttttcttcttcttcttcttctttttttttttaaaaaaaaaacagatgcagataggagatagcaacgcgcgcgggcacacgtcggaatcgagatctcctccgggatcatgcggccgaggaggaggtcgacgacgggaggagggcttggaacgcgtaccttagcttcgttcttgctggcctgcacgcgccgccgcaaaaccgccgccgccgccgccaatgaagaagatggagggagatgaagaaattaaagcgcgcgctcgccttcgattccgagagaggagaagagccacctggccgataccggcggagctctgcgccggcggcggaggtggcggcggccgacgattccgtggccgccttttcttctcttcttctccagctcgggctctcgagggtgtggttctgaggcttttctcactgaagattatatatatattgctcgttcgagttcaaagtcgtcgaagcttgtcttgaagtgtgggatcgatctccgcagaaacgtgccgtgtatgcgtgccggtgactcaaggagggttcggcttatctgatacaggtgattattatcttgatatcttgtcatgttttgtcttttattagtattgatattgttgactttttttcatatgaggtttgtccatttgcgtcttattattactccttccgtttttagctagtcaaagttatattaagaaagagattaaaaaatactatatatatgtaatacgaagagaaaatgagaaacttaagttattggactaaaattatattatttagagacaaagatagtagtacaaaagaacaatgtaaatactctatttgtccaaaaaaataataattttatctttaatcataggtgttcaaaaataagatagagtaaaaaaattgtctctggtagctaagtgataggtaagggtgtcctgaaagaataaaatttatcgatttactagtcaagggtagattaaagggacgagagcaaacttattttgggacaaagcgtagatgctaagttatttttgggacagagagtactgtctattttgttgtgacttgttttataattaaatgtattttacatatgacttatattcttattatatattttctttgaataaaatgaatgactaagtgctcattcgaaatgcaagtttgaaaaaacataagaatatcattaacacaaaactatgctatgaatacatatacagaacatgaaaacacaagaatcttcgaatagagattcatcaagcaggatcacaaagctactcaagcgaacaaaggaaatattatttcatcaataaaccttcgaatattttaaattgtataatactatgatatagaattatacatgctagggtgcaaaaatataataatacaacgaactaaaaaaaaagaagtttccaatggagaaagtttgaataataccagaaacgcttagtatcggacgtctgacgtatcgtgaaaaatcggatggacaaactactatccccatatccacttcatatatccattacatgacataatgatctttaaaatatttttttctcctaaactacttatccaatcgatgatatgatcacactattatattttttataattaaatctttacaacaagatatcacatcattacattccgatgaaagaaaagtatatgtttcaatccgttaaaatttaatgtttcagacacgatagcaatatgtttcaacacatgttttcattatgtttcataaaaaaattttaaatgttttgataactgaattttttatttcaccatatataacctaatgtttcataaatgaccgagaaaaagtatgggatgtttacgccactactctctcatgccattcgattggctttctccccacaccatacatgtatgcatgtatttagtgatcttaaaaatactttttcttccaaactatttatgcgatgagtgatttgatcataccgttgaatttgttataattaaatctttacaataagatatcacatgactatattttgatgaaagaaaaacatatgtttcaaacaataagaacttaatgtttcatacgtgatagcaatatgtttcaccatgtattctaattgtgtttcacaaaatttttatatgtttcagaggttgatttttttgtttcaccatgtataacgtaatgttgcaccaacggtcaactgaaacatttgaccgtcctattttttttatatcatcgggcgtccgatttgtagctctctccgaataatactcacaagaagtataactactttggctttaatgggctacaaagcctgaacatgtcaaagcccaaaacttctaccccgaatctttcagaaccggcccagcccacgagcttaacccaaaaagcccacaacagcaggaaccttctagtattctcccgtccagcgcatctggaccgtccatacgacaaccgacggctggatttccctggaaggcctttatatgcgcttccagacgctactcgaagcaggaaacccaccaccgaattcgtccgtactcctcctcctgcttcccctccggcgacggcggcgcagatctccggtaagcctcctccgtctccgtttcccgcgtccgattgcgtatgtcacagcggttagcgtagtagtggtagatttgattcggatttggattgactgttcctctctcggttgtgatggatggattgattgatgttgtatttttgcgtgtcttattatctatctatcgattcttatcaggttggaagttagggtgttcatcttgacacaaaatcatgccgaaatca

SEQ ID NO: 65814 - DNA, 27121 bp, Oryza sativa
  unsure (1)..(27121): unsure at all n locations
aaaaaatttgtatcccgaatattcgtgagaaaaaaaatcgaatgaccaatatattttcaaatttaatgcaaagattaagttgatgagaaacgacgagcaatttattttatatcctaacactaacacacgtgaggcaaacaatttattttgtactcagttactttcccaaaactttggcaatagccaactcttgccattgccaaaaaaaattggctaagactacaaacgacaccaaaccaacaggctgttggagatgtttggacttgacctgaaccgtccacatcttatgggcctctatatttgggccttacattttcccaaccaaaataacaatacgaatcttgatgggaagtttagacggctgagatttcgcggtaaccgccattcaaacccgccaccgagttccccgccccaaactccgccccgctctctccgaaccatcaaacaatctcgcaccactttctctctctctctctctctctctctctcgtcgcgtgtcgtgtcgtccggaaatgccgccggtgtcgtcgtcgacgtcgaggccggcgtcgctgccgtcgtcgccgcacaggccggcgctccggccgggcagcctgcagcggctgctccggccgccggacccctccgacgacgacggcgccgcccccacggcgccccgctcctcccgcggcggcggccgcgtcctgctccaggtcaccaacatcacccccgcgctctccggcgccaaccctttctccggccaccacggcttctacctccgcctctccgactccgcgcgctcctgttacgtctccctccacgccgaccacgacgacctcatcctcaccaacggcctccacatcggccaggtcatcgaggtcgagcacctggtgccgtccgtcccggcgcccgtgctccgccatttccgcgtcctccccggccgctacccctgcatccagcaggaacccgccgacgacgccgccgccggcggcgccgcggcggagatcaaggaggtcgtgtccgagcgcccgcgccgctcgtcgccgacgccccccatcccgggcgagaggagggcgcggcaggcgggcggcggcggctccccctcttcgatcagctaccgccacaggtcacggtcgatatcgaacttgtcggaggcgggcgcggcggcgaggaggagcggcgccgccgtcctggggaagctgaggaaggtcagcgtcacgtccatcgacggcaccagcaccgacgacgacgacgaggagtccgacgtgtcgtcgctgtcctcggcgaggaggaactgggatttcaccggaggcgtcaaggacaggaggcccgtcgctccacggagacgcgggaacagcgtaaatccatttctttgaatctcccaaaatttcgcgccaaataacacacaaattgcaacaaatcaaagctgattcggtcaatttttggtctatcatttaggtttctccaagtaaatccggcccaaactctactatcacgcagaatgatgatccgatggagtcggtgaggaggaaagccgagaaggcattcaacgtgctctccaagagggcgtctgctaagatgaccagagaaagctctaattgcacggtggcgacgccgcagagcgctgcggcgtcgagcagcatcaagtggtgtgagagcaatgtgatgtggagcacactttcatcaagcttgctgaagcatggaaaggtatactggtatatctccctagttgattctactgcatttttttttgcttggttctgttctttcaacaagttaattctggtgattattgtttgcccccaattgcaggaagcagtgaagcagagagatatggcactgcaggctgtgcttgatggattgctagaggcatctaccactgagaaattgataaaatgcctgaggtgagtgatgtttagagcttatgtagaattggcgagaatgattgggtgaaaattttacatgaggattgagaaatttgggaataatacagtctgttagaacagtaaatttgattgatatctgatttcacttaattatagaattgtatgatcaagtttctatacttgtaaataacattgcaccatgtaattgatagttcatttccccctctttttgcagtacttactctgaactacaatctgacaaggaagaaaacccaaaggagctcatcgacaggttcttgaaattctctcaggaactggatcatgctatcttcatcgcccaatcacagaccaaaattaggcatgtaaaagcatgtggttccaattcaacatcctcagcttcaaccaaagctgctttgaaggctgcattggataggaagcagtctgccatcttatggatcagagaagccattgaagcagacctctcacctttttctagccatacaagacccactgaatcaccaaagctatcactggcagagtcaaagcctatgaccccattgttctgttgttccaagccaaagtgcaactgcagcaaaaggtcctcaaggaaagcatctgatggttcctctcaaggaagtaacatgagtgctgccatggacctggctgtagcactgagatcagagtgcaactgttggttcctcaagtacatcgacaagttcttggacgatatcgaaagcgagaccatgtatgcaccatgtgattcccaagttgcaggccttctgcagcagcttaaaagggtggatgactggctcaaccgtgtcgcgctacatgagaggatgctttcggttgaccgaacaaacaaggatatcatgttttctgaagaagaggagagcgatgcgtgcgagagggtacggagaaagatttatggagcccttttaaggcatgttcaatatgctgcaatggcgctagaaggtctaaatggtgtaattgatgaagagaaggacgagagaaaataacagtaactgtgcaaagagctttatcaatatatagaatgaacaaataaattttgtgtagctgcagataatataagtttaccatcgtcagaattctagctggtagaagcatgttaggcataacttccaaatgctgtctgataaatgttggatgctctgatggtattgttgcaactattgctaatcttgtctgtgatgagacatggcatccaaaaactaacaattgcctcaagtgcgactttaaggccatgaaagatctgaatagtactattggtgaacctaagtaggacattgaaacaaagctgaggatatctggtgcaatttacactctgatcaattacttgctacacttgtcattacatacttgcatacatgctcatgactgcatctcacatttcattacatgttcttcggtacatttcaatttgtgttgatgtactggtgatgtcaattgtcaagtgtactgcctttttcaaagttagggcccctttgaatcaaaagaattatgaaggaattttataggattgaaatcctataggaaattttcctatgtagccctttgattcaaaggattgaagttttccaaatcctacaaatttcctatggaatggcttatagtatataggttttggaggaaacttagcaagaggtccaacctcttggaaaaaatcctttaagtctatctctctcatccgattcctgtgtttttcctgtggtccaatcaaacgatcattcctatgtttttcctgtgttttgcaatcctctgttttacgcttacattcctgtcataatcctatgtttttcctattcctccgtcttttgcagggatgaagcaaagggtttacccctgtgtgtctctgggttagtatgtgtacaacaaattttgaattattttttagaaattagcctacctagtacctctcttttgataggattaagcttgtattattcctgtcaatgtatatttctctctcaaaaaaataaacaaggtataggattagtgttacaaatgccaacactgtgacatgaaaaatactcatctcaaatggaagtcaatcatatcacttgatctttgatcattaacatgatcatgattacttcttcttatggctttatggtaaatgccaagtagtaggaagaaaaatgaataaagttacattacatgtatgatatttgggactatatgggccagaatcaattaatctctatgcaattcaatgttagctctgtatatccgaggcgatattatttttgcagagaagagatgttcagatcaatattgctgatgttgactccattgtaagcgattggtgcatacatccacgtgtcatcagagcttagcaactgcacatgatagtttgcagcaaagttaggaaggtatttcacttactgtttatagaaaaataatttggttattaacaatccttggctagatgacaatgatatgtaatgtacccaccttaatctgaagttgcaaaaatttgacatactgcactgcttcctccagcattgtactgatgtcaacctgtcagatcatacttatcaagttacacccaaatttctttgtaccaattatcatgctcaaatgtatgaggcaaaaacttagttattgcctgtagttaagtttcatattgagcttacctttgttccattgggaaccaagttctgcaggatcctcaatctttcattgatcctctctctcctcttctgtagaacggacaaatttaacctcatcagaattccttgaatcactttgtcattttttttacacattttattttatttgtacttacccttgcatagagactctggggatcggttgccgccccacggttggccctagtacccatcttcttcgagctcggcttcgcgttgccctccaggtttccttcctctgaggtgcaactgctagaactttgcgtatcaatgtaggtgttgccgccttcgtcgctgccaataggatcttttttgccagccttcttgctcttctttgatgcctgtatcagttcatcaatccaattaggcatggaaaataaaacagcatggtaactgaagtagatcactgttctattaagttatttgcaggggcataccgtcatggcagcactagacttcctcttggtagccactggtgtaacaacctttgtagcttcttccactcttgctgatggatggttgccatgtggagggctgatcagatcctcagtaaggtaggggatggcgcaatgcgcgtcgagatcggcgatcgggaacggatccatgaccgggaactcaaagcttccatagctatgagctggatcagggaagctggtgacgctagagctatggccatgctgaggccagcattgtggaggcacatcgtagttgagacaaccagaagaagaattggagtcggtgtcaaggccaggcaagaacatcgctgccattgcctccatggactcatccatttgctcgtaggtgaagcagtgatcaccatgagctccaagaaactgcgccatcgcgtcggcctcgatcaacggcaccgctgatgtgtatgatctctccatttcagcaaggtgaaaaggcctcaaggcaaagaaaagcactagcttaattagagagatgctgccgctatagtcagctgcaatggctgagttgcttctgccatgcgtgtgatgagagggtatttgtagggtgggtgcagctgggtggccaccattgctgaccacgaggatggagacgccacacaaaaacaattaatcatcaccaattgtttcttgttcttggcaaagaaatgttatctccaatcctcagaggtcaaccccgtggggacggtgctatgtttgatggcggccggattcttgatcttgatatcgacagtccataaacaaaaccagcatgcgcaattatgtcgcggaggtacggcgagtattatttatcttccaggcaagattggtatgatggggattgtttagccttgaaccaagagatgcattggcctctggccatttgcgcaattactactctcccttgtagaacgtgggaagtggtggtgagttgaagcgagaggcggatgcaacgcaagcaaattaaagattattgggattaagctcttgtgtggcttgctcagtatctaaaaaagagttcttgtggatgctgcattattgtggtgaatgatcagtagatacaccagttcatgccgttgtgatctcgtgcttgcaatgggagctgcagaaactacatatgttgccatttcctgcaacttggatagctgtcagatcctcaagatggggggaagaacagattccattgcacggagctgatgttgcaacaaaagttcttttgtgctcatttgatcttgcataacccatgtgggttcaattataacttcaaggtgtaatgtgaagattgtggcaagtcgtttatatttacaatagggatatttggttatcatcacaattggtaagtggccaccaatctttgtactatgaactaaacagcagtaatcaaatatggatataactatgtaactgttctctttttctttttctgttgataaatgctgacttcttttttgggtggaagaatatgcaaagtacaatctccatgtgagactttcagactgaaaaagggtttgcatccgatccaggcaatgttattggaaaaacagaaaaaaaaaacttatcttagctctatagtacgggataggtggttggatctgcaaaactcaaattagtcttaacttctaaaaaaactataactaggcatcaagttgctttttgtattttctgatcactacatatgtatttttttttaattagagttctacagttgattcgttgctgtttgtgacttatttctgaacagtatatttgatatggtggtgttcttctgaatgaattgacaagagttcctacccttttgcttcaaagaaactcttgctttgcaaatgtttcataaaatcaatttaaattcgttcattctttcacttatatgagattatgagcagcagatacattttttaatgggagtattctgcacagttcaataagcctaaaaataattagcattagttccattccagacaattaaatatgcttgttcagtacagttcaataagcctaaaacaactttcaataaacataaaagaattatcactagagtgaattaaatatgaaaaatcggtgattgaatctattatactatacatccatcgaattctttagcttaccatgcatcgttatttaactaatctctgtaaatgattacaacaatcaactaacttgagctatccactgatataatttacattatataacgttattaatgatagtctaagtactttgtttgtacttatatttcaattaaccctacaactcgtttagtataatcttatcatgatagactagtagctattctgaaattttgttgcatgtacttctgaagcactcttaaggctaaaattatatctctctctccttaaaatattaagggtggctccaagaaggctagaagtcaatgtacttgcaccatctctttctccaagttatcgcttttcagtcattgttggatcaattgaggccacaatctattgtactatttctcaaaattgactcacttgatatatattctgcacccagtcttaactggcaaaaactgtactacatttgtgagaaaaattagagtatgttgtcggctagaggttaaaataggcgatattttgcaccttgaatacttgatgttagaatcaactagggaagagaacaaatggtgctgccaaaaaaaaaaaagattgtaaattgcacgcaactcttttgtctttactccagacagattacttactgctaactcattgtcagctaaggcagttgacatttgcttactatgatattagactattattatttttagattattagtaattaacagagaaatatgcatacataagggtttgttttcttcactaaaattggttgactctcggttcataaacagagaaggaagtttccttagtgtcattaaagtaggtaaacagatttctgacttgttaataaaatgtacatttggatttaattataccgacttcctcatgtgtttttcctgtcattctgagtgcattgaacctatatcaaagtatgcacctttcctcatttaattacaaaattgaataagtctaacaataaagtttatgctaaaatacactgaacattcttaattttagacaactcttacgaaagagtatttcatagttgagttaataatccaggaacaaaaaaagcttagccttggctgtcactcttgtcacaaatctaggcagcagatcttgtgttggaataaaaccacacacacggaatcggtcagcattaggcagcactcatggttcattgcattggacgataattaccctaatgctttcactactaattagcactaaaccaaactattatgtatttaatcctaccaaaggcttccctgatccatggcaattatcaaaatgataaacttagtggttttgatgctaagatgcagtactactgtactgcttaagaatcaatgacatgaattatattaacatatcaagaagatgcacgtactcccctgcagaacagaaggattatcgaaattggggtccaagttgtttaatgattattcgatccttgtcatgctttgacatgattaaactacctaaccaccaatccctaaccacctagcatctaattaaactccttgtctgatgtaactaacaggattgcataaagtaatcaatcaagtacaactccatggaccaaagcagaaacagaaaaacaattgttgagtttactaagaacactagaccaacttgcagatcttagcataacacgtaatcagacggggggaagtggctattgctggctctatcctgcttgggttctttgttttttttaggccatcctcttgttgaggttactggaatgatgatgcagagtgtgcaatattgttttatataaaaaggacgctttagtacagtattgccctttattagacaattgccctttattaagcctcgtgttgcatacgtacttaagcatactgagtacttaattagctcctgcttattatagcctaaactttttttttgaacgactcgcacgagacagtgcgaagttctattgatagagcagaaaaaaattacaagattacggtcctggagggtcgtagccaggaaaaggaaaaaaaataccaccacccacgcaccgacatcaccaacacacaagcccaggagaaggctagcaccggaccggccgccgctaagcgtgaccgaccgccactagaccgacaaagggacacagacgagattgcccccaaggggatgccagaacgacgtcttcaagaagagaagcgacggaagaccgccgccgccgtccgttgggactcaaaggagccaagactgagctttcaccaggcaaacgccctcaggaggtgagacagcacgacaatgccctcaggagggtgatcatcgttgtcggtccggccgaggccggactaggttttcacccgccgctcaccacctacgaatccacggctgacgcaccaaagctccaccaccacactagcgtcatagcctaaacttctggttagcatacaagatattctacaaagcagaaccaaaattttcatttcttgatcctatcgtcatttgtataagcaagttccaatgatcaaatcctggttctgttgaaaccacagcagttcagttcacaaacgtcagaggctgcttacaagcttcctggaacaacaataatgtaaactatgcaaaatcagcagaaaacctttttcttccttgaaaatggttggtaaaacgaaattcactgtgcagcctataacttgtccggttaatccctacaagtaaggaatcgaagatgattaatttcacacctattaagattccagcaacactattaatttatcgtcccgttcttttctctaaagatacaaattttactcggttttcgttagtatgttttttaaactactcaacagtgtatttcgtgcgaaattttttttatatgaaggttgttttaaaatattagataaatccatttctttaaaacttaattaattgatagatttcttgttttgtgtgctctaacgttatattcgtatcatatcttactataaagttattccccactaactccttaagcttaacatgcaaagatgccacatcatcatccactaattaacaagatgccacatcatcatccactaacaatcatcacatttaaacatcatgcaaacatgctatatctttatagtttttataatttaagaacttttcaaatacaaacatgttaaattatcatccaacataattcacataatgttttaatgtatatctttattatgtgttatgatatcctatatacttatatagttcatcctcacttagttagtgcttaaatgattaatctctggtacaaattatctttcttcttttttcctctaattaagtcatatcacatcaattgtttttagcatttagatgattaatctacggtccgaactatctccctacttttttttcttccataaagtcataccaccttactttttacatttgaatcaccattctacatactatttaaatttaaattatcataaaccacattaatttacttaatctgatgttatctagctatcttacacgctaatttttttattgttatcacactaaattcccgtagcaatgcgtggggtttcagctagtacattacaaaagaacatatggcggcttagacttaaactccctaaaggttaataatgacaatttcgacaaaaaatcgtccttattaattccatgttactcttgaaagcgtttaaagggaaaaaaatagtcactccccatgatcatagatataaaaaccagacagtcacttaataattcttgcagaagagaagttcataataatcccatttccttaatagcttagtcctattttgattcagtacgatcaacaatggcgatagtgtcatgatacctcattaactacaccactaatccactaactactcacaaaccgatcttgaaataaaaatgctagaaaccgaatatatataatttcgatatgtaattaatgccggttgagtagctagaaagtgggaaatcccggcttacgtaacattgctttatctaagatcctaagataaacattcttgtttttctattcagcacgtgtaatgatcattgctagctccgtttccaagaattctgatattttcacatttttctggagctctgaaattttatttagagttctcacaacaaataatctccatgttctagaatttcaatatcttcaaagcatataccaacaaataagaaaaaaaaatacagagttcttcttttgcaggaaattgccgtcaaacttagtgatgggtctttgctcataattcagtagtagacaatagtgacatttttcttagataattaatctccattacaaaaagtttgatttaaattactttagttggacaactgaagcaagttcttgggacttagcagcagtcggcatggacagcaaaccttagccacgacacacactgaagaaagacaaatcgatggtgccacctaacaacatttcgatttcttcaggtacagatattccaactggcaatatgggtagattatgcatatgagtcatatgtgacaggcaaatataatcaaattatgcgagttaatttagtttccttagaaaagtagagatgaacatatgctggcgatagttaataccactagaatcctcgagatatttcttgcttttatttattaagacagctattcatggagaactggtttttaattaagattaaagctagctttcatggggaagagaggactagctatagggagcaagaattccgagtgccactagagcaagttgaagttggtgagatctactgcattttttaaactcaatcagatcctagtattaatgaggttttagatgcagatatacaccatttgtcatgctcggcttccaggtccttgatcattgtgtttccccaggtatcatatatctgcgtggaacacatcctataaaaatatttcagttctgtggactaaaattgcttcaatgatctctgaattcctaaatgcagaattacagtatcagtcaaatcttcatcctatgaaatttgtttgtcttaattgtacatggaatttatgaactagaaatttctagttggtgaacccaagagtccaagttcaacttgtctaaaccatacggattaatctttctgtttcatatttttactaaaatgcaaaggacacaatcatgccatagaacatgatttccttgcattttcagagaccaattgaaccggtggaatatagagaattcacacaaattcgacgaatttcccctataacatatgcttatccaaatatttgaaatgcgaaaagatttttttttgtttctacaggtatttagctaattccccattatctaaaaaaaattagctaattccctcatgaaatttataggttcttatagattgcgtagctaatagaggaaggaaatgtacttatctacaccattttcaatatttttaacaaataatgttccacaagttttctacgagtacattcttagagctttattcggtttggaggaatttcaaccataaaaatagggaaaatggagaaatagaaatgcttgcacacttcaatccattggaattttttaaaaggttgaagtggatgaaaattttcctataattattcctctacaacttataaaaaaaatttccttcggttttcctatactgacattccttggtgacatttctgaaagcagcagactgagttccctttaattaggcactggattttacaaaacgggccgaatttagtcgagtgaactcgagtacaagcccattttttctaggcccaacagatataactcgcagcccatctcacggcgaggagcgagctaaaccagccggcctttccagaagcttctcctttatataaaccctcgccccgccaaatccccaccgctccaaatttcgaaaacctcctcctcccctcctctcccccaccacgagacctcgcatcgaatccttcctaccctagccaaatcatcgccgccggcatgagcaccgctcccaccggcgatccgccggtccgcgtcgccgtcgctagcggcggtggcgggatggggttggggaaggagctgcgggagccgccgtcggacggcgtctccagcctccggttctccaagcacagcgatcgcctgctcgtctcctcctgggacaaggtgagctggagcaaagcaatcacgcgctccgatcggtcggatcggcgcctcgctggtcgcgcgcgccgccgcttgctatttgtttgggaaaaaaagcaaaccctagcgtttgggttggtttgatttgatttgatgatttgatccatggggttttgatggggggagctttgcttttggttgcgggtgtgttcgccgtcccgcagacggtgcggctctacgacgcggaggccaatgtgcccaggggggtgttcatgcacgcggcgtccgtcctgggttgctgctttcacgacgactcctcggggttcagtgccagcgccgacaacaccgtgcggaggtgatgccgatctccttccagtcccgttcgattggttcttcattgagcgattcagttgagataacggttgcactcttagttcactattgttttgtgctgttctgaatggaattggggctttctgtaaactaatcctccatttcgcggacgtacactatgatgttaaaaataggatatgggggtaattttagggtttgatcatagtatgttacgaacttggatcaacgatcagtatcaaaattgtgctaattcatattttgcttttctgttagttcagatcactcatgtaagttgaagcaaaactgatggcttgtgtgttcctggaactttttttttttttgcaggttggccttcagttctggtgggaattatttcttggtacgccatgatgccgcagttagttgtgtcgagtactcctactctactggtacctgttatcgcattttcatctagctgaaaagtgtcgttgattcacccaacttgagtttttactttttagaggagtcccttccgccgacctggcagtttttagagaagtcgctagttgaattcatgattaagtttctagatgaggcaggtctatctcttggaatttgttaatttcatcctaaaaagtactagagcagtgggatcagaacatttactagttgatttcatgttttagtccctcctgagaagggtaatcctatcctagtaagctggttaatctgatttcagaatgaaattccttctttgttaaagacacataaccatcttttgtcaccgtgctacatgagtttttaaatagtttggctatgttctttaccattttaggttgaacagtttatcaaatacccattccatgtaggagtagttgcttataatatccatcttctgtagctattgcttatattctttttatggttgacatgatcattcaatcatgttgtattcaaaggtcatttgaatgtgaattcttcaattgtgtggtcccaattcactgtccagaatggtcgtcagtaactgttgaatgaatattgattaatcctagcaggatagctatctaatgggccatgttgtttactcgttatacctgcatatgtatcgttgatgaatattatagtaaacagtgcatgaatttaggcttaagaaatttgctactgtgtgaagtgatccttgcttactgctacatcacttcagtcaccactttgtgaaatgttttggtaaattctatctacctcttgaatcttccaatataacattcttaatgtatgtacacactacttttgaaattttaagcacgaagctgatgcctgatgccattatactatgatgatttataatgacatcaagttataattaactaattttacttcatgtttatttgcgtcactgcattgaagtagccacttgcatgaagatattaagaaaccaaccatatcaaagcttaaactgtctccttatatatgtggcagtcatttcctgtaaaacctcaattcagttagtgcaataattgccttacaatttgttgcttcttaatgatatcatggagcattttgtgtttacctctaccatgtttcacgccaggacaagttatcactggcagctgggataagactataatgtgctgggatccaagaggtgtcaatgggacaagtcatcatacacttgttgggacacataaccaacctgaacgtgtgtactcactttcagtatcaggatataacttggttgtcgcaacagcaggaaggcatgtgaatgtttatgatttgcgcagtatgtctaggcctgagcaacagagggagtctccactaaggtatcaaacacggtgtgttcaatgctatccgaatggaactggtaaggcactgttacttgattcgagtatttcttcgaacacttaagatctatgtgtgctaaataatgcccatgatatgttcactcttttttatttgtgagcaacataaaactgtgctaggtaaagaatgcttgtctagtttgatattgaagatccttattggtcagttggaaatagactatgaaactcaagtcatactagcttgtaataaatttctacatggttgctgttcccctagctcttgagttccatacttgcatgtatgattgaaatataaggtgcttgaaattcattcgattatattgttattgttttcgtgtgcctgacttcagctgatatacaagttgcttcaaaccatcatttttgtattggtcatttcggctctgttgcttctttacaatatacctgatgtgtttcctaatatactgaggtatgtggaggcatctcatatgtctgttattgacatatgcaattgatgtggaaatcatgaatgcacatccatgtattcttcattaccagagcatttgactgtttcatcttcccacgcctaatttctgattacatttgctgatttgcatggcagtggcaataattataaatttaataacaagagatatttttctagtttttgcaagggttctagccttaaattttatcttgcacgtaaaaaatgttacccaatagtggtcccgactactgaacatgaaggcaccatttttcaggacaaaaggcacaggatgactcatgcaatagatattttatttcgatttcaaatattcattttctaaagtaggtaatgcgaggatatcatctcttgaactaagtgacagctatcttttatttttatgccgtcttttaaatcttcttttagtttcttattaaaattcagcaaagcaccattgagtaaggttccaaagttttacttactagtttaggctttgaattccttgacataactttgatacaggatttgctttgggttctgtggaaggacgagttgctatggagttctacgatcaatctgaatctgctccctataagaagtatgcacctaagctgctgaaggaaaactctttcctgatagctatttacttaagctgatattattagctttgccggagatcatctttttaatctacatattctgctgtgttccatttatatacgtagttacatgcctttattctatccaggtatagtttcaagtgtcatcgagtgcctgaggatggagagaccaaagtctatcctgtcaacgcaatttccttccacccagtgtaatgaaatccccactgatccctcacaaacggttgattattttccgtttctttaatggcctcatctaacatatgcagacacggcacatttgccactggtggatgtgatagatttgtgaacctttgggatggcgctaacagaaggaaactgtttcaagtaatagtcccgcgaactattttttgaagatctctaattctctattctgtatcacaaattcacatcagaatgccttagttcttttttttttcatcttttggttgcagtttcccagatacccatccagcatcgctgctctgtctttcagtagggatggccgtctgcttgctgttgcatccagttacacttacgaggagggagacataccgtaagaccagaatttgtctaacccaactattctctgtcagtattaagtattaacagttgaaactggttctcaccagcattattttgtacaatgcagccatccgcctgacgcaatctttatccgtgatgtcaacgaagtacaagtaaagcccaggcccaagatcacattcactgatccgccatcagtagcgtccccatcagtttgagatgaagcaatgctagtgaggtgcgtgtcttcccccaattcgcctgcttccttcgttagttctgacgctttccaaacttgagtgctcagcgttaaccgttaggtgaaactgtggattatgttcttgatagtaacactggccatgtgacagactaagacagtatacactatccttgtgcggtagtatgtgcattgcgaaagacagaagacggtatagcttggggttattaaatcactaaaattcccaaaggtacaaactgctggtaattctcaacgtataaactcagttcagtacgtagttcgcctcaccctgccatgtcgagtccaaatccctcttgatcgtctttaataaaggagaaaaggatcagctcatttatgacagatccaactggatcgagcagcgagacccacaaacctagtattatactgctaataatattatggaattccaccaacatatgtagacagcaactcgtggggattattctccacggagacgattagggaggcaccgtgcggatctgctcccctatcgagcgcacttaaagcgttcgtgagcgagcatgtgggaagaagctagcaatcaaggcacagctaatgttgcttccaattgaaaattaatgccctgagtaaagtattagcttttgattctgcgaaatactaataccccacgtcgagagtgagtggcacagctgcaggctgcagctagttacagcagcagttgtatatatatgcctttgtcgatctgcctttgtgttttagattctggtacccgtgtggttattaaagcgcgaagcgagatcatcactgatctaagtgatcagctatggctatactgccatactggggcgcaactaagtgtgctaatgattgagccatgccgccaaattgtgctacaaagtataattgagcacgccgctgcacgggcacgcggtaccaaccgtccgttgtgcacacgttggctcacgttttgtcccaaattaatgctagtgttagtgtttctgtagtctcaggagcagaattaatgagtttgtactttgtactagtccttattttaccaaaccaaggttttgaccttttatatgacgtacgtattgcatactgacgacggaatgctcttgcttccaagccgaaatagctgtggatttgttagtgtttaattcttggacagaaaaagatgatttgaacgtcatatattgtggattagaactttcctgcgtgaacattttaataaaggttcttcaaaccgtccattttaatgttgccagaaaacaacagttcagagttcagatatgtatcaactggttaaatcattgttgttcatggggcggcctgtgatcaccgtatacgtgtggagctctctcccctgcgaaggctctcgtggcaggtgaggtgtctcgcccgtgcggcacacctggggcgaccacgcccaataacgtgcctgctcccccggcgtgcccagtagctagcggcacgccgttgtcgctgtcctggcagttgatcgatcgccggttggtcgagccctgggccgtcggtgcacccagcgtccgccgcgtggcaagtgcctgtgagtactggccagtgtcttgctgctcgagtactgaagcgtgttcagttcccattggtagcctggggaccaagtagcaaggaatcaggagtctcaggactgcaaggtgctagtagcagatggatctggtctggtgccatgtacacggcacacgtgcatacgctttgcaaggattcgcaacgagaattttgcggtggtgccgtggagctatacgtgacaaatgtggggccagcttccttttctgcgccgggcatatgctagcttgagtgtgaaaaatattactactccctcctttccttgttatatgatgttggacgtcaaacaaataaaatcagataaagaatacatcactaaacagattttagaagagaaaattacacgaacaatggtcagggatcaagtcgttctcaagctcgggatgaggtgaatggagagaaagtgtaacttacccatgacagcaacggtaaggagtaaggacaactatcttcttatattaataacgagctcttccgctccttcgatgctagtgacacataaactttggtatagagtatctatgaatcagggttttgggactaggagataatggagaggggacgatgaggatatcttatgagacaatggaatgggtggactgcgagatgagacataagcgttggtgctggagttgtgaggatagtgaagggtgctagggttgtgaaagagtggtcagatggcgggttggtggtggcgtctctagtggcttactccctccgtcacaaaaaaagacaaaccctggtttccgtgtcgaacgtttgaccgtccgtcttatttgaaaaaaatatgaaaaaaatttaaaagacaagtcacgcataaaatattaatcatattttatcatctaacaacaataaaaatacgaattataaaaaaattcatataagacggatagttaaagttggacacggaaacccagagtttgcctttttttttttttgggacggagggagtacatcgttggacatatagaaaagatgatgggaacgggacatctcaatgttacctggtttagggaggaaaggacgatggtccggtgagccttgccagcatcattggtaacttttgtgctgatgaggatgaggtagagtagggaggagcaccgtgacggtatgagtgagctttgtatggggattaggggaaatatacggtcgaggagtattgtattggcacttattttgatacgatttcagcctttcaggtgtctaaaattcatgtgatttttgaagaaaagaaatgtgtgaagtaatgcattgattgataaatagctaaaaaaaatcggttatttgatccacaatggataacctagatagaacatccgttgctattgtgctttactgcagtatatacgaccaccgcttcatcccaatgactcgatttgttcatccctgtattaggctgtattccatcggaagcaagccatcacatcccaatcgaccgtctcagatcctacaacccggaaccccgcaaaccaccaaccattgtatcatttcacacagacctggatgacacgttggacttcgcctcgccctccgactcggagtcgtgctgctgctgtgggtcccacccacccttcccgcgcgccccgccgccggccgccactccgcatccccgcaccagtcactccaccgcgccccgcacccccctatatatatggccacccgaacccacgcctctctccacttcgcccacgcacaccaccaccactctcccctggttacttgtccaccccaatctcatcgctcttagtcaactccgccgagagagactgatcgttctcgttcagctctgctctgcccatggcgctcgacgggaagccaccggtgccgccgccgtccacgccgccgatggactcgtgggcctgcggtggtcgccgctccaagcgccgcggcggcggcggcgggagcagcgggagtagtggcagctccggcggcggcggcggcggcgagtccaagaaggagtacctcgcggcctgcctcttgatgctcgcgcatggcgtccgcgacgaggccgaggtcgtcggcgtcgcggcggcgacggcgaagccacagcatgggtacgagtgctcggtgtgcggcaaggtgtacgggtcctaccaggcgctgggcgggcacaagacgagccaccgcaagccgccgtcgccggcggccgaaccggcggccggcgaagagccgtcctccggcggggtggccggcgaggcgaaggtgcaccgttgctccatctgcctccgcacgttcccgtccgggcaggcgctgggcgggcacaagcggctgcactacgagggcggcgccgtcggagacgccgtcaaggagaagaactccctgaagaccaaggcggcggtggcgacagcggtgctgaaggacttcgacctgaacctgccggccgcggcgacgacggcgggggacgaggccgagagctcaccaccggaggccaagagagcacgtctgctgcttctcgtctaacccgcggcggtggcggcggcggcggcgncggcttgtggttttgatggtttaggtgcttagccgttccggtttaggtttcagattgataccgggttgttaatttcattgattgatttattttagttcacttctggttgggcgatggagacgggtggcatgataaacatgccgtgtttagatggtttactgcaattctagggagctagaaattgtcctgggctccattttttaaatttttaccatgtataccagtacataatttgatacttaaatcaattcgattatgaaacccaaggcggactgataccattgacgacaagtttgctgccaatacggtgattgtgatttctatgaatcgccctctcggcctctcaatcgctctttctgcttgtttgggaataggaaaccctagttgtttcttttggtccacgtacgggtcgtcagcgacggcgccgcttgtgaaggtgacggcggtctccttgtccgtcccgtcccgttcgacttcgattggtttttggatgagcgattcaattggggcaagactactgcaagtgtaatcaagtattgtttgcgactttgcgttgctctgaatagaattgggttctctgaaaattctcttctccattctggagacgcacatttataatgagaaaagttggatatgaatatagtttcaggacatttgtgagttataaaaccagcgagcaccattgaaaattcggagttgtgctaattcatctttctcttttctgttaggtctgatcagtaacaaaaatcgaagtgaaactgatgcttatgtgttcctgaaactgtgttttttcaggttggccagcagttctggtggaaataatataatggggccccatgattccccagctcgctgtgtcgaatactcctacagtcctacatgcaggtaggtactcgttattgcgttttcgtgtggctagaaagtgttgtttgactttgtaaaattcattttttttagaagtcgctagttggaattcatgatatagtttctagatggggtaggtcttctaaaccctgccaataaaaaatgtctatcttctgaaatttgtcaattcgacctcataatgtgctagctgagttcaggttttactggtaaggaggataatcctatctagtatcttagaaggaacttccttcttggtttaagacaaacttttatcacagtgctacaacagattaaattgtttagttgtggtttttatccattttaggccgaacatttatccttctgtagttactgtttatatttctgtatagtcgatctgatcatggaatatatttcacgttgtgttatgcgatcatttgaaagtaaagtattcgctctgggtccttcggaacgacgagttgctatgattaatttgaatatgttctctgactaagtatgcacttaagctgcaaaaggaaaactttcatgaatagctatttactgaagatgagacattactagcattgccacgtgatcatatttttaatctacatagtctgcatgctcataggtggttgccattgattatctgagaatgcaaggaacatcgtttatgttgtcaaatacaatttcatcccactcaatgcaaagaaattcccttgatctctctccaactgtttcgattactttgttttctttaatggcctcaaatatcccacatttgcagatacggcacatttgcaactggtggatgtgacagttttatggcctttgggatggcgctagcaaaaggtaaattgtcttccgtgatatatttgttgaagaactatgtatgataacttcagcgtacattattattttttcttcttttaattgaagtgccccagccctcaaatacccatgtaacatcacttcttgtctttcagcaaggatggccatctgcttcgctgtcgcatccaggtgcacgttcgataagccgtaagggagacataccttaagaccagaatttggctgggacaagtattccttttcagtagggatggcaattttacccacgggttcgggtatccatacccgatccgatggtatgggtatggggttaattttttgcccgtaggtacgcccggccgtaacccgaaaatctaatgggtagtagccgggttttatatggtaacccatacccgacccgaaattaatgtagaggttgattttggtctatctctcatacctattttcctttgatctattaaaatcttgaactttgatgaaattatgctagcttgtttataatttgtattgctctttttaaccattggtgataattttacgatttactgattttattgctctttatttagttacctttctattgagatatcaatcatatgaaacccactgggtatccaccgggtataccatacccaacgggtatgggcatgggtatgaatttctacccgccaattctatcgggtatcaatcgggcgggcaaaagcgggtcaggtacggacttgctctacccgcacccaacccgacccgacccattgccatccctacttttcagggtactaatctgtattctcatttctcacatcatttgcaccctgcaggcataagcctgacgcaatctttatctgtaatgtcaactaaatggaagtaaaccagaggacgaagacattagcggatccctatcagcctgagatgtcagtgaggtgcgtttcttcccctcaatttgcctgtttattgttcgttggttctgacactttacgaaagttcttagcgttatgctcaaactatggattctattaattgacagaaacacattcagtagtatatctgcattagagaagttacaagatggtaggttgatcaatcatctgaggtagtataaactagctagtgacaatatttctccactgcacgaatgtataaaccgagttcatcaatcagcacgcagtaattcacctcaccctgtcatccatgttgagtccaaatccccattatcatctttaacaagtcagaaagaaatcatctcatttatgaccgatccaactggatcgagcaacgagacctacatccaactattatactaccgatgataatgttatcaaattccagcaacataagtagacattacctcgtggggattattctccacggagacgattagggagacaccgcgcgtatctgcgccccaaatcaaacgcacttaaagcgttttgtgaaggagcatgtgggggaagctagcaataatcaaggcacagctaatgctgcttcccattgaaaaattaatgcgacttggtaaagtattaagcatatgattctgcacatttctgcgtaatacatccacgtcgagagtgagtggcacagctgctgctagctacacagcaagcagagtagtatatatgccttgatcgatctgcctgtgtgtgtggtttagattctcgtacgcgtgtactcactcgcgcgcggagagcgagatcatcactgaatcagctcgctatctcagctatactggggtgcaactaagtgagctaatgattgggcctttgccgccacattgtgcaaacaagtagtgtaaacgatcacgctattgcacacgtcggttcacgtttcgtcccgagtttaatgcccacggtgtttagtactacccctttccaaaatgtatgatgccgtttatttttcgtacaacataagcatagtacctacgaaatatcatatttggtatcaaaggtattagatccggtacctataatatcatacacattaactatggataaaaacagtatggaaactttctggattccgaacctattttcgaaaacagtatctgtcggtcataatttttcggaaacggaaacggaaacgaattcggaaatattttatcggaaacggaatcgaatatgataatggcagttttcgtcggaactcggaatcggtcggaaaatttcttggaatttccggaattaagaaggcccataccgtagtctataattcctccccagcctatcccaattcagcatactaattccaagtcactcaattcagcccaacccaatacacccaattcaaacttaagaattggacttgacatgattgtgttttgtgatataatgttaaaatatgagacttgagaattagatttgatatagtttaaagcttagtttgaggggttttttattccgataaatttttgttactatatcagcgccggtctgttttcgctctgttttcgttttcgacaatatttgattctgttttttatccggggtttccaattctgaaaaaatatgaaaacaaaaacgataaaggtggtctgttttcgtaccattttcatccctaatattaactatttcattgtctatgtattttcggaattgaggtccacacaaacaagagtcgtgtctgatgtgcccagcgcatgaccggcagtccattatcgactcctctaagttaatctaacctttttcttttgaaacagttaatctaagctttcagtacaagtagctaggtgcctcaacccttctattttttgtcatttctatctttatgaggagctgtcaccccaaccactttgatgctctcaaaagaacagataatagagtggcctgttccaacgagcaaaacagcagcggctagcatcagtctcacctcggctagctagcaaggcacattccctaaagacactttatgaggagctggagatgattccaacgctatctatctgaagttttgatctgtgatatttcagcaattttgtgtaatcatatttgctcacgctaaagggtaaattaattgtggttgaatattcagtttagtttaaggattggaatattctaaactagctattgtagagggcagtactaatcgacatcagggacaatcttggtcatctctggtaaacgatgaatgtcctaagtcaagtgctacaggaaaatcactacaacaccaaaagactcgacaataccaaaagagtatagaatttcaaacaaaggtttccaagcttttagatccattgatcggttctagagcctagccaccttagggcatgttcagattaatatcattttaaatcattacattatttgataaagttgataaatatatggttgcatttagtttgttatcaaacattgataatgcatagaaaattttggcaacaatacatttaaactattctataaaatcttgacaatgctaccaatttaccgaaattttggaattagcaacttttgaaaatgttaattttgatagtaatctgaacagatcattagtttaaaaaatgtcctttatacgaaagcactttcttcatgatggctcaatcctcttcatgtgtagacataggtcaattgcatcagtggtagctccatagaagccgttcttccttgcccctctagatgtgaggaattcgcaatcaaggaacactgagtgaataacctctatgcccaacatcgctagcactggataatgttacatacatcctcgttcacctcgtcctaccaccttgttgtctgacaaagtcatctagggatgaacaaaaatgcagtagagttttgttcgaattttgaaattcataaaaaacaatcattcataacattcgatagaactcttaaatgaactcttaaattaatttgtttttgaaattttgtccctacccccttaaaaaattctcatgtcaaattattgaaccgtactatagttcaaaacacattaatgttcacacaacaaccttttgcatttattgcagaagatctatatcttgcaataaatgttaaataaaatatttcaaactaattcaatcgtaataactcacttttctcgaaaagataaaatgaataaatttggcagtccaataatatatatacttccataaaagcagatagatttatatccccatacaaatatttaggaatataaatgcattttattctcccacccaattaa

SEQ ID NO: 65815 - DNA, 1506 bp, Oryza sativa
gaaatttttaagcctaattaatccataactagcacatgtttactatagcatcacataggctaatcatggattaattagtctccatagattcgcctcgcgaattagtccaaagttatggaatgagttttgtcattagtctacatttgatacttctaattagcgtctaaatatccgatgtgattttagtccctgatccaaacagcccctggctggcaaattctatgaatgatgaagtaacaacacacaattcactatcaacgagcatatcgtctgccacttcattttaggtataatattcaaatttaattctatcataaaccttattaacgttgattgccttgctgaatctgattaatgtctttatgtttataataaactttattgatgctgattgcattgctagccctggctgagacagggtatatatatgaattgtctttatctgatctaacaaaatattaaacgatgaggttagtccatgcattttttatattaatttgtcctctcttcacaaagtaaataagctaatgctaacaatacatatcgatatatctcaattcatgcaaattaagatcgaaatatggcaatcgagttagctataattcccgttataaattccaacaagatactgtctccattccaaaataagtgcagccatgggtatccgtgtaccgtccatctgatttgaaaattttataattttttaaaaaaattagtcacacataaagtactattcatgttttataacctaatacaataaaaatactaatcatgaaaaaaattcaaataagacgaacggtcaaacgctggatatgaatttttataaaactacacttattttgggacgaagggagtacatatttttcctttgttaccgttagcacgtttttcaaactggtaaatggtgtcttcgagtgaaaactttcttcatagaagttgctatagaaaacaaataaatccatttattaagtttttaataattaaaattcaattaatcatgtgctaatgacttatctcgttttgtgtgtgtacttaatcttcatcttccatcagcttcaaacgggccttaaatctttttacatgagtttatttaatcctctagggttaatttaattttggtgacgtataataattgttttaatatttatgcctttaagggtcagcaaattaattttttcttgatctgaattagaataaatttaattttattagtccataaatttaggtttgaataacacataacgattgccatatatatttctgtgttatatctatgtttgcaaaatttggtctttaaaaaccttaattggatcattatttaattttaaactactaaatacactatttaaaaacgtgaaataaagtttattgatgcttttggggatatttaaaaattcagagaacgtaataatttctagagattgggcatgagtaaacaaatgtagtagtaggtttatatttcattaggtaaggacattccctgcgattgtttttctatggaactat

SEQ ID NO: 65816 - DNA, 1078 bp, Oryza sativa
ccaaacacgtgaagtgatgaaacatgatgagatataaattccgttttttaaacatatatatgatgcagttgatttttaagatacgtttgttcattcattttattaaaaaaatacatgtaattaccatttatttttgttatgacttgacttatccctataggttatttaagcattatttatatttttttttatatttgtacaactttttgaataagatgaatgatcaagcatacgtttaaagtcaactatatcatatattaaaaaacggtaggagtactccatactgaactaataccgtgtgcattgagggaaggtgggtctaatatcagtggtgtcctgcattgggcctgctcctatttggatgagacaactgtttatattttaggcaaaaagtagagattaaatcacttcattttaatctaaaatctatgctttccactagaatttaagagttattatagccatgccaaacaaaccctaaaagctcatgtagctcatctactgggcatcctaaaaggaacaggtgtccctataatcataagttagcttgtaaagttaatgtagatcatatactgggcaggctacaaggaacaagtgtcccaataaccaccagttagctcgccaaatcatgtcaatcaggtcagataatcactaccagatgagagagcgaacgaatatgttatctggaggccctaattttgccattgtttagttccaaaaaaaagaatttttaggtgtcacatcggatgtttgactgatgtcgaaaggggttttcggacacgaataaaaaactaatttcataactcgcctggaaaccacgatacaaatcttttgagcctagttaagcagtcattagcccattgtgggttactgtagcacttatggctaatcatggactaattaggctcaaaagattcgtctcacgatttttatgcaaactatgcaattagtttttatttttatctatatttaatgctttatacatgtgttcaaagactcgatgtgatgtttttgggaaaaaaaaattaggaactaaaccaggcatgagtagccttatttttgaaagtgcaacttacag

SEQ ID NO: 65817 - DNA, 1213 bp, Oryza sativa
ttttttatcattttcaaaaggacataaatgcccttggcttcgatagcatgtaagaatgtaaccccaaccagacccaatcatgtcgcacttgtcgttcaccccacatctgaaatctgcatccaacctaaccctaggtggctggtggtgacggtggtggcttcagcttcaaccgtgactagaggcggcggcttctgctttggctgtggcgggcgatgagcggtttcttctttgacggtggctggtggcggtggcgggtgagcgacttctgcttcgacggcctctggcgatagcagtagcagctttggcttcggctaggggtgaaaatggagcggattcagacggatagtggtcataccatatcctaaaccatattttttaagcggattcgaagtgggtgcggatagtgtgcggatgcggagtgaattgtttcggatgtcagaaatggtgtggagtcggtgcggaatcggttcggaaacggattaaatttatcggatgttacgtgcatatgcaatcaatgcaacatcgagttagcaatccaaagaacaataatacaataatcaataaatgacctctcataataattatatgattaagtgctaaacaacatgaatacatgatgtctataatataaaaaatatagatacgtgagggtgacatgaaacaataaaagccttagactaaaaaatctatgttaattgatgaattagggcattggatgtaccaacttatgttatatgcaatagatagagtggttatatatgttgataatttcagattatccggcaaacggcttatcggataatccgataaaaatgtcggataatccgcatccgccggattttatagataccatatccgcatccgcatccgcctcatactatccgcatccgcatccatcggatatctaaaagcccataccatatcctcgtttcggacggattcggagcggatcggatcggatattatccaatccgttttcacccctaggttcggctatggctgcggctggtggcggtggtggccgagcggcattgggaagtgatagtggtggtggtggtgttggtggagcaaagatggatggctcggcttcaacttcgttcttgcatcgccacaccggtggttggggttacatgctactgaggccgggggcatttatgtccttctgaaattaaagatcaaagagccgatcgactgacaagccaatgaagtaatt

SEQ ID NO: 65818 - DNA, 3099 bp, Oryza sativa
tacaaatagtaatagattcgtaactgaatttggagcttgtttgatctgttgccttgaaatattttaacttactagaaaaaaaaatgcccgtgcgttgtaacgggtgaacgctattttaatcttattatacggtttagttaagatgaaatatactttggaaattcgcatggatgtatattctgtttttagaaaatcatgagctgcagttaagaatccgatcgtcttaagttagcatgcaagtttttataagagatttattatacgactcttatatttccaaaagcgaacggacttaaaaattaactcaaatacggatatgtatttccaaaagcaaacgaaattgaaaaccaactcatacacggatgacgtaccaaattaccggtaaaaaacatcttcaatttttataatagtagacgatgattttggaaactattactctaaacactgtcaatgtatttaaatagtattttgtggcggaagcagctctatgataaaaaaaaatagaacagagatggtcaataccacaaaacacccaatacaagtcagcacttaggggtgaaaacggtcacagaaattcccgatcgaccgaccgagcgccgttttcgtataagggtaccgtttctgacggtacctttttggctatttttaaattttgttttttctaatttctttctgcatcgtattaatgtctacactgagtagtttagatgataaatatggtcaattactagccgatcgagcatcgtttctgaagagatgctaccaattctgatcgtttccgaccattttcacaccttttgaaactataggtgccggaagtgctaaaatcggcacttatagatcttttcccacctccacggactaaaaacacaaaaaactggtggctttaagtgattataggtgccggttatgtaaaaagaacgaggtgtcggtttttttaaaaatcgacaccttttaaaaactgagccgtgagtcgagccgccgagcagcagataagggaggatagcgtgcggcgatgagataagtctctctctcggtctcatcgctcctctctctcttgcgtctctctctctctctcatcgtgcctctctctctcgcgaagcggcggtagcactggcctcccctttgccagatctagcgggaggggaggcaacgacaacggcggtctcctacgggtggcggcgacggcgacgtcgatgggcttcggatcccacgggcgacggcggtgtgctccccactgccagatccggcggcctctctgtccacctcccctctcctgcctcggcctctcctctccatctagcgagcagcggtgaacgacggtgtcctggtgcttccgccttcggtgagcacccgtgccgacttgcattatctttctctctccctccatctcgttctactttaaccctatcttcatttctagatatggaaatagcttttatccgctgaatctagtcgacggcgatgcgactacatgatttgttggtggtttttatgatgtttgattcaacgatgtgaaaaactgatgaacattcgatccataaacttgttgttgattgtctgatatgtagttttttctttttatttggatttttggatttatttctggcgcttcgatgcatcggttcggctcaatttgagccgagccagatctttttttcaaatcctatacctcaaaggtgctggttgggaaaaccaacacctatgggggtttctcaatcggcacctattaaggcttttggtagtattggctcaacaaatataaccgaacacaactcataccgacataggcgcaaccgcatgcccgtgggcccgtgcacggcacagagtttccctatgcatattgatgttgacaattagcatagtcactaaagcggcgaaggggaccgatatcaagtgaaagacaaacgattggagcctcggcgtgaagggttgcgtaatcacgaaattagaagatgaaactgttggtttttttttttttttgacacgccgataacacgaactggatccacctaaaattttgcggtgttatggtgttgccaactacctgatttttctgtcacatttcctctttttggtggattcatttatgttctttgctttctctacacggaatccttcatttcgagcacaagaaacgcttgtgcaaaacaacaccatcttttttcttttgttgtcccacacgaactgaaaatccgacatgactagcatatgctatatagaaatcctgggcagattggatgtcattaaaaatcattccaacttttggttccttggaagcatcacattcaggtgtccaacttgaggactgaaaaactgtgtgctgatggttagaatgatatctccatagtaagcaaatgcaattgatgttcttgtacttacacagaatggtgcactccatgatttctgcggtgtgatgcacatttgagttggagtagaaatgttctttacggttgattcagcgtcagaaacaatctcatggggctgcaatggcacagccatgctcacctcaccatcggactcaaaaaatagttgtgcaagtcagtacagacccaaattagctccaaacattgaatccatagggaagtacagagcaaaaacgaaaaaaacagaagctatattgatacttcactgtgtaccttatttcaatgaatcaaataacacatttctttctcctcactgcaactgtgcttgtgggtgtgcgaggcgatagagcacggacaactcctagtgtgcatgatagtaggcgccactctcagacttaggggcggagtgcttgtcgaacaccttgagggcgacgaagtagctgctgcgatagttcctgcaaaaaatatgggttctgtgaaaatgtagccgaatagtgtacacacttgcttatagaaaatatgaagcttcacctagcgcaaatcagatctaggtgtacgagcaaatgcatttggcaatagttgtgcaagtcagtacagacccaaattagctccaaaacattgaatccatagggaagtacagagcaaaaacgaaaaaaaacagaagctctatttgagaacatatcgaaacttcactgtgtaccttatttcaatgaatcaaaccacacatttcttt

SEQ ID NO: 65819 - DNA, 667 bp, Oryza sativa
tatgggacggagggagtagcaaaatttatacatgcatatatgatgtattggatatatgaaaagtatgtttcaaaaaataatctgaaaagtatatgttactgaatttatcgttagaatacatatatactaaaatagatacaagttttgtgaagggtcgaaaagatactttgccagtcgaaggatccaacggtctacaaaatccagagcaaaaattggattgtccgcatttagatgacatggcacgttattgttttgagaaagattagttttttcactactttagattgctaatattcttttattgacaggttcgtctgatgggaggagagataagtatcaaagaaaaggaaccaggggagagaggaacatgctttgggttcaatgttcttctgaagactagtggaaaccaagcagctgaagaagatatagaggaagggccatcaacagtgagtgaattagacatccgagcctcagtgttcagggagactaactgcttcaagggttggcattgcatcctctttgttcatggtgatgagaccagaagagtcttgcaagcttggatggagagcattgggatgaaagtttggatggtcccaggagttgagtccatctcttctacattggagaaggcgcgatcctcccgcgatgattgtgatgtcgatcgatg

SEQ ID NO: 65820 - DNA, 4135 bp, Oryza sativa
cccttcttcttggatgatctgtctgatctcttcatcggaaggtccgtaaatcggcatgtagaatgtttcaaacttttctttgtcaatcacaccctgtcaattactccaaaatctcagcttctcaggatgccatagatagtactaatcatttgttcgttagcaaatggtgaagttctagcaaggtaaaacagttaaatttaccatagtgaccatgtcacttagggtcatggctgtggattcccatgcgtgcgtgagttcggaggcgagatcaacagatcgcctgcctgcaagtgagagtaccattcggcctcctgggaccagttctacagccctcatcttcagaaacgccatgaaatccttcctgaactgccgtgcataagccccaacgaccacggctcgtctctctctcctcacgttcgcgtcaacgtcgtatgccggaattccgttcatcttcagatcttcaggagcctgctgccatgaaattgaaacaaaattttcgcctcaaagaataataaattcagaatgcatgctggtgatcagtactgtatgattcaaatttttattattttctaaactttttatttaaaaataaacttttataaaacttatttcaaattctgaaccttttaattacgctaacgtgacaaataacaatgtctgcaccacccatatcgagcgtgatagttttgttctatcacgacagtcatggtgtgtggtagaacaacgctgtcatgccagacaaactagcgtgacaatgttgttttgcctctgttagtatggttagaaggttcgtatgctcaaaataagtcttaaaaaggttacttttattatagaagaaaaaaaatcttaggatttctgacctcggagagccagtggaggctgttggacgagcagacgagatgcagggattcagcggcgaagagcctcccgtagaaggagccaggcacgacgccggtcaggaggacaggctcgtcgccgttgtttcgcctgaactccacgaggctcttcaccaccgtggcgaagtcgttgtcggggagatcgttgaggagtacgcagagctccgccggtggcggtggccgccggagcgcgaggcaccggcggcggaaggcgtcgacggcgatcgacgcgagcgcgagcgcgttcgggccggatgagcagcccaggtcggcgatcaccatgcttctgctgcatacgaggtcggcgatggcgtcttctatcagcggcctcatcctgttctgttcagcgttctgcaggtgcgttttactcgggattaacagcttttctgaaagccaaaaaatttcgggggtgactataaacccgaaattaagaaaatttcggaatatatcggtccgagaacatttgtattttgagcaaatttgaagacattttgcaaacttcttttactttatcgaaaagtctgacttatatatgttcagttgattttcattttttctctctataaaaaaaaataataattacattcttcctctaagcagaaaagatcataggcaattgttgattaactaaaaaaaattgtagattaactaattaagagcagagaaacgacctgaagaatggagtttcgagcatagcttgtttccccttggcctcgattcatatgtaccatctgtttggatgccatggtttttgcctaatttgcttggagcagcgctgaacaccagatacttcatctgctagctagagctagctagaaaaaaacgcagatcttgtagttgtacactcaccggcgaacactaggtatattcttttctgtgccaatcatatggcataactattctggctgctaatatatagacatttggcacaattaattaatgccatcctgcttccttttcaattatagaattagtacatatggagtctgaaagtttcagcggtacgaaatatcaacacacgatcattttcgtagcaccatcaacatgtcaccatcagttggcctgtttgttgcggcgttatctacaccactgccgccacaatatcctagttagcctcgggaaaaagtttaaggtccattaatgtacatactacatccatcctaaaataattatcgctttaagtttttatttacaatgtttgatcattcattttattaaaaaataaaatcattatttattttgtttatagcttgctttattatcagaagtactttaagtataacttatcctattttatattaatactaattttttaaatataagacgaatggtcaaacgttacaaacaaaaagtcaaagacactacttatttgagacggaggtagtactattattattgtccctagttggcctaatctacacaacacccgagcacaatgacaattgctcattcccaaaataaggccaaaaatagagtaggtgtaaattttcaggaatcgcactttgaaaatctcatataaaaatgctaatatacaatcgattgtatatatatgacatcttgtcacaaatggattaaagatggtaacagaatttcagttatttcatgtcttagattatcagtcatatcttgtttaccaatattaacttgtgcaaaagcagtgccaaggagcactgttttgattcttattctcacttaggagtaagtaataatgaaattggagaaaggagcatgcacaagccactggtggagaaaccatctttggtcggtcgaccagatttcacagtagtctcggttgtattaaaaaccgggactaaaaatatctttagtcctggtttaaaagctccaggggtactttccaatctttagtaccagttggtgttaccaactgggactaaagatctatttgtagtcctgattgataacaccaaccgagaaaaaagatcgccatatactcttcaccaccttgaagctctggaattgttctgccattttcttcagagtccactgtttcactatgttctccgtacctgcgggtagcgtgaacgtctcgagcattgtggtccacatcatctctttctctgattctgggacaaagctgtcattatccccgcgtgcccttgttctgcgccagtacaccgtgctgacaggcacgttatccctcacaacccaaccactgtggcgtacaaaattcttggctgcttctaccggggcactaggtcggccgtcttcgtccaccttagttatgatgtgccgaccctctatcttcttcgcggcacctcgttgtccacgtgccctcttctgtccagcggagggatgacttccactagcctcctcctcctcgttcccctccgcatccctctccacgttcccctcctcgttcaagtactggtttggatcctcgttcaagtactggtttggatcctcgttcccctcttcttcgttccagtactggctgcttccctctgcaattgtatcgtacagtatctgttcctcatcgcgatcagccatctgtgcatacaaaaatatttgttaagtctataggtcatatttgctaagcgtaatattaaaactctactaatcttatattaaatatctaataatcttatattaaaattgtagtaatcaaatatgctaagtctaacaatcttatattaatactctaataatcttatattaaaattgtaataatcatatacgctaagtctaacaatcttatattaaatctctaataatcttatattaaaattgtaataatcatatatgctaagtctaataatcttatattaaaattgtaataatcatatatgctaagtctaacaatcttatattaaatctctactaatcttatattaaaattgtaataatcatatatgctaagtctaacaatcttatattaaatctctaataatcttatattcaaactataataatcttataatcttatattaaaactctaataatctaataatcttatattaaaactctaataatcttatattaaatctctaacaatcacttctttacatcacttgcctgcgcgaattccttcgatggctagctaccacttcggcttgagggacaacgatgacgtcttctctgcaacattactaggaaaatgtattagtctaaacgggccaagttacatatattgtatttcacgttttaacctatatatataatcatatatgtatgctaagtttaataatcgtttaattatctcgttcgtacgggctgcagga

SEQ ID NO: 65821 - DNA, 4797 bp, Oryza sativa
tttccgtaagagggctaacctgaaaataacaaatgaggtgctttgttaccagcggtgtcaatcattaagtggaacggagtctactgaagaagggaaatgcatacacattcagggcagctccatttatcagatgtgatatttaagcgaggaaccaaacatttcctgtgaaatgcataagtacaagttgaacatggtactagattgtcattttctccacatttctggcaagcatcttctttctgcacacacaggtgaataactacaaataaatacaggaccattaaactgaaaatagatatatcaagaaatacataagcatatgaaaattacaggaagttaagaaaccaagccccgaaaaactgaagctccactacacatatgagaaataaaaagccaagtacaaaatcaccaaacgaggaaaaatggaaatgagaatgatgatattggcatgctcccttttgtttaaaaacagattgaattaattttcttacaaatctcagcaaattgccaactcttctagtttatgataaaatctttgaaccaacaaaataatgtaagtttagctatcacgacaaggacagttagaaacaccgtcatcacctcttatcatccaacaattaaacttggtatactaaggcatcgtatatttctcaggatgcacactagagactgtattttttcataatcccgaattagtagctgcttaacgtagcagacagatcaggcctaaattcaaatttcagtaccccatcggtaccaagcaacaaactcattcaaccaaatcacccactggctttctcaaacaccagccagccaagcttaacctatcaccgccaaatccctaaactaatcctcccgcttctcagcaattaagccatttcacaaccgactaccctagcaaggcagccatcaaattccccaaaaccagaagctaaaatcctagcatggcagcagccaattccacaaaaaccacagaaatcagagccaattcagcagtaacagctttagaaatcagagcaactgagaccaaaaacagaagagaagagaatcagggcccccctgatcggccgccataccgcgtcctcccgctcgatccgctcggtggggccgtcgctgtgccgatccctccccttcccgcccccgccgcgcggcgggaggtcatcgtcggactcatcgagcgtgtacagcggccgcttctccgaccgcacccgcagccgctccaccaggctgctcatcccgccgccgccccccggaactcccttccggatcaaaaccctaaaaccacccaccctctcgccgcgccgcgccgcgccgcctcggagttgggggggctagggtttggtggtttttgggggtagggagaggggagcgtacttatacccccgcgtgggggagggggagggtgaggtggcgcgtggagaggaggcggcggaaatggaaggtagtgacggcgaggggaggcggcggcgaggcgcgtgcccctcgtgtgggcggtggaggaggcgggcggcgaggggacgcgtctctctctctctctttctctgcgtgtgctctcggactcggagagaggagggggaggagggaggcggtggtaacggccactgcggcaagggatgtccaggggcagtggcggttttgcgattaggctcttgggatataagacaaattgcgaccggattgttgtaaggagtaggatttatgggttcctgtgcttgtttgggaatcatggacctttttgtggaaatttatttctcatggtgttgtacagttgcaagattgggaaatcttgttttcctggtgtgaagttatcaaaaagtaaaagttgttgttgctcttttttttccacgggtgtattaattgttattgaggtttgttatattaggtggttgtccggaaataaatatgataaatgttgagatgagtaaatagaacataccttgaaagaagtattctttgtgttatctctattattttagaatgggagttccatctgtccctcaacccttctcatcctgccaaagttttgttctcttgcttaaaaaaaccgttccaccaaaagaaccagttgacccacatggaaaccgtcaattgagaaaatcaaggataaaaaactaaaccatgtgaaaactttgaccgccctttacaggatcatgctgcccttcctagtttggaaaaaatcagaaataaccatatagtatttgtaatcactatggtatatacatatgtagtaagttaatagcataaagctattcaagcaaaataggaatgataattcatacggggaagcatcactagtccatgacccttcccatcgcacgcaaagttcggttccatcatgtacataagtaaattgctccacccaaataaacatgttgacccatatggaaataaattcgttgagaaaaaactggaataggaaaaattaagggcttgttcacttcattgaaaaaacaattaccaaatttcggcattaccaacctttggttaggtaaggcgaagattggtggtgttatgtttgtgaccttaccaaactaaaccacatgaaaaccgttggtctggcttttcccgatatccctttgctcttcctatgagaaaataaattaataagtatatatatttttaatcactactatctaaatacccacgcattgcaacagattactcaaaaatagcaaaaaaaaaaagtgcgtccatgttgaacaaatattaacagacttggttgaaacgagtttcttcatcttacaaacaaaaacaaaaacaccatagttagtgtaccgaaacaagagtagcggagtaaagacaacaaaattactccacacaagtatataaaaaagctagcaaagcactctcacatccatgtctcacatgctagtggtggtggcagactcactactcaccactattgtcttttagaagtagtatatatataggatacatatggatagttccgataagaaaaactaaaccacatgaaacagctagcatgccctttccgttagcaattttgtccttcctagctggaaaaaaggaagaagaaataaatatatacatttataatcactacgaatatgtgtggtattgggacatattattccatcaaattagggatgataattcttgcaattccaacatgaaacatagtgtgataaaatgacacgatgatcctaccaaagtacctgagatgttgggtgattgaaggaggatgtagtggagattactttttaagaaaaaaaaagggaatatgaggattcataacgagcacaatgaatagtaaacagtaaggcaataaatttcttttaaaaagacattgaaactacgcatctgacgagggtgtcaagcttcacttagagagcaactaataagtcaacaacaaagggaagcggtttggcagtagaaccatggatacgtgacttcttacactagggttcgaaaccttactgggcatatatattacagtgtacaattatggttgcaataagaatatagtgaggtcaacaatttaccactagcctttgtgtctttgagagtgttataagcccatatgcacctaggggtagttgtatttggcgtagaggtgagttacaacatattgcagcaactgaaataaggtaagttttgtctcaagaagcacatagagatgactacagagaactttttgaaggtgacaactttggagttcatacgagctttttaccgttacctatgtaggttcaaatttgtgtggaaaggatgggcaatgttgggcattactcatacattgttagtttgatactctgaacaggattcataactttagggtagatcgcaaatgccatagttcatagtacttcatactctacatggtcttgcacacgagtagaaatcaaatttgaagtgctccgacatgtaaagtcaatgggagaatagctactttagttcctaaagtttctctgtaggatctatttagtttctaaccttataaatggtccaaagaaatccttaaactttatcataaggcctaaaatagtccttgggtccaccaaaatcatcatatggatatgtcatatcatcattcatgtaaaatctatgataaattgtccaatctacccttatgtatatcataaaaaataaatataagggtgaatttgacataatcataggaaaaaaatacttcttttttttcacccttctgaggtatattttttctcatacatataccatatatttttgtaacttttttccttttgtttttttattttcctatgcataaaggtaaattggacaaatcatatagattttgtatgggaaggtgacatggcatgtccatgtggcgattcaggtggaaccaaggattatattagcccacatgacaaatttaaagaactagtttggacaatatgaaagattaaggactaaaataatccaggagcgaaactttagaaactatattagctattctccctaaagtcaatcatatcctctacgcgtttaagcgttttgctctgctgctgaagacttagctacatttatgaactcgaggtctgcaacctggcagtcttggcactctagttcagtgtaacatgtgaaaagagaaccaagagttgctctgtagaatatgtcaaaaataaaataccccctccatccctaaatatttgatgttgttaacttttttaaacatatttaaccgttcgtcttattcaaaaacttttgtgaatattatttaaaaacttgagtagtagtagtatatttaacaatgaatcaaatgacaggaaaatagttaatacttatttaaatgtttttaataacacgaacagtcaa

SEQ ID NO: 65822 - DNA, 2329 bp, Oryza sativa
  unsure (1)..(2329): unsure at all n locations
tttatgtcacattgcctagtagaaatgaggtgtggtgtttgagagaaatggtaaaatcgccataaatgcatttacacatttctttaaaacttgtatacacttcacttgttttatttggatataaggttgaacaggcttattttacgagcacatatatatctacttaaatctcatcggatccacacaaactcggattacttatctttaaaaagcgaggggattaattcaaatcccctcatgtattattccaaaaacgcttactaccgaacgtccgatacgtggagaaatcctggatgggcccacagtcaagtcgaaacccatccgttcccaaccttatcctcattcctcctcatccagtcatccccaacctctcgcatcggcttcttcgtgcagtgcggccacagcgtcatcaggcagcggcgccgccaccgtagacggcggggtctaccgttgcgggcggccgtatttggccgttcagccaacaccgcgagaaaacagtcgatgccggttaggccttgacctcgctggtggcaacggcaccacgacaaggtacaaccgttgtcaaagaggatccgagctcggcggcggcgacacggcggcggcgatggcggtggcggcgtcaacgtcacaaggagatacgcctagcgacggttagggccctgagcttgccggcggcggtggcactgcgagggagcggactaaaacttgaggcgccgttgatggagatggccctgcgctcgccgacgaaggtgaggatggtgggagcatcgagctagcaaggatgttccatgctagtttctttatgttgcacacaagtgtttcttgatgttccatttggtatttctctatgttgcaattcatatttctggatgttgcatttggtacttgatgttgcagttgatttctttgggtgttgcatatgtttttgctcttgaagtctgtgtttttagtgtttgcatccgactgaaacattttcggtaaaataatgaaaaattcttccatgaagaatggcacatcaaagaaacaactcacaatgaaacattttttctggtgcagtgaaaaattgcaacaacttatggtcaaacattgcaacatctctttaacacgtaatagaacattgcaacatctctttaatatgtagtggaacaccgtccggagatttgtaaaactccggacgtccgatatgtagtcgtcaccatattattcggaaactcgtgatctgccatgaatagtttctgacaagattgtcagcacgaattatacgcagccgcttgctgcccgcaccccaccaattagggttagatttccagtgtggaggtgttgggcttttatgtggcattcaccatttatttatggtttatatttgttaattacctcgatgntgggaatattcgctgatgtggaattttagtcgaggaattagtactacttaaggtgtcgaaaacgtctgtgtgagaaaatagtagaaggaattaatttaacatatattctattggaattgcatatgtacatatgtgatttcgtcatggtacagcacatggtggattagctggataagtttataggatcgactctaaaagctattgacccatgcatatatatatataatcatattgcaataatatattctcatatacgatatgatctatagctagcacatgtcacatatgtttgatagatactactccctcttctcaaattgatcatcatataagtttatataccaataccaaggacaatttaaatcgcatcaatcaagataccatgtacacattctctcacaatgcatctatcaattaaaactccataccaattacacagtagcatgcacacattctctcataccgcattaattgtattctgaggaaatccgtgtccatacagttatatgataatcaatttagaaaggagagactattgtattgtagactcgtaaaactgacaagtattactgacatgattcaagattctgacagtgtacagaaaatagataatgcacatactccctccggcccaaaaaaaagacaaactctggttttcgtgtccaacgtttaaccattcgtcttatttgaaaaaattatgaaaaaaaaattacatataagacggacagttaaagttggacacggaaacccagggtttgccttttttttttggacggagggagaatttgggagttgaataaataaattggtccctaaccctaagctcatcatgtattatggtatagctagcatcataaaaaagattatggtatagctagcatcataaaaaagacaaatgcatataatgtggaccaaatgtttgaccaaatgttctttattaaattaaa

SEQ ID NO: 65823 - DNA, 62440 bp, Oryza sativa
  unsure (1)..(62440): unsure at all n locations
aacccccccccccccccccgggttcaaaactcctgggtaaactgtcaggctgcttttgtgctagctacgtggtaattatacaaggcgccccgagagagctgatcattgacacgcaatgcacagtcgctgcgaattcgtgatgggcacatatatacgtaccactgcccctaggtccccctgccggcacatgccccgtgcaggccgggacgaggcgccgtacgcgccaacaataatgcttgctcgatcgccaatcgatcgcaaacggcaaaccgtccgggcgattctaccgtggcgcacggcgccggccggcaacgaaccgagcaacgacacccccccccccccctcccctgctcccccggcgctggtcgatcggacgagaattcggccgtggcgctgtgcgctgtgcgcgcgcgacaactgggaggtacgcgtgcgtcgcagcgtgggatcgaaagtgcgtaatgtcgcttgattaatattgtgggctgtcctaccaagtcctgatttgatttgacggggattagctagctcagctgctgcgttagttgctggtgagaaagatagaggattgctgtggtgtgtaacccggatttcctgcgagaatacggtggaacgacagggattgttcgtgcacagcacagggtgcagttgtgtcgggacgatgcaccaacgccacggattggtgcttttccgtggtgttttctcgcgtgatctgcacgcgggtttcggcgcaaactcgcaaggccggcgcgcgcggcccacgaacgcgatttcaactgtggacgctgcttcgactgagcgagcccactatccttcacggggttcggcccaaaaagaccagcagcgctccctttccgacaccgagtccgtttcggtttcaggctttcagcacgcacggtcagtatgtatataaaactacaggtgcaccatgcacgcagctgcggtagtctgcaggtttacttgagagttttgtcgatggagtgttgtgggggaaactgttttaaatactcgggtggacgtccacccgtttcttgcatgtcatctaaatgattatgaaaaaatttcaaaaaaattgacatgataggttaatatgtaatatatcacttcacaaacatgcaaatccaaattcaacttctataagtcgtaacaaaaaaaataataaatttaactgtgaatatacgtatactagttaaagtttgatttgttattttcgttacaacttgtagaagtcgaatttgaacttacatgttcgtgaagtgatatattacatattaacctatcttgtgaatttttttgaaatttttttataattatttaggtggcatgcaagaaacgggtggacgtccacccgagagagattagaatccatcctcagtgttgtggccaacgatccatcgctggcggcggcggcggtggcgaagaccgtctgagcgcgttgccggacgacatcctgctggaaatcatgggcaacctcggcgtccgcgaggctgggaggatggccgtgctgtcgaggcggtggcggcggctgcccggccttctcccgcggctggtcatcgacgcccgggagttcgagcccgccgctctccgcgccggctggcacgcgaggacgaagcgggccatggagcgcgtcgccggcgcggtggagagccttcttcccggagaccgnnnnnnnnnnnnnnnnnnnnnnnnngcgtacctgctcagggacgagtcctacaccgtccgccgcgtcgtcgagcgcctcaacgacgccgtcgacagcggcaaggtcgcggccggcgggctggagctcgtgttcagggccaccggcggaggcggcgcgcccgatcaggatcagccgagcaagcggcaggcgcggcggctggcgcgcctcctggccgcggccgcgtcgccgagcctgctgccctccgtcgccgagctttccctcgtcaacctgcggttcacgtcgccggcgctcgcgtccctcctcggccgctgcaccggcctggaggagctcggaatgtaccagtccgacgcggggttcggcgcggtgttggacgtggggcacgcgcggctgaggcgcctcgccgtgcacgccgtggacgaggccatgtacaagaaactgcgggtgtcgtcggcgccgaggctggagcgcgtcgtcgtcgccaactggttctgccgctacgcccccgtctcgttcggccacgtcccgtgcctcagggagctgcacttgaagaacaaagccgtttactaccaggaaccagtaagactaagcaaaatgttggccagcacaccgcacctcgagtctctgacattggggttctcatcttggagggtaagtatctaatgcaacatcagtcaccctactccttcattaaaagaaggcaatcaactttttttatagtgtaagtttcgtaaaactgcagatactttgcaactacagatttaaaaacttgtttcacaaaactacagatttagtggcttcgtttgtcataaaactatagatactttgtataatatatcacaaaaatacagatttaagaacttgttttataaaactacagattcagtggcttcgtttatcacaaaactacaaatgctttgcacaatatatcacaaaactacagatttaagaatttgtttcataaaactacagatttaatatattcatttattacaaaactataagtttagtgtcttcattatcacaaaactacatattttagtattcttaaaacttgtagttttgggataatggagacactgaatctgtagttttgtgataaatgaagacacaaaatgtgtagttttgtaataaacgaatacactaaatctataattttgtaaaacaagttcttaaatctatagttttgtcatagattgtacaaactacctgtagttttgtgataaacggagacactgaatatgtagttttgtgaaacaaccttttaaatctgtagttttgtgataaattgtgcaaaatacttgtagttttgtgaaatttactcatttttattttttttaccaactgcctctttactctttatgtactttaattttataaaacatcccttctacatattgttaatatcttattttatctctagaatttaagtttatcatgcaaagatatctacaggattaaattgttccaaaagccttacaattattcaattagcttgttccaaacaatatatttttctcattgcccatgcccacgacgagttgtatgcagatttggatcgaaccagaggctcccaaacaacttgaaccgatgttcagcaagctgaagtccctcgttctgacaggaattttccgtgggtgcgacctctcgtggacattgttcttcctccaagcagcgccggttttggaggaatttatactcgaggtaactaaacatatgcatgctttgtcaaatctcatctaacggcacagttttttttcgtctgaaaatcactctaatatgcatatatatatatatatatatatatatatatatatgaacttctgcaggtggacaaacctttagatgccaaggcaccgagtgatatttatggcgaaatgccgaagaccgacgatgtgacatggcaggtgcctgagttccagcatcaccatctcaagcatctgtagttcagtggcttcaatgaagaagaaatgcactggaggatagtggagcttgtcaaggagagagctgtgaacctgcagagcattgctctggatgacggatgccaagcctgcgatgttgtggcgaatgaatatgttctctccggtgggatcaaaaacaagaaaccggtgttgttatcagtgtcccagatcacaggatctcctcctattctcacccttgtatagagggtgtatccggtgccttgtgctcgcaggcgagtatagggttgacgccgactcttttaaatatgttcctaaatatttgacatcgttgactttttaaagcatgtttgatcgttcgtcttattaaaaaaattaagtaataattaattcttttcctattatttgattcattgtcaaatatacttttatgtatatatatatatatatatatagttttacatatttcacaaaagtttttaaataaaatgaacggtcaaacatgtttaaaaaaaatcaacagtgtcaaatatttagggacggatggagtaatatagagttactaactgcaaatacaaatcaatgggaggatggactcagcggccgtaaagctaatatgcaaggcatgggcaccttcagaatacaaaaaaattatatggctcctactacaaaataagatttggacggtagacgctgcaaatccgacagtggccaaacaattatttttaccagctctactaaaaaaaccttgaaacagctcagcatcaaatcaaggactgcattttcgtatgccaaatataggagaaaatcatgtaaaacactgagatgtgatgctccaagcatgtacaacagcgatgaaacctagctgaattggtagataaaagggacaccccaaggtgaaaaacacaagacaaagatgataaaagagtggcatgagagatatggtgtgaacagaacaaaagagtggttcataacaaacagactgaaatgccacaactaatgaccaggaatccaggatcatatgcagcgccaaggatatcattagaatttcccaatagatcgacataggcgggactattctgtttgctttctgtttctttttcgttttcaggtctcttcacacttggtgatgttgtaaattatttataccctactttttttaacattaaataatttctatcctacttaatataacaaaagacacaaaccaaaattagggcgaaacaggaaaataaaacgattggtcttaaccaaccagaaaggataagaaaatttatactggaaagtagatgtgatggaagaaaagaaacagaaaaggtagtaaaagtttttataattaaagagtttctatagtaaagacttattgtgatcattgtttcctatttatgtttgagtgcaaagtagagaaggtaaggaagctggtatttgtgttatgtgaactgtttgagttagatgcttagtgaaagtctgcagccaaacacaatggatccaaaatgtgatgagctcttttatagaaatcactaatctgtgtcttcattcagtgttccaatagcaacagatacacaaaaaaaaagtccatttgccgtgttacgacaactacagttaatcagttattattctgatccatcaggaaaatgttcaagtgcattctgttttccattgacgtaaaactcaatcactgctttcatgcgttccgacttatcaggatggtaattcaagtgcacaatcactggcttcaacttccgcagattagcatctttcctcacagtcttgaatagaactttgctgttcataaattggtatatatccatggttcttttggatatatggagaccttcataacctggatgtgaggggaagaacagttcctcattgaaaacagcttgatcccatgatttgggttcacgagaaaggcggccagctactctatccaaaagctcaatagaaggaattgttggccttatgaagaaaaatccggaattataaacccatatgcgcattgtgtgtgcgtatcttgcccagcccattaagggctcatcaaatacatcattgaaaccataagctgtcctattgtcatgaccatcactcattgactctacatcagcatctctgtaaagatgatcaaacggattctggaagaaaataatatcgatatctgataggagcacactatatccaagctgcaagaattccctcaatatgcgaaactttagtccagacacagcatggtttccacctacctttccaatattgtcaactccttcgtcaggatcccgcctataaaatggaacacctttagacttgcaaaaggtttcagtgctgtcatccaatgcaacaattaaataatttgaaatcccaactcgtttgatgttagtaaaccacatctcaagcatctctctcacattggagtttgccaacgcaacaattagttctttctttatagcaacctgttgcaatatcttggccaatctgggatttatggattcatcagggataactgttggattttttctaatagccttgacagtaccaaaaggaccagccttatatagaacctcgtcttttccttgcccagctaattgaagcttcattgttagttcattaatctgcttcctaaattcagcatttttcctctccaacaatactacatgtgactttaggctggtaactccctcagaagtctcacaggcaactgagtcagcctataaagatagaaacataattgtaaaaccatatctgataataaaacaaatatcagtgcatctaaggttataacaaaaagtttaaacgatcaacaaggtgcattcagttttgatgtatgaagacatattatacacatttaatttatggtatacgtgtgcagggtattgaacacaatgactaacatatcctgtaacactgcatacaagccaaaagcaaacaaagaaaggattgcacttcacaagattgtttggaagacaggattatcgaggattcatgtagtatggagttgtattgagttgaatttaactaaagttatgttccaaatgtagcttacaagtttatggaaacataacacttgtaaaaataactctgtggaaaaagtttcataatcttttttttcatggtattacatggtgtggcttacatattgataaatttacttccacccctcaaagtgttactatttgaacaacaatttatacatattacaagcagtagttaaacagactgtgagccatatactttttctattagacccctggtggcattacaaaaattataaataacagtactaactacacacaggaaattaagattcaaaaaaaaaatttcaacaaaaaaaaagacaactgactgatttttcattgaaacataaattcgatgtccaggacacaagaaaattttggcctggtttggtacaatccaggcaaagaacttaacgaagtagaaccttggtatcataataactgcagaattaatacaggaaattgcaatcttaaaattggtagtgtctcaatcaatgaaggtggcaattggaactacatgagtgtatcgtgaagagtatgcacgtgtgaaagcgggggacaaaacttagtaccaactcaacattgaagataaaaattcatctccgtactcattagtaatttgagcatccccctggctaacttactgtatcttctctttcagcccaatttcttgacaatggctcattgctagtgccttgagaatcacatctattagctatagatgacaaccacttgaaatactgttgttcatagatgggtaaaaaactaaaaacaaatagatgtgttgctacaagaaataccgtgacaagctactggctgcaagcgctgccaaccaaagtgaactagtgattggccaaagatcaatatttccaaacgaattgctcattatttgtgacaaaatattgcagtgtgtgccatcaacaccatgaacaagcatataagggaccacttcaacagaggtaacaaccaaccccctaatacattcatggaatcatgggtaataatcacatagcgttgcagcaatcaaggaaaatctctattttaaggtcatacgatcctagcaattgattgactgatttgtcggcttgtcccaatacaattgccttcgtataacacaaaccttccttatcgtatcatttaagcataccttagagagttgagctttttttttcttttgggtaaaatgatcttacttttttccgagtgatctcacgcacaccgtcttactaatccatataacaatcaggattccgtgatccaatcaccgattgctactgttacagtagtccaaaaatgaatcgtgttcgactaaaaaaatgaattcccctaacattagaaaaccccaagctaaaacagatgccccaaaaccaacaatcgctaaccgccccagttcaaaccccaacgatccccgcccacgactctcccctcccttcccacgagacgacgcggcgggcggcgaaaaggcaaggggacgggggagataggcgcggaggcggcggtttacctggcgaggccaatggagggcggcgtcggaggagcgggagaggaggccgtcggggtagaggaaggcgcacacgcagccgagcgcgacgccgacggcgaccgccgccgcgatgcgcgacccgcgcgagagcggctgccctgccccgccgcccgcgccgccgcgcatcagggggccctcccgccggctggccatccgccgctcgccgccgccgccgccgaggagatcggagggaacgggagatctgggagaagggtggggcccggctactgactagtggtggcttgcccgcccgagacgtgacgctcggtttgctttgtttgtgtggagaagtgggacgaactgtatcgagtaagattcgttagtggaggaaggggacggtggatatgtagtgcaccacttatcatatcaactgggcgtacggctcagatttgaccagatttttgcaattgggagtgtactgctccctccctctgttccatccttgttattactccctctcccaccgtctcgaaatataacaaaatacaataacctataatcagataagacattttctaatactatcgaggactaagaaatgtcttatctggtcttagatttattttaggacggaaggagtagttgttttgaaatttttttcgtaattatattttttaagtttagcatttttaacataaaataaatatattatcaaaatatatctaatgttagatttaatgaagctaatttcgtgttttacatgttgctaaattatactaaaaatttaattaaacttaacaaattttgaatagcaaaaaatcacggtgatttataatatggtacggaggtagtattatatttctgtaaggaacccgtttccaggagttgacttttggcacaacccgcaaggtccctgttttaaatagtatcctcactttgtttataaaaagaatgggaggactccaggagtattcctgctggctcactgtgaaatactacttgcataatttatgtgaatttctctgtgtttcaagtgggacatatataggagtaaagagtgattgcaaacatttactagtagcatatggttggtgtagtagggacacaagtgtgacttgaaagatactccatccggtcataatttgttgaaatttatggttaatcttttaaaactttgcaatttttcaaatacttattcaaaaaaaaataatatacatagatttactgtgaaaattactagcacgatatcccacttattctaatatgtaatcgatcgtcatgatttcagaactttaaccaaattttgttctaaacatataatacttatgaccagagggagagttttagtttgtgcttgtgtcgatgattggattttgacagtgaaattttagtggtgcttgtttgaaagcataccaattttggatttttagaacttaattaattttacaattctcaaggacatgaactaatattgtggccagcatcagaacattctttttttttccaggttcatgtagaaatcacatttagtttatatgaaaatgctacaaaatccacatggaatgaaaaattttgtgttctatagaaggcatgaaattaaataatagggagtataggcaatgattttctcatgtctagtactccatccatcccaaaatataagaggcctataattttaggaaaatccatagtttgcaattttgactaataattaaactgacaatatactacgtgcttagtactaaggagtattatgtatgtggcatcgttatattcgtcatattatgccaattttgttgtgctaattttgtggttgttgataatatattatgaaataaactaaggggcaaagttttatgttgaaaaccaagtaaaagacttaatactccttatattttaggatataaagagtagcaaattttattgttgatttaggatgtgtcgtaatgtgttaataggctaggccgcttcctcgtttattgtgactttgtactgcttaacagtgtatttcatgtcaaaactctttatattgaagtttctttaaactatcaaacaaatccatcttttaaggccaatgagcttgatccaacgaagccttaaaccaagtgaatgcattacatttgacatttgtcaacgaactatcccatttgtcaactgaatggatggccacagtatcggcaaagcgaagtacaccacgtgcaaagggagaattcctggatgaatgatcatgttcttcaaggacgatatggaagaatttccaaggaatcgtgtggcgatctgctgtagcgaagtacaccatagaataattttgagatggatggctgtgaggcgttcacaatttcgcggaatctcgcttgaacagttgaacttaacaaatttcgagcgtctcaagcaggtcaaaacaatatctaaaaacgtgaatattaggaaagaacctaatatcaaataattaaaaggggtgatgcttcgaacccaggtcgtctagctcaccaccttgtggagctagttggaagaccctgggcgtttcaaacgtcaaaacaagatctcaactgcttgaggtgcatttcgaatggtttgtttgaaatttgttaaatttatttgaaattagcgaaaaatcgacctctcccaacggggctcgaatttcactattctaatgatattgtaaagattactcatgatcagcactttcagaataagtacaacaaagtttttcttttttttgaggaacagggtgtgtctgaatctgattcagaactcagaagtgtccggttcattcatgttagcattaaaccaaacaaaaaactgttgagcctgcaactctgcatgcagtaacctctctaataagcattcgttgatcaaggctggctcttgagttgtacaaacggaccaaaacaaatttttgccattaaaaaaagcaagaaaacgaacaaattagcatcgaaaatatatcatatggccgtgcaaagatagtggcaacatgatcagatcacttctcctgatagatgtatataccacacggatcatgcatgcgtgcattgcagtcgccatgcacacgcacgcaattgctcggatcacacgatggacagattcctccggtgaggccgcgtcagctcgtcggcgtcggcgtcggcgtcgagctccggcgcatcggtggacatggctttgtcgttcacgctcacgcgcgcagcggcgcgttcgccggacgtgggcggcgcggcggcggcggcggtgactggtctccggccgaacaggttcttgaacccgagcaccagccgagacttgaggcccctggtgttcgtggtgtccttggtgatgacggcggcggccggcgcggcgaggtcctcgccgtcccagagccggcttcgcgggatccggaagctggcggacttggcggacgcgcggtctatggcggccgaggccgtggccgcggcggccgccgcctgctcggagcggcgcaggcgcgtgcggagcccggcgagctcgcgctcgaggctgtcgatccgctgggtggtggcctgcatggacgccctgatgtgcgccgactggcgcagcacggcgtcgcgctggaggatgtcgccgagcgtcatgctgctggcggcgtcgcccgcggcggcggcggtggcggcgaagccgccacaagcaccgaatgcgccggagagggagctcttgaggagcgaagcaggcggcgcggcggagctcggtgcgccggcggcgccggcgtggtgatggtgaccgccgctgagcagcatggagtggtgggagtggagctgctcgacgagcatggcctgcacgacgaagcggagcgggaggcgcgggttctggacgaggtgcatgaacaggtggtgcgacagcttggtgcagttcacgttgtagcacaccctgctcttctcctcctccgtcagcttccccctgtgattctgcatccatcccaaattcagtgcagatccaacacaaaaatcattaatgccgtgtttagttccaaactatttcttcaaacttccaacttttccatcacatcaaaactttcttacacacacaaacttctaacttttccgtcacatcgttccaatttcaaccaaacttctaaattaagtgtgaactaaacacattctaaatacatttttacacaagagatgcattgaattatggtctgtcaaaatgctgatgaattcctctgaacttcttatagaacttattttaagataatggaaattgtttatatcttcggattctgtctttaaggtacatgaccattaaatttgtgaactcttaccagatttaaattgtttgtttcaagatcctacaaaattcatctgagactcatggctagaaaatattataacttgagttgtgacttgtagaatgcagggtgcaacacaatcctcaaaagctcaacttcctttgacctgtagcccagtaggataaggattgtgctaacctgtacctccaatgacaacttcctttgaactcaacttagcaccaaagcaaaagtatactaataatcagatgattaatgattagtgactagatgattagttttcagagcatagaatctgatgcatctccatgactccgtgtatagtttgcttcagcacaaaggttctgcagctaattagcctatccaggttgacttgcaattagttactactccaaatagtgctgcacctatccagtatccaagtatgacttgcattgggagcaaggaatcttgatcctacagttgagctctacgaggattgctttgcattcagcaacaaattcgccacagtgcactgcttccgaaaccaaccgacacactacttcagtagcaaaatgcttacagcttgatgaatcattggatcacgtgatgaacagttcaaggtctagcgaattttcgttcccccgagtatttaatttgactcgaccatgctactatatcaacttggcataaattttaacaaattttgggaatttgatgttgtaaacttttttttttacttacctgcaggtagtgatcaacgatggtgtacatgaggtcgtggtcgtgggcgaagcgcgcgcgcatggcctcgacggcgacctcgaactcctccacggggagcgcggccacgtcgtcgagccacctgccgtcggcgccgccggacgacgcgagcgtctcgaggcaccggacgagcagcgcggcgccggcgccggccgcctcgccgccgaggaacgccgtgcacgcgcgcagcaccgcggcggcgcggccgtggtccgtggccacctcctggaagaagtagtcctcggcgcgccgggccagcccgtcctcgccgcgcagctccagccagtccgccgccgcccacgccgccgcgaggctccccggcgacagcgccgcctcggcgccgtagcacgacgccaccgcgtccacgaacgcgtcgacggtgagccccgccggcaggtccacggcgacgtcgctgcactccgacagccgccgcttcaggtagctgctctgcgacgtgatcggatcctaccaataaaccaaattaaaaccttgctaaaaaaatggaaaaatgctcttgtgaaaaaacgtgggtagctgacatgggatccacgagttacgggttcacgtgtcagtcagttagggcatgttattataaccaaaataaactagagcaagttaacaatattgtcaaaattttagcaagatttcttatgtatttatcaaatttggcaacatttttttaacttttctaaaaaaaatagtatagttgaaaatagcatcaatttgaacaacctgaatagtaagttaaatgatctatttttaaatttcacgcatcatgaaacataatgttatttatctatacttcatcgtctcttagcttgtgacatcaacgatttggcagagacagaagaacaatccaacaggtgtacgtgtcgtactacgaaatcttggaacttattatgagagaaaaaccattgccaaacaggatggagctggaaatgtcgatctggcgaatggttccatggttccatgagcccacaaagatagcaaggccaaagtatttgagcggattggatcttgattatttgcaaatactacaaatgacagcagggttggcaattccggcactctaccagtaacaaatgaccctagtagaactgcatcctgcagctctgctacgctatccgtgagaggaaaagaacaaaaaagacgccattaaattccaacttttcagaagttataactttcttgtgtttatgcatctcgcaggtggcaccagcctcagaagttctaacttttcagcctttaaacacacggttgctgtacactgtacaaaccccattaactcttcactaaactggaatgcacagtacagcacaagaaacatttcagtctgctacctgcacaatagtactagaactcctaatgagcagcagttaattctgcaataacttgcaactaaaggttgcttaggagtatcctagaaaaccatgtcggccaagttgagcacagttaagaactgatgcagacatgacactaacgttcagagcttcctaaaggacactgatagtaaattttgaagagatctgtccatctaacccacatttattcacaccttccttttgtttggttagcatgaatgcaatgcttatgtatgtgtacgtcgacgaaatgccatggtcccaatccaccataattcatattcgaattccagcaatattacctgtagaactgcgtcaaatttaatagccaaactgcgtactacctagcacatgttatattgaagggaccaaatcctaatgataatgaatacccctattccacacaagatctcttcttctcctagccttctactactactgtattcaattcagttcaaagttcaaatcatcactgcagcctgcaaggtaaaccaatgcaggaatacaggagcagtacaaaagtgcaacgaggatggaaggcagtaacttgtcgaggcagtaacttcgctgacggttactgaatgtttacaaatccctcctgcatcccagtgctcagaccaaggcagggaagtaaatgtgctacagaattgtcatcaataattttgcctcttgcaatgccattgggagctgttcctcgtggggggcagagaagcctgtggcattgcgggctcactactctaccttcttggcccaaatttaagcacaaccaaactgctcatctacctgcaaaccttttgcaggatctcttaatgcagaaaaatttaattgatgaatgccattataatccatgtatttatgcaagttccagttgatgaaggattgaaagccacatttgccagtgccactacattgatgaaatttgcaggcacataatttcttttttaggcagaaaatgggcatctgcccaacgaattcttgtgcagtgcggctaaaccataaggatgtaacctgaaatgttgtatacctaaagaaggcagtagcccagccacagtgaatctatgagcactgtctttttggtgcaaggaaaaatgcacagtaactaatgtgagttactcccttccctttcttaccatcacaagaaacgtatgaccagatggatgtggactgatcatgcattgccatccgtccgtttctatccagccggacccgtattaatttgccatgaataatttgtttctaacagaagacatgcagctgcagcatgatctattacactattcaatttttaaaaactgccaggactgcaggacatcactaacgcagcaggttagaaaattcagtcacattctaatcggtaataatatccttcaaaaaaaatcggtaataataagatactatgtgtggtaaaaattcgataaaggacggcgttcgaaatcagaaagaaggactgaatttttaccctgtgcagaaagaaagcaagtgttcaagaaaggaagggtctttcttaccctgtgcagagcgaagcaatgttcttggacacggacgatcacatccggcttgcacggcccattcgcccgcgacctttcgccgatgcatcatcagaacagagaggaaacaaaattcaacaccgatctcccagtcagattgcgaaattcaccaccaccaccacaagaaccaatcaaccgaaaagatcaacaactgaaactgcagcaaacgtttacgtaccactcgcgcaccgcgttcctgagcgccgccggcatggcgaactcctccgccgccggaggcggcgagcacgaccgcgacgtggccgccggagaagacgacatggtgggcgaatcgaagcactcctcttcttcttcttcttcctcctcctcctcctcttcctcttcctcctcgtggtcgtcctcgtagatggtgtccacgacgccgagctcttgccagcttctgctcatctccatctccatgacgccttcgaaatctctctcgccttcaccttcttgtcctatctaccgcgtcaccgctgcgcttctagtaccgggcgacgccattacaattacggggagggggtggtgttaaatcggggcggcaatgaatgcgtgcatgtggatgataaatgctgtggcaccctcatccatcttcttcttcctcttctctctcactcccagtggtggtgtccttcaggctgcactgcaactgcagtgctgcagctggtgcttatatgaggttcttttgtttttgaacactgtgtcttgtgaggggtggatggagaggaggatcagagatagctgcagccagtggtgtactggtgtggctgtttggttggtagcctgataggtggtgtggttgcaaggtttgcgcgagatctggaccgttggatcgggcaatggatggttcagattaggcgagcccatcttgttaccgaggttttgtagggctttatggcagtttaatggtttaacatatgttacgcatcattgctgaggaagtacggtgcgaaaaaaaaacctagaatcttaaaagaattaagagatggcaattcctactatagtgagcaaaattcaggaagtaatcaacatatggagagttttttttttctaaaacatatatatggatcatgtgtagggctaaagatttggcgaaattattgtaagcgtcttgagctgatcttttcttttctttgtttttattttcagcttctgagcaggttggttttgtgggtaatacctatccaaccagcttatgcacaaaattgctacttttcctaactatatataacacaagcagtttgctggctcaaatttaaaaatatattttccttttaaagttttgtttatatatttccttcggaatggggaaaaataaactaaaacaccaatatatatgaacatggtctattagatttagaggttatttttaaggctgcattcgatctgcacttttaaagatagatttttagtgcactcaaaacaagaaaccttattatcacatgattaattaagtattaataattataaattttaaaaagatttgtttgaattttgtaaataacttctatacattttttaaaaaaaacacatcgtttaacaatttaaaaagtgtgctaacgaaaaacgtgaaaattgaagtttggagttgaagaaaagaattagacctaagtctgtttagcaattgttagatctatcttgacacgtgctagctcatctcaaaacataatccaaggttgataaaaaaaaagaatgccctagtttggagagtgatcgacctagaagattcatcctagtttggagagtgatcgacctagaagattcattcatgcacatttgtcgagcataaatctatggtaaaaatatcgattagattgcagacgtgagtaagttagcacttagcacggattcgttatacttgtcatgtacagtttgagtaactacaacattttctatgtcagtactataatgacatagatgtattgttgacatatgcggtttgttcgtccattgcatttgtcgtatggactatggacagatgaaaggctgtcgtcggtttaatttgtcttcatgggcggatgggcctctccttctgtacgtagaacaatcacatggttgatggttggtcagcatagcagatctcgctgaattaaaagatgtaactgttgtttttgctgacacgctgttccaagggtgcttagcacgcaagagcgctggaggtgcgtcgagattcgtgcggtgttaggccacacgctgatgccgaaacgatatgcgttgtacacgactaccacgtagtacatgcttcagcaatactccctccagtcacgtgatggaatttatcctttgaacttattcaaaaatttgttttattgttaaatataatttaaacgtgacttatgtttttttttctaaattacacagtaccacgcagacactcacaacgcacgcacgctcacccctatgaacgcacgcacgcacgcacctactcctatgaggatcttcgaagactgggccggcaaatccatcttggagatcgcacgcagctcacccctatgaacgcacacacgcacgcaaatcctactcctatgaggatcttcgaagactgggccggcaaatccatcttggagattgatgaagtcaccgcaggcgcttcgccgtcgcctaccgctgaaagcacaagccgttaaatcctaaaaaaatatgcccccacggaaagtcgaacccaggatttaaagtgctactgagactcttgtaaccactgagctacatgctcatgtgacttatgtttgtatacatttgcattaaaactttgaataacatacatggtaaaatctcgtgatcaaagttaactgtgtatatttatgaccagtgagagtatatgtttgataattttggagttcgtaattcttgttctgtacgtgtttgtgttgttctcgatctccttttttgttggatgcacctaacctagtattagttttccgtccacttaattatagggaaaaatcagtacacaaatttaattacacgtgagataccacgaaagcttgcactccttgcttttttttcaatgtgttggttaattaaggatcagggagcaacaaaagtcaggcgcattaagatgaacagtaggaggaacagtgtattctgttagacagttagagaaggatactttgcagctggaagccttcacttaaggacagaagttgcaacttgcaaccgtgccatccatgttcagatacaactttttgaaaccttccatctcaaaagaaatacggagcagtaaaattctgaaacttgaccaaagcaaagaagaacatggtgggcatggctgatggctctctcatgtcatgcgacgaaacgcaagttacggagctgttgaattcttcccgaattggatgcggtttctcggcgtgttttttttttctttttgttctgttcaacctgacgctagcagaagttcagaactaggaactcgccgtggcagacttagggcctattcactttaatgccaaaaaaaaccttaccaaattttagcaacttgctaaaaattttgcaggatttcttatatagttaccaaaatttggcaagaaattaaatgtaaccactttttttgtaactttaccaaaatttaatagggttgaaaatggcatcaaagtgaacagacccctacgtaagctactcatagatatacaaatcacgaggatgatcattgagttgacaattcgttattggtttttttctccattttatatgtatggtcatgtacattttcgaatacaagtcaaaagataaatgtaggcgaatgattggcagaactagtgaaaatatgagcggtgatcaccttcatcttacgctcgtaggtagaatcggaactttgtttcttacatggctaacaacaaatcaagcaaattaaaccaaagtaacaaaacctaataaatcaataacggtgcaaatttgcaaaaccatccttcaaacttaatggtcctcctcccgtgttgctcatttccggcgataagctgacccggcggcaaccacggcggccggcggccggcttcgctcgtcctcggcagcaccggtctcctggacggagcccggccgtgcgtcctccgccgccgatccggcgagctcccagtagtcgatcaggtgcctcctgctgccgccgccgccgccgtgggagctcccgtcctgcgacgacacgccgcggtagccgccgcgctgatcgttgctcctcctgatcgcgtcgatcacgaacgggatcagcccctccatttttgccacaaaacccctctcctctttagtaatcttctctcccccttcgtctcgcggtcgcggctgcttgtgttgctgtggttggttacttgggttggttggtgttacgttcatggctgtggcttgtgtatttgtagaggccacgaggtcgtggcggcgcgggcgaaacggggtcgcgcctggagaaggtggcttccggtgggcggtcgttgattggggtggagtacgaagatttccttcgtgttcgtcgtcgtcgtcgggctcatcttctcatccggaattcaggattccgttctgcttcacattttcttttctgtatagatgcgtgggactctggaataggggaaaggatgagagggatcttgtttttcagggggcgcgtacacacgaaaccggagcacagcagtgcgtttgctgccgtaggttgggttctgggttctgttcttttattacttgtcattctggaaggcgtgcgaatttgcaaatgttttttcacatgaaaatgtttttctattcacaaggagttagcttttgatgtttttcacacgaaaatgttttttttttcacaccaaaatgttgttgcttcataacaacaaacacaaattcattttagttactctttttgacctatgtggtactcagaaaagaacagagtattcctttaaaatccttcaagaggtttcagaaaagagagaggtcggtttgtgccttttggcataaacaaaagaacatgttggtcacgtgctcgataatgcgagaaaaaaaagattttagtgtccatgtttgatgggctcgctattacgattagaaggtgcaattaacccaccattagtttagaaagactgggccacccccttatcagcatgacacatcacgcttaacaatccgaagcatatgccgttcgtcatgagtcgcgtgtattaattccatctgcttggctgcttcttcgcctgtcaaaatctgcagggcaatgcaaaaccaccacccacttgcatgcacagcgcaacaatccgcggcccgccggcgcagcaacagcgaagtctgcgacctcgagtcgcccagcgagaatttctaaaaccccatcggaattcggaagtggcgacgagcactgcaaatcacgtggtttgcgaccatgacgtggaaaattcaacgagaacggcggtttttttgaccgatctgacgtgcaaggctcaacagcctttgttacttttgacacgccttgattcattctccccagcagctatacagagagggcaccaaccaactctgattttgttgagttgaaagtgatttttatcactgcttctgcattgccatcaagcaaatccccacggcaattgggtgtaacataagggagtcattgccagaaaatgcgagaaatatcggcatccggcttgaccaaacagctatggaaccacggggcacgggagaaacgtagtatagacatagcaggcaagatccaaccaactgacgtcaaaataaagccatgggggagcccagcaataagaggagcaaactagcataacagtaacttcattgcaaaaactgcaaaagtagcagattacaccatatagtcacgagcgcgtccagcgtgctcaatttcaagcagacactagaattcagaacttgcgaatatagttgcaaaaagcagacaatagacaaccagtacgaccttggcaacagcatgccttttaagttcgataacttcttgacacattactatcatgatgatgtgactcagtaatcctttcgccttaatcccttccagcataggatgaggctggcccacgcccatcaatttctggatctgaaacagaggagaggaatagtcaagtttacattatagcatgagaaagtaaccaaaataatttgagcaagaccaaagaattaatatgcatacagctgctttcgaagtgttcctgcgtaagtagagcgaatcagactcgttgcagctgcggcgtccttccctgggccagcacagtcatgtgattggctgattgctaatcagagtcttcatacaatccctcatcgtcagaaagctcatcaaatgaccggatatctagctggtaacgcaagataccaccaatgccaccgaatcctctacaaaactgagatccctcttgagatttattagtgacaaactcaagcgagcaaccaaacttcttgtattcattagcaaaccattccagaagagacattttttcctgaacttccaactcagcattactagccggatcacggaaattactctggtcagcttcctgctctttgttaaaatgtttgatcacagtttcaccagatgcactgttcttaagcacatatctgttggtttcaaggttctcccacactattagagtctcaacagcacccatctcaagagctttaagagtgtcatcaaccccaaagacatatttcccagtatcttgactgatctcttcaaaatacttgccaattagcttcttctcctgtatgaacttgacatttgctagaatctcagctgacaattcaatagcttggttgaaaccattctcgccaccataagaaacatcaaccacattaagtatcttggcttgaagtcgttgatcaaacatgtcagactgactcaattctgtcttaaaatcagcagaaccagcgaggattaggcctgaaacattaggctgacttgtagcaggattaatgaagaactgagtagcaagctcagctgttttccggacataattatggcgtttctccatccgaagacgagcaaaacgcaaagcagattgtcctcctctaccatgcttctttgggagatcaacagtgaatttgtgaagcacctcacgtgtgttgccacttagtgtgccaaaaagagtaccattaccatccataacaatgaacccaaacttgtcatcagattccaagagctcattcaaagcttcagtgtggaacttgttatcacaaagatacagtgatacattgataggcttgaagggttcaaaatcaatggtaaccttcttttccttcccatcttcagtaacaatggttccagtgtagagaaccaatccatttggaggaactttgttatagagcttcagcctctgctgagctgaggtaatggcagccaaaacagactgacgattgactctactcttgatgtttgaggcggtaccatattcatcacccaacatcttagccactcgcgcaatctggtcacgtggaggcataataagagagatcatgcttgtgccatttcctctagctgactccagagccttgattagcttcttaatcttccagatctcaatgttcctatcagtttcatggctgtcagacatcttgacagagcttggatgactggctcacctgtacaatgccaaaacacagggatataagggatttgaagggaacattaaccagacagttcactcaagaaaaacttgcaaacagattaaaaaaaaacacagaacaaagacaagtcatattattgttatatagtacattcaactttcttgttgacacaagctctgttcatgataccaaattggacatggacatgctaaataagaaatgatacctgtctcctgtacaaattaatcaataatgagactgatttcttcaaagcagcatgctctattactttatacgtaacacagtgaaagaacaagaaaaacaaccaccgtttatcttactaaatatctcacaacaaaatttcggcagcaaaggtactatcaaataaccacaacactcagcagacaaggttaaaattaaaccacaacactcagcagacaaggttaatattgcccaatgggtggcaaattttggtttggtttaggaaaaggtaggttacgaaatgtgaaaaaggttttcatttgcatatactcaaatgatttttgcagctaacatgaaacaatcatgaacacatacgatgttatcactaggttacaggtacttggtaacattttttatgtgggacaaacatactgaaataaaataaagcatggagttaacccccaagacaaatgaaggacctgcatagccatgtaaaattttcagaatcggaatgtcacccagataaaataataaaaccaacataaaatctaaattatatccaagaaacagaatttagtttcaataatcacaaaaccgaaatagagagtacactcatgaaacaaacggaaagtacaattagtactagtcaactagatatcaacttggaaaatcacaaaacaatgaaatatggaatataatcagtcaataaagttaaaacagcacatcttagatgtatttatcttctgccaacaatgtaataaaaaattaactataggcaatcaatataattaaagtaaatcattgtaagaccaaacatgcatctgtcaccaagactaagatagaagataagaactaaacctcaggctaacattttaagatcgaatggcataaatttatagaagttgcattgacattgacatggtcagtgttttgtctttacaagctaccagagtcatagaagatcaagaaaccttcttaacttcttgattgccatgttcatcaaggggtattccttctagttcatgttctactagcagtccagcacatacattttcagttaccagttacttccaaaatcaataaggcaaacgtgcagcaatctacagatttcagaatgtttgaatctttaaaatcatgtaaattcagaaaaaaaacacatagtttgctcaatgctcactactacttcaagttaacctaaatgatacatcaccaatgaaaaggaaactattagcgcaacaaaacatacaagagcagaatgcaaccatgaagaagacatataacatgtaattttcaaaccaacaacgctaaaaagagcgccgtgaacttgagtaaccgcatgtccgcatggcaccatagcaggaaggctcgtctaatatgacaataactccaagcattaaggaatcaaaataacccgattaatatccacgatggaaaatagcatgtattcctatgttaatacacatcccagtacgctacttcaaatagccaacaaacaaagccatctcctggcaggcaattacaacttacaaacacagcatggatccaaatacatccacctaaattagtggcctaaatcaggaaaatcgcgcggaacagccatctagagtacttcccgcacagatcccgagaccgggaggcgaaggatcactacacgccctagaaatttcgccacagaactaggtcccaatcactcccgatccacctcgcgctaccagtacaccggatccagactctaatctcgaccaaatctgacgaccacacgaaccatgaaaacaacacaacccgcgacgattcaacagatccaacctgctcccgatccgccgcacccacgcagctccgaacgatcgggggagaagaagcacgagacgggatcggatcgagggggcgcaggagggaggaagaggaggaggggctagggtttccttaccgaggaggagggaggaggaggaagaggggagcgccgacttctcgcgggtgggaaaccctcgcctctgaacttctggtgtggtcggctgtttcggagagagagagagataaggccccggaattgaaccacgcgatataaccctcggttccgtggggcccacctgtaagccggggtgcggcttggtgggggggggtggggctttggagacgacgggatcggaatgggtcccatccggcggctttcccaggatctggatggacggttggatcgtcaccgcccagaggcgaacggaccggattgggccgaatttttctgcaccaatgattaacaagtgggcctagtttctagttttgttgtccccaacgaatttcttctaccctttctttttcaaatatccatgttattattcacacgtttcaaacatcttcttgttacatttttattaaaattaataaattttttttgcaaaaatataaagtacttactttagctaatactcctataccataaattttatggatttaaaaaagtatcttatacagagttatttggttcactaccaaagttttatggatttaaaaaagtagcttatttggttcactaccaaagtttatctcaccatgtcatagcttagattaggcaaggtgtctatttagtttgtgccacgcttatggcatgattcctccatcgtgacgtgggtccgatatatcattttgcatataaaagtgtggcaaggttttatatggtgttgcttcagagaaatgttccaataggacagagtgcccttacatagagttgacttaataaatcttatgttgtaacgtttatatgttgtatttgtttgttgcaggtttctggtccatttgactaacaagaaacgattgggtgtgttaatagtaaactaatgtcgaatgttctatacttgcctcacaaagttgcgtcgttttttatacagtggagaagtttgactcctcataagcttttgggggccttggatgcttaaaggagtcactgcttaccaatgtccacgatgagaggaccaaaaaacttcttaagtttagaggactggaggaaggtggaatttagtcgacctagcccatgagaagatcaatgtgtttctaaaaacatggttgaagatcttttgtggtggtagtttgctagtgtttttagaggttttttagttatggattgttaagttatgccaacagctagggttcttcgcccgccgggacattgtgtttcatttcgcgctggcatccttagttttgttcttttattttgttatatggatctttaagttgggtgaaaacctttttgtctaaaagtgtagcaagcttattctcttttatggctgaagtatgatttcaattttgttggccacgtgttggacatgttagctaacataagtatgacaaattttcagtaatgtgggtacgccaatcaaacagtcctcggaagtacccaaaaccatgttagttgtatccactattacataacacgtagaatccacttgtagtctcgaattatgcctagtatgaaaggtgacctggaaagaagatgatgtataaaatggttattggaaccataggtaaccagaaaggctagaagttatagttttatgatagaacatccgtaaaatgtgtaattttttaattaatcatgttattaaatttgtagctttacgataaattggatagagcatctatagttttacaaaatttactcaaataaatgttggatgcacaaggaggtaaataatttcgttgatgtgtgcgtgtttttgtgttctaggtttggtttgtggtggaggacttgactgttaggttttaacattaagcttagacacagcaacttaagtacttaaccacaaaaaatgacgcacaatgggaaaaaaaatataagtcaagcaagtcatggcaagatgacccgtgcggttcacatagagataggataaaacgagtcgatttgtgtggaaaaagaagaaaatggcgcgtgctttgacgctttgtagcattgaccctccttcctagggtcttttcctgcaaattccaaattggagcacatgattttggtgcatgagtatctaaaaacatcagtagtattctatattcttaagtcttaaccccgtcgaaatcaacgtatcaacactcaagatcttaccactgtacaacctggctccatcacgtgtgatttgttgggctcagaagcaatagcagctgttattggatggctccgcagtacaaacgcccatgcttttatccatcgccgctcgtccgagcacgtctcattaactaactcactcactcaagtgaggtcaaattacagaagctcaagtcaaatgcttatctaatctgccgatactgtcgccggatgatgccattacaccccttcactctcacgcagaggctgtccaaaaccatcaaatcgtcgtgacgacgcgagacctctcgctagcctgacagactggtccaacccaaccatcttctcctccgactcgagccggaaatccaagaaccgagtccaccgcgctcctccccttccacggtcgctgacaagtggggcccaggtggaccggcccgcacgcgtccctgccgccctcacgtgcgggcctcggtcgcacgtgtcgcgcgcggaacttgtcgcgcccacacaccaccgtcgctccgtgctaacgaagatgcggcacgcgcggaccgtcggattcgcatcgtgcgggtgaggggtgcgtgccgcgtgccccgtcgccccggacgcgtccaggtggcgggcgtgcggacagccgttggattggatccagcggcggtggttggatagcgcgggaagggaggaaaaagggttaggaaaaggtcattaattaattcgattaattatttttcgcggtgattaatacctcgccccactcctcctcttcgcttatttcattcgctcgtcgcgtcgcctttgccttgcctcgctcggttccaaacgcaaagcacccaattccatttccgttcccctctcggcgaacagcctcgcctcctcctcctcctcgccgccgacgccgacgccgacgcctccccggcatttggttcgcgcgggtggtgccgtgagatacgtggtggacggggtagggatggagtcggacgcctccacctcgccgcgccggcggagcaccagctgctacagcgacagcggcgattcgtcatgctccgagccgttcagcgagtgcggcagcgacgacctctcgttcacgccggctgccgccgcgggaatccaccggctgctgctgtcgtgcgcggcggaggcgtcggacgggacgatctcgtcgctcgtcgcggagctggagtcgccgtcgtcgtcgctggactcgctacggcgcgccgcgatggagctccggctgctggcgaagcacaacccggacaaccggattcgcatcgcggcggccggggcggtgcgtccgctcgtcgcgctgctgtcgcacgccgacccgctcctgcaggagcacggcgtcacggcgctgctcaacctgtcgatctgcgacgagaacaaggcgatcatcgtggaggccggcgcgatacggccgctcgtccacgcgctcaagtcggccgcgtcgccggccgcgcgggagaacgcggcgtgcgcgctgctccgcctgtcccagctcgacggctccgccgcggcctccatcggccgcgcgggcgccatcccgctgctggtctccctcctcgagaccggcggcgcgcgcggcaagaaggacgccgctacggccctctacgcgctctgcagcggcgcgcgcgagaaccgcctccgcgccgtggaggccggtgccgtgcgcccactgctcgacctcatggccgacccggagaccggcatggtggacaaggccgcctacgtcttgcactccctcgtcggcatcgccgagggccgctccgccgccgtcgaggaaggcggcatccccgtcctcgtcgagatggtggaggtcggctccccgcggcagaaggagatcgccaccctctccctcctacagatctgcgaggacagcgctgcctaccgcaccatggtcgcccgcgagggcgccatccctcccctcgtcgccctctcccaatcctcctccgcccgccccaagctcaaaaccaaggtaatcatcaatcacatttcctcatcaaaacacaatcgttttacacgttcttgcaaattacaaattgggaaatcgtgtgttgatcggttttatgattacacaggcggaggcgctgatcgagatgctacggcagccacggagcgcgagcctgcgcgcgaggccaacggcggtcgttgcggcggagtgaccctgacctcgttcaattcaagtccccaacttggcggtgccccaggtgttgtgctttgcttcccctattccggcggcgaccggggccggcgccggccgccggcgcgcgcgtgtaaatataccaatcagcgtgtttgcgtccgcgagcgagtgtacattttcctcaagcgagatgacgacgaaggcgatggtggagcgaagaaaagtctcttgtaatttcattcttccccaccacttgttttttttttcacttcacttttatcccctaccttgcttggttgtttcctcctcgtcaaacgaggagaaggttgtgcaaaaaaaaaaaaaaagctacaaaaatttcatgtgtgagcgtgtggtatcaaacagtgagaatttgtgctatgtgtgtgttttagttggggaaaaggaaattttttggtgtcacatcgaacgtttgaccggacgtcggaaggggttttcggacacgaatgaaaaaactaatttcagaattcgcctggaaactggaaaccgcgagacgaatctttttagactaattaagccgtcattagcacatgtgagttactgtagcacttagagcaagtttaatagcatagcccactacaaactccaattcacttatagccgatctaatagccaatttatataatagttgcttactatactaatatatagtcccatctatcatacacacattgtgtcttggagtccgtgctgcagctggctacaaatctatagcctgctatttctctctaattttttatctcattaaaatatgtttatagctggctaatagtctgctattgtacctgctcttatggctaatcacggactaattaggcttaaaagattcgtctcgcgatttcccccgtaactgtgcaattagtttttctttttatctatatttaatgttttatacatgtgtccaaagattcaatatgatgtctttgggaaaaaattttggggaactaaacggccctatgtcactgtgtgtgcgctacgtcaggaatctcatgcaggtctatgtgaaatacaacagaaaaacctcctgtctctgaaagcaccagccagtcggaatttcagctggaatgaatgaccatgctgctccattcagttcctaccgtgtctgcaccgtttttacgagtggttacagtgaaaccaccgtgagatcaaggttaggtccgttgtaggaacggcgagttcgttggccgtgagtgcgtgtgcgtgcatgacttggtaaaccagcaaaccttttactacctgttcaaaccaacagggaaagcacaaaatatttttccagtgaccatccttgtcatctactgctactcacttcttctgcgtctttcttcttctgctgcttgtggattgtggtctagaagacgcaggaggacggattggtggagagtggcgtgggggcccgggagcggtaaaggcgagagatcgatcttgcccgtgcccggtaggtcgatcattcgttcgcctgcagctgaaaacgaccctgttctctggctgaatctagcctctgctggtagttttcagtttctggagctctcgtttcccgagccatggaagaaaagcatataccgttgcctacgccaacgtggctactgttgctaggacggtatttctacgtgtcttttttacgggtgtgtttaattcacgttaaaattgaaagtttatttggaattggaacggtgtaacggaaaagttagaagtttgtgtatgtagaaaaattttgatgtgatgaaaaagttggaaatttgaagaaaatttccaaactaaacaatggctacgtctcctgatatgggtagggatagtaggagttgtatgacgagattgagcacatcgtttcgttcacttgtcgtttgtcgcttgtcgttgcatgtctatgctacggatgatgtattgtacgagtactggaagtacatgcttgtgtggacacgactgccttttttggatgacgtggagacacacacccggcgagcggcaaaggtgcttccaatactagcatgagatttttctcttttctatctgaaaaacatgcggtttcctgctccaaccacacgaccttgtttgtgcacaacgcaacgcgtggacaagttctcggtggagtgttcgtaaccctgatgtgacagtgactgtccttggcattttttgttactttgtcaagtgcagtgcagctaagagaaaaagaagagtgtcaactgttactacctaccatacggtgtattgctcgtgcatcgaccaaattaatcgtcaatgcccttccaaaaaaacaaatatttgactcggacggcggggcgattgacttttgccctgttcaaagcagcgcagcagaatccttcaaaacagaaggggaaaagaagcagagctggttgtcaacttcaaccatgaacaataccacggcaccccattcgtagcaaccgatgacctaaaaagtcacccacggaaaaaagcacacaaaacccacatctacacgcacgcaaacattcctgcaggagaaaaaaaacaaaaacaaaacgtattcaccactatacgcacatctcggatgccaaatgcttggcataattgcgttaattaatctagccccctgccaatcatcgccaccccggtagcaacggtgcgttgtggttgcccccgcctccgctgcgctgcgctgcgcacccacacatgcgctgccggctcggccggctgccgcgcgaactgacacgtgagctctccccctcgccccaatcggatcgtgaactcgtgagacgaccacccccgcgcgcgccacgcgtcgtgcgcggccggcgcgggggtgggccatcggacggatggcggggggacacatgtggtcgtgtggtggcgccgcgggtggatgccgcccccgcctccctcctccgcgcgcgcagccgcgcccccacttcgtgcgtgcgcgcggctgcgtttgcgttgcctttccgccgctgggagcggagccacagccgaacgaacggaacgaacgaacgtgttgcggttgatggggtgcaaagcgggggtggcatggagacgggcggctagcatgatgattgctgatgggggtggggccgtggtggtgcgagatgccgctgcctccgctgctgccacacacgaccacacatgcaaaataaaacggggatcatgtgacggcacatgagcgtactgtgcggcggtttgattgatctctctggctaaaaagaaaacgtttccttgcctgacgtctttctttgatgattgagtgtagaggtagcagcacaagtaatccctccgtaaaaaaaaaacaaaccctgatttcgtgtccaaagtttgaccgtctgtatatttaaaaaattataaaaaaattaaaaatataagtcacgcataaagtattaatcatgttttatcatttaacatcaatgaaaatactaattataaaaaaaattcatataagacggccagtcaaacgttggcacgagaatccatggtctgtcttttttttttgacggagcgagtatatatgattagcatatgcctgttgtttctgcctggttgttgtagttttgcagggatcggtacgtacggtaccgcattccgcatgtgtgcgtatcgtcggagtaaattttattcccaacatgtcatttttgttatcggtggagtatattgtaccatgtggagtggtgtggtggaaattaaaccaaaggtggttgactgcgatcgatcgatcgagattttgtactagtggtactgttcgtacagagttgacaatctactactactactacctttgtttttatctgcattgacttgccatcgattttcttccatgcgctgcgcgtgtttcttttcctccgatcttatacgtacgtattagcgtatatcttcacgaagatctgcgcgtgacagaggtgtggcaccatggcatgggcgggacgccggaacagggtagggtttggtgtggggtgaccgtgacaggagcgtgtgtgtgcatggtgcgtcgagctgtacgtacgtccgacctttgtagtagtggttgagaccagccgcgaatccccgacgcgtggcagccgagcgcggcccacgctggaccgcgaccctcacacgatgcatgcaccggcggatggatcgggcaggcaccacccccccgtgcggacgatgcggccggtggcgaaagcgagacatggccgccgcaagcagcccagccagcgcgccaccaccaaccactggatacacaaaaacacttcgcgcgcgcgcgcccggcacgccggcgtgggagacgttcgccgtaaggcgtaacccaggcggtgtcctccgatccggaccttcgattcgacgagcatttgccggatttctcccgtgatatttgcggtgtatacatgcatgtggcgtgtgctcggttcgatcgggagctagttggcgacttgcctaaccccgatcgcattcaaataaattgccgtcgctatcaccaaatgatgcgtgcccatccccaataatcccgagctaatcaagccgcggtcacctttccggaatcgaggtccaggcagtagcagttaagcgttgcctttttgaaaaactcgatgaagttacggccatgtacgcaacgataagcatcagttttcgtactccattcgttagttcggcgtacgaccactgataattttggagtcacatcagatcatcattttgcccgtgcaaaagcgagtaaatccaatccaaaatactcaagtatccaagggatggagtactatttatttttcctactcttcacatctcggtacagtaataaaatgagagtgggtcaagttgattagtagtactcctattttcctactatgaagtactatggtttaaaattctgactgtttgaagcgatacttgtctctggagttttggactgggcacaatttgacgttcgagcatttctttgctctgatttgatttttttccccttatgtatgcttgagttgattgaccaaatgaattacgatgtataggctcccaacaataccaaaaagacagattccttttcgcgtatttcgttgaacgttgattccatactctactatgcaacttgcatttatatacggacccattcgtgcatcgttcctattttattttttgaatatcaaacgcaccggatttgatatgttcttttcttcttcttttgagtacttgttagacaaaaccgaaagcacataataactccatatccgataatgtagaccgagcacagcctctgaattattggagggaaaaagaaaaagcagaaccttttgagttcagtttggtcatgggctaacctcgcatgaaattcagatacatctgctggcattttgcctggcggatgtatctgaattttgcctggcaggaacaggaagaaccaattgcattcggacatcccgtccggcaatctgaatctaaaatttgttcctcagttcaattatctatcttccccaggtgctactgctacatctgctggcatgaaagaaaaagctgtactactgtttgtgatttgtatgaggaattgaggtggtgtttggatccagggacttaactttagtctctatatttaaacactaattttgagtattaaatatagattacttacaaaactaattacataaataaaagctaatttgcgagacaatttttttagcctaattaatctataattagagaatgtttactgtagcatcacataggctaatcatggattaattaggctcaatagattcgtctcgcgaattagtccaagattatagatgtgttttattaatagtctacgtttaatatttataattagtgtccaaacatccgatgtgatagggactaaaagttttagtcccatctaaacaggttctaaggatacttccagggagctgcagagcaaataagaaaaagaatcaaacccaagaagattcccactatttgatattgatattccaattttcctgtttccctagctaagatttctgagctgtcattgatgtgcatgtcccttggtagaccaacaaatggagctgtcatgtcagcttaagaaactagctggagaaaataatatttggacagaatcataagttgttcatgtcatttggccttggccgcgacacgcacggttaaaatatagaggattgggttgcctttgtagctttctcagaagctgttgcatgagaatgctggggttcttttttcgccattgtaagctgaaaccaacaatttggttgcatcagataagtctttgcagtagttgggataacaagatatctcccaagatagtgatctctctttaaaataccatgtactgctaccatctctgtgacgaactcgtgttgtaaatctgcccgtacaattccgtttccatttagtaccaggatctcttcaattattttgtaggatttggtttgtcggtgtgagagacttgagctgagacaagtagagattttagtaatgtgctagtcatgtgtcatgaatggtcatcctgacatctttgcaatgatgcatcaaatattcaaacccgaagctctgctcagagctaagaatgttattttcagtacaccgaattcctgaaacattattattgtagtatacaagtatctgacgcaaggtgccttggattatcaaagatgaagtgatctaagaaacttaatatatagaccaccagaaacaaagtgatctaagaaagccgcgaggaaaggcaggattgtcttttgtgagaacaagcctctctcttattttcttttcttttgttttttcttgagaggatgaacaaagcatttcagctgagcaatatgtgaaccaaaacaatgctgcaatgctactcaatgatcaatattccaaagccattagcttctttcaggacaaaaaaaaaagaaaaaaaaagtgggcaccagatagcacctgcactgcactattcctaaacaaatccgccacagaatacttggggagaagttgaccaacgcatagcaacacaacaaaattaagcactactatttcgtatcatcatcatcatcatttttgcgttaattaatctccaagacgcggttgagaggagtagtggtcatgatcagaacagctagagcgtgtgaccgaaatgagggatacggatttgtgttatcttttggagaaagaaaagaagaaaacaaaagaaaaggcgcgcagatgcagccactcgtgtgacgcactttagttgttcgggaagcaacatccctgcttctcccctcgagcagttgttgagcagtagctgctgcttgtgtcacgaacaagacactccaaactaatccgagggagatagatggagatggagatggagatttgatattagctaggaatttttgtagtggtgggaggaggaaggtgacagtggaaagctgcccggcaactgaggcgaccggtctctcgctctgcagcatgcgatgcatgcacagtgcgtttaacaacaataatggaaatggtttatatctccggcctctgccattaagcacacaccgtagcacggtgcgtttaactgcaatcatagagagtggccatggctgtatgatctatgatctatcagacttttgatcgatcattgtagtttctactgatgaagagagctagtgcatgggaaatgtgatgcactgatgctgatgctttctgatcagttcttggacttgtggtgatggtggtggtagtctccatccatgatttggacaagttaaattgtgtgtgtgtgtgtgctgtaaagtaagtaaagcatgggtgcttcctgttcttcacctcgaggaaatgtggagaaagcaggctagctgctctgttcaggctgtgtttgtcttcgctgccatcgtagtcgtgtcgtttggctctctctttctgagaaattttcaggtcgcgcatcacttcagctgctcctgccgacttccatttccatttcagttttatggttcctgtacgggtacacatttaattgtcctaggagttgtatgatttgatggtgcagacaaatcctctcgtcggctggaatggatgcttctgaaaatggccatctcgattcttggataagcaagcaacttgtgctgtagagcactggtgtattggattctatcgttcagcctgttgcccagccgccatcgagaaggaccaggggtcacatccagccattatcgccagcagattattgtgtggctgtatcagacagcaacttggatctaaccaaaatacttccaaaccttttgacgagcgcctgcaagactatttttcaagcctcggctgcaacgagagaatttcacactgaacagttcgattatagagggagaacggcagaattgccgcgcgtttcgaacttagcccggttacttttggataacaaccagtacggctaacgatctcagaaacttcagtacctttggtgctcactgaagttgctggaagtctgaaacacatttaagaaaggttgatgctgtcttgtgctgaaacatacagtacatgtctcaaaatgatcggagagtatagttgggcctcatctgatttgtgcaagcacttgaattatcagccaatgctcttcttatgcaaggtagagaaggaaatcaagccttgtgttcgggagctcataatcattggcccatcccaggcctttccacgggtgggccaattattatgggcctccaagtgaggccttagagattaaaaaaggaataagttcaccaggcatccctcaactttacgtcaaggttgtttcacatccattatctcgaataccagaatttttcaccactaaactatacaaaactgtgcaattttggtcctatagcagtaggaatctttgatttcgctgatgtggcatcctagtcaacaaaaaaaaaagggccacatgtaagtgagaaggaaaaaaaatatgggttggcatctcatatttcttctcttttctcttctcttctcttcttttcttcagcagttcaacaagtttggggaggccaccgacgacagagggcggagcggcggcgagcgagcgcagcaacaagtgatagaggaggtagacatcgggtgggtcggtggtgggcgatgagcgttggagggggcatgaacggtggaggtggtcggaggaggaacagagcggagccgagcccgccaccgctttgcctgcctgctttgcccgccaccgctccacacccctcctcctccggctagggatgcaagcggggtgggcaaacgggttttttaccccgcttatctcacttctagtttagtttttcttctaaattttgtactaccatatgggaaatgacctaacaagcgggtttttatataggtagcgggactatccacttgcatccctacctccgggcaccttttgccgttgcaacattgaggttgtggcagtggggcttgggcgcattcgagtcggcggacctcgggcgccgggcacgggagaagcttgtccttggggatgcagagcaggtgctcaaggttgagcgcctcctccagcaagcagttcgcctcggcctcgatgaaccacaccccttccccgtgtgcagtatatctagggctccccgaggaccggctccgtgatgtgtcggcgacggggtagtagtggacgagcaccttggcgaaaccctcccacatggcaaagatcgatacggccttgtcctcgacgatttcagcgaatgcgaatggaaagacctggatgaagtcgacaaagacacggacggcggcggtcttgtcaatggaggatagtggaagggagccgcccggggtaggccctggctctatcgattaggaggaggaaggaaacaggggtagttgtcagttgagctcgcgtgcgtgtaatgccaccaccaacgtcgtgtagttgacggggagggttggtaacgcctcaactacacactgacatgtggggcccgatgtatgctaggatccttcaaaacttcaagtttatatgaaactcaagaaaggcgtttatgtaaaatttaaggtgtttatgcaaaggcagggtccgtcccaagtttaagtcaaaatttaagtgagcgaggtcggctggtatctctaacagtctctctatgtctatttggctagttagccaacaaaattaagtagttaaatttacctttcacttcaaaagcctctcctaattacacttttaatacgatggtgggtcctatatgttagcctctcttgttcccctacccttcttcttcacccttctctctcctcttcttttcctctttgtccccactttctttttccaatctccctcgatgttgctgtccctcgtctttttccttgtgccgttgctgcccaatacttcttccacccaaatagagctccccagtgttcggaccgacttctccactggctgaattcgaccttgagtggtggtcttggctgcctgtgatgagcggtgctcgtgaggggagtagcaacggctgcactcaagagctcttcttcggcagaggcaatgacgctcgcggcctacggcggcagctttgtctcacccatcgaatccttgacagttgcggtggcgcttgtgaacggagcagcgacaacaacaacatttgtgggaaggtttgccagcgcgcggcggggggggggggggagggtggagagagagagtggttgggccatggttgacaagtgattttggttggctaaatttggttaccaagtggaaggttggagaggctattagagcataatttttcgctataattgtcaaaatttgtggaaggttggagaggctattaaaacataatttgtcgctacaattgtcaaaatttgacttgagagattactggagcatgatttttcgatataattgtcaaaatttgacataggagactactggagatgctatgacagaatccgtagggtgtgttcgcatacactggttcccaacccggaatagtaacacggaaaatggagcagtctagtagcacgtgattaattaagtatttgctatttttttcaaaaatggattaatgtgatttttaagtaacttttgtatataatctttttacaaaaaatacaccgtttaatagtttaaaaagcgtgcacgcagaaaacgaggctgatgggttgggaaaaggggtgccgaacacacgcgtagaaatgctagagacgtcacggttgggcgtttccttccacgcgttcacagtgttcactggttcagtttagagtttgaaccaaaattttgtgcgatgcgaggccccacgtcgttgcagaatccagtatggaatgctatatgtccattgcgatttgtgtacgatccacgcactcgcattggcataccataccataccaaaggcaaggtcgcccgtagccacgtattactccctctgtccacgtcactagcggctcggccccgcgaaacgtcgcgcaccttcccaccgttccactccaccacgcgcccgtgcgccacacagccgcgtacgagccgttgtgtgagcggaccgccctcgcgcgcaggcgcgcgtcgcgaccagagcaggacggcgcagcggccgtgaaatgaaaaaataaacaaaacaaaacaccgggagcccagctacccgcaccaccggcacacgcgtaacgcatgtttggacttggtgctcgtcgtcgcagtcggtgtgcgccaccacgcgcggaggtgggggcgtggggctcgcgcacggcgcacctgccgcgcgcgtcgcggtacggcgctcgggcagagtggccccgtgtgcctgtggctctgctggagcctacacgggcggttcagccagcacgcaccgaactgccaaaacgtccccacaaaactgatggaactgaagcttgtagagaatatccggtgaacgattcgggcgcagaggtatctcacccatcgaaattcctcgtcagatgccgatccttttgctatttcgtagccaactttgctaatttgatcgattattaattagtaattgattaattctctttgcttagctgctaaagatatatgaagtggctcgcttgaagggaagggcgtactaaacacacgttatctcgtcttcttttcttgcacatatggacacgccaatgagtattgaatagtgcacttgcttttgtgtgaaatggtccaataaacctaagttgctcgtggcaccaatcgcctctctccttttccaattcaaagagataggctcgcactgttgcaattggaatgacgttggtccaagttgctctacaaaacatcggcgacattctacagtaacctgaatgtgactttggcacccattctatcaaacacaaaatacgctctaatgatttaacacaattggattactagttttttttttaaaaaaaactacatactagtttatgtgcttaccgttgacgataacaacacaacaccatataaaaggccactgatttaaggccacacattcttgttgaacgaaaaacacgttcctgtttctccaaagagaaccaaatgtggctaatgaaaatgcagacaagtcacaataaaaaacagaggctactatagaaccaaaataaacgctgttccgctattatccttgtaagcacaacagcgaaaaatgcctaaaataaaccagagaaccaaaagcaaaacgggcaaggaaacaaaaagaacagcttaggtttattttagcaaattagtaaacctaagctagggcaaggaaatagcgcgaaaaagaactaaaaaaatgccaaaaagaagagcacgaaaatgacaaaaagaaattagtaaaaacaaaaaaaaggggaacagaattggagaggaaacagcttccgtgccctagcttcccacccttccagcgagagaacagcgccgcatccatcctccaccgcctctcgtttatatttctgcgaggaaacgaagcgaagcgaagcgaaggcaaaaacatccgccgccgccgccgccgccgccgccgccagttcgtcgtcgtctcgtcccctttccttcctccatccctcgctcgcgagcatcgcacgcgctctccccatcctcacatggcagctctgcgactccacgcacaacccgaacccctcaagaacaacccctgcttctgcttctgctgcttctcctaccccgatcccgactccctctcccgtctcggcctcgccgccgcgcccatccgcgcccaccgcactagctcctgattcgagcccgagtcgagccgagctgaccctccccccgcgtcgcgtctcctcctccgtcttcttgcggccgcctcgcctgttcttgctgtggttggttcttgggatcaggttctctgattcttgctgcgcggcctctttcgccatggggaagagtgagttcctctcttcgagttggttgtttggtggtgttggtgttttttttttttctggttgtgtgatgattttttggtgatttcttcaggtaagaagagcaaggtccgtggcgttggcggcggggacgacctgatcgacagcagcgacgccgacagcgtgggctcgtcgtcgacggcgctgtcggatctatccatgtcgtacgctaccgagcacgtcggctcgcaggagttcgtcctcgacaagtacatcgatgctctctatgagaagaggtgaagtttctgtctcgccatctctagtttctactacccctgttgccatttcggtattgtgtgcgcggtaccttgatttaattcgcgtagaaattgtgtgatcggcttctttccgtaggctttgcttcgatgaatttgtttcttatgcaactatgctgtcagtatggattgttattggcgtggtatgatattaccttgtttgaaatacatgagggcttgacacctgctcttaattggctgagatatttgattccatagatagctttggataatatttataatccgtcaaattatacgttactatgaacttttggattttagtttgcaagttgttcttatagctataaattaatgggatggttggagtttttttgctggattactgaatagtagacttcttaatgttgttctgtttcatgtgtactaaaagcattgtgagttcaagttccctgtatactatacttgtacagttactatggcccattatgataaactaagctagacaaatttattgtgatgtgttgcatcaatttttcagagcaacgtttcgtgacatttttaaaaccaactgtgatttcattggaaacttttgtaactgcaagttaccgatagttgtgcctgacttgctggtttacttacaaccacattatgtctgatgatgcgaagtcctgattgtttactgatgagggctaaggagctctatcgtttgcattcttctcacccttgcatccttctgatcagtgatattgaacagtcttatctatattcaattaatggtcttcacaataattttacgatctatcattgcatgtcttattctacaaaagaggatatttgggggtagaagtacaacatttatggaacttgtcttttgattatctcttgccactttgtatgtgacaaggccaccctgtatcatgtattgtatttagggtgatacttttattttttcgttaattgttgagaacctttgatgttacatgatggtgccaccctatattatggcacaaggtccacaatgcttctgcttacgtcatagttgctttttttccctgaaaaaacttgcttagctccattgttgttgtgaatgttgaatcctgtttatcaaatatggatctgacaaataagtagcaccatcatgttggatgttgaaattatcaagcttgctcttttttattgtacttaatattttaccatttgtgttggtgcagggggtctaccagggaagccgcactctctcaactggttgatgcttttgaaagcttcattcttcatggtcttgtggagaacaagtaagctaatacttccaccagtcaatcttacagttgcatctagagataatagttacttagttgtcagcaatatggatattatatagtactagtgattattgtaaacatgaaagacttatatgacaatcaagtccaacctagtcagatgtcagactaacacacttctcagtgaagatggactatatattaattcattctgttccattgtgaggacgtgttactgactttattttttccctctttcgaagatatgccaccctgctgagtctgttcaacagttcgataaagaagggatctacaaaagaggcttgtttagcatcccgtgccattggtatgtgccctgtaacactaaatactcatttccgttcattgcagctattgtttactcaccctatctattgggtgttttttggacttgtaggtcttttagcccttacagttggtgctgggagcagctcacatgaaataatggaggagtcacatgcacaactttctagggtccttcaaacttggccagatgcttccaagatgatttcggtatgtcaagtattttttttttctttagctttcaaactttctttgcacttccattcaagtgaatctatattgaaatgttgtaggcacttgattgcttggctgtggtgacatttgttggtgctgctgatttagctgaaactgagttatctttgaaagctatgtgggatgtgattcatccaaaatcaggttcaaatgtatgtataggtctcgttgacttttaaaaataatataaagtatttggacaaaggcatattttttttaggacaaactacaatcaaatgtactttggaatttttgtaggtgggaattatccgtaaaccaaggccccctgtgttagcagctgctatatctgcctgggcatttcttcttacaactattggttcatggaggataaatgctgatagttggaaagagtaagtgatacatcccacccaactctgtgtgcttgtgatgtagtaagctattcatgttcgtgaaattatttactttcttttttcttcatttgctaggcctattgcatttctctctactcttcttggtgcggaggatcgtgctgttcgaatggctgcgggtgaagcattagctttgtgctttgagctaaatttgcttgacgtttcctttggagaagatgatgatgttgagaatggaggaactgttggttctaagagtaaacttttcctggatatgcaagctttgaaagccaaaatatcaagtcttgcctccaatctctcaatggaggcagggggtaaaggtgcagataagaaaaatcttactgaccaaagagatctgtttcaacggatcttggattttgttaaggtctgcctcattttttcatgtttatgtttgaatgtttggttccgtttatttgctgccaataatgttgatctttctttccttttcagtatggtgagtgccctgaagaatctgttaagatttcaggaaagcgtgacgttttaagggtgtcatcatggtctgaattgattcaggtgcttacctaaccactttctctactgaattcctgaatttctgcatttttttttgtccctgcctaattttttataatgctatagttgaacttcttgaggcggtttcttgggagaggcttcctcaagcatgtgcaggtactgttttccagagtgaagccatttttgtattgtactaatttatctggtatattaatgtgacaaaagttggttctgtttttgatgcaggagaatggacttcttcaagatgtgtttgacattaagactgacaaagctgaaactctgtcatccactgataaggtgagaaactgagattttagctcccaccaccaattgaaagcccataattgcaaagtgcttttgaactggtaacttgttacatgataaccaaaagtcaatggttggatatatatttaaaaaagaacttgggaagtatggtacataaaatgcagtaaaccatgattgatggtaatccgctttaggtttagggttttgacttgaagctaccaattcagagtaaacaaaactgcaaaagtgggcactctatccttagcagcatttgcttccctgaggacaaggggagaaatgtttttagcattttcatgcacacgagccttgactactcatcaaactgctgaatcagttagtcttcatcttcttaggcccctgcatggatagttattccttttcttgaaaatcaaggggagctgtgtgatttttatcaggtcattaaattgttcaaacatgcacgagcttgcttacacgatcttccatgagcagcccctgctcgtcttttttcaaagtttatcctgcttgttttcacgtttcactggatttgctaattccttttgcgtatttctcatatacttttggattgctgatcacaaacaatcgcaaaacacttgcagaaaatcttcaggtctggtgaagagaaaggaagagctctaaagttgaacaaggaccgccgtttagcccaggtgagctgacctgttgctttctgttaacactagttctgttctgtgtggtgtgtgacccactttgttaccttgtttttcttcagttttgcttaagacatgatcaaaacagggtttgtttagaaagtagcttatttaactgacatgaaaatggatgctaaaagcagtgtctttttgggtccttggaggaaatgagagggagaactatatcctagtgttaatcataaaaggtacgaagaggtatcaagaaatgtttttaaaaaaagaatatataaagagatacctgtacctcaagtaccataaacaaaatcctcaagcgcaaaattaaaatgcttatgtttcttactttaccagtgcaccacaagaacagtggtggtgttacgtgtgtctgactataatagtatatttgatcttctggacttcatttcaggagaggaagaatgccgttatgttggacttggacgagtagcctagtgaaactgcagccgttcgtcctcttctccgtttagctggacttatctgtaacgagtgtttggaagtcgcgatttgttatcacgacgctatgcaaagcaatactgcagaaatactactactatactagatccaaaccagttcgtgtttatcaactcagcagtgcctttacatgtaaaggtctaaaccagtttctgttgtccggtcgctcagagtgcctttacatgtggaaacaaacgtgctgaaatgaaatctgattcctattggggtctatttatgcatgtcgttgctcgtgtttcctgtgattcttaagtactctcttgctcgtgtttcctgtgattcttaagtactatctctccgtctcagaatataagaaatctagtcctgttgagatacgtagctgaactgctcgtgaacgttggccaccgggcaacagctgaactgtctcaactctcaactgcctaccgtcatatggtcggaccggcgcgcagcatgaggacgttggcctcgtgcgctgtgtaccttcacaggctggtcggcgcaggcccgtggatgtggaacctgatatgttttgtggcatggctgtgtgtaattcaatcttttttttcatacggaggaagtaacttctaatatcaccaagtcctttaatagttaaacccggtataaagtgtatcctaacttttaggaccggagcaaaccgagtcctttgacaatattgaggggtccttcgataatttttttttagaactcttcgataatattgagatgtggttctatcggtgttctcatttttagttttacttctagtactacgtaggtgttacatgaaacaaataccgtactatgttattaagccatgtagacatcacaatagttgaacccatctttaataatatcgaggaacttcggtgttaaaatttttgaacttttacggtaacaatgaatgtcatctctccactcagatactttataaaataaatgaaacataaatttctgagccttacagattatgcaaagacaattcatgtacataatgtggatcgatctatattgttataatttagatccatgtttcagcattgttataatttagatctacatttacaaaaattcatgttttacatacaacaatatcgatcaatctatcttagtattataatttagatccatgtgacaatatagtggtgtaaatgtttccttatgtctctgctaatgggaagaaaagacaaagttgcggagtgcaaatgtttctctttttctctaactagcaagaagttggaagtaaaacataatatttgatagttaccatagtctttaatgtattggctttaatggatggtgcagcaaaattgcttgggaattcactcaaacaagccatctgtttcttgttccctaaaaacaggatctaaaggctcattaccgattatctggcctgcagagtgcacagatcctaaagtggttcattcttgcaaaatgaggggaaaagggttattttaacaaaagaaaaactgtgcggatgttcagctataccagcgttgtgaaaacgaccgaaaatctcatgtgacgtccaaccccccaaaagttcccattgctgattgagcttctccttcaccatttagtcactcaatataacatcagtacagaacctgaaactgtcatgatgggaaaaattttaaccgaagagaagacggttacttggtttgcacattcacactagcttcagaaacttgagctggtgcaaactgattatggaatatcaaatatgcatgattatgacatgataatgctactggatgccaaagaaatcatcgattgatcattgatgcttacctaaaagggatttgtggaagataatcattgacagccctgtaaccttgatacccattgtaccattaaacacatcaatatgtcagctatttatgaatatgatcttaatggatcaaatataagatcacaactgacatgtccctcatgaaatgccaagtttctccacgactttgccagcaatctgaattagtccattctcggattctcctggattcatattcaatccctctgtttgagtcagggacctcacgaacaactgtcagaagtcatgctgctgtgaccgcagaaaaaaatattcaccaataattaccacatgaacattctccatccttgaaatgatgaaaccgcctgacatctctaacaacaatttcccgtccaaccgcctttgacatgaacatcattgcagtatgacagtcaccacatattctcaagttttttaaaacagtaactgtagctccaggaggcaactttagaagtccaaatccaactgccagcttctcactatgtgcaaataatatgtattccttttcatgaggctccatatcatgcaacacaaactttgtatcaggaacatatcccagctttctcatcctagcaccaatcacttcaaggaattggtagacttcctgtgcttctggatgttttgtatcaccaacaagaaacacatggattttacttcctacttctatccaactgcacccaggctccttcttgaccccacgatcacgcattagctttctaactcttgcagcatcgacccaacgtccagcagctgaatatgtgttagacagtaggatgtatgttccatcatgctgtggtatcatccgaaacagctggtcagctgcataagcaccaaattccatatctccattagtccgacagccagagagaatcgcctcccaaatggacggggtaggctcaaaaggcattgtcttgatcaaatctctagcttctccaattcttccagagcgaccaagtaaatctatcagccgtgcataatgatcttctccaggactaatgccaaagtccctcttcatggactcaaaataatggaagccttcatctaccaaaccagcatggttacatgctgtcaaaattgtgaggaaagaaattcggtcaggatctatgccttcagcaaccatctggtcaaatagctcaagtgcctctctaccgtgtccatgttgcccaagagctgaaatcatggcattccacgagacagagtctaaattgggcatcacaaggaacacaagacgagcatcgttcacagcgccacatttggcatacattgttagaagtgcatttccggcagaattgcttgcctcaaatccacactgtacaagatgtgcgtggagctgccttccatgcttcagcgctccaagttcaccacaggcagctattgcacccgcataggtgtagtcgcatggtttgacatcctcagctctcatctggttaaacagtttcagagcatcttctgaaagccctccgtggacatatcctgagaccatcaccatccatgacaaatcgtttttatatggcatcaccttaaatacctcaactgctttgtccaaacagccgctgtcaatgtatcccgacaaaatggtgttccaagaaacaacatccttcagattcatagtgtcaaatatcctcttcgcaatcacaatctttccacccttcgagtacaaagtcactaacgcattgttaacaggcaatgctgcctcaggaacgaaattcggctgtaaccgaataatctgaccatggactgacttcccatgcacaaagaatccagcatttgcacacgcactcaggacgctagtaaaagtgaactcatcaagcggaaccttttccgacaccatcctcctgaatagctcaaaggcgtctgcacacattcccgattggacataccctgagatcatcgcattccacacgacatcaaacttaccatcaacctcctcaaaaactgatctagcagcattgacatcgcctctcctgacatagccgacgaccatagtggtccatgtgaggtcatccttatccggcatttcgtcgagcaccttccgtgcgtcccaggaggcctcaggcgtgtcgcacttcatgtacagagcaatgagcgcattggacacagacaagacagccgccgcgccggacttgagcacggagcagtgcagctgcgtgcagtgtggcgcggcgaggttgtgcatctggccgacggcgctgatgagcgcggtgaaggagtaatcgtcggggcggagtgagccggagcccagcagggcgtggaacacggagaccgcgggcgcggcgagggacgccctcgcgaacgcggacatcatggcgttgtggagcacggtgtcgcggcgggcgggcgggacggcgtctaaaaagccgccggcgtcccggagccggccggcggcggcgtgcgcggcgactagggaggtggcggcgacggggcccgggtcggggtccgagcggaagagagccgcgggggtggcgaggtcgggggagagggtgtagaggtggattaggcggagggtgaggtgggggtgggacggggcgtggaggaggtcggcggtgagaaggcgggcgtggaggcagcggagggcgcggaggaaggaggaggaggggcaggtcggggccggcgagtggcgctcggcgaggcggcggaggaggagggagcattggtgggcgagggaggcgacggcggtcggcggcggccgccatggccgcatcgcgcgttggcgtggtggtcggggcaattcggagcgcgcgccgcgcggcccagtgttcaattgggcgtgggcctttggttgggttcaggcgtttggcgggttagcggatttctgaacattactttcaggtgttcaaatgtttctgagcatagcaatgttctatggagtattgaagagcaagaggaggcacctctagcagggtttacattaccggttgaccactaaatttcgagccacatcgatatcacggttttcgataaattttgatcggtttttgataaatttcgactgaatttcgaccaaatctaatgtttaaccttcgaaattctaatcgaaacttaattccaaaccgtgtcaaaacgtcgaaattttgcggaatttgaccggttttcatcggaattgtgaaccctgacctctagagcatttttttttggattacacggtagtacacaagcacatatgttattacacacaacactatacttacacgctcataaatatgtctttagcttaaaagatactacctactttctagaatgtagcaatctagaatgggatgacatgttctaggatgggtcttattcaattataggttaatacgttctgaaatggagggagtagaaaccagcgacacgtttccgacctgatatttaattatgtgttttactgtaccggctcttacgtatctatgacagagaatctcacaattcttctccatgccactttctctcctgtaactggaggtacactgaagatttctaatctactactacctactaacataatatgtttagcctaaacacgatcaccctagaatcagattggcagcgcaccgttgcatccactgcatctactgatctactacgtactaacataatatagtacactgccggtttgattacaaaggagtcactgacgatcaggtgtgacgtggcagcatccctcatccaatcccttcacttgcattgatcaaggactgcactacgaacaccctccaacatttagcttaggatagagatggttaacgttttttggacaagaagaatgtgaagtgatcgctaaaaaaacatgaatactagggaagaacctaatatcaaataattagaatgggtgaggcttcaaatccaggtcgtaatccaccatcttgtgaaactagtcggatgatccctgtgcgtttctctgaagtgattgttaccatgacacggtgttggcatcttttgttaatatcacgttgtggatgtcgaggataataaaaagaaacatcggcgtgaccgatcaatgcacaaaaattgggaaaacatagcgttgattcgcggtgatcgtgtaagcaacgagtggaaacggccctaatgtggttgactcccagttttccatgctgagagtcaattttcccaataatcaccgttttctaaccacctctgaacttccttccaacctcgaaaacctgatgcaacaaagcttgctaaaaggtggggttctttgttgaaattcgttattataggaccatgtttggtttatgattaactaatgtcacagactcacatacagccttaattagttatgttttggcacaaagtgaccaatggaatggtttccacaagttcggaaccacatggctaaggaagtcaaaatagggtcaatgaaccaaataactaaccacctaaaagtgtcaagccacatcataaagaaacatgtgcaattgtcaactttggcattttaatctcgatcggcgtgtcagagcatgtcactggttttatgtcctcctacatgctccaagtcccaaaccgtgatccaacaaagtacagctttataaattgtaagctgaaccgttttaagcaaggaatcgatgccaaagaagcaggatcaaaccctaccaaagaatgtgactttaaaagagtggtacttctgtcaccactaaaccatgtcgtcgaatgcactccatcaatccatatgtagccatgattgatgcccacaggatggaatgtatgtaaaggcaacgcctaaagatgataattatcgcctgaagatcgatcgatcgatcgatctcgctaattaacgggccatctgcccgttattacataccaaatggtactcagatcacactgatctgaccaacacactagctgtcagtctgtcacccgttacaagtgaattattgagctccaggctagtcagaccaacggattctggctagcacaaagaacaaatcttcagcgattccggcggcagcagcagcgagaacctgacgaaacggtcgccatctcccaaccgcaaccatcgcgcgggccgggcatgcgcactcggcgtctgcgtcggcgacgcagctgagctagctgtggacgacaggcatgtggaaatatggaataaaccaaacgacgtatttacaaatgaaaagtaatttgtaaataaaactttcatatacgtgctaataacaaactaaaggaggagtccctccagttgtggtggaccgtcctatcgagccttgagctcctacattgcttcctctctgacgatgtttccttccacgagtggcactgctcttgccaactcaacgttccgcaggagcatcgttatggattcgacacggtcgtgacccttggtgcgcgttccatttggaaggaacggaacaatcgtgtgttcaataactgttctctgccctggtccgatgtggtaataggcatggcgcaagaggccgccctttggtatcttgcccatcccctgtcgccaacactgccttcctagcgtattaggtcttttagtcgtcccattgtaatcgcaagaataggtttaagttctcgtttttctctttttcctccttttattcccaacccctcctcccccaccccttctttttttttcgtcatctgtgtaaattttattcctctgtgtaatccttttacgtattccaaaaagagcaaactaaagcagaatgctaaaaaataaattttgatgaaaaaaatttctaaaatcagctacaaatttaaggttgaaaatttaaaatttggttgataaacataatgaagccggacgcttcagtgtgcgcgctgagacagctagaggatagaaacaaccaagcagcaaagctaccttcctaccgcacactagctacctttgaggcataggtcgcctctcgcctttcagaattttcagggcctcatgattctgccatggatgtaacagcgagacgtcgatcccgatcgatcgacggtgtaacttccgatcaaatctcagcagcacgcattccgttctcgagtagtaggatccgcgagcacggcgacaacggacggacggaagcttgcgttcttgatttccttggcgccattatccttgcttgattagtgagcgtacgtgcgagattagttgcattgcacaatcgcgcatatgcaacgggtgaagcgacaaaaaaaaatctgcgtgtcaaaagcggaatgaattgatcctgaaaagtttcaggttcacacgtgaatcatgaacggcttggccattttcgtatcccactggattgcatgctggcactcgcgcgctcgtccatcacaacgtcagatagcacgctgcatatgctgtccattttctagtacgctggccgctgggccgtcgtcgtactgaagagcgagcacggtagctgatgcttactcgtagacttacctccgtcacattataagtgcagccgtggtttttcgcacccaactttaaccgtccgtcttatttgaaaaaattttgaaaaaaatttaaaaacataagttacgagtaaagtactattcatgttttatcatctcataacaataaaaatacaaattataaaaaatttttaaataagacgaacgattaaagttggatgcggaaacttatggttgcgcttataatgagacggagtgagtacacgccaaggccagcagagaacgtactgtccgtccgtttctcatgccacagtcgcggttccagtcaaagttttttctcgtcacggcgtctgaaatcttctctctgtgtgtcccctatctccggcacggtttatgtcacaattttcatgccagcttgacaatgttggcgatgcgccgatgccacgtttgtgccaaggcccattgtccccaccagagttttccaaaccgccgataatcgcgcagttatagggtactaaggactcgtacaacggtttttattagtggtctttctatttctatacaagtaaatttaataacatagaaaaaagaaaaaagagtatggttgttgtaacaccctaaaaattcgacgacaaaatctaaactctaaaaatacggatcttcaaaaactttttaaataaagttgcatcatgccaattttgttcgattattttattgaattttgatttcggagtttataaatcgcgaataatggataattagttaggaataaaccctgaaaagtaaattgactaagtaaataattaaagtacaatttaaaataatatttagtgaggatagaaatgagtaaaatattattacgactatatttgtatcaattaaattgaaaagtgtcggaataagaattaactctaattaaattcaagaaaattatataaaaataaaatatgggtaaaattaatcaaggatggacccattggatggaataacacaaatattgagtgaacttcatttgtacaaaaattaaggtttatagaatcaattttaaataaataaataggcttaaatcgggtaaatagaaaacggcactattcatcggccgccaggtgttcgacgaggtcccctagcctaaccctgccccgctgccgcgccgacgccgcgcccgcgccccacgcctcgcgccgcgcaccgccgctaccgctgtcgccgtcgccgctcgcccgtcacatcgccttgcaccccgtgtcgccgctgccacgctgtcaccgtcgccgtcgcgacccgcctcgcgccgcgcgccaccgctgccgccctgtcaccacccgtcccgtcacgcgcgtgtcccatcgcccgccgctgcgccgcgcaccgtcgccgtcgccacgtgccattgccgtcgccgcctcgagccctacaccgccgtcgccatcgccgtcacgccgcgccgtcccatcgccgcgcgcgtcccgtcgccgcgcgcgtcccatcgccgcctcgtgccccgcgctgccgcgccgccgtcgctcaccctccttcaccgccccctctctctcctctctctcacaccctataaaaccccccagcccttcttttctcccccacacccattcccctccatcacctccctttttaccgcgccgccgccgtagtgccgccgcaccgccgccttcgtgctgccgcgccgccgttcccgtgccgccgcgccgccgttcccgtgcccccgcaccgccgttctcgtgccgccactcccgcgccgccgtgcgccaccgtcgctgccgccgtcgtcgccgctgctgccgccggtgagccgccctccgttcccctcgcgtccaccgccgccaccgctcgggtgggagagagagccgagagagagagggagaggaaaagagaggctggcagagagagagagggagaggaaaagagaggccggcagagagagagaaaaagaaagagaggaaaagaaaaagagacaaaaaaaggaaattagagggagattagggaagtttagaaaatttaaaataattggaattttataggttaattatagtcatagaattgcaaaatttaatataaattatggattattcttggcaatttctataagaaatcaattcgcggtaataatttagatgtagttaataactaaacaaatagatgaattcttatggattattatagattatttttttgggtaatccctataagtaatcaattcacggtagaaattcggatttaattcctagggattttagccgtgtattatatttaatcatctagtcatagactaaattaaatcatataatatttctaggatttcgtccgatatttagctcgcgatagaaatctctaacctattatatggatataatgctcgggtagattaaattaaaaacttatgacaacaaaacatttatacccgcaaaatagtttgaatcgaaattgggtttgccttagttcgcgaataataaagttaaaataaaggaatcgactttcgcattcgactttcatttggatttatttggattttgtttgaattctaatcgaattcaaattgttctttcgcacataattatagagaccgagggagccgcggatccgggtgaaggccaagacccgcaagaccttgagcaaggcaagtcatcactattccttgaacatgttgatcccaattgcgaagttgttttgtttacaaataaaattgcatgcaattatgaatatcctacttgtaattatgccatgccttgattattgtttaccccttattccttcgtaaccatgtttacgtatgagtctctagtcaattatgacaattgcttagaaatgctattctagaatcatgcatactcatatttatcaaatgctatatgcttgggcaattacctttgggaaggtaattgagatgcggcatgtggagacatgagcgccacattgccatgatattgatgacatgatttgtgaaaggaaaaaaaagttaaacaactgttttcgactggggcggctggaggatttgggtggtgtccggaaaaggctagtgccgtccctggtcaattaaggaacgagccatgaagttaagcatgaaacgaccccccgtacaaccgcacttctcgtatgggtatagacctagcggagtggatagctgagcggaggcagtatccatgcgtagtggtcttcttttagctgtgtgatgtggcagcagtctgctggcagatgcccggttcggatggccaggtgaatggcggatgcctattccggatggtcagaggctggcttggcaatactacatgaggatacccataagagaacaatcatgatggactgggttcaacgacaagaagcaacgtaggagtgtgtgtttttcccttcccgggagcgccagaactcctctcactgctagaaacgtatgacgcctagagtgcatgaggatgtaaagttcatggagcgggtactgccaatgcgaggttatcgaaaagctttgccgtgacgcgtctcatgtgttgggatgaggctcatgtgttgggcagtcgcggagtgcgggtaaagtgtacatccactacagtgtgagtaaaccaaatctattcgaatagccgtgctcgcggttaatgagcactgggacatgtattacacttggctagactctaaattctttaacttgagtgggatggaatattgcatgataatttttatgctgatggagccacttcctgagaggcgggaatgtggacgtcctcagaaaatcataacgactctatggcgggaagctatccttgggatcacaatggatggtggacagaaccgtcattgtttaatatgaacaatggtattaaaacttgattagtctttgctaggtcttaggcttgtgaaaagaattataaaacttgctttgcgcaaatgaaccatagccatcctttgaaatcctctgtcatgtgcatcattgctgtggtggcttgctgagtacggttggtactcacccttgcaaatataaaatttatcagaagcgggagatgaagcttcggaggatccctatgcctactaccaggagggagatgaagacgaaggcgcccaataggtcttagtacggtcgttgcctgtggcaatggcatgccgctgcttaaattctgctgccttacctatttctgcttttggatgtattccggaccgcttggtccgatgatttaagactatgcctgcaggcttatgatgtaataattcgtactagacattcgtgtatgtgtatttggtatttcagctatgaattcgtgtgtaccagactacttgatccagggaaatggtactgtttacacgattgattcctgttataaaaacgggggtccacagttgttatgcatgataacggctcagagtcgactcttagtatttatttgagcaaattttgttgcatggtagtgaaagaaaggaaagaagagtaagaaaaaatatttttgatacattaatgattagagatcatattgtctctatctgctgtagaatgctactctctagataacgtagagcttatatctgactctatctttatacatgtcctaaaagaaaccgcaataacctccttaaatttaactaaatttaaaaattaatttaaaattttgataaattttatacgatttgtcatggttactatgggtaccgcttatcgtcgggacacgataatcccggtccggtggtctgagaaacgctggtcccgcaactcgcgatttgacgatttgtcttgcacagatcaccggctacaattcgcgagctccatcaatcccatacctgtgcaagctacctgccactgtacagactccatacatgttacttctactactagtactagatgctacaccgtgtagcagcgcactgtttcgccgctatgtagagtgaaacggccactccgctttcaggccgcacgtaacatcgcgcggaactcgccacgtcagccggaacccactgatgacacgcacgcaccaacagtgtgtcaccgcagacgacaagaccgtcgcgcaggggacactcccacatctcacgtcgtctcagccccccaaagcatccgctaccttcactgacatatgggacccacctttggtggggtagctggtgccagcggaaggggggaagcaccggcgccagcgtggccgcttcttccccactgggcctccgcgtttggttgtttctggagcccctggaattcctcttcatttattattgttcccccctgaagctgacgtctggggcccacctggggatgtggcccacgtctcattgggtaggtgctgatggccaggcgtttcgcgtgtttttgtgaccgcgccccggttcaacacgccgaagtggcggcttgcggttagtcgctggctggtggggcatgcgagatacccgggcccacgtgtcggtgagaggaggatttctggaagagaggagcgcttcgcttcgcgtgggggggggggggggggggcaaacgctcgcatttgccactcctggcgaggcaaagcctctccaactttctcctaacgaaaaccacgccacgagaaggaagtgagccaacgacgctggaattttttgaaaatttcagagaaaatttaccggaggagttcgaatttctttcgggtatgaggaggagagttgcactgagcacggcgattgcgttgttagtgggtgctcaattatgtgtggcggcggaggtggaggtcgccggcgccggcggtggggttgtgcggcggcggtcgctccaccagccgttcttcccaatcgagtggtcgccgccgccgccgatgtccgggagcgaggccgtcccgccgccgccgcctgcggccgcggcgtcggccaccaccggcggggggcggtcgacgaccaccgtcatgaacaccgtcgccatcgcgctctcggcgggcctcgtggcgctcgcggtggcgtcctactcctgctgcctcctgctgcggcgacgacgacgcgaggaggaggacgacggcgaccgcgccgcgaagcgggcggtgggggcggcattttctgtggcggcgagagtccctagcgatgtcgggagcagcttccgccagcaccggtcgccgtcgccgagcttgacggcgtcggacgcgatatacctcgacccgcttacgacgctggtggaggtgcgccagcacgaaaagagcccggaccttcgcccgctaccgctgctgaagcagccgagccctgacctccggccggtgccgccgctgaagcggccggaatcgcaacccccgactacgacaccgttcacttcgccgttgaccaccacggggtattccaccgacgaggaggaccatgccacgtactacaccgggccgaaaaccgacatggcctcgttcagccggagcacgagccaggacagtacgctggaacaaacagtcatgtcgtccatggacgcgcctgcacccgtcgaaactaataccccacgacctgttagttcagcaccgccgtcgttccctcgaggtaaatgctgatccggccgctcccggcagaattgccggccgtccgccggcttgccaatcttggaactaaccggatcctcctttaaacccgctgctgaag

SEQ ID NO: 65824 - DNA, 61470 bp, Oryza sativa
  unsure (1)..(61470): unsure at all n locations
aaaaagtcaacggcgccatctattaaaaaacggagggagtagtagtttaaaatgttatatttcatctaaatattatcagtataactttaaaggttgtatattgctagcaggatataaaggtgatgtcacgctttctagtatcattaaatcatcatcgtacttcactgagaacttgcccaaaaccaaaactaagaaaaagtacagactaaacagaaagaattagtaatgtgtatacaccacaagtacaaaatacaccacgatcaaataaaagtataattgatgctttagaatattaaactggtaaaattagtttgcataaaatacacaatttcttgaagatttaaactgatggaatatctttagtttgaaatggaaatcttggagctttgtctactcaataaagagagaatcaaggataaagcagagtaaaatcaaccattccatgcagattcagtcatttgaatataaattaaatttgaaccggctcaaagctgagttcatcagttttatcccaacttaactaccaaacctaactcccatcagaatcccaatttattttctataaacacaagaaatcaaacatagtgagacttgtattgatgtggtagaaactaactcatgattaataaaaatatttggtggattatacataagcttgagactgaagactatcaaaggctactgacttgtattgacattgaaaaacaaattggcagttcagccctgtcagggttatggataccacatacctaatagtagttgactaaatctcggcaggacccaccacataccatgtcctatacggaaacaacctacggatataggagggagttccggataaggaaagacaaccagagttctacatggaaacgacaaggactacttgaattgtatccatattggtttccctagttctacttggacaaggggacacctatgggtataaatacaagcccccctaggaggacagggggacacacacccaccatggaggatcaacacgatcgacccccaccatgagatgatcaacaccaatcatgagacgatcaacacccaccacgagacaatcaactcccaacacaatcaacatagaagcctacatacgccaagacaagccgccggatatcgacatcagagatacgcttggatcgaccctatccggtaccttcagaggctggccgtagggatctagcactgtctctgattccgtcgggcgcgagctcgaggaggaaggctaccctgttgtcgactacgagtcagaccttcagaccgccatatcgacaacagttagataggctacccacatattgtactggtgtgattatggtgaataagagcaataccagcttcggccaacaggatgtagggttattacctgacaactcaggggctcgaacctgtataaaaatccatgtctccatctcttttacctcagtctcgcgtatatcctagcaccaacgatccccatactgtccaaataccgtagtcgtgacatcaaacgtcgacagtggcgcgccaggtagggggattttggtgctttaggatttcgacgagatgggtttaagagatggactctccgacaacaagctactcgacgacttcggctgtggggagatccaacctaaccagatcggaaccatcatcgtcatcgacaacttggtctatcgagatcatccaagcctcaagatacgcggcgtaccaaaagatgtcagatcatatgatgtcgaacgagtacgcaataaggtaattggtagattggtttttcaaattgatctactaatttcgtagatacatccagcatgtatctacaaaggtacgcaatattttatctacaatttatcgtacctattctgatcatacaacattgtcagatctataatttattatgtttacctagagcatgttctttatacaataatatctgttgcgcgggtgtccccgatgttaaatcgactacgatctaacgctgggggctcgctctgtcttcttctgtataaatcatgcttgtttatggtttacataatgcctgatatttacatctgctcgttatatcctgataatactagaagacccatgcagtttttcgaatacatattcgatattatctgctatatatcttgccttctagaaaatatttttcaggaacagttgagcactcgagtaggtgatggtcgagtacactccattaccgagaacattctcgacaaatgcggagttatcgcacccaacctaccaacgaagaccgacgacctatctcatagcaccggccatcgctggactactcgagaaaaggttgttaacggataattcctcgtgaacgtcgtcggcttgatcacccgacatgattgcgagcggacatccgaatatgctataagttgggtatgtacgtcatgctggccacatgatatgcacatgtaataaaccaactttagcgcccctttaggtgattaagagattcctactcctggttcttgaaccagtaaaacgtagtgatctctctcgccccactttaagtggtcgagttacgactactgcctggtcctcgaccagcgatgtagcgtttctcccactacttctactttcagtggtcgagttacgactactgcctggtcctcgaccaacgatgtagcgtctctcccactacttccacttcaagtggtcaagttatgactactgcctggtcctcgaccagcgatgtagcgtttctcccactattttcacttcaagtggtcgagttacgactactccctggtcctcgaccagcggtgtaacgattctcccactatttccactttaagtggtcgagttacgactactgcctggttctcgaccagcgatgtagcgtttctcccactacttccattttaagtggtcgagttacgactactgcctggtcctcgactagcgatgtagcgtttctcccactatttccacttcaagtggtcaagttacgactactgcctggtcctcgaccagcgatgtagcgtttctcccactatttccacttcaagtggtcgagttacgactactccctggtcctcgaccagcggtgtagcgattctcccactatttccactttaagtggtcgagttacgactactacctggtcctcgaccagcggtgtagcgatttctcctactacctctacttcaacaaagttgatagtaggtacacaatatcgccaagtgttttacccagagatcccttaccacgacgacacctagcattgaaacctatcctactgtccctttacgccgtcttgacaaggcctccgaggaacctaagggatcttcggctggggacgcccagagccgataaggccttgtcggatcctgtagagacaaaaggccatgtaagatctggccgtgtaatcagaaattgacttttccaacttcacggctgggggctaggatcagtgcttattcaaccaaggcaggtcaagggtccaagagccttatcctccgagaacgattctccgacgacaaggctgggggctagggagagtgtatgactctacaaactgactgatcgaagtcggtaagagagaagaccctcatacacaaaacattggtcggtaaatttaattcattttcaatttaccatacatattataacattgtcaccttttgagcgttcgctcgggggctatttctatctaatattcttttctgagtattgatttcaggaaaattctattcgacattgttgaagactccatgtctctgtggttctacaccaagatcgactaaggcgagtacgacaaatgtcgacaaagctccgtcgcagactctacgccttcttgatcgctcgagaacggttgctggatctcgacaaggaatacggaataaagacatggtgtacccgccgagataaaatttcttgacttcaattcaaattctcgattacagcaagacgggagacttagttgtacgctatgtactttctcggtcgacatcaaagattgacttagacaaaccctttcggtgcccgcacgaggctgacaaaggaagtctaacgttatctctgaactcaccgaaaacgttcacatgagctcgataatagttactccaaagtctgcgcgcgattgataatatgaattcgttcatttgcattgaagtcggggactactgtcagggttatggacgatcaacaccgatcatgagacgatcaacacccaccacgagacaatcaactcccaacacaatcaacatagaagcctacatatgccaagacaagccgccggatatcgacatcagagatacacctggatcgaccctatccggtaccttcagaggccggccgtagggatctagcactgtctctgattccgtcgggcgcgagctcgaggaggaaggctaccctgttgtcgactacgagtcagaccttcagaccgccatgtcgacaacagttagataggctacccacatattgtactggtgtgattatggtgaataagagcaataccggcttcggccaacaggatgtagggttattacctgacaactcaggggctcgaacctgtataaaaatccatgtctccatctcttttacctcagtctcgcgtatatcctagcaccaacgatccccatactgtccaaataccgtagtcgtgacatcaaacgtcgacagtggcgcgccaggtagggggattttggtgctttaggatttcgacgagatgggtttaagagatggactctccgacaaccagctactcgacgacttcggctgtggggagatccaacctaaccagatcggaaccatcatcgtcatcgacaacttggtctatcgagatcatccaagcctcaagatacgcggcgtaccaaaagatgtcagatcatatgatgtcgaacgagtacgcaataaggtaattggtagattggtttttcaaattgatctactaatttcgtagatacatccagcatgtatctacaaaggtacgcaatattttatctataatttatcatacctattcagatcatacaacattgtcagatctataatttattatgtttacctagaacatgttctttatacaataatatctgttgcgcgggtgtccccgatgttaaatcgactacgatctaacgctgggggctcgctctgtcttcttctgtataaatcatgcttgtttatggtttacataatgcctgatatttacatctgctcgttatatcctgataatactagaagacccatgcagtttttcgaatacatattcaatttgatatttaatttttttccaacgatagagctattgtggagccatctgatgctttaaagttgatgccaacaacttaaaaatttgcatccaaaatagcagagctatattcggctactccacccaaggaacaattagaaatacacaattcgctcatatttcagatgtgtcaaactatcatcatgagtaaaggacccaaatttaaatactttattaatacaacacatatcaaattatcaatgtattgtctacctcacatttctccagtgatacaccgtatagtcaggataatcgactgttggtatcattcccaaagtgaagaaaactatatctttaagcgctttgtgctcattaaaatgagtttgaatcattttggacagttgttaatcctctatcaacaaacataatagataagtaaccatggcgaataaaaagttcagatgcctaaatattttcatcataccatcaccatatgttataggaattaatatagccttatgaatttgcaatatgctaattgtgagcatataacaaaacatagtgttagaatatataatgattccataccgttaaatctttaacaatttttatcagaaccacctaattgttccaaccactatgatttagctgcactgcatcccaacaagctaatttcaattttagacaattattaatggatagacatctccaacggacatcaagctagttgagtagattctgattcttggtgattctaattctaattcaccctaaaatcagaaactaaaaaaatcaggatcaattagataatgtgtttggtgagaaaagtttgattgactcaaaatacaattaaaattacaataattttataaacaatctctcttgcaagaaaacaatcaacaagatcttatataaatgtacttccaatgcagtaacacaaattactgaagaactaaagatgacttgatcgtaatcattaaaccatagaaagtcgctacaaggcagtcaaataatattattacctctccattacatatgtttcgtgttctagaattaagcaatgatgcattagaggtacagtttactctctatttgtttgaagcgatgcatttctagtaagactggttatattgggccttaggtaaggatcaacattgtaagtactaaatgcaccacaccaactagcatatttttggcatcctttgcatacagtgaaaaggagaaaagataagaagataggggatgcaaatacactaatatagagtactctattcatcacagcccaacagtagtccattcaagcacttagctagcctagcctagcaggcagcagtgtaaccctacttcaatcacacacaacataaactatatgcaaatatctataatgtttacttctatcatctagtagcaagtaggcaggaaacaatattgtcgtgaccttaggtcacggacaagatttgggatagaggggaaagtgtatattctccgtctatcctgaatatgagctcgaatgtaaatgccaagaattgaagtttgtattcctcttcctcctcctctgttacaaggttagggttgggttatatagccctcaactatacatatgagattacaaatttgccctcaaatgcttacaaggagttactataatacccctataaagcttataaccctaagggtatattggtacatttttgtggttcctaaagatttttggcgccaacttgcaagagtagttgaagtggtccgcatggaatcttctatgcttgagagcattttccttgatcttctattgccttgggtgaaagacatttcccatgcgaggactcgaacacactcctccgttggctagctccttgggtgtctgtctgctataagtaaaaaatctccccgactgtatataatagctcgaatgtgatttgccatgaccaaacgcctcattggctatgtaaaatagctcgaatacagttttccatgaccaaacacctcatcagctatgtaaaatagcttgaatgaagtttaccatgactagagaccgccttgatcaggctcattgagtcgaaaagtatttgccaagagtaaaagatcactttgacttgttcgccaagggtgtttagactgaatagggggatggagtttaccctgcctcaatacctcatggacctcatttctttttatcccaaaatcacaatattacatagcaaaccaaagtaaaagaaaatatctgttaccaacatgatgcatacaaaataaaatgcaatcattgctcatctccttaaccaaaataaagaaaaggtggcaaaaagaactatttatccatgaagcaaatttaccattctttcacgctgtagttggtatgcaggatggaaggaaagatgtgaaccgagggaaagcggctttggtggctcttgtcgagacgaagtaggatggtcccagtggcacttggggatgaaaagggatgattagcggctaacgagatagcggaaagcggcggcgggcacgggtgagatcgagataggggtgggacggcggtggacgcatcaactgcgtgctcgtttgcacgcgcacgcccccatgccgacgtgtggatgataggaaaaggaataactctactttacctccctcaactcatgccattagttgaatagcatccctcaaccgcaaaaccggatataacccatcctccaactcacaaaaccatcacaaattgactcctcgggtggtttgggaggcggtttcgtctgacgtggtatctttgaccccttgactagctgagtcaacacatgggcccaatatgtcagtgtcttgtagtacaaaaagtctactttacctctcccagattcttcctcctccagccgatctcttgttcgtgcccatgcactgtagcgtaacctcaccttccaagtctggcctccccatcacctctctttccaaattacttgcagaaacggattcttctcgatctcctctccttttctctccaagaaagcctcatcaatatcatgttaaatcccgcgaattttggccatattcttatcccgacgaactcaggatgaaccctagttttccacactgaatccatctgtttctagaccggtcttcctctcctccgcctatatatatataaccctggtttgaactcatgccctagccgcctccccgagcgctttatctctatgttcgcccaaggccaccgctctagccgagccgcaccgccgcaaccgtcgtcgcctgaggtggctgtcgccactgtcgggttcgcaagacgaaggagaagctcggcctcacctctgcttcacttggacatcatcggagcgctgtcgtcgacatcaacccgaggtcgtcgccttttgaagctcgccgccggccactcccgtcgcctctcgttgtcgtaattgcgtcggtaaggtccatcgtgttcccctcttcttgcctatgcccttggtttccaccgccacacctttgttcgccgtcatgccatggccaccgccgtgcaccactaccaggcaccgccaccgcctctgcaagacactgacatatgtggtccgatccacatgctgacgcagctagtcaacggggttgcagatgccacgtcggacgaaaccacctcccaaatcgtctgaagagttgatttgcaacgattttgtgagttggaggacgggttatagccggttttgcggttgagggatacgattcaactagggtatgagttgagggaggcaaagtagacttatttccttcctatactttattgggtgaaaactgtgtgcaaaacaatacggttagttttactatagcccacttgaagctacatgggtttgggccttgaggcccgttccaaaatgggctggatttctcaaagcccaacaaggcaacagctggtctccacaactcagccgtttcgtttcgacaagatgtctccagtatttcacatttcgaaaaccactttcgtcaaaatcacccgctcaaaccaaaaaaaaaaaaaatccccaattcgaaacgcgattcgtcagccgtcgccatggtcgccgccgccgtcggcgaggcgacccctccgccgggcgggccaccctcccgcgtgtccgtgtcctcttcttcgtccaccccgcggcgccggtgcgccgccctcacgagccgcttccgcgagccggcgagcccgcggcggcacgcgtgggtgtcgctgcagggccgcctcgtcggcgccgaggaggcgacgtccgccgcctcggccgcgccggggctccctccggatgaggcggtggcgtgggagctcttcagcccgctccaccgcgtgctcctggtcgccaccgtcgcggctgcctcctcccgctcccacgaggcccgccgcgtcgagcaactccagcgatcgattcatattagggtttggttttactgatctcatatatttcgccttatcccagatttattagtcacatagctaatacttaatagattgaagtgttgaacccctttgttgattttagtgatctcatatatactgaagcctgtgtgttcttgtcatttcggccaagtgctatgcgtatatgacttttattatagtacctcgtaggtgattaggttccacttgaatgttgcatattctaatgtttgcggtaatgtgctatatgcacgatatctcggcttttacatgctgttcttgcagccttaagtaatcgtatgaagaaatgtttatggtatgcaggatgaggtgcttcaaagcatgcagcagaagcttgatgatctgtttgacgagatgaactccctgcaacagcagtatgtcaagtgcaacaccttcatttcctcggagcagggaaaatctgagttggtgggtagcaagaaggtaggagattatgacggagctagatgctgtgcgtgtgcaaagccagagattgctgctactcctcacaagacaaaggtattatgtctttacagagagcttgttccatgaggtattttcatctcacttccttttcatatggtggacgagtgcaggatatctgtggaatggacgatgcaaaatctgatgttgttgataggtccagcgtgagtcatatggaccatgaagagcgccgaatgtcagacctctcagacttttgctggagtgttgtgtcatcggtggataatcatgtaaatggggacaatcaggtaaatcctactccattctgtggtgaaagcatcttatttatgcgcaacgtcatcattgttaattgttcatgtacagtttttttttcaatgtacgaattattgatcaacatttcagtattaccttcattatggagcggagtgctttgataaaatctgaacatttctcgtgctttaaatgttgctgactggtgacactctggtcaattgcatccagctaagttccctggcggcagaacaggaattgtacaaccttcagaaagaatgcgaagagaaggatgcaatcataaaggaactggctgcaactgcacatacatctagcactgctgatgccaaggtacaaattgtcgtggtggtatgccaaccatgtgaattatatatacttatgttatccatctgtctatatgcagagaatagcagagctgcaagaaattcttaaaagaaaaaacatggtgatatctaaactgaagaaggacatgtcagctttaaagcagatggtatgtggtccattgctacttacatcttgtgatttttctttgtgtgttctggtaaagttgtaacatgtcttgtttcaatgtttcatactcaaggttgttgaattaacaagggctaaaagaacatcttctgtcaatttaagtactagctgctctgaactgccagtgatgtcaagtaatgttctttatgatatgagcagcactagcccatcatcatcggattctgagtctcctgtagcaccaagagaataccttgatgatcatcttaaggttgatgatggcattgctggagactctgaatacaagggtagttctagattctcaatggaaagcgcatgttttcccacaaaaaactcatcagctggcaagcttcggtcgactagtccattaaaagagaaccgtatagatccgaatgttgaaacaagtttggtcggtagacagaagcaacgtatatccaccaatggagactttaaaaggactagacggcaaagccagcaagactcaaggaacagagctacaaagagatggatgtagagtttagactgcagttattaccaattacaggtacactgaatacatgactaaattcagttccacagcttttgttaaatttattctactatcaaatatgtgactttattcagtgcacctttcttccatgtatattctttttctttgtactgtgtacttttgtcttcctcttccatcatctttgctgttgctagtcctcagaaccgtagccaatattagtgcaatactccctccgtcccaaaaaaaaaagacaaaccctggacatgttcagattcatagccagggtttgcctttttttaggatggagggagtacatctctaggtgataggctgacagcctttgccagatcagcagatacagcaaattgatattctatatttcattttgatttgtgtattaactgtaattcagtattctgttaccagatacactgtagatatctgtttattctctagatctttatttctttttgttagttgtttctttattactgaaagacttttggacgttaaattacatctgagaacacatcggctgcaacttttcagtttgtccgctttttagggatcaaatacagtcagcttctttgatactatatatccatagtatttcttttaagatgcacatcgtgtaaaacgtcagttaacttcatgtccccttttctttaaccgggtgcagcagctctttttttttcttttaaaaacttggttgatacgctgaccaatccattgtttcggcatttcagagcaggaagagacgaaattggtagcttcatcctggctcctgctgtttctgtaaacaaaaaatatcgatgcaagttgctacatactttatttatgtctatgatgaaaccgaccaattcaagctgttcatcttcgtcattggtatctgctccgatgtataatatgccatttggatctgcacagtcagcgtctctctgctcttgaatctatcgctcttttttaattagtggcttaatttatcaaacggaatccagcagttcatacgtgcacatttttcctatattacttgtttaccaggtacacaaaaaattcttcatacgagttgccagatggttagatatatatactcctggattctgtccatcaggagctcctgattctttttcttccagtagtacaacttatgtgcctatgtatttgcaatttgtcgcacaatttgatacctggattgcttgccgctggcgggctctgcatatgccattgcttccaagcttcatcatcgtttatacatatagccattgggttgggaagtccacaggggcaatctgatgaagttgactccatttgggagctctccaatcgcatctaaccaacaaagtcttagcttggaaatttggaacatatgtgatcaataggaaatagtagtcaaatttacaaaggaatcagctctgaatcgattatggattatctggtttttgagataatattcaagggtgtacaaatgaataaattagctaccccaattacgtagaactaattagacatcatatggtacttcgaattatctagatttatagtaccggattaagtgttcaatctagtattaggcttctatattttagaacgtagagtactttaaaattgaaattttgtttcgttaagaaaaaaaaggtattataagaaacttagtttttgcagaactcgcaacgtttaagaagcttgcaagcatacacgtaatagtttgcaagcattactcttaaatcggtaagaggaaaagaacaggagtcaaaatcaactcgtgaccataaaaaaacggagtaatcaaaacacgccctgcactgtacgaacaacctgaacaagtgaacaggaattcaccgaatcgcattcaattcggaggtggacacatcaaatccaaaggccagataatccaacgaggcggccgccgatcccatcaatccatcaaaattccaactgtactccatctaaaagtttaaattataagagtactgtatttcttttattactaaaagtagaaaggaattcactcgtggatcatatgaaaaaaccaagaaactaataatatacatacatgtaaccaataagtattaaaataatttcttaagttatgatcaataatttaatctaattatctagaacatagatgttgtaaatatattaatctcatttgaaaaaaactaaaaaaataaaatatgcacgaagtgagcgtaacttaactgtggtggtggaatcagcctacccaggtagcaagacgtctgtggtaatagggctattgtatacgtgttgtgtgagactgcgtttatactatgtatttttaaaaatagaaaaaaaattgaaatatgcagtgacattttggatagagagagtactatgcaatacccccctctccctctgacatgtgggccacgcagcaacggatcgagcggccctcgcgcgcgcgagaggtgagaaacgaaacgaaacgtgacgcggcgcgattggtcgtcgtcgtcaaccacctcgacggcgacttgcccccttctcctctcctcttctttaacccctcccccctctcgccgcgcgcgccgccgcggccgcgcggggcgcaaagtctgcgaggagcacgaggccgcgcagagtattctagagaaagtcgccgccccacttggcccacgcgatcgttgcagaggttgatcactcgaggtcgagggcgatcgatgatggagcaggaggacgcgaggaggaagatggcggcggcggcgggggagcgggggcaggtggtggtgctggagtgcgtggcggggagctccaaggcggaggagtggggcggcggcggaggggtggtgcaggaaggggacgtggtggaggcggtccgggtggggcgcggcggcggccccggccccggcgccgcggtgctggaggcgccgttcaagggggggcgcgccgcgctgcacaaggcgatgcacgccgcgttcaagcgcggggacacctccgtcgaggtgcgcgtccgcggaggcagcgagctgcaggcctgcatcctccctcactccggcggcggcggcggcggcggaggcggtggcggaggcggaggaggaggcggcggcggaggtgggaataagcagtacgtgctgcgttccctgcacgaccccaactacgttcttggcttcgtcgaccgcctcgaaagcgagtgcctcttgttgcaaggtaaactacttcgctcactgctcatcgctctgaaatctgaatagttcatccgttttgccgcgcattttgcaattttgctgttccagacgaattcaaccaaaaaatatattactgtttcaagttgattcaagtatagaaatgttctgccgcttcagctcatccttggtgttatgaactgaacctttttgctgatcaaatcgatttcagagaagttcggtgtgttcatttcattacgagaattttttcttgtgtgtgttcattcaatgtgttggtaaaatataaacaagagtgaaacgaacgaaacaggagtatcaacaagacagatgcggcatttaatcttgttttcattttgtgcctttcttggcctctacatgtgtttttacacctgttgtgaaaaagacaagtttgctgtcaactctttgaggttcaaaacccccaccaagaatattctgataagctgatctttcagcgcgttgttgcaggcctaatttccttgcataagtgtgtgtctttctctcacggagagaaaactaatctgcctgtagttatcaatgataagaacgatagctacatgacaaaagataatggaagcaaagtggaaagaaaatagtgataaagtatgggagaatatggaagacgtttcggaaacaatgtcaggccaattgctttggtagagattggtcgtttgtctagatggtgatcaatttctagatacctcgtaatgttcactcgttttctcaattctcatatccccggggaagatggaatttctatggtggactagactttgtagtcgttataaacagtcatcgtttgtggcctcctgattagttggttcattactgttgggacataactaccgcactcttatctgattaggctggtctggacatatatggcttttgatctacctggctagaagttataactgttagtgccctggtgcaacttttctttgtcaagcatgtgcgttttcctgtagaattcagcgcttctgaacaactggtagatgcttccatccctgactttaagttttaagtaagaaacagataatctatttcgttgtgaacttttgggtaatgaaacatataatctcttttgttgtggttttttggattatctttctatggaaagtatgtgactttcccttgattcatgaaggcactaggagcacaagagtggcatcagccctgagcagggcacaacttcaggatggttatgttgcatacccatgggagaagaagatgcgtgactcgttgcgcatgcccaactccagcagctacctctcgatgctcgtcctccccaaagctctggacctgaattcatgtcgatacgagtcctttgaggacacccttgcccgtgccaacgcgtggatctactcctcgcaggtctcaggaatccccatcgagttcatgaatgtgcagagtgaggctcttctcaccaaggtgcagatacaatctccctgcttcaggctttttgcagcctaaatttcctgttgcttaactgaaccttcagtagattgaacctgagtatgaacataaaaccccagataagagttgatttggttaactctacttattaagatgtgatctttgcacttcaaaatgtacagatatctggagagacagcgtctgcaactgttaactcaggttctttgtctgatctgtctaacgtcacgaatgcgaccctgtatggttttgaggattaccatggggtagatattggggtggtgaaagcagcccgactttggtacagctccatagcagaagagatgccgctggagattccacttgaagaaggtgacacgaggctaggattcgccatcagccgtactgaagaggtactttgtcacttgacactgtacacaatgccgacaatagtgtacctgaacaattagaactacacatggaacacactgtgacacatttctttctggcagggttttatcttcatatcttcagtggttgacaatgacaaggacaatgaggcgccatcgacacggtcagggctccgcgatctgttcaaccaggcaagggaggcatcaaaactgctagttatctcaagggtgtccaatgagaaggtccttccctggatgatctccagctcaggagcgatccgctgcttcgacaccatctccctcagccaaaagctttccttgcaccgccttgcggtgcgccccatccagctccacctgctcatgtgggagaaacctagtggtcctgtagaaaggatcattcgctctccgaaacttcccccacaatctgagctacctcaagtaccctggaatctaattgagagcattgaacctagagtagatgttgatgaggactatgtgggggatttgtcatttcggattgatgatctttcagtgggaaccagctgggtgtgatcctttcatgctgcaagcttctaatgtgcatatgtatgtcttcatttacatagttctcttgggcagtatgctcagttttgttccatttaagtgtagaagcctggctagaaatgtccagagccttactaggtttctggatataccaagggcgaggctttcataacatctgaaacattatgttgtgatgcaatgtttttgttgatcatagcataccattggaggaatacataagcatttcaataattatctaaggattatcccaattatgggcctgttaagttactcccaaacatattgttcaacactgacatttctgtactttgtactgaacataaagtttgttacacttaaaccacacaagctattggtcaatgagagctaagccatgaatctcaattatgctacttatcaagttgtgagcactctacacttgagcactcgatattggacatagaaccccggcattaccatgatctttacctgacaaggattgtgcagctgctgcttgtcaggtaggatgtcctccatgtacatctgatcgaatacgcggctctcttcgacccgcatgatcgtcagcgcgggggtgaaggagaaggccaggaggtggagcagccagacgcacttggcagcgacgaagaagcactgcagcagctgctccggccatggccgggaccaattcttcagggtggacacaatgcagctcatcttctggtcgcagaaccggctgaagtcctcgctgtagtacttggtgcccttcctgagcacctcgttccagctcaggttgcgcagtgcgacgaaggaggcgaagctctcctgggatccttgcttgggatcgaggcaccgtggcgagccgttcttctggaacgtgcagttctcgaagtcctggtacattgcctggttcatcagagcttccagatggtacagcaccagcttggagcaatgcttgttgtcagtgatcatgagctggtaaggttggagaagaatgtttagtttttctatcaaaccattgtcaggttcttcgacctgctggatcaatgccttgcagaattgcttcaccgaaagccgcgcctcggaggcgatctgcaagaagccttccaccatggcttcatggctgaccggccccgggagctcctggcttgctccgatcgatcgcgttgatctcctcgacatggaggatgatgatggttgagcgttgctggttgagctcgtcgctagtcgcagtgccttcttgagctccgagcagtaggcctcgaggccggcgagcttggtggtgagctctcccagggacgacctcatctcggcggcttcctgcagcgcggcgtcgcggtgcgcgttcgcgtcggcgagctctcgccggagcgagtcgagcgacagcaacccccactccttgagcagctgcgacatgttctcccgctcgatggcgctcggcgacatcggcttcgccttcttcttcgccctcgggaagagccacgagaggatctgcgcccttctgtgcttcgccggccggggctgcgccgccgccgccgccgccgagagcggcgcgccgctgctggcgaggaacttgagggccccgacgtcgatgccgtggtcccggccgatcgtcgccggccggaacgcgctgccgcacgtcgacggcgccttgagcagctccgccgtgccggccatggtcgccctccccgccgacgcgaggaaacggtcggccgacggcgcggagtgcaagaacgccgggtggaccttgtgccgccggtgatggtcggtggacgacgggaagcggagctcgctgttcgaggacgagaaggcgttgaggttgtcgtagtcggagaaggccgcgtcgtcgtcgtcgtcgccgctgccgccgccgcccaacgcgatgccgctccagttctccgaccggctccggttgtcctggcaaatgtggctgagtccggccatttgctcctcatcgtaagcctgaccaatttaacaagaaattcaagccaaaaattagccaaaaaaatcttgcaaaagaacagaacaaattcagggacagtgagattgaaaaaaaaaagtgaagaaatccaaacagaatggcacattgcaacccacatttctgcaatctgcatggagttgctactgaaagtttccaatttttaccatttaccaaggcaaagtacaggttgctgctataggttaaagcacagcaagagattactccacagatgtgtcatcaagcttctttcagaaaaaggtgagaatgtgacatcaaaagaatctgagataacgcaacttttactgttgcttaactgcattacatgtcctattaattgcagagtaatagtaggagcatctgggattagctgtcaagaagaggaagaacatgctagcagcaagaagagcatgcaagttaaggagaactaatgaatggctcaagttcatcaccaacgaatgacccttgaaaacgagaagagatgaaccaagaaggcacatcgccatggcagcatcaaagatagcagtgacagggtgactgtacgcaagaaaagctcgctcaccggagtaaacaccgggtagtcctcgtcgacggtggccaccgccgccgccgccgcccccgccctggagagcgcgggggacgcggccggcgggaggcggatgatggccgggctgcggctggcgctggcgccgccgcctacgccgccgccgccgcgctgcagcagcgcggcgtggagcgcccgcagctcgaccgccttggcgatggcggcctgcacgtcctgccgcgtcgcctgcaccggcggcgtcgacgtcgccgccgccgtgccgaacgcctcggctgcggcggccgccatggccatgtcaggcgagtcaaaggctgcttcgccttcgcttgccccaaggattcttggaacgcagagcgaggcaagcgagcacgggtgaggagaagcaatggagggggaaatgaacagtagattcttgagagagagagagtggttgttgcagaggagagtgacagattgagagagagattgaggaggtggagggaactgcacatttgaagagatttgccagtgcttgctgcaagcaaggccctcttttcttttgagcttttttttggctttcttttcttttcttttctttttgcttttagctgcattatgtagattcgctgctgctttgtgtatactttgcttgattggtaggagtaccacctcaaattcgggcctcctttgccaaaaatcttgtaaaggtgtattacatgctaccgaccaatgttaaagaaacagccgacaagttggtgattaaggttacgtttttttctgtttattcatcggcttcttgggacaaagattatcagaatctcgatccatatgctagtaccttacaatactactacgattctaccaaatcaaagcggtaccgatccacctagtatttgcattatgctttaaaaaaaatgttttctcgaaaactttcttctactgcagtgctgagtagtgaaatacacttgaaatagagttttatatttgcacaaatttccctccgaaatttttctacacatacaaacttctaacttttccatcacatcgttttaatttcaaccaaacttttaattttgaccgtgaactaaacacacctctatatctgcacaaatttcgagccattgtcactatttttcacctgtttatggctggtagttggaggtaggtcaaaaatctcaatgccaacactacctctatctgcaacaacccggccattaatggacatctctgttgcgatgccctgcaggctttcttgcttgcttgcttgccccgcggtggcggatttgctgtccaaccgaggcggcgacggcgcattaaattcccggccgtcgctctcctctccggcggcggcggccaccgcgatcgccgccggtgacacacgctgccgtgtcaggctaagctcgtgacaacattctggttggagctcggactgaacattttcttttctttttttatggttagctcagacacgagacagacattctgcttagctcagctagctatcacgcgcgacgcggacggaatactgataagcttttttttatcttttgaaagataaactattaaaaggttggacctttcgtcaggaatgcaacctggctttaactaccatttctaaaaagaatgaagcgtataagatgcagttgttgttgttattggtatttttttgggtagatgcagttgttgctgatgatccatttcctcaaaacttaaaatgtactctgaaatctctccatgtcagtataccataaagaattttacaaacattaaggtactatttttcttagtgtaaaatttagtatctttacataccttcttaagcgaatatacaacaaccagacaaatttgctaacatgatatagatgagagtagagagaaatgttgttataagattaatatgggcttaacaatgatttttattgtttataaaagaaaattgtgctgtgtaagagtagggaagaggaaagaatgtaataaaaaaatccgtatactaatagttagagcatttgttatctcaatcgttatatgatgataatctctaactgagttgtgctttaagagccacatcaggttctacatttgatcatgccctaatgggctgtgtacatccttttttgggtgtagaggccggtttaatccattatctaaaaaatttgatcatgccctaatggctttaaaaatcatagtatcctctggaacttatgaactgctgaagcagagacagagatttagatgttcctttttccttgattgtttttttaaggggaggatctcaaggagtctgtcattcttcgcattgttttgagcttagtgcaggattggtcaaaagttagctgtaaaaaggtttacaagatccaagttatacacctatcttgaatcttaaattaaaccctcagggaagtgtcaagcagagagcatactagatgtaaagctcaaggtcctagctgtacatatgtccaatccaaaaggcccaagaatcttatgccaggactcaagatatgttaagggggtaggttgatcattcttaactttatccatggaaatttctcaacaagtgatctgtgaaaggttttttgcaagagacaacacaaccaacaaaaaggtgatctatccattccttttctcctctttacacctttactgaattttcctttgtatcggagtgcttttccaatggcatctagctagatggatctttgcacattgagctcaccatggccatgcatacatgcatggaaggaacaagattggacgtctcattgtcaagttaaccacaggggctgcgtgctactaaagcctaaaaaggcactaaaccaaacactttgagcgtatcttatcttaaccttttacaaccccattgattgagtaagagctgattataaacttatcaacataataaaattatttgtgagtaaaccttctctatatatgtgttcttagcaattttaaagccaatgctggaaaaataaactacaatgaaaaaaaaaacttaaaatcaacttcaaaattattttcttttggcagtggcatatataaccttttatgtgaacccttctattgtcttgcatgcatctgatctgcaaatttttaaaaggagttttcagagcaagaaaacgaaaccaggcaggcaatacccccaaagaggcctttgtcttggcacaaagcaaggaacaaaatactccagctagggggcagtatgcgaagccaagggtagctgcagattgttgcagattgtatacctggaagggatggatgtctgtgtccatgatggtgtttgtttaatccaaaatggcatccagtgatgcccatccattatactagggatgtgtgagtccattttgtttgagggttattaatttattaatccattgtgattgattttacaaatcacaacaaaatagccttagaatccatttttgtccgggctgttgttcaggacaaggtggtgttaaggtcatttggaattcaccccttagtttaagtatgacaggtgcatgtgagctcctagtcctttctggctttctgtccactcttggttaggttaggttaattatctcttccctcttatccttcaatcatcggtcgttttgctaaaataaaagaaaaacatagtaacctttcctaatagcttatatgagcctgaatgcaataagaaaaatacaagtgcagaaactgatttagggcatatttggtttgctactatcttcaaccttaccaaattttaatactcctattgccaaattttttaccctgtttgaaacatattattcactggataattgccatgggttatctacatgtagagataaattaaacatttttataaacaaacttaacaaatagtttagaacaagtagtgtaagcaatgaaataaaatttatgagaaaacatactttagagatgcataattttcccttaacttattcacataactctgcacaaaaatctgataatgtatcaaaccaaactaacagagttattaagggggtgtttggnactctcaaaaacataagtccctcccaaacaccccctaattttggcatcaaactgaacacgcctttaatcgaacagaaaagcagtgtatctttcaggccagaagagtacagggaagcacaacttgtgagtgtttgctgctgcaaaagattgcagcgtgcacagtactaggggtgaaaacggagcggatattatccgatccgatccgctccgaatccgtccgaagtgaggatatggtaagggtctgtagatatccgtccggatgcggatgcggatgcggatagatgcatgcggatgcggatgcggatatggtatcggtaatatccggcggatacggattatccgctattttaaacggattatccgataaacgttttggcggataatccgaatttcacagcccatataaccactcaatttggcccatttgacatgagcattttcatcgtgtaaagattcagcccatccatgtccaccttatccatcaatctatccaggagttcagtccgtgactcaaacgacgtcgcgtcaaccaatttttttatcgagacttctcttctttcagtcctcccacgccgccacctgacgccctgacttacgtgtggaacttctatgtcttatgtgatactgttttttctaacaattgtgaaacttttatgtcttgcgtgttatgtgaatgcgatatatcgtgatgtcaatactgtatgtgtcgattacatgcttttggacagaagacaaatcaatgttaacaacttgacattatattatgatgtgattggtgctttcatgagtcatgtgaattgtgatattggtacctcattgttgctcattgcacagatgataagatgttatatcgattgtatatacatatcacatccgattattttcatccgtttccgagccgagtccgcaccgagtccgcatcatttccgacacccgaaataatccgttccgcatccgcatccgcacattatccgtaccgcctccgaatccgattaaaaaatatggtataggatatggtatgactactatccatccgaatccgatccgttttcacctctacacagtacaatggttgcatatataggactgacaaaagctacagccgcgagtgcgaagccaaagcaggtccaggagacagatataactgcattctgtgagaggcggacaagatcagcggcggtggcaccactgcacgacccggtcggtggccatgcaattgcagatgcaggtcaggtgcatttgcaattgcaacgcaaagaggtgtgtttggttggtgcagcttcttttccgcggcgcctttcgccgcctggtccagagagagagagactcccattgtttcccccattcagcatttgttgttaaattttgaatttagaagttaaaatttaaagttgatttttgattttttttttcatcaaattttattttttatcattagtatttaagtcgttaagaacacatatatgacagttttatctataaattattattattttgttaatacgtcgtatggtgtattatccgtattcggccaaacaatggtggcctaggaggatctgcacgagagcttctaacggttgttgtttcttttaaattaaaagctcacttaaatggtttaatttgtcactctagattttaacaagttgtagttatgggataaaaaataaactaaaaacaagaagttagttttttttcccttgcttctcctgattctccttctcgaaacctaaaattcctcacagacattatagatcatgtttaagtagctgaagattttgataagcaactagtaagaataccaaaataattttttttagcctcttccttttagtttataacctttagtatctgaatcaaaaccagactcttcgaaagagtagagagatttaggaagagttgtagctgtcaaaaactcttctaaacagggccacatgtgtgcagtggttcagggacagagatatcaggatgctgccgaaagacaaggtgccaaaagaattaatgctaatggctgtcttgacagtcctactgtccactgtggttaagctattacgcatggcagggcaggctttgaggctactgttactaatgggccctattatattgtttttttcttgttcatcttttcttcctctttctttgcaactgtagtaggagtacagtactccatttgtgcgtctcaagagaatggatgcccagtcagtgtcgttcttgggagttggaaacagtaagataagtgtactaggggctggtttggttttgctaccatgccaaaatattggcaatgccaaatcataggcaaaatttgatagtgccaaatgttttggcaacttatgtaccttataggcacattttgttagcaaaccaaacactagccaaactactatttaaaatgccaacaatttgatagggcacattttggcatcaaaccaaaatggccctagattagtaggagtataccagaacgtctttgcaatccttccaagggaatgaattggaatagtaagataatatgtgttgtgtaattagccggtaggttaggtccgagcttccaggatggtggtgtggtgtgagcacatcgtgctagcatgctaacagctaatgccactcattatgcaaggcccacaagtttaacctgagtaatactccctccgtcccaaaatataacaacttttaacccctagaatttatcttaaaatataatacttcatccctttcacaatgtaagttattctagcatttcccatattcatattgatgttaatgaatttagatagatatatatgtctagattcattaacatcaatatgaatgtggaaaatgatagaatgacttacattgtgaaaaggagagagtaacttctccaccaacattctcttcccaaccaatcgcaactctccaccattcatttttcccatctaccttcactactcatctaatcacaaccctttacaatttacatctacctactttcttaataaccgtgtccaactctaaaacttattatattctgatacgggggagtagatcattatgctcgagggtttttttcccctctgaatagatatgtcaatatctaataagtttcagacttcagacgacttattcattattggaagtaaaatctttgctgctgctcaacacagtagtctactgcttatgtagctcactactgtttgcagttgaacaatctgatacatgaaaataatgtcaaatctgacaggcagccataggggtgggcagaaaaaaaccgaaccgaaaagactgagaccgagaccgagaaattcggtcctaggtagtgaaagaccggattttgttcggtcaattcggttagtcccctcgggtaaccgaatagaccgaaaagaccgaattaccaaaaaaaatatctaaatgcaacatacaatccactatatttaataggattaatctctaattttcacatcctacttcttctaggcatgcaacctattaagagtctttactcataagtgcttacgaatttttttttgatttttgtgttgaaaatttctattgtttctttgcatatatgaaaatattgttgaatttcggtcaggactgagaccgagaccgagaccgaatttgtcggtcctgacattttttactgaaattcggtcttcacttttcaaagaccgaaaagaccgaagaccgagaccgaaattttcggttagaccgaatacccacccctagacagccataccccaagaccacaaaaaaggggggaaatgtactcactggcagacatacattgtacgctcaatttatgcataatagcatcgatggcattgccggtgtgtatacatgatgcagaggacagggatgtgacccccttctgtctaaaacagcattgatcacctcatgtagagaaacactgaaaataaccttactgataattgttgggaaaatgggaccccatctgcaaatgggttgtaataagcccacaggaattgaacatgaatcttgcaggagcaataaatccaaccctccaagctcaatgctcaagcatcagaggttaccagaaggtacatcgtcattgttacatttggtatagtagcaactacatgtttagtcataacaggggaagtaacaatgtacatctgcaatagtatggccacatccatgcaatagtggatgctaaatcaaaaggttctgtcaggttttccaaggtcccgtggtccggttctgctgtacaaagaccagaatgtgacgctatgaaccctttgaaggtacaacagttgaacgccaccaaaagctaacagagaaactaatagaaagagatctgacgtaatgccaccattttggtggaatgtaaagcaagtcaccctcctccaatatacagtccaagaaatcaagattttctacccgtgggaactccttcagatcaacgttgtcaagatctacctgcacaaacatttgagctgtgttgataaatgggcagttaggagaaactataggcagtgctaaaattatcatggggctagaacactctgtatcctcacatcgcacacaacagaattggacataatgcttttaaccaaataatctgagaaatggttatgactagcaggtaactgaaaaggttgacctagaaaatggaagtcaagcatatttattgtttcctaatttagctctttaaaatgctctgataagtagatccagcttgcaatttcatgcttaagagtaatcaagaagaggatactaacgctgagttcttttcagcaactcattggcaacttactcattttccgttagcacgcatccaaactgctaaacggtgtgtttcgtgcaaaagttttttatataaaagtttctttagaaaaatcaaacaaatccattttttaagtttgtaataattaatactcagtcaatcatgcgctaatcgcttgtctcatttcgggtcacatccaaaatttccgccaaactgcccaattgaatggcccaagaatgcaaatctttggctcacgatccatatatattaaatggtgatgacctgcaaatatatattttttccaaatatgtaaccaatcgaacggagttatgtacctgactggtgttacttagcatagtttctgtgtgtgggtacaagtcctcagatatggaagcaggatatagtctaatatacttccttcccaatacctatcaaggagaaagcaaagatattattaaccaataactgttgataaaagttaccaaaagaaactgctgagtactgatagttatgaactatgatagtactatgcaaacatctcaaatgggtcagccgtccaccatcaatggattaatgatgtgcagaaaggcatttgaatttgtcagctaaactcttaaatatgtatcagatcgctatttttttttggaaaaggagtatcagatggatttgaatgtttggacactcgaatcctttgcaccgcaaagtttcatttacaaagattgattcgctaatattagctttttcttgactgctccaatcaattaaacttatcagatgatcattgttgccaattttgaagaaccgtttcaattatttcaatcaattaaacttatcagattatcattgttgccaagtttgaagaactgtttcaattatatctacctggtagctgactacggaattctgagtagatttatgcatttagacattacatagatgacatgtcaatcagcacctaatcataacgtgatgagtaacatgatagcataaacagtgtgaacagttgaacttgctcatagaaaaaagagtatttactctagaaaaaattattgacaacagatccaaacggggaaaaaatatgaaaaggagtactcacactatacctgagctaaaatgttgtgatgtggatcatggtgcaatggtgtcactgtcccgtgtggaccaaaccatgcattaagtgactgaagctcccctccaccagcataacagtagtcaggaaccattatatcttcatggagctcttttatctgcaaatggcacaaaaaaaaaactgacaattgggcttatacttactagagaatccacaatgatagcatggttacctgttcaaacaagggatgctgagccagatatgtcaagtttgaaggacagccagctgaccacatcctctcaaggaactgagagaaagtgattagctcctgcttccactcactgcacacataattttttccaacctgacagatattcaattacattagtgctatataagtattcagaggtaggtcaatacaggaggaactttcatcataaaatgtcttcgagcaagcataattactcgatgcatgaaaaaggtaactacgggagaataaatgctgcatactaattggattagccatgtaattcagttgaataaatagcatttttgagacactaaattaatgggtaaatatgttacgacacaactattctactgtgatcaaatttcaggaaaatgttccatcacatagaagtcttgtgaataataataataatctatgtatgaaaagattgttcatgcaagagcgccgtagagttaatctagctgtacatgttaaacaatcacacaatcatataaaccaaatctttcggcaaaataagttcatacagaaagagcattgaacataatatgagtaagttaaaatactgaaccaaataccatggcaatatggcatcaaactgaaaccaacaaatatgaacggaacagcttaaaataggttcaatctacctactgttctgatcaccaaggcaaaagattagtgttccaacttgcaaccggaagaatacattgtaacacatttctcaaaattgcacctttgtacaagcaagttgagtcagagacaaatacaagatacaaaaataatctactgtaacttaatgttacttgcagacagctggccaagttcactaaatatcatattttgatgtatataggttgtttgttacaaataagtaataaaacttagcaccaaatttagatgcacttgtttattttacttcaattgaaaagggcataatattggcgctcgaatttgttactatgatcattaatgcactataaaaactataagcatcgaatagtttaaacaaagttaactaaacagaaatggcttgtttccatataatagtcttccagatctagtgtaaagagcaaaaggcatttacttcaacaggaacagttcgatctccagcaatcttcttcaggtattggatgtctttccactttgtccttgcaggccaatgatcgatgcttccactgattataacaggggactcgcgtaaaaagtaatcacatataaattcctccaaagaaatgcatgatcgcctctcaaccttcttacaagataaagactttgccggaagaatattaagtgcctggaaaaagtactgtcagtagtaatacaagatgagcagaaggtaatgattatgaatgcccttatccatacaacaaattcagaaaatgagtaagcgaagtggtaactagaatgaacggtacaaaccataaggagtaatctacaaatcttcactgatcattccagaaaaaaagatattcctacaatttatgagttgatatacggcagttcacccctaacagtttttcgccaccagtttgttccttagccggatctaactatatatgaaattatatagttgcagccatagttaattacgcatactgcaatgagctcctaaaaaattaagctaagttggaacccgcattgccgcagaaaagcgcgcaaaacaaacacggaatcctacaaaggcaacagcgatctcacatcggcgacgtctcgattcctctcgagcccttccctccacctccgggtctcctcgtcgacggcctccgcgtcgccgccgccgccggggtcggcgacgatgcgcgctatggcggcctcgaggtcggcgcggaggaggttcccccccatgatgaggcccatgtcgagcgccctgagcgcggcgcggcggtcggcggcggccgcccccagccgccggagccgcgcgacgtggaggcaggcgagcgcgtaggcgtccctccacgcggcgcccacctcgctccacggccccgagtggagctgctcccacgccatctcccgcgccgcctccgcggcgcggaggtcgccgcacgccgccttctccgccgacgccacgaacgcgaacccgccctcctcggttatctcccgcagcagcgccgccctccgcccctcctccgcctccgtcgccggcgccggcggctcgccgccggccatcggggtggaaagagaaaaaaaaaagcgcaaaaagcggaggagatatttttctggtcgtcgttgcttttgctccggatgcttcctcaacggggatatttgcttactccgtttggtatgctaatatcacgaaatgactttctaatttgggacagataatggttgggttcggcccatatgctttgggcccactagtagacaacatagcaatatatttgggccctgctgataggcctatgtttttggccccaatatatggtagggccatgtcagctggtaccaacagatcgttaatgggctaaaaaattgggccagtaatatatcgatcataatcggcccagaaaatttagattaaggcccaatttcaaacgcacacttgaatttcacattatttttcttatgagcttcacataattcagaacaaaaaaaaaatcaatgtttcttgcattcttttcagcttatggcccatgagttatatgcggataatttgtgtcgtgtttcaaaaaaaatacaatttattcaagaaccttttacattagcattaacaacatcattgtttcatttattcatttgcttatttgaatcacttattagcaaataaaagatccatttgtcagtaaaagttttatatacatatccttatcgactcaaaagcaaatacactaaagtaaactagggtgaaaaaacaaaaaaaaattcaaaattaaattctaaaatgcaaattttagcttataagcaagcaccaagcaatgagatcctaattgtttagataacttattctaaccaaaatatgttatatacttttataatcggttcaaatcatccatttcaaaatgcccccgactgctggatattcgtcggatcgaaggtttcaaaaacgaaaattaatcttgaaaaacctcacgttgcaaacgcggtttgatcgagggagcatgcacactcctacagattaaacgaattaacaacgactgcaggttgcgttttcatcaggaaaaagtttgattgagctgcatcaacacttgatgaaccagctgctgaggtaagatccgctaattcaagatcctatcgacagagatctcgatcgatcgaccaagcagtcaaacacgcctactttgtttacatcaaagggttaatgcccaaacacagtacacatcggttcatccatccatccatccatccattccatggggggtttcacagtcgtcgtcctctctcgatcgatcgcttaatttctgatctctcgatatctctaagctgctagctaagagctacggtgtttgcatgcgttgccggcggcggtgatctcaggtgtggggggcggcggagtgcggcggcggctggtggtcgtgaggcgggtgcctggggcgggtgacccagagggagctgagggtgcggaggcggtggaagtagtcggagacggcgagcagcgaccgcgccatctgcctcgtcgtcagcacctgctgcagccggtgcagcgtctgctgcctcaggttctcagcctgcatatatccagttaattaattacattagaattaaatctactaatcatgcacgagctatttagagtaagtataatagagcgctataagaagactgaatgctgagatagatgagagaggaaaggagagagagagatgagaaacgggactgtaagcttacagccgacttaggcaaaaaaaactaaaaaaatctatgagacagacaggtggactatatatctatagtgaagagctaaccactttataagtaagctgagatatagaccataaagatctatacagtaaacaactaaataactggttgtcttattagccttgctcttagcttgtcggaatgtctgatgctttgccaccgtcatgccaaaatcagcagctaatcatccagaagcacagttagttgaagactttggagtggagttggagttatatatggtaaaactattatatattcgtgcaatccacgatataaaagtaaaaataaatattggacgtttgtaaatttgtcactggttttttctaattttaaaaggatgccactcgaatgatagttttgcaaattcaactctaagattatattttagacgcggatgataagaaaacaaatagacgataagagactataggctggaactaaatcatttctattttcaaaaacaaaacatatattaattcatacttgcatctcaaatggatataagaagttatcctcctatatattttaattgtaaaaaaaaagcaacaactagttacacgcattgtaggaatattactttacacatacgtggacatcattaattagttggctgattaattatactaagcacaaacagtaaccaattaagcaagttgcaaagtgtgatatgaaatgaaatgtgtggtcgatctgtttgtggcatccatgagcaggtgaagggcggcctataaaaaccgagcagccaggcacatctacccaacatggaaagaccgatgaacaaactaacaattagtcaagcaataaaccctcataaattatacatgtttgtggtgtttgttacacagccttttcagggtttttatatcaaatccaacctctgctctctcccgtttctgggatggagacagtcgggtgcttttcaaaagctgaaaaacctaatccacatatgcttctctgtcgatcgatcgacacaacacctagctaggcgacagcaattatctaatttaatcatgaacatattcagtattgcagtgtcgatttcaattaggtgaactatccattgaaccttctcaactactaacaaatatatgtgatcttctcccattggctccagctctaactaatccatcgaagtgacaggagattaactaacaaataaactataataaagtcataaacatgtagtacaacccagttttattgttccgaataattaaatgaacagatggtatattatctgactattcttgagatactcgacgtacaaacgaatgaattaactattataaagttaaaatgtggcttttattaaaaaaaaattctaggcaatctatatataatttcttgaaaaaaaaatcgtattgttcagcagcttggaaagtgtagtgcgataatcaatactccctccgtcccacaatataagggattttgagtttttgtttgcaacgtttgaccactcgtcttattcaaattttttttgcaaatataaaaaacgaaaagttgtgcttaaagtactgtagataataaagtaagtcacaaataaaataaataataattccaaaaaaatttgaataagacgagtggtcaaacgttgcaagcaaaaacttaaaatccattatattataggacggagggagtaattaatctgtaagaggaggaagtacaaatgggcctacaactgatggaactgaagagaaaccaactaactgatgatgaagagtgcatgcaatgcatgactgaactgattgcaagaagggttggtaatttggtatggtttggttactgagctcgatcaaatcatgagagaagaagatgcagacagtgtgtgagaatcacgcaaggtagggtacctggcggacgaagccctcgagggtggagagcttgttgatggcgacggccatctggcccatgtagttggcgacgttggaagggcagctgagggcgtcggagacgacggtgtcggagagcgactggtagagcgcgtcgaggccctgcgtcagcgcctcctccgtctccagcgccgactgctgcagcccgtacacccccacgatctgctgctccgtcagcggctccacgtgcgccaccagcatctgcatcccctccaatccacattgatcacaattactacttattaatcaatccaatcacattaatcacatcacgaattcagtcatgcaatcgagcaaaaaagaagagaacaaatgcacacaaactgttgctctgtcagctagtgatcagatattcagatattcattcaggagttatagtatatgtcaatgcaggtactgtgatagcagctgatataacagttcagtatacgcgatcgatggagcagtttaattacactgaaaaacccagcacaattaatcgtaacagattcgaaacgaatgtaggtaaatcctgaatccgtaatggtttttgttggtttatcagtactgctacgtacgtacgtacagttctacaacatttggttggattcagttgtggcccggcttgaaaagctgaaatcccagtttcctgatctgattatgatcagatcgatcattcaatgcgtcgatatatcgatcgattcgatcgacgcatgcgcccacgcggtcgcgaagatggcggggaatgctcgcacgcgcgcgagcgcgacagatcgatgaagctagctatccatccactactcgttgtcgtcgtccagctctctccatggagggagagggtatgatgagcttgccgagcaagtgcacaacttctcctacccattgctggaaacgacaataacaaggtgtgtgttttggcttttgtcacatgaatattattcactgcctccgcgacccatataattaaggtgccaatgctgctaatactctctccgtttcgtattataaacaagtactaaactaaaatagggtttactatcgacattgtttttttttttaaaaaaaaagacattttcctttacagacggctaggatgcatttgcaaaagacggaatcgcccccctaacagaaggccaatgaaaattttcacatgtagaaaattatcacattccacaagcagttggcttaactcaaccacgtgtgcggccaccttaagtcagccatatatgaaactacgttttcgtatgcgatcaatgacacgacccttatggattgtcaatgcagtcggagggggcatcaatagaaatcattttttatatagtgaggctaagtattatatattttcaattttcttatcgaaattgttttcgataagttacttttttcatgttgatcaaaattagaaatgcgcaaacttttttcatgcgacatttttcttcatcactctgaagacccgagctagttaaggttgtttatgtaaattcttttattttcttttgagggactaatacgcaatataaaaatattcgaggggtttcaaagcataatccaaattattttttccccactttgttccgtttgtcttctacctcccgacgaagccattgtcaatcgctacgagcatctagggttagggttaatccaatccaagccaatccatggcggggggagtgcatagtagcgtaccttgatgacctcggaggggcggaagccgccgagccagaggaagcagcgctcggctgggctcatccagacgccggagatgaggtggaagacgtcgcccctgatggcgccgtccttgatggcggcgacctcgtcgtggtgcgccaggcagctctccacgtacacctgcagctccccctccggcagctgctgctgcagcgccgcccgcagctcgtacatcagccggtggtgctcctcctgccacctcccgtactccacgtcgaacatcgccgcctccgagctcagccccccgccgccgccgccgccgacgccatcgatcccgcccagcaggacccccttcccgctgcctccctcgccgatcagcccgccgctgccggggaagaacaccccctgcaccatgtatagatccgtacacattttcatccataatacataatccgaattggttgtgtttgatttgatttgggtgcagtttgaattttgctcgaatttgaaattatgaaattcgcctacctgggctctcgcggtgtgcagttcctgttcgagctgagcaagcctgatcctgctggactccagctgctggatgtaagcctgtcgtttcagtcaaaatttcagtaaagtaattaatccacagtggctgaattgaagaagagtggtagtaattaactagcaaaattaatttggtttaatttgatcaaatttgggtgattgcttttgttctgaatatattgaatatatatagcctgtcattttcttctttttctttctgtgtttaattactgtttaattttgcttcactcaccttcttccttagcctgcttttccttgctgcctccctgttctgggctagcctcctcagcgtctgcatatatttacattaatcacaaaatgatacgcaaaaaagtaagcatgatcagaccaaatcatttttagtattgtccttaactcaactgatatgcacaaaaagagaacaacaactaatctctaattatttcttgagaatatcactagtatagtacctttgggtcgcgttcaccagtagatacacccctcctgtgatccttctgcaataataaaaaaaaacataaacaatatgcacattaatgtaagctaaaacataaaaacaatcaaggacagtgttctgaatagattaatcagggtgttttctttagctagcagggttagatattagttggttaattaagtggttaagtgatgatgctgaccttggctgtcaccggcttcacatccctgttgatccctgcaggctcagcagcgaaaggttggtgctgcaggtggtggtgatcctgtctcctgctccctgtcgccaactcctccatggctgctgctgcttgctgctgatggtggtggtgatgatcaggtgacctcgccatcttggttcccacagctgctggggacagcactaaactaatctctccctgccaaatcaatcaatcaatcatcacatccacaaacattaaaccaatctttgatttcatatatactacacacgagtgctacattgaaaagacaaatgacataaccaatgtgagattcagatgaaagtaagtaaaattaattaaataccttgggtgatggctccacatgcatgggctgggaagggaagatgttgagggtctctgcatcatccatgagcacaacacaaatcaagagatcgatcgagcaaaagcagaagaccagctaaccctggagactcacacaccacaactcacaaactgatcgaattgctactgaaaactctactgaagaagagagctaggctgtatatatgcaggcatgcagctggaacaagacactactgtgctactgctgctgctgctcaaattcatcatgctttgcatggcagagagtagtgtgtactatatatgcatgctaggtacgtccaaagctagctatagctgcagtactgcaggcacacaggcaacacgagaaagctgggggctacgagagatacgggagccaaggacagatatcacacagctgcacagctagctgctgctacactgcaacactgatcactgtaacctgaagctggaaacaacagaagtggatagcatcgatcgggtcaaactcgaacaaatgtgcacatcttgctactactcctagctagtagcagcaacaagaacgatcagtagcatggggattgatcgatcatctcttcggcgtgtgtgtgtacgtccctctttctctgcaccaggccacatgcagatgcagctcgatctcggcgaaatcattgagcagtttgttacatgtcacagtccaaaccagccggccagatcttagcagtcagagatagagagagagagagagagggaagagagaggtatagctagagagattgttggtttcatatgcatggactttgggttgctgattccctggtcctgagatgtgtgatctccacaggagtgcagtggtagtagtagcagtagtagtactgcagagatttgttgcagctagcagatatcctggtcaaaatggagtacctgagaatctgctgcatgcaggccggccggccgtataccatgatcgtttctgatgaccccagaaaaaggatgcaactttctgcaaccataggaatatatccctcctcctcctatactacagcctactgctactccctgtgtatgcttggcacatttgtttctgtgcctaagctatatatactgctgttattatgctattattactactaatgctaaatgccaaaagaagaacaactgaaaactgttactactgatctcatcacctgcattaatactctttgaaaaaaaaaatctgaactttttgcaaggaaatatatatggtgaatgcatgtttgagaaaatttgtggtgatttttcggttggcgaattaaaatttacgggtttttttcgtatacgtacgcctttgttcttggtgcgacgccgcatggctgccatgatccaggtacatgaacaaggcctggtccagctcccccagatgatcataagctcctgcagatgcctccttgctgctcctggtggtgcaacacaagaagcaaaattaggagcagcacaagaagcaaaattgttggtgatgaggtatagctatatgtatgtgtgagatagatgcaggtagtatagtagcatgcatgcacaaggttgaggaagtagtgaaggcatcacacatcatcatgaaatcatgcttctataagccaattatgtatgatgctatattaattatttgtctggtccaacctctgcaagactgcaagagtaggagcagaagaataatatgaatctactctacctttgtagcatttattttggcacagcccagaaaataagcatggccatgtactctccaaatttcatgtgtgcaagtcatgctcactgtaaattaaatgtaaaaacttgggcagatatgtatgatcagttggtcataaatatgtcttaggtaatgctcttgtacttatgcggaaatgaatcgctgacctcccaaaatttgaaagaaagactagcgagttgttgcaacaattcaactatatctggctccagatattaaatcacaagtactgaatttttaaatctgaacttgtttgatcatcgtctaactttttttttcttggggggagaggaagaaggaagagaaaaggaccgatctgtttgcatccgctcaaacaatcactgaattcccaaccaggaagcaaaaaggcaaaatcgtctgcatgtaaaatgcaaaattctagcaaaaaaagaagcaaaatcttcaacatgtagaacagtagaatgcaaaattcagtccacaagaagattattggtaacctagtttctccatggctagtgttttgttaaaagaggaggaggaggagaagaggaaattaaagcagtttccataaaaagaagaaggagaagaagaagaggaaaccatggcaaaaaagagatcagaagaaccagcagaaacaaagagagcaagcaagaaaaaagaaccaaaccaaaacaaaccatgcatgatcatgactaacaaatcagagatcaaaatcaaactccaagacacggcccaaatcaagaacaagaaagagacacacatatatatgcatcaaacaaatcagagagagagagagagagggagagagattcagtaaacaaagccgtacatgaagcttgcggcagcggcatgcatggaggaagaggaagacgatgacggaggcggatgatgatggtgctgctgctgatgctgtccgtagtgatggtggccatggttcatcatcatcccaaaggagatgttcatctcctgctgctgacgatgctccctctcctgctggctctcgctcccgctcatcatcgatcgatcaaatcaaagctaacctcttcagaatcgagaggaggaagaagagaagaagaagaacacacgccgaaacatacacagagaaggcaaggtagcaagctatatacgtatgcgtatgtgcctctatctatctatagccatagctgcaaggtcctaaatactctttgactctatgaggctagcagccaaggcgccacctctctctctctcactcactttctctcttcctcttccacaccagcaactaccccatgcatgacctctagctctatctaggactctagttcgtgatggcgccttggacactagcaccacttgcaaactaccctctcttactgctttgatgatgctgttcctgggctgctactgctttgatttcctcttaattcactaatatggttgctgatgatgatgatcttggctatgtgtttctagagagagaggtgagtgggagagccattaatggcgaaacagactttctgtttggctccatgctccctctgcatctaatggtatactgctacaaacagccgacttcttctcttctctcctctcctctcaattttctctctctagattgagagagaagtagagagagagatggaggggcaggtgaagcagaagacgtcgccacctttaatttttctgccacttttgcaccgaagcactcgtggtttctcttattctcgtttcaattcaaaccccggccggtgacaaattgcattagccattaatttagccactgtattttgttaactaaaaactgaactgttattacgatttgagatgccggtagagttgtgcagttgtgcatgcatgcaccaattaacgatttgagatgtgatcctttcaacttgtctttgtctctgttttgactttcggtagaaaccgatattgatgtgttcactcccaacagcaaagtcagtagtacgtactaccatgaaaaaagttggtcagagccacccaaagattgcgagagagaatttttctatgagagtgagctagaaaaagtaagcaatgccttgtgccaaaaagcccaggcctcttctaaaagtaaagtgagttcaaactgcccgtttgtctcacggcctcgatcgtgtcgatatgatgttgtagagattaattgatactatctttgatttttaaatataagtcgttttagccttatgataagaattgagaaaacaatacaaacgactttattgtgcttcatttatactgcggggaaaaaatagcgtgtttatttgtgagcgaggtaggtagcatttatttagcaatgacgggtagggaagaaagaccgaaaaagtgtcttgaagttccaaaaggacttgtatttaataatacattgagaagtttaaaatgatttagaatcagagagagtattaacttgaaaatttgcaaaatgtcatgtgaatcagtttaattcccatagaactccatgaaactttgtacccatgatttcaaagaggagaagaactagataggtgtggtgtaaaaaggtaacgtaggtagcatgatcgaacagaagcatgcgacgaacaaagaaccacccgccttcctagccatggtccccaaaaaaatatacatatagtttaattctaaacggaagaaagatctaagaaaacaacacaaatgattttatcgtgcttcatttatacatggaaaatgattcatttacttacgagtgaggtagcatttatttagcaatgacaaccagggaagaaataccaaaatagtgactataaattccaaaataactcatatttaagaaaacattgagaagtctagaatgatttagaatatgagggaatattgacgtaaaaattttacaaaactaagtgtgtgaatcagttcaattctcgttgaattccactacccataattccaaagaggagaagatcagctagacagctagacaggtgtggtgtaaaaaggtaatgtaggtagcacgatcaaactagagtaggagaggacaaataaccgtccacatgcctagctatggaaaaaaatatttctagtttaattctgaacggaagaagtgaatcgttttagccttgtgcggaacaagtaaaaaaacaacatgaatgacattattgcacttcatttatactacatggaggaaataactcaattatttacaagttaggtagtaagcgtttgtttagcaatatcaaacaggaaaaaagaagaccgcaaaaatgactagaggttttaggacgacttagatttaggaaaatattaaaaatgctataaaataacttgaaaatctgacaaaagcctataacattaaagaaagtacaaaatgtcacgtggatcagctcaactcccgtaaaacttcctacatatgacaaattgggaaggaaaacgttgagcaagcatgctataacttgaaatcagagggagtataacataaaaactttacaggatatctaggttttaattctcctgaaaattctgcaaaattatactttccgcctatgattagtgtggtgtaaaaaggtaagagtttggtttggtagtataggtaggttggtcgagcgaagtggaggatcgcgcgggcgacgacaaaagaaccgcccgctcgctcgcgctggctgtgggcatggtccaagattgagagccgcgcctgggatcagacgcacaagagacgcagaagaattattcgccgagtatgtgaatgctcctgttgctgccctcgaggcacgtataccgtccccaactcccaaaatcatcagtctgttgaatgaatgaaaatgaatgaatggccatcgccttacgtggccgctatctccccatcctccgatccaatgcatctttgcttaatttgcgttgcattatcccccgaattctcggcaaatttctcttcatcatctccagtttctgtttgttttattatctcgatcatcataatacaggtagtagtagtttgttatagtacatctatcatcttgaaatcacaacacttgtagtcctactagcaattatttttacgtgaaaaacataattaaaaaaaaccacctgcgccgataaacaatgatcattgagttgtctggcttaacaaaaatatataaagagacaagatagaatcctaaagtcctactagcaaactaacctgaatatattgcatgttaaaattcaaatcacatttatatttaacagtacgtttgttgaaattggttcaattctcgttgaattcctttgttgcaacggacccaattgaattggtgcacacgttacaaaaaaactggcctgaattcttggaggaacaggggagaaaagtttcgactgaccgacttaaattgttcgttcactggacgcattaactttgaagtgaatgtgctagcgagtgactggcaggaggatcgtcgatcggaccaggaggaccggaccgagggagttctgacatcttggaaattgcagtctcgagatggtaactcgatcagttcagcagcctcatggcttgtaaaaattcttcgtcttctcgtgtactagaaaaaaaagattgttccttttgagactttgaaaatacagttgctgctgctcatgtcatctggagacttgcagcctgtggtaggacgctcctggaaattgcagcatgagttgtgacccagtttagcgaagccgtcaacctttgcctgatgacgacgaaacaggaactccgtcagctcctagctaaagaaaacacagggtcagattatctcacgagattattaatttattatcattcgtttatgacaattcatattctaggaaaaaactcagcatatattattatgtacaaacggccggaagcagattcttttctattatataacgctcgtttcagctacaaaatatggtcaagacgacagtgaaaataaatgaaaatgcaaacgtccatgagttatttctttacctaatgtgctagaagagaaaaggtagagcaattgctaaaagactcaccttgacagcataggtgaagaggagtaagagcaggtacgatagcaggctataagccagctataaatatattttaaagagataaaggaagagagagaaaagcggcgggctacagatctgtagccagctgcagcacgaattctaagatgtaatgtgtgtatgatagatgggactaggtattaatagtatagtaagcaactattgtatgaattgactattacattagttatagataatttggagctagtagtgggctatactattaaacttgccctaataaaagattagtactctaggggtagtagaaaggacttacggagtacacttctctccatgcgtaaagagtacttgcatccaaaaggagaatctccggtagaagtcaaaactgttactgcctgacatcccgtttcgcaagtcgatattctactcaacagagcttttcactgatccagtcgttctgaattctgaacatatgctccagcgggtagcaggtctgccatgtgatgggaggcatggagctgcagctgctgctgcaaaaggattaggatcagaggacccacaatagttggcccctgctattttgtgcacaagaacagcaatcaaataagggaacaagaagtcaagaacaacattgtctctccaagccaagaggtatgaatcttgtgtctttaacgcaaaaggaatcaaacaaaatcatcctaaaaacacacgaacagaaaagaacaacaaacgagaggcagcaacaacattccagcatggactgaacagcaatggcaaagctcaaacaaccaaccaaacaatgcaaatcactgcgatgtcaaaacaaaaatgcagatgacagataacagcaatgggaaatgattatgcaaaaacagaacccgctccatgatgagatgaatgtgttacatgaagctctgcacaattagaagtcatatggcaaactttgtaaaagtactgctgacattgacagtaacaaaaattagtatttcacgaacataactgccccaatgcgatcaaagaaaaatcccttcactttgacctttccctaattcatgcattacaaacatgtcgcaagtcaatgacaatctcaatccattatcaattcgaattttttgaaaataaaaatagcagcagccattcattgcttggattgatctctacttttatcattgaaaagaaaatagtatgtcaacttttaacatttgaaactatgttggctgttatgcatacaaagcttttcttcgtgaaatatttatcaagaccatttcaagttcacatgctactcccaactcacatgcttctcaaggatacataagctacagctcgcagatcttggatgcatgcatagtcacatagatgcactgtggtgagaaaacttacggatagcctctagataagaataatcaagcatagaagatacatggtgcaagggatccaagatgcatggtttaggaaaagaaaattgtactggaagcaatttctactttccaagaaattgtgctgggtcataagtaagcagctcccaaaattaaagcatctcataaaaataagcaatcatgatgatatagttactatcaatgctgcaagaacctagtaacattctacatgctcatggcatttgggcagaacaggttctttcatataatagtcaaaactcaaagattatactttcataataagagcatcagttcaggaccaactctagccatagattgatgggtttcttcgcccaattaaacatcatgtaaccacatgcagcactgtgcttagctgaagttattagtattaataaaattaagataaaacttatgcttcccagtgtttagccataagcaccagaacatttccttaacattagttgtttttagttttttaggtaagagaactacagaagacactccatggctcttattcagcgtataaacgctttcttggacttctttttttttttaaaaaaaaagcaagcaggattgcaaacagattctacaaattggaaaatgtaccagtcatacaaaatgtccagcaggacaagctatcatagtatcatacagatttaagggttattttcttttagggaatgcacaaagacttgtctatcatcacatcaagcctgggtactgatgttcaattacatcgatctaacttcacagctgcatgagaccaccaaaagtaactatgccatattgccatgtatgatgtatcgttgcatcaagggttcttttctctcagctatctccaaaaataactatgccaattgccaagtagcacaaggggacagaggaggatagtgttggtgtgatttagtagcagcccccattgccacctggtagatagtgccattacattagagtatcctaaaattttatatgcacttatagaattgcttcacttttgtaactattagaaaatggcactggcaaagagcttttgatctgctacaacagttctctacttcattgtaattgaacatatggacagatcggatacaggaggttcctatcaactgatgatttttcatttattagtcgcatataaaatgttgaggtgaattctcaatgtttctgtagaatgcataaggggagagagtgagagaaagcaggagaccaaaactttcatttctcgcaggctaaaaaaattacaaaaactatgttcattcttcactagatatctttcttcagaaaaggccatatttcaaacttaaatcatatacacctttcccatttacaattcggtcatcatttgatatatcatttccaaagaatgcaagtcaggtataatttgccatgctagaaacggtatcaactaacaagattgatatttgatggcaaaataagaagtatagccttccatactcaagttacgatggtaatcctactgacaaaatgggcgacagaaacaaatgcaaggaggcattggagcctaacctgaaaaggagaaatgaaaaaaatggtcaaagaggaagcaacatcgaataaatggatatgtttaatgaatttacctatgttatgttcccaagtattccattagatcatcatcatgcagcagcaaatcatcaatatctgggattgggctactgatactgatatagtctaaaggtaatcccgcaaaggaactgccagcaaacttatcttgttcgccatagaaagggtaatcaatgagctgcatatctccaggaacagaagtagaattcccactaccaattatttgatcactataaggactgttgtcagctggtgttctgatacccaagggaaccacatgatgctccatgatagatagtggaagtggttgcttaggaggtatggtctggtaactactaggcatattgttaaagcctgaatcagaatcctgtgggaagatatttccagtttttggcctggaattgtcactgctttcataaggtacagcctggcctctcatgcatatgcttacaggagtagcaattgttgcctgcgcattgccatagtgattaaaatcggcaggaagatgggccagttcttgagtatttcctctgtgttgcaaagcttcactcgtattagcttcctcattgaagcttgtaatctggttagccatgccttggatttctacctggtccagtcggttcatatctggaatcatattccttgaatgttctgatgcgtcatcagctctttgtacctcctgctcaattacggtgacactgtggcgtggtctttttctctttggtggttcttttgttcctgccttcttaggaacaacctgattagggcgtttgactttagctctttctctccttgttggggcatgctcctcgctcaactgtgcagccggagaaagatcttgttcatcatctccagatgatgttgaaaggggagcctcctcaaaaccatcaacatcatactcattactgctgctgtgtgtgtccccatttctgtactccagagcaccgtggtgagtaacctctgacatgccattgtcaatgctgagaacaagcctttcctctctctgtagaacacccaaccaaatcaggctctcttttgcagtcatcttatcctgcaagcattttgatttcctaacatggtttctgatcttatcgaagtttggggacatgtgcttgatcacacctgtaagcaccccaaccttccagaccttcttaagatcatgtggctttttatacggaggaatttgccccctcggaaggcccaacgcaatccaccaatcctcgttccctgaaggccaccacgggggtggagtgcccctctccaatgggtacttgcgctgcggtggatcacagtgctgcatcaatgacgaaagcagtgaaccgagagtggcgtcttggagatccatcaagctgtgctggctcttgatcccgctgctcggagcatcagccgacgccaagttctccgactcatactttgcgattgccgccggcccgttcttatcaaacttcaccttctccttccaccaagctctaatattgtcggaagcgccgctcacgggcttccctttatcagggatgatcccgtaaacgaacccgcgcgcgttgcacacctccatcagcttgagcatgtacttgaggatcccgtcctgcgccctcgacatcttcttgcgcatggcctgatcggatatcggcttccccttggacttgtccagctcagcctgctgcagcgcaagggcgagcctgtcctgcctctccttgatcctcctcagcttgatcctgtctttccacatccgccgggccagatcctcggcctcaatctcctcgtcgctgacatcattctccgtcagattctggatgccctccacctcgaagtccgacgaatcccccaactccgtcgcaatgatagccagatgatccatcacaacaccacaaactagggatttcccacaacccgatcacatccaactccactcccccccaaccctctcctcgtcagcaatccgcccaccgaaatcctagcgagaattcatacctcccggtgccaatcgggagcgagtcagcaccaatccgaatccgcgaaacaagccctgcaaaaggcgaagaccaatacaggattaacgccaccaaaaaaccaaaaccccatccatccaccccgactcatccaggaacaccgaaacaacgaacagaaatcggaggaatcagcagggcgggcgcgtacttgggcagcagcggatgggattgtgcgcggcgcggcgcgaggcgaatgcgacggcgaaagagagagaagaaatcgctgtgctcccctcctccctcgaatcgaagcgaatcaatctgttcgggggaatggggaattttatttatttttttaattttttttgcccagtggaggtggaaaagattcgcttctcttccgtgtttccctttttttagaaaaaataaaaggggaaagggaaaggaaacacgagggaggctagcgctgaggaggaagggagcaggggtagggaaggaaagaaagaaaggctcgcagatcccatttgctccggtccactctgtgcacagccctgtgttgtctaggactacctccgtctcaaaataagtgcggtcatggaaatctgttttcaacatttgaccgttcgtcttatttgaaaaatttatgaaatttttttaaaaaaatagtcacacataaagtattattcatgttttattatctaatagcaataaaaatagtaatcataaaaaaaattcaaataagacaaacgatcaaacgttggagatgaatagtgtaaaactgcacttattttaggacggagggagtaagttggagttgggaactctcctccaaacatgtaaaacggagctatccattagtaagaattaattatttttttaaaaaaataaatcaatatgatttttaaagaaacttttgtatatttttttatgcaaaatcatgctatttagcaatttggtaagcatgtgtacggaaaacgaggaaagtgagttgggaaagctaattctatataccactttaaatgatgttacacgtaaatgatccagaattactaattttagaaattgtaaagggttacgtacaaaaccttcaaattcaccttctaccaacaaatgaattataagagtctccaatcttgtatgatccgaccgtatgactcgtgaacatagtcggagaggataaaacgaggtgatctagaagcattttttcagtgtggctgcccttggagatgacattatatgcttaatcatctaaccatgctataaacttgttttttttttgcttttgcttttatttctcaaaatatactccctccattccaaattaatctgcatatatatttttttaagttattcctaaatgatctacatatttgcgttcattcattaggactattcgttatttgtacattggagtaaatagatattgatgcatgcatccatgcacacaagcatttataacccacatgcaatatcttgatttgctattggctagaaaatagtggggatggtgtatgcattgagtttgttgctagagtaaatatagtatgagagagttattagcttttcttggtcttggtatacctatgaaatatgcagatagggagtatgttgcaacacacaggttttagctagttttttgaaaaaaaaaatgttggagtgtgtgtcatttcacataaatttcatttatcaagttaatttataatagatgatagctgggttagaatatgtattttttaccaactacttgtcgtaagttacagttaaaatagttaagctgtttagaaagatgcgaagatttgttcgtgattttcaaatatagtggttttctcattgttgttagaatataatatactccctctgtgtcaagataaatcaacttttgtcctaaatctagacattaacgtagagagttaatttatttttttatgggagtatcattttttattacacaaaagacgcacactactcccacatccacgagtgtgtctcctaaaacacgctcaaatttagccgcggccgtagcaccactataacccatttgttgcttcattttgcgtgtaaagggagggttcccaacccttccaaaacaacacagcccgtataactcagccaacccaacagtcacagaaatgtgaaacctcttcctctccacaaaggatcccgatctcaaggggtcagccatgatgcatcaatgttcactggacacccccaagcttgtgtttgtgtacgttccttccttgagtgacttttcctgcttccgtagagccgttttccagcgtcaacccatgctcggaatctcggattctcgctcggctacgaccactccccatcccggagaccgcccgtctcaaccaccccaccctctcatcgattccatcctttctacggcggtggcggcggcggcggcgcgcggcgctgcgaacggtgagcgtcaggcattcgtcgtcttgaccatgaaacttgaaagacctcgtggttgtactctggcagaggcgtcgtcagacgtgtcatcgtcaagtggctataaaaactaacactacttaagtttgaggtcaaatagattcagagccacacgtttcttaaggatcaaggagtttgatttagcaaaacaaaaaataagattaagcaaagttatacaagtaacacaaacttgcagggtatggataagatagtagccctactggtagtattctaggagtactgctggtagcagcttgtttgttcgtgcatggcacctttggtggtttttttttggccatttgctaaggttcactgaaagggcagattcattgaacgtggaccccctcgttaggtgccgaggaagccgtccagattcactgtacccagcagcgggcctctcatgggccttgtccatcaatctgggccgagagccaattcaggccggaacacaacaagagcagtagtagaaaagtaataagttcaggttaggtcccttgaattatcaccgagttcgactttggtcctcgaaccacaataccacgtacaacaacgagggggcagtccctcaacttgcaaaacctgtacccgagattctaaacagtatagtgtccagttttaactaacatgactaggtgggtctcacatgtcaggcatatttctcgtcctctccaacctcctgccattgctaactaaaattataaatctctcctttttagttttagtagagttgttggtattttttggatgtatccatcctaatcaacaagcaggaggtctcttctctgatttaatttgctagcccatcagatatggggtgcttcgcgttcaagagcggcaacaggagcaaaggccaagaacgcgcggacgccggtggcggcggccgcgtcgtcctcgcgcgccgtcaagcgccttaaccagcgcagcctgcaggtcagtatggttttgcatttactcctctcaaaaaattgccatggtgcttttgatttgagctagatttgtcaaaaccataccgaatttgttcatcagaatgatcgaattacaggcgatacttcggcaaaaaatgaacttgcagattttgtcttttgagcctgtgcactgaccacatgtctgcatattttcagagtaccaaaaagaaataggcctaatatgtggggctcactcgtcacataagctaaaaccaagcattatactgtttgggatctcggctacaacagttttataagttgagagacacgttatatctggcattgtgtttgggggatgaaattcgaactcaacaactagataaaggacgtaaagtgaacttattccagtggaaaacgagatgaaacaaagagacgagaatttgttttattttcctccagatcgacgaacaaacaaccgaaacgaattccaattggtaaatcaaatagctcaagcaacaatgagctttatcccctccccctcactcaacaatggcaacggtggtcaagcatgtacagtacatcaattcaccaatcactctgaaactgaaaatcgcacagagagctagcttagcttagctagaaccattagctcactcagtacttcttccgcttgaggaagttggcgatccagtagctggactgcttgtggtagcgcttgagattgttgaggcggtcgatgtagatgaggccgaatcggtcgaggtatccgtcgccccactcgaagcagtccatgaacgtccaggtgaagtagcccttcacgttcaccccgttcttgatggcgtggttgacgaactgcaggtgtttcgagtggaactcgatcctatgcccgtccttgagcgcctccgtgattggcaagctcttgttgttcccctcggcgattcctgcaatcacacatgaaagtcatcttgcaggatgtcgatcccctcgttttttttttcatttccatgttatccaaatagttgtgaaaaagttttggagaaaaaaaatgagaatgtagttcaaatgtatcagcccacaaaacatgcaacttcaagttcaaattaatctatataaagagtgtactacttatctatactcctttaaaagaccctaatgataatggtgagtggtgaatctgccaccacccaccaccactaccatatgggtcccctaaatactgagataggtggacttttatcccttccttggccagaagccatcaaacaaggaaaacttattttaaagtgagatacaaaattatgaaaaacataatgtggaatgatttataatggggataattttattttaatatttgtggttttaaagccgtatattaattcctgttgcaatgcacaagcattcagctagtatatcaaaaagaagttaaagccattacaatgagaaagttatttaattgggaagtgcggcggtataaatcctaatgctcatgaatattatgcatacatgagtacattttcaataggaatttagtggagcttaggataagctattagtccctgtctatttgagcgtatgctagaagtgtgcgtactcgtgggtgagtgtagtgcacgtatttatctcgtgtgtaatgaaaacaaagatggttatttaattaccattttctgtgacgtagatgatcgggttgttgtacctcctcttggtgtagaggagtagctcgcggagacccggagggtagttgaagaagatcggggtgaactcctgccaaaatgttggaagaaattaatcagccgtggattgatggattgatcgatcggtctcaagaaaatcaagaacatgatgttgtgttcatgcgttggtgttgaggaggagtcgatctatgtacgtacctgcggaccaatgggtttgccgttgcggaagccagtggtgttggcgcggatgtcggtgtcgtaggagagcctgtttgagctgggcagcggcacgctcttggcgtagtaggtggtgtagtagttgacgccgatgaagtcataggatcccctcaccgctgccgcctgctccgccgtgaacgccggcagccgcgccccgagccaccccctcatcgtgcctgggtagtcgccgtgcacgatggggtccaggaaccatccgtacatgaagtcgaggctgcgttgcacaacgcggcggtcagcggccgtgtcattatacggcacgaaccagtgcgacaccgccgtgatgccgatctgcccgtgctgcgtgggttggtacttggtgcggtagaggtggacggcggtggcatgggcgaggatgacgtggtgcgctgctaggtaaggctcgcggctggagtcgccgccggcacaggaggtggagacgtagggggagcaccggcccaaggcgtggatgccggtgccgtagccctgggagcagtaggtccatggctcgttgaaggtggcccagaacttgacacggtcgccgaactcccggaagcacacttcggcgaagtccacataatccttgctgaaaatattgacaatccaaatctctaatatgagtatttttttaagataatggtaatggtttacatctccggtgtctttcgacaggcacacagccaaatttgcataatcgacaaattttaatgtgagtcattgatgaattctagccaaatttgcagaaccgacaagcaatttattttgattcagatgaccaaattacctaccctgttctatctaactggtttttcttttgaaacttaggtgaatggcctaactttaatcaacctcatcatcagcttaacaagttgagtgattttaacaggtttatggattttctttgtctctatctaaaaaacttacatgatattctcactcaggaatcctccgtatttgctctcaagggcctgtggtgtgtcccagtggaagattgtgacaaatggcttcatccctgttatgaaaattttgtaattaattcaaagtttactacttaaaaataccaaaaaaatatttataattttgtagtaacagtaacacatgattgtaaataggacataactgaaaaaatttactcacctttggctatgatttcattgatcaggttgttatagaaagctactccttccttgttcacccctccactcaatgttccatctgcattcaacaggcatttacaaaggaaaatttcacggtcaaaaaactgaaatgcaactgaatgcgctgatacgatctaggaaatataatgcccattctcaaatacttcctctgatcataattatttgacgttctggacagccatatactaagttcaagtcatcttaactgtctaaaacgtcaactaattcagtccggagatggtagaattaacttcactcacttggcaggatccggctccaagaaatggaaaaccggaaggcgtccatgttcatgtctttgagaaggtttacatcctcctgcattttcaaggttcaacaaaagaaatgaatgatcagttcaagaagattcctgtccaagataaactttttattcggtccatcaagtcatgaaaacatttattttttgacatacaacaagtcaaagattaaaaccttgagttaatatctttttaaataattagactgacacatggaaatcatatgggtaaaatctcatagtaaaatcaggtttttataatgtgctcacttcggtcaaatttatttgacgttgggagaactgagtttagttcttccaatgtcaaatattttttttactagaggctggagtatactataacaaaaattagtcattaaaattgcattccaaagactgcgattttttggggaaattactgtagaaaaggcttctacagtgtgtaaatatatattccaaagactgcgttaataccgaacaatgtgtttccttgaatgcatttcaagagcaagaactcctgctttacttaaaagaaaaactagaatctaccttgtagcgatgatagaagtcatctgccacatcgccggtgtcaccatttaagatttttcctgcaggcatgaaaatagtttcccttaatcacctattttaaattttacatgccagctatatatataatagtgggaggttaacacttaataataataataacctgggatgtgcgagaaagtgtcccacacgctaggacgctaggacccctacctccttccttagcagctccctcatactgcaagtaattaagcaatgcaaggatacatctctgaatttgttcaggaactaaccaagaaccatgtgcattgcacttgattcaaaccattcttgcagatgtaagagttttggacaaatttatctctgtatggatcacctgatacgctgcagagccggtgccgaagatgaaatccttggggaagctgtacctgttgaacgatgcatcaacaccgctgcagagtacagcaacgaaaacaagaacaggaacaatctgccttcccattccgattccgagccaggccatctcgaaactggaactgatcaagccaagcagcttagctgggcagtggctctgcaggaagcataattcagaagggtatttatagagaagagttggcgatgcagataaacggatcagatcataggccagcagatgtgttggcgttgcttccctgattggcaattctcactattccgagatcgagttcctcaagactttcgagaagagatatcgtattatatttgattttaaccggttgaatttgtcatctacagtagcaagaagacgttgaaattgatttgtttagttcagcatgaggggcacgagagggcaactgctcaaggcttgagacatgtaagtacagtttttttttatatatatagaatgtatatatgatagcggctgatttcgttctcattcttctgaagaggacgcaccacctataatttttagttaaagtattttgtgattggtacgaatggtgtataaatatataatgtacgttgcaataaaaggaatagttgctataacgacttacgcacgacgatcgcctagttgctataactggaaatgtattttcaacaccgcaattaattctcttcacatgtaatggcgtgccgctggttacaactgacctctgtacttgtaaacctcttcaaatggcaatggaaatttagttgggaaacctctcccctctggtctctggtgattattaaaaaaaaatagttgtattgattataatataagtacacactatacttatattataatcaatacaactattcctttttttatatctcacttggatactaataatatacctcctatgtggattaagggagagacatttgatccttacacgtaaggtaatgatataaaaccgacatcacagtcgtcatctatatacaaacatggaaaacactataagatcaagattcattctagataagtcatttaaaggcacgatatttttgataaattttcatgaggtggatttattgcgcgcatgttcgcgctcgaaatcgctaatagacgatcagtcgcgcggggcgtgcgactggacacgtgtcatgcgtggagaggggggcgtgggcggcgtgcagtttctttccttttttttttgtttttttcgcacggtttctaggcggcacgcggtttcttttttttttctctttttatacgcgcggtttctttttttttttttcttttcttctttcagtatcgttactttttttttggcgcatggctttttttctgtttttttttctttccgtatttttttgtttttcggtttttttaatacaaacatatacaaattttgtatatgcgtatataaattttgtatacgtatacaaaatttgtatacgtgtatataaacttcgtatatgtgtacttttttatatatagatgtacaaactttgtatatatatacgtatataaagttggtatattttgtatgcatacatatataaactttatatacatcgtatacaaactttgtatatgccatatacatacattatacatgtgtatatacatattagaatatctacttatatatactacttaaaaagtttaagatgtttccttcctctgttaataaattttttttaaaaaagtccgattgtaattaaaaaaagcccggggcgaaaaaaaaagtgcggcaaaaaaaaactgaccgattcctatccttacttaaaaaagcggaacaaaaaggtgcggcaaaaaacgattgtaaaaaggaagcccggcacggccaaaaaaaaaatttgtccgtttcctttttttttccttttccaattttattttattttcaccgcttttttctttcaccgtttttccgggctttttcgtccgttttctttttttttcgttttattttctttgcgccgttttttctttcaccgtttttctggtttcgctattttttttctgtttttccattgggccgaatcctagcgccgccaccatatcgatttgcatttttatgtgtttcctcatccaattgattgcaaaaaccgattctccactactctcttatcattttccccttgaatttctcttccagttcgtcattttttttccaagttttacggattgctttgattttggtaaaaaacgaaaaagggaatcgagtggatcaaaatctctcaacaattttggagatcgagaaagattcgaccgcatttgacggagaggatcgactccaccatcgtacagacacggtactatgcgagctcgaccagattaccggatttgatgggtggatcggctccgtcatggtacgggcacgagttgacggagaggatcgaatccaccatcgtacggacacggtactatgcgagctcgaccagattactggatttgatgggtggattggctccgtcatggcacgggcatgagactgttcgagctaggcctacagttgcacttgtgggctaagccgaagagaggtaggccaggcacaggactgttcgagctagggctacagctccacttgtgggctgagccgaagagagataggccgagcatatagatgtagtggactactctaggactagagctgaaaaggaaggaaggaatgaatgtccggtccaaaaacaaagaagcatccggtccaaaaccaagggagtataatgtatcggcttgtttggtaactcaagggaaggggattgggagtttacacgagggaattgatgatgagattaagatgggaatttgatttttaatctcaatatcttgtttggtagaggtgatggaaattgatagggagtttagttggagattagttcattaataaaaacggatggctgagattcgcttagacaaactaaaggaggaattcccttccaattaccttcccctacccaggtattgaaaaggagggagttccttactcaattccccatcccaccaaaattctcatatctcccaaccaaataaaacacttaatagcctcatccctctaaactctcaatccctcataaaaactccttccaactaaacgagccatataggataaaaaaatgtttttacccgtagcaacgcacggatattttttcgtgtgtgtgtctatatatatatatatatatacacacacacatatgtataaactttatatataaagtttaggaaaaagtacgatttaccccccaaactattgcgacagtacgaattatccccccgaaccacaaaaccggttatattacacctcaaaactattgataccggctgaattaccccctgactcaatactgagcggttttgctcctacatggcatacacgtggcgtcgacgtggaaatccaatcagtaaaaaaaaagaaaatatagggcccacctatcattactctcactgtctctccctcttctcctttggacggcgacggccgaggcagcaagcgcacgcggagtcagcagcggcgaggcgaggcaaggcggcggcggtggagagcggcgggggcggaggagaggctagcgcggtgggggcggtggagaggcgagcgcggcggtggcgaggcagggcgggcgcggcggagaggcgagccgagcggcaggggcggaggaggcgaggcggcgga

SEQ ID NO: 65825 - DNA, 890 bp, Oryza sativa
agcaaggacaagagccatcgttccatgtctcgtgggacgtacacgaggaacattgtatatagagaggttctcacgtcatagaggtactgatttctgagctagcaccactgtagtatgttggtttgaacagcaatcctctgagctagcatgcaagtagctagcttttgtcgtaccagcactatatttatgtgctgatgtttgtttttacctaatttcagatgtaagatatgtattagcacttagctttctacgcacttatgatttcctgtaacataatcacataatttgtattattctagaaatatcagttgaattcatagcactatggaaatgtttgtgtcatgcgatggtttcatttgtgaagtggttcacaatttatgtctaaccggttgagcagcccatgatatggccagtgagaaaaacaaccgggaaccatctcgaattacccctccccacctgacctactcaaactagcatgaccagtccacccgttctattcaaagccaccttggaaacaccacaagagggatggtatgacattgaagacacgcaccaaccataggacgattcgaaatgaaccctgcagatccagaatcccagaaaatccagactcgccccttcccaagcaatgttaatgggaacccagctgatgggatacaggaaccactgacaaaatagtgcctataaaaagaacctaaggcaacttcaaaaagggcacacccccctcttgaactaagccagtcaaaaaaaccttagcccatggaaaaccctaatgggtatgcccaacagttgaagtacctactccagcaagtagggtacttccaggagccggtctattgttttgagcggatcacccaaggatccttggagatctggaaggtgaaaatctt

SEQ ID NO: 65826 - DNA, 890 bp, Oryza sativa
acatttaactgctccctctattctattctaatttgatcatcctctaagcaaagtgcacaaaataaaaaaaaatgtaatatccatcattttgaaattaatccacattaatcaatgtgctccgtcacttcgtgtccaacaaaaatttattcacactttaaacattgtgagtttaactaatagaaattaatcttaattggttgcatgtatgcatgcagaacattccacaatgaacatttactctctacacaaataaataaaggaaaaagtacgaattagcacctgaactatcgcgatcgaccgaattacccccttaacccgaaaaccagatatcactcaccccaaactttttataccggacgaattaaccccccccttcaacagaatccagagcggttttgtcctacgtggcgtacgcgtggcaatccagtcagcatttccttttaaagttactaggaagatggcccacgcgcatgcacgggtacttatattttgtcaaaattgtaagattaagggtaaactaaagctgggatgatggtattttataataatttagggttctatttttcttaaggtatctaaaaaaccgttttgagtaggagatggattaagtacttaccacttttgaatcatgtttttttctcgagtaaataagaaactattactagttaattaattatcatgcaatccatccatatacatatcgtgtagtatgtccacaaatgaaaaattcgagagcaagatatgcaaaattcttgtgattaaatcgtctcatgaaggcacatgatataataagaaagggagggaagcgtatgcatggaaaaaaagaagaaaggggaaaatgaaaaagagaggggaagtgtatgtacccacttacgtaggtgcgcacctat

SEQ ID NO: 65827 - DNA, 810 bp, Oryza sativa
acccctggaatccctggaattattatgtgttgttttattatatttgtatcacaatatttcactgtatctgttgctgaatatgtaaagatcattagatcagatgtaattgttgtttatgctaaaataatattttctgttgcgatgaactgattatttcttatcatctcgctaagatttaaagttgccctaatttttttcccattgcaacgcatgggcatccaactagtcaatagaaatatttctaattcgtgagtgcttaggaacataacaatatttttatatactgttagtcttttacattgtcagcttctatggcctgaaagggagagatagagagtgtgagtgagagagagattgagagagaggtagggagagagttacatgtgatctatcattttttttttcaaaatgatcagtttgcaaagtttgtcaaatgcgtgcaattgggtaatgttttagagttgaagcttgttactatggtttagatctcatttcctatgtcaccttgatgtttatatggcacatggctatatgaggtccacatttgctggaagacattcccttgcttcagatgatacatacaaatacttcctaagttagcattagagatattggattgcatgttcaatggaagagataagtatgatctcttaggcaatataagattatttagagactgtgtctaccataaactcaaaaaaaaatattctttttattactattctttccattttttcgtcgtcatgcaaccatgttttcatattatagatgataagagtcgctgttgagctgttgttacctatagcaatg

SEQ ID NO: 65828 - DNA, 1521 bp, Oryza sativa
ggcgggaagccgccagatacagtgaagacggcagggcgggggcactcgtgccgtccgttggggaagagaggaggaggccggccggggaggggggaggaggggggctcaccagcgtcgttgacccctttcggccagccgacgagtccgggcggcggcggagtcagccgcacacgagaggatgctgcggcggcctggaatgacgaggggagagataggggtttagggttagaactgcctgcacgaatcttaaagcgatccaacggtctagaatttgtatgatttgtgaggtgtttttctgtcaaatgccacttgttctttttacatatagtatatatgtattaggagttcagattaattgctcagccgttatggtgaggcgctggagattatttctgtttggcaatacataatggatcggtgacaagggatctctttgctgtatgcctagctattccatgattgaaaactgatatctcgcaatgagccagaactgagattaattacgacagaaataaaaatatccagttgtaccatctttgcctgaagttacagccaattccactgaatcgtaagttttaattataagtgtccagcctcatgaaaaagtgccagctcgatctttcttagtttttgcagaattttcacgaaaaatgaaattctcatgaaacacccccatattcttgatgattgaaggcactaggctctttgagtctatatatcccctgggatggatatattgtttcctttttgaaagtagcaaaatatttgccaactttaaaagatggcagagttccaaattaaaaaaaaatctatgagtttaagtccacccgtcacaaaaaatacatttttccgtaggttgcttacaggaccaacagaaaataccacggctcacagggaagctgagtctagtaatgacgactctacagctgtgactaatagtacagcatctttcataaaatttgcgaacattttatagaaacccatcgagaaataatattctacaatatatatgccatcgacaagaggtcaattttccgattttccatctacagatacgagttctacaatattccacctacttcccccttttcccatttccattagttaatatccattagctgtttggaattttattcacagtgctcaaagtactctcgagagagaagaaattaaaaggcacttatacggtggcatagtagaattcagtttcgttgatggagaaaacatagaattgaggatttgtcaatggctttttgtcatatagtttctcaaacattgatccagcaatgaaactgacttgggactttgtctctcttgtttaatttggcgtggaaaattttgatgtcagcatccccacactggtggagaaaccatctttgatcggtcgacccaaatctacaatagtcccagttccatttaaaaccgggactaaaaacgatttttagtcccggtttataagaacaacaggactagatgatctttattcccggtttgtatgaccaaccgggactaaagatcatc

SEQ ID NO: 65829 - DNA, 8632 bp, Oryza sativa
ttgcatctttcctcttataccgctgcatatctagacacttgtacattgatctaatggcggaatactaattttttgcatcaacccgcccctggtgatctaaccctccgtgccatgctttgatgactcttccagctcatccttaccaatggatggatacatcctaacagatggattttgcctgcatgccagaaagagccttctggaaggctcgggaaacggatagtccgctgtaagttaagcatagtaggggattatctatgtcgtgttgtgtaacaacatagttaataaagtagtgtgctataattcaaatgtttgtgtcatatgataaaccttgttataagacaaaagaaatataaaactattgcattttcccctttcctactttaatttgtctttgttatatgttatatttgtttccagtaaggactatttggataagccaaaatgctgataatcttgctgtgtaattgtggcgcaagagttttatttgtaatcctctattactatacaatcgcagcctactaattagcattaaatattttctatcttgcaccacagtcttccacgtaagcatcaaataaaaaatgtcggattcacttctacctcaaaaacacgctttcaattttttaacagctttctcagtactggcccaattctaagaccttgccaacagcccagctaaactcctgcaaaaagcccaactcacccacacccacatcatcgttaaaaacaaaaaaacaccagagagagatgcactattcctctgtttgtcgcaatgcataccaggaatgtataaccatatatgtatagatcatattgtatcattgtattccttgtattctcctccatttgaggatcttgtaccttagctatactataacaatacatggtcatcccacaacattgggtgtgtggtgttcctctaattccttctacattgtatcagattccaggatatttccctctctttctgcaccttcctggttgccgcgcctacactgtcgcctccgtagcctccgttggtagaatgccgacattccagcactcctccgtaaaattctcgaaggaactccgatatttcagggcactccttcctgaacttcccctcactctctactaagttaacaaattaaatatgaaactgtcacgtcctgataaattcatcccgaattaaaaatcattccctaaaaggaataatagaattaattaaaattcgaaaagaaattgacaaacactaaaatacgtaccagaaaaattcgaatgtggcccggagaatttttgttaaattctccttggtctaaaaggagccctcaaattttacttgaattttcagagcaccggaaataattattaagcaacaaaaacaattatcaaagtttattaaaaagaaaacctaaaaataaatcctcttcctcctttgggccaagcccagcccaaagtcctctcttcccccccccctctctttctccccctcctccctttgggccccaaagcctccctccattcctctcagcccggccgaaagtctgtttatctcccccgtgctacagtgctccttcttccagctcaggcagagcccgagctctccagccgtgccgtgcacagtgccaccgcctcctccttccaaatctcgcctccccgttgctcctttttccaaattagttgcgggaatggaatcctctcaatctcctcttcctttcccccaactttccccctttaatcccgcccccaatcaccgggatttaatccctcttctttgaccaccattgatgccgccggccacctcctccggcgccattttcggcctctcccgtgaccggcactccgtccttgccctataaaacgaagccctcctccttcctttggtccattttgctctctcccgagcccctagccacctccccatcaccttcccctctctcctgtgccgacggccatctccggccgcccctgccgcggcgcctgtgtgccggccggccgtgccgtcgccatccgcgacgtcgcagctgcctcctcttcctcggcttcgcctccgtttcgcggggaaatcaccggagacgcgtcttcgccggcaaaacagtggcgttgccgccactgtaccgccatcagtcgccccggtcgccgcgtcagagcgtcggccgatgtcgccgtctccttcgtcgacgtcgcggcgtcgccctccaccccggcctgccctcggtttcgccggaacgccgtcgcccgcgccgcctctccctcggtcttgtcggcacccactccggcagccccttccgccatgccagtgcgccggccgacgtcgccgtctccacctctggcatcgcagcggcaaggtcgtcctcggcatcgcttcccctccatccaaacccctccgcggtccatcatcgtcgcctctgttcgttctcgtcgtcgacgtcccgtcggtcgcccggctcgtcgtctcgcggcgtcgcctccgtcgtcggattcgcagcggcgcgttccacgtcgtccccgtctccgtgcagctgttgccggctgccctcgtcgcttcctcgccggccccggtcgtcgtcgtcgtcgtcctctcgtcgttcccggtcgtcgtggcgttcgtccctccgtcgagccgttctcgtccgtcgtccgcgttcgtcaagcgagccgctgcagccccgtcgtcgtcttcgtcctcggctccgcgtcgtcaagcattgcgccggccgcgtctcaccttcgtccaaggatcgccgctgaagtcgtcccctcgccatttgtctccgtcgttcccggccgcctccgccgcgcccgttcgtcgttgtcgttcccacgcctcgtcgcgtggtggtaaggatctctcctctcgctgccccgtcctcgtcctttcggtgtcgcccgtgcccgttgtgcggttgtcagccccggtatccatgtatcggtatcggtagtcgttcgcttgtccgtgtagtgtccgtgttagtgtgcccacttggtagccgcgttgtttcctcgtgtgcaacccgtgtggtgtctagtggagtccgtttgtcggccactcgcctcggttgacacacggggtccgcttccgtcgacccgtggaccgtctctgtgtacctggtctaccgcggtcctttaggttgacatgtggggttcgcatgtcaacagcgcagccttcctgtcttttccaggctagcgcttacacatgttttatagtcgcaaagcctaattataataatccgcaaatctccatataacagcattaaacttcggatgatcatatcttggtcatacgagctccgaatcgacccgttcaagtctcttaatgtttgttataacctaaagaactgtgtgctttctttttatgtgttgttattgcttctttataggcttgtagctttgcttgtgtgcttcgcgtagcttctgtcgttccggaggttcccgaagcgtggttcgtggtcgtcgccgaaggttcggaaggccgttctctctgagcaaggcaagtcacatcatccttgagcatattgaatcccagtttataaaattattttgatttaaattaatgcattatcgctttatttaaattcctgcgttatcactgttttatttagccatgcctatttacctttgttatgaccttattattattgctattgttattattaccttgttcaccctagaataaacaaaaccccaactagtggacactctattcatggttccactagtatgaatttaggtagatgcttcgctgtttaattaggcaacattaggtggttttataactttagacttggggaattctcatatcacttggatactatggaatggttggcttattgtggaattggacatacccctctcttcctctttcaaagcccctaaaacctgtttttcggtggggtttgggtgcatgctagttgtgggaagttgcaccccggccactataaggattaagctcaggccactgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctagggggctcaatcctgcctgcctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggatggctagggacgagctgggacccagggtcgggttgccagttcggtctaaatcatcgtaggccttgggttaaggcaggttcgtgcgggttcacgaccttgattaataatactgtgtagctttaggatcgtctttttaaaatggctttgggcaactaagtgacttttaaatgctgttttctgcaaaacttaacccctatatcattaccccttgtacccccttgcattaatcgtgcatccgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttattttttattgtcaggccttaagtgcctttgtaataatgtaaatattatcgatataataaagatgtgtcttttatatcatgtttgtatggtgtaccccggcttttcctgggacggggattaatacactagcgttcgggaaaatgcaattttctcggtcgcgacaagctggtatcagagccatctcgactgtaggataagccaagtggataaaacctaaggacatattttataaataaaactatttgcgaaagttccttttttctccttcccctaatgctatttgcaaaaggtttactcccttcttccttcttcgaatttccactagtactagatggttagttttgcgaagaagaagatgtcgccaattgtttgccgaagctccggaagactgcaggatccgctagcgaagcgaaggaagcagtgaagccagctgtaaagcaggagtgaagatcttggagaacctgtcgcagaacctaagccaccctctagggtagagtcgttagtcgtgtgtttccttgcttgtgtgtgtagcgcgtggttttcatcagtggggtgtgatgtaaccatgctaggttgtttgcttaatcaacttgcagaataagtgaaacaaacaacacatcaacaagaagagttagttcctttaaggtcctgtctctagttctggtctattctttcctagcttgtttcctctctcacctcaatccctgtaacagatgtttaacagagaaaaaggaaagaatgtcagagggtatgcctccagtaactcaagttttcaactcaatccaccactggcctcaagagagttaacaagggcacacccttggtccattccgagcatgctgcttggttcacagctaccattggttggaagtcaagaccaaaatcagtatgtgtttgatcgagcatttgccacccaggtcaatgagcttccaatgccagaagagcatgtccccttttgtcatgattgtagagagtaaggacactatgccctgaattgtccatgggtatatgtcaaagaagccccttcctttggtttagcagggcagacatcgctaaaccagcctcctcacaccaagtcaagcttgcagcctagtgtgcaaagtagagagcccaatggagagaatccattgaatcctgggaaatgctttcctcctagcctttcgtaccacgtggggtcacgtactaagcaagccaaaggcaagaagagtaagaatcagaagaaaaaagcaccgatgcgaactgaagaagaagtacgtaagatgactataaccagcaccgaatggcctccagcagggataactattcctagacgtcaaagaggaaataccttccgaggtgcacgaaagttgacccagcacctcctaagccatggcggcagagtatctgatagtgaagggtcagatcaagtctcctcggattatgaagatgagtctctccgacatctcggcgaggaagagatggaatcaaaagcatgcccccgttgtggagaaattggacacgttgctagcatgtgtttcacactctgccctcattgtgaggaagaccatccaccaggtgaatgtcccacccgcaaggtcacatgttttctgtgcgaaggtacaaaccatgtgcccaaggattgccaactcagtgtgttgttgaccaagaccgcagaaatccaacgaacaaccctacgattgtctcgtcagttagtcagctccaacagcaacatacgacagaatatgcatgccacaagtcagccaagtgactgcctgcttagcctggcagcctgaagctgcgtggcaattaagatgcataaggcaagtaatacccttcaagcaccaagccattctcatgcaccgacggcctcagcaaagaattgtcatcgatggaagaagttgtgtctctccccgacctactccaggccgagcgaagggcaatcaacctcaggaggatgatacgaagcagaagaccgttattcgcttcaaccagcaatcagaaggaagcttctcctgtgaatgataacaatatgcagtcctatcacatcatcacagaaccaatcaaggatgcagtcactagaacaatgccagctatatctctccagaatcaaaatgagcagccatgtttgtggttttcagttcgcgacttatcattgtgtaatggaaagtatgcagacaatcagtgtaatacataaatatattcatgtctatagacagtagacaagctatgcttatggatgattcatgttgaggatacaatgtaccgatgttgagcaccttccctttttgtttaaggcagtgcctcgtattcatgtaatatgggagaaatgtgtaataaaaacaagttctatgaggactctttcagaagatgctgatatgggattatgtgtataattgtttactgtcaaaggagacctagggtctcatttcagaggaactatgttctaacctcgagttaataaccaacctgatgatggaaaagaaaatcaagcgattaaccaaagagacatttgtttggactaagagtttcagatgtgtcttttttggatcaaaggcaatggcagtcagtatagcttttggcgaaacacttcaaggattcactgaaaggcagtagaccaaaggacctcatcgccaccagaagtgtccgcaacccacattaaagagtaccacctgttagagataggccgaaagatgattgataaaagatattggcaaagaggttctctagcaggaaagatgtaggccgaaaggtgattgataaaggataatcaaaaacatgctctgcatcactcaaggaagacccctgatagtaatcgccctgcaacagtcaccttgtcattgagagaaaaaaaaagtcgtgagtaagcaagatgacctaggtaaaagtgtttctatgaaggcaaggagtgaaatcttcaactcagtatcagatgctacacggagtgaaaactgcaagcaccggttaccaggcaatgccatgtcttgggagatgatccaatgggaaggaactcatcaaggtcaaaggagtaaaggaatacgttgaatgctaaataatgacaacctgaagataatagtgggaagtaaactgaatgtaaagaaccaagtgatatgttcgaagatagtctacagaggtcagattaaaatcacatctaacaacgaagcttcaaatttggcaggataacgatcaaacaataagaagttcagcagtaaagtcatttgggaagacgtcaaagcatgtcaagtgggataatttggttcccttgggaaacataattcaaaggcaaagttatcgaccctcacaatgaatagaggaaatatctagcaccggagaccaggaaagctaatatgagacaatcagtggcaagttgtcaatcatggtattcttagtaagcaggatatcatagtctaaagcatatggtggtaagttagaagtaaatgacaagcatggtattctcatgatgacaagcatggtatcctagtaatgacaagctgatatcggcgcaaaacgtgaagtgggtaacttgtatgaggttgacgccaaagatatgaattatgagaagttctggaactgaagccccatcttccaatgccgcagcctagtcgaagtcagctagaggtgcaaccagggaaaagtcatgtgaagagaagattccatctataacaggagatcgagccaagcagtccagagtggagaggttttgctaggcaagtttgttatagaagacgcgacggaagaagtcagataagaagagaagcccgcccaacctatcttcttgctagcctcctcgaatctcgg

SEQ ID NO: 65830 - DNA, 3815 bp, Oryza sativa
ttcctgcagcccattgcatgatcctgtgatgtatttgatttgtgtgtgatgtgaacttgtgatgtatttgcgatgaattttgtagaacttgtgatgtaatttgatttgtgtaattttttttaggatttgtgatgtatttgatttatgtgtataagtaacttaaagatttgtgatgtggatttgggatgttactttgatttgggatttggggatatgcatcccacttgattcgggagaaaataaaaaagaaaaaagaggaccatctgtactgctgttattccctctttttaccaaccgggactaaagataaagtatctttagtcccggttggtgttaccaaccgggactagagatcgatttttactcccggttatttcacccgggactaaagatagcgatctttagtcccggattcgtagtcccgattgaaaaaccgggactaaaggggggttacgaaccgggagtaaaaaccacttctccaccagtgccatctcatccaagttagacatggctagtccaaacgaagggattccatttattatcagctcagcccttctggagaaagctagttggcattcttcttgtgcagcctgtatcctgaaaatgacttgattagcaatgttcatggacagttttatgtgtcaggccttaccttaatttgtggcatttgatcatagctttattagcaagtctgcttaagtaaccgagacgaggggaaaggagaaatttgagaatggtgagccgttagcgcataagtaactgagtattaattattttaaacttgcaaaattgattgatatgattgaaaaaaataacttaatttttctatagaaattttttgaaaaaacatattgtttagctgttcgagtagcgcgtgtacaaagaacgagggatttttcttccgtctgtgcttggaatgaacgcaaacttagattaatatatatgaagtgacttggtgtggttattgttgatgtgctgtttgcaactcattttgcctactgttgaaattataagcacataatgatttaatttattccataaataaatcatgacattgcaatataaactagcataaacgcatcattggatctacatatgtaaattaagcagtaaaacatgaacggatcaaatatacacaacatgttgaacatgtaccgaggttgcggaacaaccggttgctcgacaggaatcactcgcggttgcgggcgtcgacgaaggcgcgcagcacgtgagtgaacaggaagacgagctgtcgcggacgaacagggagcagtcgcgctaagcgcttcccaaaaaccttattgccgccttctcccagttgtagacccccgtttttataacagaaatcattcgtgtaaacagtaccatttccctggatcaagtagtctggtacacacgagttcatagctgaaataccaaatgcacatacacgagagtctagtactaattattacaccataagcccttaggcattgtcttaaatcatcggaccgagcggttcggaatacatccaaaagcagaaatagataaggcagcggaatttaggcagtggcatgccattgccacaggcaacgaccgtactaagacctactgagcgccatcgtcttcatctccctcctggtagtaggcatagggatcctctgaagcttcatctcccgcttctgattattttataattgcaagggtgagtaccaaccgtactcagcaagccaccacagcaacaatgcatatgaaaggggtatttcaaaggatggctatggctcttttgcgtaaagccaattttgtaattcttttcacaagcctcagacctagcattgactgatcaaattttagtaccagtgtttgtattcaaacaacaacggttctgtccaccatccattgtgatcccaaggatagcttcccgccattgaatcgttatggttttctgaggacacccactttccccctcctcaggaagtggctctaacagcatataaattcatcatgcaactacccatcccacacaagttaataatttagagactagccaagtctaatacatgtcccggtgctcaataaccgcgagcacggctattcgaatagatttggtttactcacactgcagtggatgtacactttacccacactccatgactgcccaacacatgagcctcgtcccaacacatgagacgcgtcacggcaaagcttttcgataacctcgcattggcagtacccgctccatgaactttacatcctcttgcactctaggcgtacacggtttctagtagtgagagaagttctggcgcacccgggaaagaaagactcacacatacattaagttataattatgtttaaattctctcatggcagtcctaccgatggcgacaccactgtagacacccgcctcgcggttctaccaatggctgccccaccgtagagcccctgcctcacacatcaagaaaccactatgcatggatactgcctccgctcagctatctattccgctaggtctatacccatacgagaagtgcggttgtacaagggtcgtttcatgcttaactttatggctcggtccttaattgaccagggacggcactagcctttttccggataccacccaaatcctccatccgccccagtcgaaaacatttgtttagtttcattttcctttcacaaatcatgtcatcaatatcatggcaatgtggcgctcatgtctccacatgccgcatctcaattaccttcccaaaggtaattgcctaagcatatagcatttgataaatatgagtatgcataaatctagagtaacatttctaagcatttgtcatagttgactagggacttttacgtaaatcatcgttacaaggatttaagggtaaacaataatcaaggcatggcataatcacaaataggatgttcatcattgcatgcaattttatttgtaaacaaaacaattttgcaattggtatcaacatgttcaaggaatagtgatgacttgccttgctctaggtcttgtgggtcttggtcttcacccggatccgcggctccctcggtctctatagttacgtgcgtaagaacaatttgaattcgattagaattcaaacaaaatccaaataatgaccgaattgagaaacgagcgcgggaggtgaattctatataggctactttattcgcgaagtggaattattcttctacctaaaatatttgtgtttcttaagaaattttgtgatttaaagtcatgtcctaagactttatctaattatctagtgcttaattacatctagatcactaccgcgaattaatctcttatagagtttactaaaaataatctataataatctgtaagaattcatctaattgtttagttcttaaataattgatcctataattaaatgctagtattttaggtatttaaatagcaagaatttatctagctatattttcattaagcctatgattaaattctaatatttttaaatattttaaatttccccctaaatttttcctttccttttctttctctccctctttcttttcttttcttttctcttttcccttttcctttctttttctctctctctccctttttcttctcctctctttctttttctctctctctccctttttcttctcctctctttctttttccctctcttctctccctcccggctcctttctccctctctctctcggcttcttgctctcccgggcggcgacgacgatggacgcaagggggggggcggcttaccgacggcggcgatggcgacggtggcgacgtcggcgcaaggcgcggcgtggcgcggcggcttcgtggctgcggcgcggcggctctatgcgac

SEQ ID NO: 65831 - DNA, 2628 bp, Oryza sativa
tgatttcgatttgattgggattgggatgtagtttttgggttagatttgtgatgatttgggattggttgtgggatcttcagagcggatgaatcagagggaggaggtgcgcaatgcacagactaagatggatttgtgcggtttttattattcttctcgttcgatttctcttcctctacgttctatgtttggttggattttgtattcgattgaatttgtgtaatatcgatgtgtggcgcatgtgggaacggagggctcgattccgattgggattgtgggggtgggggggaggggattgcgacggacggatgaaaaggcgaacgttcgaggagacgaccggaaaaatccaaatcttttaattagttaagatattgaagggtaccaatgtgactgaaatttcggtccgagattatttgatttttaacaaaatttgatcaaatattaccaaattcacaaatgaaaaaaagaaaaaaaaactttccaccgaaagagtttcttctatgcttggaattaattaggatccatgatcacctataatccaacgcactaagattgaaggtaccaggagcaaggtagtaaaagggtggaccaggtacaagaggtggaaggttaaaatggtaattgacttctatagttaactaggaaggtagcccgcgcatatgcgcgggcacttatttaatgttgcttaaatttttgttaggaatgtttacatgtagatgtagatgatatttttaaaatagatcttgactctattttaatcatgttttcgttaatatctagtttggacatattacttgaaaccgtacaaccttgaatttatgagaacatgtgtcacgataatggaatacttgagttgtttcatatctatttgtactatatgtgatttttttaacctatataaagggtcttttaaatactaccacgataatctccaaagcaccatattattagttatattttgacaaatatatgtaattttgagtttgtttattttcaacgcttatgattcataatgacatgagacacttttactaattaacctggagaatgaatctattttcccaaacttatttacaataactaatttattgaagtatactttatagtcacattaatagggtatatgacataagcccatcaaattatgcctgatgtgttggaattcctcaactacaagaaaatataccataagcaagatcattggcttaaaatatttttcatatttgttttacatctatgtaacattcatgttgctaacttatcatatactaatgaaataattctgaagattcaaaaaaaattgagaatctcaatctcaaacgaattaaaattaaattagatctacttaaaaatacacaactaaattatgttattttcatttattttacatatgtagatttaaattagcattgtatagtcgtcaagtgatatttgacacctgaaatataatgtaaaatttttttgaaataggaaaaagtacaaattacctccataaacctgaaaacatgacatcttttactctcaactattaatagaatgatttaccccctaactcaacccaaagtggttttgttcctatgtgacagtccagtaagcatttttttcaaaaagtaaaataggtggggcctacctgtcacactatctaccctctctatctctgtcccctctcccctctctctccctcatttcctcaatcctattcccaagcctctctctttcttatccctccccttgatgcaggggccggctgggcaggcacgtcgccgctcttctccttctccttcgtctattcccctactcttgctcttttgattgatccacctcgttgtttttgattggtgctttctgtcttgtcaggagagaggcattggtggtggggatcgattaagaaccgtggtgggatggcatgctgtggtagatggagctacgactgcatttgtttggggagttctcgatggtaggggcacagtcgaacctggccatgaaggagcagcgcaggtcctcgcctccggtggccgtcacgtgacgatgagatgtgatggaaaggatagagatggcagcctttgtcggagtgcgcatgtggtggccgagatagctgaggaggagccgcctccgccgcttgagctccaccgcccaccactattgtcctcttcacgcgccggtagaggctaaggagaagtcacgtggccatcaaggaggtgctcgccggcaaaggctgaggaggagccgcctccgccgctcgccactcaagctccttcgccccactgctcaccgcccctagccttgccgattcacagacgtggaggaagaagaaagagagaggagtgaggggtgaaggagatatatgataggtgggtcccaccaatttgtttttgaagaaaatgctgacaggactaccacgtttgaccaaaaccacttcgagttgagtcagcgagtaatttgtccggtattaatagttgaagttgaaagatgtctagctttcgagtttatggtggtaattcggccgaccataatagtttagggtgtaattcgtcttttttactttaaatattatcataacattatttattatatgttggcctcatgtgactggatcacaaattagatatataattttcaaataatttaaag

SEQ ID NO: 65832 - DNA, 3794 bp, Oryza sativa
gtccgctgctgtttatgttgattgtcagccctaagtgccttgtcataatgtaaatattatcgatataataaagatgtgtcttttatatcatgtttgtatggtgtaccccggcttttcctgggacggggattaatacactagcgttcgggaaaatgcgattttctcggtcgcgacagaaactacaatttagttgtactctctggagctcaaaagttgtgtgttgaagtgtgttaggtctcctactttcatagctgccaatgatggttggaatggcggttaacccctcagaaccatcattgggactccactggagccatccacgtgtaaggtggagatgaggtgggccaggatggattctctagcagcttataggtgggcccctatggcggtttggtcccaatgtaagtcagtttcgactgacttgtggtccgtccaatccttgtactcgcacatgattggtcagaggttcatttttgtcgcatggcagatatattttctccttaaatgacctgcatacatatatttaccaaaattagttgaagtggttagtagtaaactcctaccactatgttttgagagtatatttgatatcttttatgtaggtgttaacggttaaagtttgcacttaacgaccttcaatgacaccccaacacttatcttcaactcgtccctgagtaaagctcatgaacctactagagtaatgactttttgcttcatgacatgacataccaaatattccaagacatacttgaggctgtaaacattgatgtgtttaccatgccatctttaggcgattgaagaacgtaacagtcctcgaaccaagtcccctctactacttctgatgaattaccataggattttctttgatgtttataaaaacataacttttactgtacttctcaattgactccctcaaatcactcaaagtgtttattcctcaccaaggtattgatgttgcattttctcatcctacctttctaattaggcttatatggatctcagggtagggaataagaaatgacatacttgcatcagatatatagtaaagtcaaacagaggatacaacaagataactaatcatataaccatgaccaagcttgtgcacctatgtttatgggtagaaatgaaaagggtgaaaaatctacaataaaaaatgggatggtgactctttttatctctacctttttttcatcgtgctcgagtttgatcattttcttttgagcagagttttttattttagctcatctctcatttggcatggatcatgggaggagagaccacaaaatttttagagtctttattctgtggatacattgcttaaaacatagaagtttagcatatagatatggatggattagttttctttttggctaatcctccagtgtagagaaaaagcaatatttttggtgtctaagtgcacaagactttgctcatgagaatatgaaaagaatctaagatggtcacaaccatttggcaaaactcaaaatgatagcaagcaattgagtaccaactttccgataatgtacaaggtttcatcattaagatcgatatatggctttggtaggaagggaacatcaatgaagagtacgcaaagatatttattttctttttataaaatcccaaggattcattattaagagcaaggttcatatctgttgacggtcgttagcgatcagtttcgcacgtcaatattaccaaaataaagtagaactaagttttgcttgcaaagcatattatgtcaaaataagatatattccactagcactaggctttctaacctcttgcagagaataaacataaaatggaggcgattcgacagtaaaatggacgatcaatcaatcggacgctgtcgaggatcagacttagaggaagatgggccaagaattcagaaagaacacaaccaatgggacaaaactcgcaagtctgcagaaaccaacagaagaggaggccgccagccgaaattggactaattttggcccagcccatggttcggccgaacccccttgagctccgttggatgcaggggttggtttggacggtgtggattagctccgaatgatagttggagaggtatttaccgacgcattcgcaacaagtgcacaaccgtcattggagagctatataaggccttcacctcctcacctcttccacacatctcaagcaagaagcttcatacattctctcaagtttaatatagtttctagagtatagtggaatagaaatagaatataatcttcagtccgcagagtttttggaagagttcgggtaagactctagtagcttttccttcttttgtaagacttgtactatttatagaatattcttctcaatatattctcatttttgggggttatatgctgcggatacgtcgaggagggctactgatggagacagctcagtatgggtattcctctgcgcgtgtatataatcctaagttatttttttagggagggtactcctccgtatttagccccagttggatgggcttgacgggttgttgtaagaaactcggcaaccaagggtggtctctcgaaacaccaggagggcatcataagggggtattggctatacggttatatagtagataatattgactaaagtgtatgtatgtatattagaagtataggaaatgatccttttcttattctttccacttagcatagaattagtaagtatgagaatagtgaatgcttcagctttgtgtcaccctaccctttgaattgaactaaccccttcttagactttgattattacaagtaacatataagtattagcttggttctctctattataattttcccacgggattaaaaaaatacgatacccttggaatactctcgggtgaaatgctacaattatccatgtgcttgcggatgaactctgtaaccataatataccacgagtgtttctgcgtcattgctgggaattatatttctagcaatgtcgttaagaaataccaacagtgtttagattattggatatcattatttagggttatatgctgtggaagcgaggtgggctactgatgctaacagctcagtacggttattcctccgcacgtgtatatagtcctaagttaatttcctggagagggtactccttagtatttatcctcggttggatggtcatgacggattgtcgtaaggaactcggcaatcagggtggcttctccaaccacaaggagggcatcggaaagaggatattagctataatgatatgactaggatgtatgtataatatgtatgtatactattgtcacgccctgaagtttcccccttcttctttctttaaaaatttgttaaataaatcgtccaaagagatggttcaaattaacctagagctaattccctaattaataaatgcaattaataattggaaatggcattgtgggatttttcttgggttccacatgtcgcaattgattaacaagatttttagtggaattttcagagccttggaaataattttaaccaattaaaaatgagcaagtgcaatatttaatcccaggaaaaatcctttcttctttttcttttttcttttccttctttttctcttatgggccgccggcccatctcctcccgcgccctccccctcctaccgggctggccggttccctcttcccctccagaagtccacccggtctccccctcactatcaggtgctgacaggtggggtccacctatcagcccttcccctactccagcggttggagccaagctccacgccggcgcccccacctccccacgccgcccgctcctccgctccacctcgtgcccccactccacacacgcgcc

SEQ ID NO: 65833 - DNA, 3353 bp, Oryza sativa
aactcggaattggaccgttcaagtctctaatttttccttaagaagtcaagaacccatttttgtgctttgtttctgctgttatgtggagtttgttagagtaaaagccttttcttttccgttggtcgtgtagacgctgcagcttcggaagatccgctcttcgtagaagtcgaagccgtcggttgggaaagcgagcaaggcaagtcacatcatctttgaacatattgaatcccagtttgtaaagttatgttgatttaaattattgcattatcgctttatttaaattcccgcgttatcactgttttatttagccatgcctatttacctttgttatgaccttattattgttattgttattatttccttgttcaccctagattaaataaaacccctactagtggacactctactcgtggtatccctagtttaaatttaggtagatgcttcgcaatttaattaggtaacattaggtggttttataactttagacttgggaaattctcatatcacctggacactgtgaaattgttggtttattgtggaattggcttcacaccgccccctctattcaaaatccccaaaaatggttttaggctgggctcggggtgcatggttttgatggtagcacctcggccatataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtctatggctaggatgggttggaaactatgtcacgtctttcgtctgtataccgtggtggtatgtggcacgtggttacacgtgaggaagatgtgtcttgtgggtaaagatgtacacctctgatcagagtaaaacctattcgaatagccgcgccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcgtaggccttgggttaaggcaggttcgtgtgggttcacggccttgattaataacattgtatagctctaggatcgtgtttacaaaatagcttgagcaactaaatgtctttaaatgctgtttactgcaaccctaacccctctatgttataattcccttgtactcccttgcatttattctgcacttgtgggtgtgtcttgttgagtacggtggttgtactcagtcttgctcaatttttcccaagcccagaagaggagctccttgaagatgaaggctttggtgtctagctcgtgcctgccgtcaagtgcctgtggtcgtcgccctagtcttccgctgtttctcgtttgtctttgtgtgttctgggccttcgctgcccatgtaataaattaactatttacgcttccgcttgttaaactctgatttgtatcaacttttggtgtaccttgcctcctgggacaaggattaatgcacgcacgtaaggaatgcccgttgggttatttccggtcgtgacacaaagatatattttgtagacggtattattgtccaaaacctcaattagaatgaaaccgaagggagtaatataatttccacttaaaccattgtactactttgtactattattttcaaataatacactattttaaaataaagtttacacaattatattgtgtacctatcaaataaataatttaagatctatattaactaatttatacgtgcactcccattatttaaatcatccgatatatttttttttacattggactatcattctataataatgcattgtttcaacataaagtctacaacattatattgtgtacccactaaattaacaatttaaaatgtatatcaacgaatttacacttacactaaaaccggtggatccgttatttaaatcatcggatctattatttgctaataaataaagcatccaaagctccctttttggctcggtgcacaatgcacgtctgcacatttgccttttgcacacgtgacaaagcgtcgtgtctgaggcatgatcacgaccgctgcagcgctaccgctttgctacatgtcaaatcatatatggagataataaattttgttaataacatgaaaagaaaattaaaggtgtgatgcagcgagagaagaattaagcaccgtgggttgtgtttttggaacacttagttccatttaagctgaaccaagagttgattacataataattataatgtattatgttatgtcgtatttgaattttgtactatttgttcgtacaggtgaaagaaatcattatattataaatatgagcacaatattaaagaatatcaatagaactcttctaagacaagggagtttaagaccctctttttttttgattccatagtttggattttcgtttgcacgcttttcaagtttctaaatggtgtcttttttaaaacaatagtttaacttttagaagtcaattcattcgtttataccctcaaatagcaatcgcataaatcagataattcatcaatttcagttgtcctaaacccgcgactcatggtggacaattggggatcgacggatactcaaagtcataatatgaatatgtaagagctactatgaataactgtaaataggtgtcaaaattaattgctattaattagacatctaatggcttgcttgccatataattactttctctctacgtgtatataaacatcgacgaagctggaacaaatattaccatatgccccatacatatatattaagcggttaatattgtaattacatgtgttaagtcctttaaaatttcttaaaatgctctcaagctatcacgtggtgctctaataaattagagcaaatattagaaattctatcaaaaaaagcaaagcatatattacttgattttcacttaaatcggtacgtccaatattataaaccgttagattaaattgatcttagaacaaactaaatactatgaggtcccacctctcctcccactgcataggtgcgcacctacgtaagtgggtacatacacttaccctctcttttttcattatcccctttcttctttgttttccatgcatacgcttccctccctttcttattatatcatgtgccttatgagacgattaatcacaagaatttgcatatcttgctctc

SEQ ID NO: 65834 - DNA, 84970 bp, Oryza sativa
  unsure (1)..(84970): unsure at all n locations
aggcacgtaaattcaactactatggtagccagtggtgactagcttgtcctcatcggcttggtactaacaaaagataggagttgatgaggatgagggactctctgactagatcacattcgatgtactcctacagttgatgcaaattttggatttttccctatcaatcttctgacttgctaagttgtgattaatgtgaatgctctattgctatctactttctagaatgaaaggagtgcctttcgttcaattcaaagtcacggagacagaaaattcgaaggtcaacaaatcagtcgagtgccaccatcatgtagcagaacacccgttcgatcaggacctcccgtcgtctctcccatttgggtcattggcattcatttcaacccctgctcaagttggtccttcaaactaatctgattaatccttcctcacacccaatgttaaagcatcccatcacatgattccacgtctcctcttcttgtcttacacttccaagatggcactctcaacttccctcctacgtaggcctccgcccactccctcagtcttaaaagtatgccacagtttcgtccctacaatcttctcaccaagggcacattgtaatgcatttgacatgatctgccccgtctaccatgtttcatgtatcaggtatgtgctacatgcaagcacataaataataagtatacttatttgcaataagctacatagcctcattttatacaaaatgagctaatatgattagtatagatgaaattgtctaagttttttttttctattcactggtggctttttcttcactttggcacttgaaccacaatatcaactatttcctgtgggactgtgaggctgtgactacgttatatccaccaaaatgatgcagaccacgttcaacatcacatattccaccatccagaacacggtatgttgttgaacaaagttaaaaaaggggcacttagtagtaacttgtaatgcatgaattgacaaaattataaggatgcaagaatcaaagcaaccaactgggtagatataaaaaaaatgcatcaacacagtaaaatggaagatacgtagggaggtgtacagaccttcaaaagaggtgtatggcgtttcctaacctgcaggaaatagacattatgtgagtaaagagttctaatttcttaagaaatttaggaggtggattccaacaaatataaaggctcgtggtatgccaatgaatactgcaccatagccccccaaaagcattcctactgtcgagaacatattttatacgcaaataatatacgagttacaaattgtttgaaaaagctctagtttgccacagaaataaaatcaaagttccatgtgtcctaactaaaattacaagtacaacaaaaatcgggaacaacagatttactccttgagttatacgaaggatttttagagattttatttttcaaaattgaaacatcgacaagtgattctgaagacaaagatttaaggcaaataacattaaatcatatggcacattggatgcaaggcaatctgaaaataaaagaccatgcacccataaatggaccaaatttccttcagaaacctgaccatcagaattcagaacactataaaagaacattccttactttaacctctaaattgtaaagaattaagaatcaaatgatcctatacattcaagagagaatatgcaattaaatcctgctccaatatatcctaatatttcagaaataagtatagccttattttttaaacctgatgttaagtatcaggaatggatagacagatagtaagaactcaccacataatcccatccatgcttttcagcaaatgcctttgctgaatctgcactgtcaaacgtaagccctgcttcaccaacattagcatatggatctccagtagatgtccatcccattaatgggttctcccacctattattcacacaaatgttagaaggggaaaaagcggcagcaactgaaatagtaatatctaattgtatgctagaatgctatataataaggaggtgatacataaagctaaatgaagtaaatgcatgagacataaaagaaatgaaatagactaagtacacactgtttgaccaaaccaaggtgaccacctcaatgagaggtcaaatgcatcagttgcaaggctttcattgtacaaaaaaaagggggggtaatctcacgttaaaggaaaaaaagaaacagacttcaatcgtcaatgaattcttctgttatgaatgtaaatcaagttttaatatgagactatttgttttcatttgatatattattgaggcagttcaccaaacagcaacacagggtttgaggtaaataattcatgaaaatgaatcaacaataaccaataaaacaaaactggaaacatacttttgggttgacacaaagttgattttccacctcccgactttgcctgaaccctgctgagatgcagtcctagcgggtgaatatattacaacctgcaaatacacaaggataagttgatcatgtcttcccagctaggtagttgaaaagcatacagtgagtcttaaaagaacaaaagtggcagcaacaaaaatcatattttctttacagtataaatatttaaacctatctgaataacacaatcctgtcgtaggccatttagaaggccgtttactgtataaacactaaaaggtgggggagaccacttgttaacagtctaatgatctacaagaacatagatcacaatcaaaatattttctagggctcactctgtataataaatctgcaaaaacataagatctattgatgtgtaggcatcctctctctgcagacaaacataaggttgataataccatgaaaaatgtgactgaagtggtgctatcagcattgggccatatcataagatgcttctaagctctttgaagttaagacggatctttgaaacaacagaagaattgatcatcaaacaatattcgtattaacgagattatgttgtagagaaaactatttcatggaagctctgttcctcagaagtcagaacaagaaactaccactctacaagtaggcctctacatggattttgaggtaattacaagaactatgaaatggtatgaaacagacattagttcatagtccaacaagttatctaaattcaatagctaagcattgctagcaatttcatctttctttgtatgcagttagttctatcaaatgtatttttaagtttgatgtacaccaagaaaatggataaataataagcatcctagcatcatctaaactctggtatgtacagttctctaacaccaatactgtcaactctaatcacaaacaatttgaaaggtaagaacatacacctatatacattcagtcattcacagtacataaaccaaatcaggataatttgatcaaactctgttgcctccagccctccactaacataatctaaagtgggagaacccaacctggagagcagcacattcctcccaagttctaaacgcagttcaaaccacacaagcgtaaaacatcatcaccaaattcgcatttctatccactccacgattcgaacgtctactagcgatagcactgtagtccgtacgacgagttcacgacccgacgcctccaggctctatgcctctatccctaaacacgagtaacgaccaaaacaacccaccaaacctggacatctcgagcgattcccacacggatccgcgagggctagccaatctatcgccactacataaatcagaggtaaggtcagcgaagcaccgcaccttgcggcggaggtgctcctcggggatgccggagaccatgccgatctcgcctggcttgatctcgacgagggcgtcggacgccgccgcggagagcatccgcgcgggcgcgggggacggcgagaggagcgtgcgccccagggaggggaggctccgccggagcggggcggccatctcgtcggagccgtacgccggtgaggcggatggtggaggagagaaggggcggacgagaaggccgaaggggaaacaccgagagagagagagagagagcacttcagaacttgggagaagagacggctggaccgaggatatgttggaagcagctcatgttgggccaatcttctcggcccagtgttgtgggatccgattggtttatgggccgggccttgcggcccagactggtgcgaattcgatttgtttctgtgtgctgggcccagttatggtccagtgggtgatctgcagccttggagttgaaggcccataccgaggttagactagctcgttgggttttggtccagatgaaccactgacttatctgggccggcaatgttatattgggctgcctctggaataattcttgatggcccttttgataatttatagaattcatttttcagttccgttatttcaactacaccgtgatgaagttcatcaagagcataatcacccataataagtgtattcagataatttaatacaccatttggtcgtgaatatttgatggttaggccggacaatatttggatggcaaattttactacaaaacatctaaatttcgtgtaatttgctgatagacatcgaaaaaacattcacaaatgaaagacatctaaaaatactagtaatttgttagagaacaatatcgactcaattaaaaagataaattcttgagaaagacaagaatgcccctagaatcacatgcttcaaacataacgttaaagtacgaatttagaaattatgcaactccaaatttagcatcaccccaagtacatcactagtatacgtgatattttatcttcaccctagtctcagttcaaaatcttttgaccgtgggggcatccttgtcttttttaagaacttttcttttcaattgagccgaaagtgtcatttagcaaattatcagttttttaagagtgtctttcagccgtgacacgtttttatgatttctatcaacaaacacaaattttgagtgtcctatagttaactttacctatttggatcttacttttgaaactttaactatcaatagtctttgaaatgcttagtttaaaaacaaaagacttggtagtatcaatgttttatgcccataatatagactaattaaattttataaacttaatactaattggccgaaacttgttttaaacgttaactatctagaaaacgagggagtaagtcttttgtatttcgcctaagaatgaaaagtgattaacattgtgtaggaggacaaatacgtatgatctatgatcacatgaagttctgaaaaaaaaaagatcacatgaaaatgcaagattacatctctaaatcattttcaatatcgatgccaaagaaatccacaaataagtccacctgaatatagtataaatacaaacgatattcctatcttggatctttttcctagttctagaacagtacattttatttaacaagcaatagctgacgtgtaacactcttataaggtcacgttaatccactattttttcccacgatcatagaggaaatcatgcacaaccctaaaactctcaatccctgtcctcattcatatacagtaagatttttttttccagagagtacaaaatgcaggggagagagggatgcgggcacgggtgatgatgccgaactggccgaggccgccgatcaaggacggcgaagaagaggtcggggtcggcggagggaagaagagggagaaccgagagaggagagagaatgacatgtgaggcccacgtgggccccactattttaaaaatatttttgtgtgtagctcacatgtgggaaacgatttttattattttccgagatataattgccaggtaagcgctacgtcaatgtcatgtgggatggagacctagtcaaaccagccacgttaggcccacgtcagccaaaaccgccttccaaaccactgagagacctcatttgcaccggttttgacagtttaaggactggttgtatctggttttagggttcaagaacgaaaaacggaatcggtgtaaaattaagagacctcagataaacttattccttcgataaattatagacttcatttttcagttccgttatatcaactaccctgtgatgaagttcatcaagagcataaccacccataataagtgtattcagataatttaatacaccatttggtattgaatatttgatgtttaggaaaatatttggatcttattttgaaactttaactatcaatagtttcgcatgcttagtttaaaaacaaaagaattagaagtataagtgtattctgcttataatatagactaattaaattttataaacttatactagttgatcgaaacttgttttaaacgttaaatatctacaaaacgagggagtaaatctctagtatttcgcctaaaaatgaaaggtgattaacattgtgtaggacaaatacgtatgactatgatcacatgaaaatgcaatatgacatctctaaatcactttcaacattgatgccaacgaaatccacaaataagtccacctgaatacagtaataaatacaaacggtattcctatcttggatctttttcctagttctagaacagtgcattttatttaacaagcaacagctgacgtgtaacactcttctaaggtcacgttaatccactatttatttttccacgatcatcgaggaaatcatgcacaaccctaaaatctcaatccctgtcctcattcatatccagtaagattttttccagaaagtacaaaatgtggattttaatgtacgtgctcacgtagaaaaatacataaaagtcttctttgtttgcgttctattagaaaaacattacgataacgacttttttttattggatagttgcggtgcattatgacattctgctatgaaagcatggtcgtaatgatagtcatggatgagcaagtgacagcaacatcctgcgttaattttctgcacgcatggttagacacaatccatccagaaggtttgaaattaatcgagagcttaattagattcacatgttaatttaactggcgtggcagcttatccttgtcaggcgccggccggcggctaactcagtaatactgatgattaatcaattttcaagtcgtacataaatttcttttttaaaaaaaaaaacagagttcaagccgtatatagctgacgcaactgtctgttgattcgtcagtgaattggttaataaaataatatagtacttagctgatctttggctgattttttttacaataaattttgaagagatttatcatactccgtaaactgtgtgaattgtggtgatgttgaatgataatcaattgttttcagccaggtaacgatgatcaattgtgacattgctagtgaagtactatactatataataactgtctcgctgatgtcagtgatgaacttgataagaattagcaggagtaactaactaactagtaggaattggcgatgaattaacttgattgtactgtacgtgaggtacgtgatgcacgtcgtcatatctatctgccgtgttcttgaccacttccgtcgaacattcttcttcagataaagcagatagagatactagaatgccacaggtctttagcccgttgagtcaagcaaattaaatgattacgaactaacgtagtaattaactgcacccaaaaacaagatcagctcccctgccattaactaaaactggttaaactaattacagtaggctaccggattgatttcaaatattatggctgttcttcttcaggttaaaatttacatagttagtttttcaaaaaagaaataatagacatttataatttaagtttgacttatacctgcactcgaaactttgactcgttttcagatgaattaatcacgcagccttttgagttttgatccattcaactgttcaaggttatctgcgcggcgcgagcgataagggctttcagaattcagagtccacgccttgcccagcaatcaaatattaccgcgggccagaagctctcacgctcgcgagaaatcaacgctgcaaaacgcgatgacatcatgatctggcagaaaaatgcaggcaatcatcatctccaaaaccacgaaacgagagaaaccgatgacgtcgaaaaaccaatctcagcgccgttagctcgtgaaaccaacgtgattacccgaaacctgcagcaaaaaaatcgtgctgcagaaacgttgttttctcttttttttttcaagaaaaggaataatagatgcaggaactgtaatgatccgatcccatttgatatggtcaaccaattaaccagcatcttagagctaatctgatccgagctgcacataatcagatcgattctgtgctcgagctgagctcgatatacaatccggcgcagatcgtgagctcgaaccgagctcgatcgacgggtaactgtcattgtcggtagctagcttgatgcagaatcacaagagtaaattaatagtaagattttagttatcatcacatactaaaaagctagtaccggccaaattgctctcggcagattcctctgcattttgttactcgcacaactccaccgggtcaatcgtggcaagcaaggcacgaaattaattttcttttacaaaactgaacagtagtatctttctgaacgaaattgaatacatatttctttcagacatccatacttgaccaagcacacgcataggcaggcagcaatcacgcgccaacatctgaagatcaagtctttgctccagaaagaaaaacacacaaaaaaaataataataacacgtactagaagaagagcaggtcgtcgcggagacccaagaaataaacgagtcgggacagaaacagaggcgatcgcgttgcgttgcgttgcgttggcaaatcctctttaaaaggctcgtgcccgtggcgccagaaatcgttgatccgcacacggtaatatgcaagagatgttgttctgcggcacgggcagtttcaaggacgtcgacggcaaggcggcggcgccggaggcgaagaagaagaagcagggcggcggtggtggtggtgggaagaaggagaacccgtacgcgtcgagggggctcgacaagttctccaccgtgctgtccgagctcgagtcgcggcgggagaagatccttcgccaagtcggcggcgccggcggcggcggcgcaccgggggagggcggcggcggtggtggtggtgagcatgtgctcgtccggttcgtgcagtcggaggggaaagggtgggtgcccatcgtcgtcaagctcccgcctgaggaggaggagcagcagcagcggaagggagggaagaacaagcggaagcagcaggcggccgcgacgtcggcgacctcgtcgcagtcgtccacgccaccgacgtcggagcccgccagccccagggaggacgtgatcaagcccgcgcgccccgccgccgccgcggcggcggcggagccggggagtgcgaagcggaaggccggcgtgaggtggtcgtggtcggacgtgcggccgcgccactacatgccgttcgtggcggtgctgctgctggcgagcctcgtggtgttcggcaaggtgttcgccatctgctgcacctccgtctggtggtacctcgtgccgatcctgacggccagctctaatggcgccggcggcgccggcggggcgcacggcgtgaggagatcgaaggccgccgtcaaggttctcggcaagaaggcgagcgacaagaagatggccgtgacgccattgctgggtccttcgcacggcaagaggggtagctccggtgtccatgagttgatctcgccgagaagtcatccacatgggaagaaagggtagtaattcgcgtggattcattcaccacacgctgtgaaaaaatcaacgccgtgtttgtaaatgtttgtacagtagggtggccaggaagatcagattttttttgttatctttcctaccgtttcgattcagtttggttgcaattgcatccagtgttcatgtagcatcagcccccttcttgtgtggctacccaaaattgttcataaattttacagaattttgtccattaactcgtccctggtgtactggcagtttattttcatctctatgtatgttaactatgccttcgacttctggatctctggttgatttgagagagcgccattcgtttatacgttgtggaaacatgttttttttttttggctctatccgttgaccttgtttttaggtacaatcatcagtaaagaacttctagattcaggcatgtgattgtgtagccacgcatatcacaatgaatagaaagtcaagcatgtttacttctagaagttagagaacttacttgtttgacaatccagaagaaaatgcaattgtacctgcctcgtcaatgtcaattcacattatctgacttttaaccaatacaaacagttatgcttagaatttgcaggcttaggctgatcttagccattgcaatttctcattcagcaaaattgtgagtttgtgattgaacaatgaatgagcatacattgagatgccaacagtgcaaattcttttacaaatcacaagcaagactgtgttgtgatgatctctgggaatcaaccaggacataggctaatagtaataactacgcaatacctaattcagaaagactttactgttagactaatgatgaaacaacagaatgatacagtacaatcattttccctgtccttggaaccaagtaatcccaccatcatgccatgccctatatccatcaatcctgaatcataagggaaataatagatgttagaaaatgttacaaagagaatggtaaaaatgaagtaagcaatacagcattcgggccaagaggaacaaatatatacaattatcaatacagccacaggcaaatcatccatgataactaaatgggatgcggttgatattgcattctatgctcccagccgttcagcactattaaacccccggcaagatgaaaatatgcatcaggatgcacccaatgaagatgaatgcacatcacatcacaaatacttatattagaaagatttgatatgttgtcctaccctaaatctctttctatgatctgactcaattcgcgatgtgtaatgtttcttccttccatgagccgatgaatttctctcttctaaattgctgcgaacaggctcgtattgtgcattgcggaagaaaccttcatgatcccaagttacttcatagtctaccttcaaccgtgatccttccttcaaacagaatagatgagtcagcttccattatgttttctaaaacataaaacataaatgataacaagacattaattgaggctgttctggcatatatagtatacatatgtggatttatccatgtgtaacaaatttatgcagcttaaacttaagttgtggtgccaaggtagtgaatatgagatagtatatatcagtcatcactcatcagagctgtatgtggaaggaaagcaacaaatcctaccaacaattgtggtcctcaatcctcatagaagctgatgcacttctaataatttctaatacctgtaagtatctaataccttagtaattttgtagtcctcttgtctagctaatttagtaatgatctctctagttagtaaacactaatgtggtcactttgctttcaataaacatagccatttatctgaccatggaatgtttatcggcagggttcaccaaacaaggaagcaaccagataaccataagctaacgcatgaaggtactgcctggcactctaaaagtgggttcaacccaacccaacccatcccatcccttgaaacaaacacacgctgatagagggtgatggttaacttcagtggaagatagtgatgtgatatcctgctaactttattggaagactcagaacgcttggatgtatttgaaaaggccaacaggacaaaatatataggatacaagaaacacaatcctacactaccacaaatacctctagcatacaagttcacacatcagaagggcatgtgaaggtctgaaggatgtgtgctatgcaacgtcagtgcatgataattgccagtaggtaatgctaaaacagagctgcacagttgaaacaaaaaacctatatagaaggaaaccagaaaggaaaatctagaggatattgacttcaaaaaaaaaatctagagggtatgctcacaatatcatttatatgtgttatgtgaactaataaaaagttaaggattgagagataactggtaacagaatatgaaaatcttactttttctaatgaacgtccacataatgcctgcattgcactgttgaaatcgtcgtagttctcaaattgcacccacactttgcaatttagtccagatataatctccttattggttccgtcttgttttgctccccattcatcatcactagaaatattaaggttcctgaaaattggcagaagaatgccaaagaaaagggtatgcggagtaagttccccaaaatgtgaagggcagttcataacctgcagaatttaaaagaaattgggtgcagtgttatttaaagaagtcacatgtatacaatagacattactccattattgtgcttgatgcactagggttatgtcgtatgttgttttgtgtgacatggattttatgcgtgcaatatctaatactactaaagaaatttattttacccatgttacttcccaagcttctttattatgaattttgaacatagctaacacattcacctaagctaccacactaacatcagaaactgtatgaactggtttttgctgagtttaattgctatcttggagaatcagatcatagatttcaaaatataagaagcgatatgagtgagaagaaacttatatgtggatgaaaaccaactagacagggcagaccttcaggtttcaggtggtgctaattttaatgcgcatattaagctctcaaaaggtgtgtataccggaatgggaaggcaagtaagaacaaaatatgagtccacaaacaaaataggaaaccaccaggatggacattgaacaaaactgaatcaaacaatttccttatggatgctcatgtcaactaagtttaggactcttttcgcttttattagcttacgtccggcactaatattctgccttgtatcccagagatatgaatgcatttacaatataatgaaccaaacagaagttgagaacaccaaaatgcaccttattttaccaagtgccgagaaaatagtgtgtgtgaccagcgtggaggctttcgatgatatcctcgtctccgcaaaccacctggatggcacaccccggacaagaatggtgtctggccttttcgctatcttcctcacaggattccctgagcaaagcaaacatcaattcaaactccacctagcaagaatcacaactaagagcagcattttcatttaaaaaaatgaatcccatactgctactgaggagctcggaggcgtagaaattctcccaagacttcttcattgccctgaagtcatcggagggcgggatctcgacgctcatccgaaacttaaccccctcgaggttgagctcgatcccggccagcttctcgaccagggagctcctccactggaagtacttctcctcctcctgctcacgggtcatctcctcggcctcctcctcctcatcatccccgttgcggcggcgtgggcggaggaaggagaggtcgcggacgtggaggacgcccgaggcgacgggctcgtcgcggcggcgcttatgcaggtcggggagggtgcgcacggagaggtcggagtcggggaggacggggagggagaggggcgggtcgcggaggaaggcgaggagcgcggtcttgagctgccactcgtcgacggggcggacggagaggtcggcgcggaagaaggtgaggagcagcttgaggcgcggcgcgagggagaggccgctcgggagggggagcggctcggtcggccggagggcggcggcggcggcggacatggcggcgcggtggtggggagagagacggcgggatggcggcggaccggcggcgggttggactcgacgggttgcagatgggccgggtgaatggacaatggagaaccggaggcgagagaactgttgcttcacgcgttgagggccgtccgatgggagatcaacgggtgatcgtaattcaactatcgcctatcggcctatggcgcggatgtgttgttagagaaaaggattatgtcgagattatgttcacgtcatgttcatacggactagcgccgatttgaacatgcaatttcgcacgaaattcatacatacgtgcaatatgggattccgagcataagaaaatcataattcgagttcaaagttcgaacacaactccacatcgaagacaatagatcttactatcatcaaatgattcgtataagattcaatgctaagggaactattctaaataaaattttaaggggatattcactcgttgtttgcagctactcaaatggttataaagaaataaaataaaaaatcgacgagatagattaatatatgatatatcaatccacaaacatacaagttaaatttaacttctacatatcgcaatttaaaaaaacaaatttaattgtcaatatacgttaactagctgtagttttttttgcaacttttagaagttgatttttagcttgcatgtttgtaaagtgatatatcacatgcaaacaacaaggaacatccctttaagagtttaaaatctactctcttcaatactctgtatttatgttgcaacaccttattctctcttactataaagttataacccactaactcttaaagcttaacatgcaaagatgctacatcatcgtcgactaacagttattacatttaaatatcatgcaaacatgctatattatctataattttataatttattaaattttagagctttaaaatacaagcatgttaaatcatcatctcacataatttaaataatatgttaatatatatcttcattatttttaataatatcttatatacctatatagttcatcctcaattagttaatgatatttttatcttctctcattaagccatatcacatcaattgtttttttttgtgcttaaatgatttattaaattttagagctttaaaatgcaagcatgttaaatcatcatctcacataattcacataatatttcaatatatatcttcattatttttaaaaatatcttatgtgcctatatagttcatcctcaattagttaataatatttctctcttctctcatcaagccataccacatcaatttttttttgcttaaatgattaatatatggtcaaattatctccacattttcttctttcattaagctatatcacctcaattgcttttaggtcttagatgattaatctatgattcaaactgtctccctacttttcttctctagtaaagtcgtatcactttacttttatatttgaatcattattttatataccatttaaatttaaattatcataaactacgttaacatactcttatgttgtgtagctattttatatattatttttacttattgttatcataataaactactgcagcaacgcgcgaggtttcacctagtatatgagatgttagctctcaaaaaatgaatatgggctggatttgagatcctactggagatgcaattataacttgcaagtcaatgtagcgataaaattctaaaaaatgcgctaattagacacaaatcaccctttgtaagaccctctttcgctgaaaaaaagttctgagtgtacatgtcgcatttccacttgtgatttttttcaaaacgctcagtgatatcactttaacttagaactattgtaccatattttatccccaaatttcattcgagtgacatatagcaatcccgtttgctttattaccaatctgcacgtgaagtgctatgcaacagccttgcattgcaccgggaaaacagtagagctcatcgccctccgccgccccggcggcacgcctgcctgagcggcaccggcgggtcggagagcttgccgccgacgatcagctcgaagacgaacctgttcgccgcctccgtgaagtgcaccccgtcccagctcacgctcctcgacgggtcgtcgcacgacttccccgccagcaccgacgtgccgttcacctccaccttcccgccgcaccggatgtccctgtcgaagttgtactcgccgccgccgtacccgcagcacaccagcagcgggtccccgaatcctgcaacgaacaatacccaccaatttttcaatcctgcggcgatttcaagtgtttcttctccggctccggtggtcagatcaacgtacgtaccgagctgcttggcctggctgatgagcctgtacttggcggagtagacgtcgacgtaggtgagcgcggcgtccgggagcgccgcccttagccggtccacggtctcgcgcagcctcgcgttgaagaaccgggcggccgcgttgtaggcgacggagcagccggcgtcgtccctcggcgcggcgagcttcggcaggagcaccaccgcgtacgtcaggcagccgagcggcgccgtgttgtgcacccagaagtacctccctccgaggctgtacactttctgcactcaccaagcaagcagagcacgtacagtacacatgagcagtcctatcgttttattcgaacggcatatttacaaaagaaaaataatttataaataaattttttatatacatcttcttggcaatataaaagtataggtcgaaaattaaactttgcgatagaaaagtataggtcgaaaattaaactttgataaaaaaaatcttaaaattagctttaaatataaggttgaaaattcagaatttgactgataagtataaacataagcgaaacaataaggccgctgatcatctgataagccgtggaaaaataaacaaaacaagcaaagattatttcaatacaaaacatttatatctctgttattagtgttttaaaagcaaatgctagaaaaaaaactacgatgaaaagatcctaaaatcatctcgaaaattaagttctaagaagattcaaaatttcttagtttgtcaatcagtcaatgaacctaagtgtactgtaactaggctgtgatcactgcattgagctgcacctggatggctgcactgaacctctccatgagatcagggacgtaggcctcgacctgctcagtgctcatgttgtcgaagtagcccattgtcaggtcgttctggccaatgtcgaacgtgtagagcgccctggagaagtactcagctttcggaagaatctccctgtaaattccacctgcacgaaaacagagtatatatcaacttcacaaaaaaaatggaactgaattttgagctctgaatggcgcatatgcagaggctgatcgaatttgtcttcacctatgttgctataaacgaactggcttctgttgatgaactgttcgaattggctggtctgcacgtccagggagatcgggctgatgccggagacgaagatgctgccattcgctggtctgatcgacgcagcggccgtcgcgaaattggcaccttgactgaagttactcccaactgaatcgaggtatgcactgaggtaacgaatccccaggctctgagctgcagcgtcaggaaaccaaaaaaaaaaacacagtagattcagagttcgttccgagtaattgggacgcactgagtattactgacccatgaagtcgatggtgaggcggccgtcgctgaaccggccggcgggcatgccgaagtaggtccggccgaacggcggcggcaccacggcgatgagggccgagagcccgccggtgtccgagttggagtcgccgaagttgaagatcgccgggaaatcgcatggcgcgtcgctgccgccgtcggagcttgccccctcggagagttgcagcaggagcacgacgaggagcaacacgagcttggcggtggtcggaggagcggcggtgcagcggcggcgacgtcgtgaaggcgccattttttctttccaccttgctcgatcgtagtgtgtgtgtgtgagacttgtgcacttgattattcggagctagcgctgatgtttcatgtttcataggggaggtatgtgtgtacgtgtcgaaccaacgagtcacacgtccacgaagcgttcgaagtccctgtccattctttctcaagatttttctaggtttgggtgttgtttgtattcagaattcacacattgtctcaggtttgcatcaggactggtacaatggggacaagagtttgtgactttttctggaagtctgattggtttctccttgtttgttgcacgtggcgtgaggatgacttatctacacttttctaaagtaacttattctctcttttgttttccacgtgtacgctttctaaactgttaaacgatatattttttaaaaaaatacataaaagttgtttaaaaaattatatcaactagaaagttagcccgcacatatgcgcggacacctatttaatgtgtttgtgataatacaaatgtttatatgtgagtgactttttactgaaatattttttactcaattctaaatctgttctttttttgccaacaattcattttggattgctttgaatgctagttttgattcccttctaattacccttaaagcaaataaagtctaaactaaaattacttgaaaatatgaatttataaaagaatattgtgtcataagaatggagttggttaccatgaaattatatatcatttgtattatgtgtatttactttttaaaatatttagcacatcttatttttggattttctaaactttaattaaggtaaaattttattatgctatatatgtctttatagattttagggcatattaattgaagatattttctattaaaaatatggctaagagactattttatctaactatagatatacctctatttacctctactttctccgtctcataattccaaggattcaaatcatatcccaaaatataaaggttgtaaagtactaactgtcccatcgaaccacccctcatttattttgttcctaatcttacttcaaccatctttattttttatccaattttatctcaaccgccttccctatctctatgtatcctttatttaatgagagttgtcatagttttttttcctccccttaattcctcctaaaatagtatgatcccttacattataggataaagatgatacaaagtatgcaccatttatagatggatttgtttggtttgtttgtgcctatgtagattaatttagccttgcatgtttataataatgtggatacatgaactattgatttagttgtagcgacataatattttactgatatttgaactatccaaaagcaagggtttaaatatggttatttaaagatcgatcaaatatttagcaagtatgctcatgaatttagggtggtcaatgtgcacacaaattgtgctgcccgcgcatatggacatgtgaaaaaacagggtcaggtgctctacgcaaattagttaacattccctaccttccaacaatgcaaatttgtttaaaatatgggtcattaatttaaataaaaaattttaagagctgtatgctttcaaattaatttcattagctagctattctcatgttatcactttttcttcaatcttagagttataacagtaaaggaaatctggatgtaatactttataaagataagctataataatcttcaaaataccacgggaagaaaaacatgccaaattaattggcttggtgaataagataatataccttcgtcccgaagatcaaaatttcaaaagtaccattgttatgggaacaaataacttaaaatatgcataaacatcttcagaaaacctgtaatgttatgaggaggtgattattagtttaacatcaaagagaaaagtaaaaaagaatgtgaaaaaactatactgaaccatattaaattaattaatatttttttataattgtatagctgcaaaaacgattatgatctttgttgcaaaaatatgtcattaatgaaggatattggtattgtatcctctctgcaaaacttatgtcgcatctacaaatcacctaaggagaagaaatatggaatttgcttttagatggatgatgggatggtgtctcgctaagcattgtgaggctgagtttaattttcacatgaagcttcctgctcaattaacggatgcagaccgatgccacgcttgactgcttaccggcctcatctttttcttaagcatcttattagccaaaatttgaatttttaatcttaaatttggagttgattttggggtttttttcatctaaatttatttttcagcttttgcttttaaatcactaagaacacgtatataaaagttttatttacaaattatttttagtttacaaatttattgtttcgaaacgatggagccttgtagatgtatacatgtaggacccacatgattcaatgacaaatttatgtggcatggttcaaattttccatatattgtatacagaccccaaaagagctacagtacaaatgctaccgcacataattctgagagcacctatgtgttccaatctcattcaccgctgttaattatatcggctgcaatgatgatggcatcaaacgaattagaatgcagatgcctcgtggccactcagacgaagtaaatctctattacgattcactaattacttagagaagggactaaacaatgcaattagtcttgagtggcattggaaaaaaaatatatagcaccatggatttacctagatcgatcggaaggggcatcacaacaactcgataggaagggggcatcatgatgatcgatggctcctttcctgacagttagcacctagcgagttgtactcgtattattcaagtgatgcacggagattaatcgcagctcctctttccaatctgttgagagtctcggatcgatacagaaacgtgataaactgcgggcctagctaagacataattacgtggattggaaatttttcttttaccttaaaatttctatgatttttttctaatttatttattaatttccttaatattaggatgccacgtggtggcataggagcgttggtaggagtgccacttggcggcataggagcgtttgtaagaagttttatgtaattttagtatataatagattcatttttttaatttttaagtaatacttaattactcaagtgttttgatgtgcttgtcagaggagaaatgttcccaacatgcaccttcaaacacagactactgtccgattgtaacggaaagtgttatgaactgaaagaatatccgctcatcttatgtataccatctcaatagttaaaaaaaataaaaatttggtaggacatattaatacacaatatataactccacaaacatgcatgcaaattcaaatacgatttcagtaagttgtagcaaaaaaatatatatataactgtgaatatgtatacatactcgtcagaatttaatttgactttttttaattaaaacttatagaactcatatttgaacttacatatatttttaaaaattacacagtacaacgcagacactcacaatgcacgcacactcactcatatgaacgcaagcacgcaaaccctactcctatgagtattttcgaagactggaccggcaaattatggagattgacaaaatcaccacaggtgtctcgttgtcgcctaccactaaaagcacaaagccgttaaatcctgaaaaaatcgctcccatagagagtcgaactcaatcttttcaaatatttattattttttagaattatttagattccccgttaaccttcttttctcaccggagaacatagtgatgagcttgaggctttcatggcggcaaacaccgtcattaacaaaaccaaaggtccaagaccatgcgcataacgccttcacatcgtgccattacggcgcaacggcgtctaaacaaaacttaagatgattcagaatcgtattgtcatcttccagattgtctagaagcatttcatcgctactcgttatgaatctcattctccctttattgcacaaaggaagcagtatatgtactttatatcaaccatatgcctctgcaatattgcacacttacaaagccagaggcagcagcagcagcagaaatggcagtacggcacagccaacctgacgacggctcgatgcacccgcaccggcggcgacgattcactgccctctgctgatctggcaggcctgcctgagaggcaccggcgggtcggagagcttgccgccggcgatctggtcgaacacgaacttgttcgccgcctcggtgaagtgcacgccgtcccagctcacccgcttcagcgggtcgtcgcacgacttccccgccaccacccacgtcccgttcaccttcaccttcccgccgcacccgaccctgtcgtcgaagttgtacctcccgccgccgtagccgcagcacgtcagcatcgggtcatccatccctgcagccacaacacaacacatcacgccaatggcacgggggggattgcacgagctcgctaggcacaactagctaagctttaccgagcttcttggcgtcgctgatcagcttgtacttggcggagtagacgtcgacgtaggtgaacgcggcgtcggcgtgggtcttccggaggtggcccacggtttccttcagcctctggttgaagagctgggcgacctcgttgtaggcgacggagcagccggacccgtccttgacgacggcgaggtcggggcggtgcaccatggcgtaaggcaggcagccgatcggccccgtgttgtgaatccagaagtaccttcctccgagaccgtacacattctgcaggttaccaatcagctcatgtatatgggtgtgtttagttacaaagtttttttttccaaacttccaactttgcatcacattaaacctttcatacgcacataacttttcagtcacaccgtctccaatttcaaccaaattctaaactttgggccaatctaaacacaatcatatgtgtagagttccatatttcagttcgaaattttctttttggcaacttcggtcccccgataggaaactattttagaaaaatattcaaattatttcagactagaatattctgaaatttctgcaatttcaaaaaattaggatcgatcggtacccctgtttttttttctttctgcaatatagaaccctgcatgtatgtgctacactactgctgttattagcggagaagaataatttggtgttcttttgagttttgaagaaaatagtaggagtattgtacaatctctgtacctggattatgttcgtgagcctttccattagatcagggatgtaagctatgacttgttcagaggtcatgtttatgaagaagcctgtggtaatgtcattctggccgatatcgaatgtgtagagcgcctgagagaagtattcagccttgggtaggagctccctgtagattccacctatgtgaagaaatggagcgaaacagaacgtgattgttgggttcaacgtggtactgaattactgacagaaatggattttttggttttcttgtcacctttgttgttatagacgaactggcttctgttgatgaactgttcaaactcccaggactgcacgtccaaggaaatggggctgaaaccagagaggaacaaagatgtgttctgccttctgattgacgacccggccgttgcaaagttagcaccttgtgtgaagttacttcctatcgagttgaggtacgcactgaggtaaggcagtcccaggctttcagctgcagcatcagagagcaagagtgtgtgtttacacagtaagaatctgcatttgatcgttcaaatagcagtaatctcgttgcatttgatgatttccgaagagtgtgagttgaagcctgaagcttttacaaccagcaccaaagctatagcacggactgccatgcatcacaaagttaaggtacatggcgaatggttcaaataagtttcacatgcgtctctgtcagtggtgttggtgacgacaagaacccgagttcagagccatgtgcaaatggttactactccagttcatggtttctactgctgtgtactactcaactattcttgcggtcctctcccaattagccaggacaactttatgctaatgccaccactttataccagaatgcttcaactgcaatcagaatttataaagcaaaacttccacaatctgcagcgaatattgcatagcatggcatatatgataagctcatggctgttttgtctcccagtttttctggccagcgaccactaaaactttctaaaagaccccttagggccaccaaactactatcttaaggtaatgtttctttctgtctctcgtatcaaaagctaaataaaggaggagtatctgatatattccccagctgcaatgcaacatcctctctacaaaatctccccgcgaggatcgcatggctgatagcagtggcgtgaccgtatctagagatgctttgccgcgagttactggccggcctttcgtcggattgtggggaatatatcgagatcgtgtcggcgctcggcagcaacttgttgcagtaacaataataccgtgtaatcgatgccatcgttggcacggacacacgggccgctcgtcaataattatggccatggttgggttggttctttttttttagaactgttgggttgggtcttggctggttgtagccagcttgccggatatcacagcactagcaatcaatcagtacgtgaaaatggtagaccttctctttcttttgcggacatttgttctaaagcaatcgagcaacctgttcagacgttcgtttttacttttaatttgggcttaaccattgcgagacactaaaacactcgagcagcaaacgctgaaacatctcgtgtctgcaacctacacatggaacgaattaaagctgatatttattggttcagagtgggagtaggtttcagttcgatcaagtatatgcagtcaaggctcaagggccctacgtgcagtcgtgcggaagaagaggcagtgaaaagttgataatagaaagaacgagagaaggttaattagctgattaagacgtgcaggggaaagaaaaagactctggttgcagtgattcagagacgtacgtaccgatgaagtcgatgacgaggcggccgtcgcagtagcggccgacgggcatgccgaagaaggtcctgccgttgggcggcggcgcggcgccgaaggtggccgacagcccgcccgtgtcggagttggagtcgccgaagttgaacacggccgggaagcggcagtccgcgccggcggccactgagacctgcgacaccagcaccagcacggcgacggtcgccaccaccaccgcggctgcgtacggaggaggcgccattacccccccaccacgcctcgttcgcgcgcgcggggcactgcgagcgagagcgacgacgagcagagcagcgtgggcggaagacgaggcggagcttagcagcagtggcgttggcgtggcagtgggcggaaatggcgaatggagatggatggttgtggatctgcggatagagataggcgggaggcgggaccgcgcgcgtgcgggagagaacggtgggagaccccaaacgcgacgcggtgccgtggacgacagcgatgggagggggagggcgcggtgggatggccggatgggtcacactgactgacgagatggccgtggtgtggtatggtgtggtgtggtggtgcgcgggcgtgggcgcgggtcgcgagcgatggtggagtggagcacagcgcacggtgtgccggcccggtggcgcggcgcacgggacgttggatttttgttgctgtgggttcgtgggagccgcgtccatgacgccgcgctgcctcgtcgcgcgcgcccggtggtggattcgcgtcgcgtcgcgccgcaccgcacgcgaccacgagccgtaacggagatttttctttgctctacgtgacgctttggaggcggcggtggagtggcgatcggcctatgttacatacatacgcgatctaggcaaagcgtgaaccgggcgcgcgtgtacatcaatgacggtacgtgaagtagaaagcagggaagcatggcccacgtggagggaacagatgggtttgttttgctagagtggagcacatcattgggctcaaatagtagtgtgatgtatgcctgtatgagccttatctctcggtcacttggtgtctggatagtgggtggaataagttcaccagagatccctcaacttaatattgagattttttgaggtcccttaaccataaaaccagaaatatatacccctaaactcactcaaactgttcaaaggaggtcccatgacagtatcgactacccggttttgctgacatggcatcctagtcagcaaaaaataaaaaataaatatgtgggacccacatgtaagtgagaaaaaacgtggggtcaacaatcctagtcagcaatctccttctctttttcttttttctcttcttctctttcagtagcggtgcgcggtcggaggtaggcggagcggcagcagcaggcgagcggtggctccgggctcgggaggtggacgcataccgctctcaacactgatccggtcaaatccagaagcggatgcagcttccgccggtgatgccgatgtgaagccatcatcattctccggcgatttggggttcccctcaccattcaccatggtggtgatcatgctctcccttatgatagaggcgtcatcatcacatcccctatcgacgtcacatccttctgcgatcgcaccgctctccggcttgccgtcctcatctgcgtcggaattgatgcggcttgacgacggagtggaggtaatggagcgtggcggccacgtcgcgagcgacggcaaggcagcggggccactccaccacgagctccgagcagcgccaccccagcagcgcgtcctgcagcgacccattgggtatgcggtcgtacgctagcatcatccgccgcggccgcccctcgccccgcgccgcggacgacatcgagtacgtgaacggaagcagtatggagtcccgccccttcccacccggcttggcggcggcggcggggacaggaggagatcccggtgcggaggacaacgcgagaaggtgggacgcgacggcgaactcgttgtggaactcccgctccccctgcagcgaaccagcggcatcccagcaacccaatccaacgggacgcaccggttgcttcttgagcagttacccaaagaggaggacctgctcgaccgtcgtttcgtgctacgggaggcccgcctcgatggcgcttgcaaggagattgtgttcctctaatgcatcttattagccttccatgcgcacccatcctcgtcctcttccactccgcggtcacgtattgtgaggcgacgatgtgccgacgctcctagatcccatgcctcgtgtcactagtctcgttgttggtcatgctttgggtgttgcggtacaaggagatcgagatagagggtctctccaccaaattgatgggccggtggccggttccctcaccatcagcatccgcctcctcctaatctcagcctcccggtcctatcccctaccgtgaagcttatggtgttgatgcttcgctgcttgctgcctcatatcccctctctccccatgccatggtggcaatcgaggaggccatagggggagtgaggaggcccaggtgagaagctcctcgtcgccttgccgaccaccgctttcaccttcctgtcgaggagctagtaagctcgagctcatcggccactactattgatgatgtccatgttgagataaataggaaaagtagagaaagggaagagatggaagaagggatgaatgttccactgacacgtggggctattgtaatttttttatttattttggtaggagtgccacgttgatgccacattagctaaaaccggacataataatgttttgggatctcaagtgcaccagtattgtaagctgagacaaacactatatctggtataatacggttcaaggatgcaatttaaactcgacataaaaatgagggataagaagtgaatttattccgcatgtatttgtatatggaccaaaattttggcccattaaaacgtggcctcatgaggcatacgagcgacgtggatacacatggcaatctccagctttactgtggtggatcgctctcttggttagtagatttgaaatgtccagaaaaaaaaattactagtgcgaatgcgattttagagcatcggatcaaaacggctatgcgttatttgggtggacatctgcaccgcgatttccgcaacggccgcctcctccttctccgcctccaccctctactgcttcgctagtagcttctctgtctgaggatctgcaagaagctatcagcaaccgcgctggtagggagatcatgattgtgatctgcggtcttaccaagttacaagatgttgcgaaggtctagaggatgctgcatgagaagataagagaagatagatgggttggacagtagaggacacaaatatcaaagtcctcgatgatgcaacagatcgatgtctgagtcttatggttttaggtcgttcattcagttatgtgatgttccaatcgaatcaaggaaggtactggaactacatgtgtttggcaagttgcgaagagagagtaaggtgcctggactatgggaattggttggtgtagatgaggccatggccatcgcaatggagggtcagtccattctcagagaattggatctatcggatgaacaaccattggattctgacaatgattgggggggtgtctgaagaagcacctgatgattatgacagcctgagtgaggatgcacctgatgattatgacagcccgagtgaggatgcacctgatggttacgacagcctgagtgaggatgcagcgaatggttacgacagcctgagtgacgatgcacctgatggttacgacaatccgagtgaaagatgcaccttatggttacgacaacctgagtgaagaagtaatcaaggatgtgcaagttgagccggcatttgtatccaaggctttgacctcattagaagaagcggtccttatgaagagcagaatcaacaacctgaaagagcttatccagaaaatgatcaatggacccattcgttttccacaaaaaagttaggaagcaatccacatgatgaacataatggaatcaacaatatgaaagatcccattcccctctctctcgatcaatagaataaacaatatgaaagacccccctctcgatgagcagcaatatgaaatatcccctttttgataaacagaacataatcaacaatctgaaagatcccatccccactccctcttgatgaatggaatcaacaatctgaaagacccccccctcacgatgagtagcaatatgaaagatcccctccttgatgaacatgacataattaacaatctgaaagatcccccttacagaatcaacaatttaagaaaaataaaactgtaacgatttgttattttcacctttacacttcttacattttataacctttttttttgactatgagactgaccttgctcaattgcaatgatgatgcaatgatatgagatgtagtagcataaataaaagaaatgttatctaggatacaatgctctggagtggatatattgcaaggatatcttcaaaccaattgtaagaaatattgtacatgatagctcaaggggatacaatgtttgtcttgtcgaccccgattttggaaatcggagatcttctgtgtttatcagtaccaatctctggatcagaagttggtacacacatacatagttgaatcacaacacatcacgaatgctttttttttgataacaaagaggcagaagcctcagatttaccaaggaagaactgggtgaacaaccagttttacataaaagcccctaaagatgggcaaattacactggaggatacacttatgcagtgaaggacaaaataaagtttgaaaaaagccatcaggtcctgcacaacaaactgctcacaacagagatgaagaagacgatgctccaggcaacggcgggtactgagcgctcacgataggttgcagaagattgaaccatggcataaacccagttggggcctcacaaaggaggttaaagccttggtttttcacatacaaatacaaccatatcttaaatgcttatattagggccagccatgccaacaactatcagagaacaacagcggaagataaaataatacaagtgcccaattaccatgccacaagcagtcgactgggaacaagacctagaacggaattacactacgatcatcttgttaggtatgcaagcgcactgacaagggtttctcttcaagcactatgctatatatatatatatatatatatatatatatatatatatatatatatatatatatatatatagtaacattgagtacaaaagtactcagcaattcaccacacaaaatgcaacaatgtacaagataatacaaggagtggctatggttattttgcataaagctaagttcacaaatatcatttcacaaacctaaaacttagcattgactactcattcagtttcacatgggttataaggaaacacaacgtcgtcttcttgcagttaccacttgctaactgatgtgtttgacattgtgcttctatttcgacatatagatgaccttttgttgtcttctccagggtgatatatgtggtcattacattacttatcagattagttaggttcagtttaatggtaacatgtcgtgtttatgtatctctttagtactccctccgtttcgaaatataagaagttttagggttggacacagttattaagaaagtaggtagaagtgagtggtggagggttgtgattggatgagtaatggaggtaggtggaaaaaatgaatggttgagggttgtgattggttgggaagagaatgttggtagagaagttgctatattttggaacgaattctgagggctaaaagttgttatattttgggacggatggagtaatattaatctcctttttcttaatattgaaggattactagccaagtttgcgcctttgcggtgctacttaacattgatgcaacacagttgatttgatcctgttccgctagtggcagacggtagtttaaccattcggtgcgtgtgtttaattgctgaggtgtacagatgtataatataccaaaactattttttcccatctaagttttttctactttcaaatgtgtactaaagcaaacttgcatacaacattctgtgcatacgtgttaatggtaattagtactcagcacgtgtcttcaacatgttatagcaatcatgcttaattccacgtttaatttgtaattttttggagccagtttgcgcagttatgtttattctttgttcattggcatcatagaccagcgcaacgcaggtccaaagattaatgagatgcggacgtgtcagtcagtttgatcctgcaactgacaagatatgtaaacagcagatcaaaacagccgatcggctgacaagccgatggagtagttccagccagtagccaataatagccgatgtcgatactagccgatagcgatagggtttaagcaatcggctatatgtccaatgtagataacgatataaaggcaatcagctgatgatgatgcaataaaataacaatataatctagtataaaccaatcgactagcaatgatatgataaataagcatcgatccgaaggttaaagcacacatcggctggaggtccgatgtcatgaaatccacaagattagattaaacagttaaacctttgttgtcatcggcgaaatccagcttatatgtatgtgcaatccttatgagccaatacaacgtcctgataactcaccggctgaaaccccgatgaaacccttattggcaatcaagaagcaggctagagattatggttctaagaacgacttagtagatcaaacttaactgatgcagcactaagtatgaaaagaaacataatatctagacaatcaagctgttgactgatttttagggtggtagatgtctgagctaatctaatctagcaacgcgatttagtcgatatcggtagaaaccctaaaacgagaagcagccgatagagctaaattgatatgctaggactagattaatagagacatatgataaataggtaggcaaatatatcatccaaaccagagcaatccaagaggtcgaatgtactgatgcagctttgaatgacgctgatgtagatgagacaattgcctgggccgacggaacattggacttatcccttcgccggagatcgaagacgatgcagccccgcgtcgggtgccaagttccacagaaacgtaaaaaacaaaagtagaagtaaaaagggtggcgatgcgccgaattgtattgatcgtagattgatagattacaatgaccccgggtatacatatttatacctatagggagatactagtccttgtcggacaagaaagaaactaaaaaggaaaagataaagtccttatcagacactaaacatactttcctaaagataaaaggaaactaacaaactatacctaattaatagataactgtcatgtcgtatccttcttgaactcgaactcttctagataagcttcctttgattgatccgactccaccaagaacacgacatcgtggcgacttgactcccatcggctgattctagaactttgaagccgatactgactctaaaccgatggtaactttgggcttaccaaacataggtgatatatagctcgaagcattatcttttttgataaaaccgtttacacatgtgttttttttaagatattggctacttaagataatcttaaattttaccgataaagtatgtctctagggtctttgatgaaactgtttacacgcgtgtttgtttgagtgaagacattgctattcaaataatcgccagttctatcgacatcgtgcaatcaacctctggctccacgctttatagtctactccctccattctaaaaataatcacttatccaatttcgttgattctttttggataaagggagcaggactcaggtccattctaaaaagagtcacttatccaatttcgttgattctttttggatgaagggagcagtacttaggctgagttcttttgttcactttctcaactcaactctctcattttctgtacgcacgccttttaaactgttaaatggtactgtcggagaatgaactcctccaccagggaactgtgaggcccccctttgtgagttcggccgggggcagcgggtgagattcaagtgagattcgagggcttggtgagcggagctgcgtgatcttgagggggttaggcccctccaagacgatgagacaaaaaagatttatataggtttgggccgctatgaagcgtaataccctattcctgtgcatgattgattgaatatagaacaccagtgcttggggttgcgagacccaagcgccagttcgctcggaagtcccccctctccaccactaggcctagacctccttttatacctcaaggggttaccacatgggcctaacaacctaacctaactccggtggagaagtattataatttttgcattaaatgcatgtcttgtcttttgacttgggaagccaagcacacgtcgtcttgatgatagggcctgtcaaatcttgccgcctgacacggggggtgcccctgtcagtcaccatttaatgggtgaagacttctgggctcctattacactgggaaacgggagccttgctttgaccagagcgggaggatcgactccggctgggataagaggatgagaacctctcaccatcattacattatttgatgggatatgtcgggctgcacgtcgcctgacacacgcgatggtgcgcctgacatcttgggtcccatcagtcattcgaccggtcacagacctgttgagtgcactgcacaccgcattaaatgcggcgtggcgcgaccgctcgggacgccataaatgcaggtaggtgggcacctggaagcggacacctaacccaccgtacgtggtgacctagagagggggtcgggggagcccgacccctagtcacgggagggggcggccaccgcccgacctcgggcccgatcccccctcgggagggggggggagggagccacgtggcgcctggggcggccttctccctctagtctcggccagggagtggtcgccgccctacctcgggcccgacccccctcgggggagggccacgtggcattggagggcagcctcctccatccagtctctgggaaggagtggccgccgccctacctcgggcctgactcccctcgggggagggccacgtggcatcggggggcagcctcctccgactagtctttggggaaggagtggccgccaccccacctcgggcctgactcccctcgggggagggccacgtggcatcgggggcagcctcctccctctaaacctaatactcccgggcccatatcaccgacaggtacgtttttttaaaaatttttctataggacaattgtttttaaaaaacatattaattcattttaaaaaattagttaaaacttatacatcgtttgtatgccctcctctcggctcctcccaaacaaagggcccgtttggggagattaagattatgagaagcagctggttggtagccagtatttgaaaatctgaaaaagctgggcttttcaacttccgacttctaatttattttctggattctataaatacaacctctcaaaatttaaaccaaaaagctgtaccgtctcgaaagcttctaattatgaagaaactaaagcagcaagctcccaaacagacccgatcctcactcgagtcgagtctcggtggggaggcccagaagggtcaagaggtcaaacagccaccggttcgcccaaaaccacgtacctccccgtaggccccaccctccatagaccgcgaaccgcaccgagcacatcccatccgccggtctccatcgccctaccatcccagccggtgggcgtcccctcccgcttccgctccgcctagcccaaagctgcgcagcaccctgaacggcaccacaccacggaacccctcaatttccacgacgcttcctaatcctccctcctcatcaaagccgtcacctcgctcgcgtcggcggcctcgactcccctcccccaaatcggttcccctccaaaaaaaccaaaccctcaaaaccctcgcctccgctctctcgcgcacactcgtgctccctcctccccccatccatggcttcctcccccgcctccgccgcctccgaggaggaggccgtcaaggtgaggtttccgccgctggcgtcgtggggggtgtaggggatctcccggtttgggcgtttttgttggtggagttttggggggactgattcggggggtagttatttggggtgcaggcggcgaaggtgctgatggtcggcgccggaggcataggatgcgagctgctcaagacgctcgcgctctccggattccgcgatattcacatcgtaagttttttttttttttggcttgctacgtgtttgcttcatccccttactcgcggttaaatttgagctgttcctagggttttagccgtgtttcgtgaattgagctctggtatcatctaggtagatgcacgtggattgctgggtgtctccagttaggtagttgcgggatctgtgatagggattggaggatagcgttgaccccagctgacaagtgggcactgtgtagagtatgcgtgggttatccggtgtctatctggagttttttacttagtgctgatgtttcagtatttcttagtttttttgtgaatcagtagctttgtgtattgtctattgtttcaccaattagaaccatgaataaacaatccgtcaggaactttagtattctttgcaaccatgcttggcagggattgttttgtgtaggtcattcttgttagaattcgtcataaaagttagtcgatatagcggaacgacgactaaccttcctgatcacttcagtcattgatcgcccaagacacgccagatgacgacacaggaacacacgatatttgttaacgaggttcagccgaagcctacatccccgaggctctgattatgggcgctcctccccaaccaatatagctcctagccgctacgagtccatggtcacgccgccatcatctccctgcgtgtctacgctacattgtagtcgccatggttacattgtggtgcgcccctctctatttaagagagatgccgggttacagagttcgactctaactccaccccctaacacctattacaactacaagtccaactgtaaccaaatagaactagtatattcgacacctattctaacagaattgttgctaggttcttactcttagatgaactgttatgctgctgcccttgtttcgttcactgctgatatgaaagcctccattcacatgacttcttttgaggttgatgtattgcacttggaccagtttggaaatagacacggtgtattctttgttcaggtatccataactaaatgaaatggtatttgaggcacctaagtttgttatccacacaatgccgacttggctgctattgatttctgatgattttcttttttggactgacgtttgtagttatgtttacaaagaaggaaataaaaccttttctaggaccacatgtcagtatggtactgggagataaattaaatcctcgtctattattttcatttcttttcatattttatctgcttttcgtttttttcttcactgatccgtttcttgcttctgacatactagtttacattacattgtcaaagggtcattttcccttggtgttgatggagctaatgaaaaaaatatcttgatttcctctcaaagtgttgtacacaaggaatttgatctttttctctacagattgacttggacacaattgaggtgagcaatctgaacaggcagtttttatttcggcagagtcatgttggacagtcaaaagcccatgtaagttacatttctatatgttgatatgattaacatagttgtatatgagctttctattatgtatgtatttgttgtattcaccttattattgctgctgcttattctgtttttgtcattgatcttgtcaggttgctcgtgatgctgttctgaaatttaggccaaatatcaatataacatcatatcatgcaaatgtaaaggacgctcaatttaatgttgagttcttcaagcaatttaatgtagtcctgaatggccttgataatttggacgctaggcgtcatgttaatcgcctttgccttgctgctgaagttcctttggtggaaagtgggacaactgggtttttgggacaggtgagttaagaaagtaccactgctctggtccccgtaactcttctgcatgtatgaacggatatataatacactctggcttatcttcttcgtaatctgtatggttaataagatttaccagacatacggccttctagttgagtatgttttgtgcacttaccattgttcactgtgatcatgtgggtccagagggaaagtgtggttgttacttaatcaggccgttttagtgcaaattatctaatgttgatcatagaacaggttttctaccttctccacaaagttcctaaaataatatggtcatttagacattatccagccttatttacaatctaactctttatacagctcaaatcaactcctggtggtagcttggccaatatttggtgcatgttcatataagctgcacaccttttaggtagttacgtacattgcatacagacattacatacttttgaagtgcacatgaatacatgatgtatatcatttgttggcctgtgatgcatgggactctggtaggcaaagctgaagagttcttttgtgtaccttgatgtattgtgtttattatcttgtgcatgatgggttttttgtggtctagaatctagattctgggcttaacaatagtgtcatttaaatcatcttctttatttttttatcacgtatatgtcaacaactaactgaaagaagctaccagtgttcactaaattaactaatggatgaatcgacctcggtcaaattattctgtttattattatattaggccgcaggtggtagaatccctgtctcacgagcaaaacagccaagtaagctaagtctatattttcaagttaattctcttctaaaattatttccattccatattttgcaggttactgttcatgtcaaaggtaaaacagaatgttatgaatgtcaaccaaagcctgtccctaagtcataccctgtctgcacaattacaagcactccatctaaggtttccttttgtcccactttcctcctaattatatccctctactgtgaaaatattagtttggaatgcccttagtcaaagtgcaaacctataaaaatctgaccacttgtgggcatattattagaacttaccacatagggatatttttttatttgtattaataatacggtatttcgtcacatctttttgtattcttttactaatgtatagtctatacagttacaataaactgatgttttggagtatgcgaacaaacttcataaaaaacagctatcagtatctttggattttcagattgggcttacagcaacaaaatgtgcaaatctgtccaaaatgtacctctgtaacattataattttaccttattttataaatataatggagtctattagtcaaagtagttttgaaggatccccccagtgtccaaaggccacctatttgcgactggactggaggaggtaaatagactaagtagttgtcaaggtgtgcattggaaactgtgtcaatatccaaaatggcaggtcacgttgacaaattaataaagaaagaagatgctatctctcctatgctctccatatcttcagttctcccatccaaatctatggacatctcactgttaaaagtgttctaatccatacataacttgaaaatcctcaatatgcagaaggcattcttttaacaagcacacactccgctttatggcattttttgtaattaaaaatctgaacttgacttcttgtgggaatactctgtgaacttgaccatttggaacaagcactgtgctgctctgatcagtttttagtgttagaattcattactgactttttcttttcacagtttgttcactgcattgtttgggcaaaggagttgctttttgcaaaaatgtttggggataaaaaccaggacaatgatcttaatgtccgttcaaatgaaagcggcacttcgaaatcagatgtatttgaaagaaatgcagatgaagatcttgatcaatatgctaggagaatttatgatcatgtctttggttacaacatcgaagtggccttagaaaatgaggaaacttggaagaatcgaagaaggccgaatccaatatacatccgtgatacattacctgaagaagctattcggcaaaatggtagttcacgggacatcaataatgagcaggaagaaccatctgctatggtctctttgggtcttaggaacccacaagaaatttggagccttgctgataattcaagggtatttttggaggcattaaaactattttttgaaaaaagggagaaggttgtattttattcggatctaggttatgtaacctttaaagttacttccatctgagatattttgctcttctggttttcaggaaatagggaatttagtatttgacaaggatgatcagttggctgttgagtttgttactactgcagctaatatcagagcctcctcttttggaatacctctgcatagcctttttgaagctaaaggtgttgctggaaacatagttcatgctgtggcaacaacaaatgctataatagctggtttgattgttattgaagcaataaaagtcctccatggtgattacaaaaaatataggtgactaggctctttgtttgtttcatgtcattgttgtagcatgtacttcttttttttcctaaagatagtaaacttaagctaaaatacctgctctctggtcttctggatatggtaatgtccagagagttctaaggtgctgccaattttctggaatttaatggcacttcattggctaacaattttacagaatgacatattgtcttgaacacccttcaaggaagatgcttttgatgcctatcgagccatttgagcctaataaatcatgttatgtctgctcagaggtatttttgcactttcttgggctatgatattcgtatgtttgttcgctttctttcaagtctgacccaaaactgctactgaatgcatcagacccctcttcttctggaggttaacacaaagacaacaaagctgagggaggtcatcgagaagattataaaaagcaaacttgggatgaacctcccattggtaatgattggctccactcttgtttttgaggatggtgagggcttagaggaagatgaggctgcaaattatgctctaaaccttgaaaaggtactaaccttcccccttcaaagcagtgaaattatatcctccatggaatttctttctttctaagctatggcccttgcagttgcaacattgttaaaatactattcattttttgccaactgagctttgtctggttattacaggtcttggctgaacttccagctccagttgttaatgacacaaagcttactgttgaggattttcagcaggaattgtcatgcagcattaacattaaacacaggtaacctatgaaccatgtatgctgatctgtttgcatatgggaggtctttctaaatgatacttatctatatgtttttcacatatatttcaatgaagagaaatcctttgccgtccaactatcttctcaaaaggttgggatcttgccagatgtaaactaaaaacagacaattttgcacaagtgaaaatgagctgctactaatttgctatacatggaccagtggtttttcacctttttcactaaagttatcatttgcagagtattatgatgtcacaacttttagtttcataaaatgtcctctacgtataactttgttctaacatgtaaggttgtttggctcattccattacatggatatacagtagcttataatgctgtgctatgtagatttggaagctatatgttatgatagtgtcgtagtgtacacatacagttgcctactctttcaagggggtagactgatttttcagtgattattacagggacgagtttgatgaagaaaaagagcctgatggaatggttctatctggatggtctgctccagtggagaagcaagttacgagtaatgggggaaaccagtcggttgcttcttcatctggtgcagattatgctgacggtattgttgaggacatatccactaaacctggaatgaagcgcaagctggatgaggttttagagttgaaggagaattgcgatgcatccagtagtgctcaagttgtcgaagatgacgatgacgacgatcttgttatgcttgatgagaacccaaagttagccaagaaaaagagattgcaatagcaacccctacggtatctgttccagggataacagcggttgacttccgctattatggctaacacattgttccaacgtaacatcttttgtaacttaatgatgtttagggctgataacactgaggtatcagtaagcgtactcagggtcatttttttgctttagatacggtactttaggaatgtaatttgtagcgtttaggcacaggagtgactaatgccctgctgacagtcagctgtaaggctgcacctgtgtttgtctagactggagcaatggtgatgttcttgtctactttctcgtttctgctatgcggtgatatatcttctgattgttttcatggttccgttgccctgatacgaggaatatattggtggatttagacttctatatagtgctcaaagcctcaaacgtcacaagaaagcagttcccacctgtgctacgtgttataagcaacagcaattttctcctgctgagttttctcccgttaagagatgcatatcgttcattaggtcttgagagatgcagatccggcccagttcttttccgcttaatgcatcaattgactctggtgtaagaactttatatataaataaatactgttacctcttcatcccttgtctatcactaacatccatatgattttagatgcatatgggttcaggtaaaaatctatttaaaatccaaaatatcttataatgtgaaaaacatcttataatgcggaatagaggggtataatagttaatccatgtattacactcgaataggtacatctcctcagccatccatcatagaacacaattaaagttgattagtaggataagcatctatattaggttcaagtagaggttgatcctaagatgaattcctttcagatgaaatgtggatgaaatctgagtgatgatctccttatatttgtaaggtaaaattaaatatcactcctatgttatgagtggtagtaatgttgatggataaagtttatttttcagaaattgtatttttggaagtgttgtgcaaaggcaactgatccacagataagctgaaagtagacctatggagtacttgagacaaacgaagatgaaatcacaaacacaagggaacacagtagggctcaattttttaataggaattgatcaaacctgagtataaggaaactagaattattttcaactagaaatcgaccaaacctgagtataaggaaactaaaaccgaattgcgataaaaaacagatatatcaaaaattgaattgaatctctacgaagtatactagtattccaacatctctcgttttctatcttccattcagcaatgcgatcatcatatcacagttgaattgaatcaatattccaagaacactaccccatccacaagaggaaacctacaactctgacgccgcaattccccaattcagggcaaaacactcgtctcacgaattcgaaacaacaaatcaatcaatcaatcaacaaaaaaatcaatgcaggaaaatccgcgctagtttccggccaccggccgtcctcgcgaggccgtcgacgagcgcggcgcccctcaaatggcagacgagggcgcagaaggcgatcccgagcagcagcgccgcgagccgccggagcccgccgcctcgcctcctcctccctcctcctctcctccacaccgccgcccacacgccgagcgcctcgccgaggcccgacgcgttccagtagtcggcgaggacggccagcttgtcgccgagcgccagggagagcgccagcgccgcgagctcttccgccggtgttgccctcctcctcccccttccccccatcccgaaccatcccccaccgccgccgccgccgccgaggaagaggacggtgagggggcgcggccgcgggaggaggcggcggagggaggacgagacgaggcggcgcagcggcggcggcgggaacgcgacgggcttgggcttgggcttcgatcggcggccgcggccgcgctgggcggcggcgcgcggggtgaagctaacggccgtggaggcggcgagggggaggtgcggcggcggcgtcggcgtcggcggcagcatcatgtcgttgcgtgcgaattgggtggagcggatcgagcgggagggggaggaggaaggcgttcgcgtgctcctctcccccgaccaatttggatttggaggacacgaattgcgaaatcgacgtgtccactgctgctactgtcgcgctctcctatgggtgaaggttcattctctgctcagaaattcatggctcgctttttaaactgctaaacggtaagttatgtgagaaaattttatataaagaagtttctctaaaatattagataaagggtgtagctatatttatggcgctatattttttatcaaaaaatagtcggcatgtatttacattgtaagtccctaaattacatatgtaattttagtgtatttacaatgtaagtctcaaaattacatatgtaagtactaaaattacatatgtaaattcgaaaattacatactaattacaattagtatgtaaatttgtaaatgaggtgtaactactgtgtaagtggctgaaaaaaaatcgactgtagcatatggcgccatatttctagcaactccgtagataaatatattttcaagtttgtaataattaaaactcaattcatcatacgttattaacaactcgttttgcgtaaaacatttaatcttcatcttcatctacattagtttcaaacaccagcattgtatgaaattctacaatcttgcttgaagtacaaaatcaaataatcatgaaattgattggaatttggaagagtgtatctctttgcactttgaaagcacaagtttataaccaatgccctatggtgcattagatggcaaatgcgcgatgttcaggtaatagaggttgagtccctaaaaaaagttgtatcaagttacatggtttgtttgactgtctattttggtttacaagcagcaacgaataaccaatcaaaactcggggcaagaaaacagctttctttggtttacttttccttactgaaaatgctattacaacaaatgactgaatgaacgtaagcaattgagcatcactcatatcatgtctgctcagtcgattgagggggtccgacatgctctttggcctttatgcatcgcgcatctctttctccctgcaattggctgattcttacaaggagaaccatccgaagctcgagcaccacagattgatggccatcctgagcttccggaaaacggtacagaggaagcatcggtgacctttattccttcatgcgcatcgcatctttctcttcctgccattggtattgtttcacggcatctgttgtccgtcaacgcttcacagatagctgcgacattgcctgtcactcttttctgacgtccctggcctttggatgacagtgtgctggtaggattctgcaatttgatcagctcaaaccacattcttccggaaggctgattctcttgggactgatatttaccatgagaaatctcctccccactgagcttgtcaactgtcatgcttttgaccttttcttcattctggagcaaatcaatgactcgagatgaaacaaactcttctgctttgcaaccattatgcagctgacattttttacttcctgaaattactttgttggtgcaggcagagttgtcactctttttggcttcacagatatcaatgacctcagaggtttcctgttttccatcttctataggagcttctccagtttttatttctttcgcttcaaagctataccatggtcttgatgattttttcactgttgctggcaaaaatttggagaggagttcactggtttgctgtgcttgatctgactcgctttcattttcagttagtggagatatggattcaacaactggaatctcaacttggcaagaatagctacaagaggagcctttaggattgactgtgattcttcctagtcttctacctttgtgtaattcacacctcttccttccttgtactggatggtcaagacaagaggagccatcttccagcatcactccacaaacatcgttagaatcttgttctggcatagttcttcgttttataacattgactcttttgactttgtatccttcagaacttcgacgtgcttgtttgccataactgttaccttcagatgtatttttccagcgaatgccaatttccttgtcaacattgtcaccagagttaactagctgaggtctgaagccaacaaatgttcgaattcttgggagcatatttttcataatgccagatgagacatcaacagacccatttctgcttatctttatacctgctttctctctgaacacttcctgtttgaagtgccgtactctgctaagcagagatgatctattgttgactgccccttgttctaacttgataagtatttcttcacggcgaagaccaccgttctgaagcttgttccatgcgtaatcaaacactctaagcagccgagcctcagtcttctcagcttcttgtttgttacccatctgtttatttgcacattaaagacacattagaaaagaaaaacgaaatccagtgctaattgctaaaagtggaattatgccataagattcataacttttttagggcacataatattcatagttgaccccgttgcttttgcaaaagctactaaagatatagtacttatacactccatccatcatagatactctgatagaccaaagatcttaactagttattaaaagtgataagatgaatctgagtgtccaaacatttgtcatgagcaaagcgtaacaaatcggatagctgttcgtgtagactacatgatagacaatgctggtgctgaagacaaaatgcatttttcagttcttcaaacttcagacttgggcatggtataatctcaaaatttgtggcaattgaccatcaacttctatttatttcactcaacaatttattcggacacgaagccattattgatctccacatgaacggtacagttcaactgttcaaggatccatttcttatctgaagaaacaaaaaacgagcatggaaagcagttttgcacttaccagagcacatcggaacaccaaggagtagcctctgacgaaaacttccctgaacaacccattccccgtcgcccgcgtattcgtctccgcttcgccggcggacggcggtgggttcccggcgtccaagtgcgatcccgtccggccgtactgctggagcctcgccctgacgctgtcggcctgcccgaggtacacgacgacgacgccaccaccaccggatccattccaccgccgagccgccctgataccctcgtcggaggccctcgcgacgcccagctcgtagaggccagggaagttctccggcaggttgagcaccctgtacctctggatcccttccttgccggcggcgtggtcctcccagtccgacggcccgacaagaacctgcaaccaggttggggaattcgatcgaggagcaaaaatcagatccaaatcaattcaagaactggcaacgaaatcggaggcggtagatggcaacccggggagttcaactcgactccaccggatcagatctcgtcagctctgcgccggtggcgggttggcaaggggcacctaaccttccatggggagaagagggagtcgtgcttggtgcgtgggtagtcctcccgcttcagcctcgctgggacggcggcggaggccgcaggcatcgtcgatccggtccgcctgtggctgcggagtggtgcgctctcagtctcagcgccgccggagccgccggcgccgctgcggccgcatcggcgccgggagcgggggctcgtcgctttttgaaaatctcgggttctcttttgggctgggtttgggccgtgagcccgcggctcgatccgacccgggcctgggcgctgtttggttggggttggggaaacagcttttgccgtgtgcgctcggccgttggattgacgatccgatggtctggatgagggtttacctaaccgtatggttattgtgattatcacatgtggtaacttttcagttttggaaaccacgatatacctcgtgataaccgcgcggtaatcgccaaactgcggggtgacggtaaccccacctcaaacggtttggtaaatcctagtccagatcaagagtggtggaaaaacaaagggggtttcatttgtcaggtactctaactgtccaagccattcgagctatagtgtgactgtgtacaactcgtgcggtaataattgtggtagattttcactatatattattagagaaaaatatgtagtgaaaacttaaaacttttgtaggatgtaaaaatatatgtatgagatttgtctacgtcgatatgaataaaagttttactcataatgacataaataatccgagacatttatttttctatgctatgatagtttttagtttttttccactataatgtggttttcattacatattttcctcgcaggggaattaaagggggcacattctcttcttttgcctcagattgagggagaaacatgttgagaaaaaattggtgacatgaattccccatgtccctcatatagcactttgaagtttgaaatgatagtttgtctctccctccccattttgcatggaagacatgcatgatgtagcatgttttctgtaaccagcgacggacatgaatttcctagttccgaacttacacatatatatatatagcttgtttggttcgtggccaatctcaatcaattaaaaaaattgtttatttctactagtagaatctgggtgagtggacgatttacattttatttactcttcgatattatcttccactatgatttaacgtcaatcattgatggtgatgtacgcgaaattcgatcggcacaataatcggtcgctgatttaagatattttaatttgtttccttggtgttttcaggagaagacaataactgttttgcaacccgttgaggcaacaatggttatgcatattttgtcaaacatatatggatatttaacaatatgtgctatctatgcctttaagttggtgttctaaatagttttcttgttgtctatgctttcaagttacgattttgtaattcgcagttgttcgacctgcaaggttgtaacatctgtaataattgttgtagcttttgtgaaataaagatagaaatgaatattgttgtttaaaaataatatagccatgatggggaggcctggcgatgagtctaggcaatcaatgtgttcaggtcttaggtccaagccatgtccacaacaggattttctctctttaccttgggtcctatagagacttttattgctttacttgaattggtaagcatcttcagcaatagctcctattttagagtccctaaaggttaaatgggggctgccctcatttcctcaggactctaagaatggttctaactccagcaacaacgtctatttcttagcccctatttctttttctcctctatttcatcttataatccatattttatgtttagtttaatattacaataatgtaaatattaatatttccaacgcatagaatttaatcaaatttaaattaataatttcaaacaacacaattcaattgaaatttgaatttttttttctaatatcacactgatatgtgcatatacgtacactagtgtgagtgcatggatgactcactagaatgctcgattagtgcatctgttgcggctagtagcagtagcagttcatccatcctacactcagtatccaatgatatacatgcatatatggatgcatataatcatatatgagctggacaatattaataagatatattatatccagtgcatacacaaaactgcatgcatatatgcaaggagatatagtagtagctccttctagatcagcatcaaatctcagttggccactggcggcagatggctgttcacacttaacaggaaccaaaccacgtctcatcgatatgtggaaaaatccatgcatacgtgcatccatgcaggtgaccaatactatagcagggcgatggccggattagagcagaaacacccgcaacaagacagtcggcagcgtgcaagcaatcgcacgggaaggagcacgcgtcgtggaagcattcccccgcgccaaagaaaactggataggggctggggatagagcccccaggcctaggggctgtaggagggaatttgggagccttcctactttagggccttaagtaggggccctgttgtactttatttttttagtctcaacctctcaaagttgtttaaggactgtatttaggggttttactgaagatgttctaagcattcgtggaaattgtactgcgaggaattttttttggttcattcctattcttaaccttgccattttttttttggcaacggtaagagttggtcattgcttttttttttggcaaaaaatagttagcctttcgcttagtttgctaccaaagtaagcaattagttgagcagtgtcaattttctttggctacaaaccaaataaatgactaatatttttgcactgtcaaatttactttagctagattgaatttggctacaaacttaaacagacccgagaactcaaactttcaaggaatttttgcactgcatgatgtatcaattttcccgtcattcgatttttatatacaacctaattctaaagcacaatataaaatctacagctgtacaatcgctgataccatgcaaaccgtgtcacatcagcatttcgtcaaccaggcagcaacagcaaagcgccatgaagctgcatgatcacgtaagaaaaatgtcatgaggataaaaattctacacgaaattcatagccccaagaaaacgaatttctagcatcttacaatcctgcgatgaatccacatttgggctgaggatgctccggcggcgcgggctcgtcgtacgccgccgacggcggcgccattggccctaaaaaattgcaaaccacaaaattaaggcgatcgattgaacgaaattttgccaaagcacacgctaattaatcagccaaatggcattcaaaaaaaagaaggcattcaaaaaaaaattaatcagccaaatcctctttttgccaaaggcggaatgcaatttaatagacgtttgccgaaacagcatatatctgagatttgtagaattactaattaattacctggtgctccatcgtgatgcaagctgctcgcccggtgctgcatatcgccgtttgctttgcgacgaagcgacggatcaaacgaaacgagagagagagagagagaacacaaacacaacacaacagagatgctttctttctgaacgaagagagaatctatttgttcagagcaaggaggcccaagaaaaggttaatcatgctgtgtgctgttgcgatgaacaggccacgcaggagagaacacagctggtttaaggttaggaagcctgcacaacgacaacgtagaggcaggcaggcagggtatccatctcttttcccccccggccgttaatgttagtattattgtgagccattgtttgcccgtctccagctgtatctctctctctctctctctctctctctcaggctcagctttttcttcctttctttctttctttcacctgttggatctaatcttggctttgcgagacaggaggtggtgaagtggcagttcgctttgccttgcgacgtacaggcaggaagcatacaatgcatgcacaaccccaacatagttgggtgcctttgctgtcagtggtgtggtggtggtggcatgcgttgcgtttttcaccgtcaattgtgcgtccccgtgtgcgtccttgcagttgccggtacggatacagccgggttagggcatgttgtcgtacagcagtgttacagtacaatcatgtaatataatctcgaactgcggaattgaatttttgtctctcgagggacactcgttttgtgcatgtcattgaaaaagtcatcaaaaattttaaaaatatttatcaagatagatcaatatatataatatattttcaaaaacatgcaagttaaaattcgactaatacaattcgaaataaaatataataaacttgacaatgaattacgtattctattcataattaaatttgttattgtttttctacctgttaaatttgaatattcatgctttgtgaagtaagatattacttttttttaaaaaaaagtttgatactttttaagtgacatgtaaaaacgacgagacatcctatttaagggatgaatagagttttcccttgtactcaacaattaggtgtgattatattttatcattgtattctcttacaacctacgacttcctctttttcaaagaaaaaacaatcttccaattacagtactggacatatgctatatctaaaattcgtacctagaagttttttttttcatctcttgtttggacaccagctgcctgcaatcacctcattcgaccaatcgaccactgtcatcttgttgtcatcgtgttatgatcgccataatgttctcaagcttgttggtcgaccactccagctgttgtattcacacttagacttcgtgggtccctagatcctacgctgctcactttgctggtggccaaaacgattgttgccagcctcagactatggaaatgcaattgttgtcctccatgatcacctgatttggcatcattgtgtcaccaatcgttagatttggcgcctccaacctttgggcggatttggaatgatcgagcttgttgatgaccgtatacagtactccctccgtttttaaaaatataacactgttaatatatattaaaaatatatatattaacggttttattgttactttgatttatcgttaaatgttatttaagtatgacttattattttatatttgcaaaaatatatataacacagtaatccctccgttgatcattcatcttactttaaaaaaattatgtaattatcatttattttattgttactttctttaagtatgacttatttttttatatttacaaaaatattagaataagagaaataatcaaatatttgttttaaaaaaatcaacgttatcacgcactaaaaatggaggtagtatctctgaccttgccagcagtactcgattagtcctgtttggagccatagtgctagctagcgaggcccttatctaggtctactctatctaccagcaagggccttggggagcgaggctacaccatcgcctttgtccgcataatattctcggccaaaacacaagtcaaccacaaagagacctcttttatatctctcccccatcttatatttttgctaagttatgagctatttttattccgtaaaaaccaagctagtacgggatgtacttggttttctatgagatggagaaaatatgtgttaaatatgcacttagcccattaacccaatctctcataactaatggttcaatatgcatctattttgtagtcaaaattacacatctatacaccgtactagtaaaaaaatgaactagagtgggtttgcaagttaacctacatgctctacttggttcatgctcctttattaaatcataagaatttcatggaaatttcataggatttagttcaactcgtctaaaattcctttaaatttcctccatttcaaaggttttagttcaacacatctatacaccgtactagcatacacgacttaattaactgagaaagatgattctcaaaccgttcatgcatgcgtagagatctattgaacatttgaactagttaacatgcatggaactgggcaaagtcaacaggccatgacaaaaagaacagtagtagctagataattcacaattagcaaaagcgtttttaacatttacagagcaagcaagcatgcagggcagcctaaaccgtgcatcctcgtgtgccagatgctttttattgttctcctcgaattgaattcctccatggggatgatcagatgatggatagctaggtacacgtatcattcgtcgtcgtcttcgtggtcgatctctctcacaacctcctgctgctctcgagcctcgtgtagccgaggatgcagttggcgtaggccacgttcttgagcgccttgccgtgccaccggccgacggcggcgacgccggtgcgcaccgccttgagcaggcagtcggccgtcttgacgacgctcctgacgcccatgggcagcgacaggtagggcgcgttgaagaggtggaactcgagcgacgccgcggcggcgtggtggtggtggcgcggcgacggcggcgaggaggaggaggcgagcatcctggcgacctggcgggcgaagccggcgccgagggagtggccgcagaggcagacgttctccgacccgaacctctcgatggtcgccctgagcgcctggagcgcgccggcgagccgcgccgagccgcggaggctgttgcgcgccagcaggcggagctcgtcctcgacgtcgcgccggatggtcggcccccgcagcagcgtgccgcggaacgcgatcaccgcccgcggcgcctcgccgtcgaccgcggccgccggctggtggtcccgctcgaagatggcgccgaacacggagccgtccctctcgtcgaccagctcgtgcgccagcctgtacctgaacggcttccaccactgctgcgccaccgccgccgcgtccctcctctcctgcctctccagctccagcaggtacaccgcctctatcaagcacgccatcaccatcctcctgtagtcgtcgtccctccacaccgacacgttcacctgcgccgccgccgccattgccatcgcaagctaagctaagctcagctcagctctcacactactcactcgatgacgccctcgatgtcgtagggaaggcgaggcaggggtggcgggaaatatatacgcggagtccggaaggcaagctggatggatcgatcaagccgaattcatttcgctttttactaattaatggcgggaataaagccaccgaatcgggagctaagctaccgacggatcggccgatcttttcacggttcctgcgacttgactggatcgacggatcacaacgatccgaccgatggatggcaacgtgcagcccgtgggtcgtaagctcactctctcacaagttcacaatagtcgcctccagctagccgtctggtttgatggatcgatcggatggtgtacgtcgttcgcgagctttatttaggggagggagcatatattcgccacggctaagcactggaccatggcttatagttcgttcgttcgtctcggtgtagtttaattgccctaaattaacatggctaaggatcgaatctgacagcctcagggtacgtgtgggtgacaggtggggcacgcgtttgcgccttggggattgtgcggggacaggtaggaggagtggggttgcttttgtcaggaggaagggtggttggttggttcgtcgtcctccggttgattagtgccgaagattgggtcgtttactttttctttgttagagcaagtttaatagtatagcctactgctagctttaatttatctatagctaatttaatagcatattcatataatagttgcttactatactattaacatatatagtccatctgtcatatacacattgcgtcttgaagtccgtgctgcagctggctacagattcgtagtctgctgcttttctctcttatcttttatcttattaaaatatgtttatagttagctaatagctcgttattgtacctgctcttatgtttccgttttcttttgggttttgggtggtttcggcgagaggatgggagagaaaaaaattagtgattaggaggtgatttgtggcacgtttaacactaaaccgaggggaatttgttccatctgatgacgttgggggaaggggggttaattcggtcgcgctccgcgtgtgttgattcgttcacacgctggcttgtgggcggtttcttctcgttcgtaatggttagacgcgggagtcaagctgcttatacgggcttggttttcttgttttcttaagaaaaaggggggccttggttttctttggaaaaagttacggggaatatgcatatttcgttcacacgcaagtgcgtggaaacatgacattggctacttcagtccttttccatcacatcaacatgtcatacacacaaattttcagtcacatcatctccaatttcaatcaaaatctaaactttgcgctgaactaaacacatccattgttctaagagaaggagagcgtttgataaatcacatagcaccttcatcaaaaaatagtttcagatttttttttcacatttgaatgtgaacatgctaatcatgtgactgaggctgcgttaacttttaattcttggatgttcaccgacaatttatcctattttaatcttgataaaaatctttatttatctttggatggtggcctcttccgttatttccccctactatttcaaagacgtgtgtacagggtttacatttcaatgaaatattaatgcgaatatggtatcgcaatatgccaataacaaataaggactcatcggttttattttccaaataagttaatacttattatacatagaacatgagaatacacaaatctactttaaaccctagtgtaatgcagagcaagaccatctcaagcccgcatggctacttaactacgagctttaggttagacttacaattttacaatatactatatatgttttaaaatatatggcattgttgaattttagacatgatgtttgactattcaccttattgaaaaaaactatgtaagtatttaccatgacttattttattattaaagctaggtactttacgggaatgctactgggcgagcgatccgctcgctcgcccagggcgatcagttttgcacacccccctccctccctccacatctccaccttgtttccttttttggcaccgcattacttttctattttagtaaatttatacacctaaagtttacacatctaaagtttagagacaaaaaatttataagtcaaaagtttatatatccgattcaaatttgaatttgaattcaaatatatatatatatatatatatagtatttctatacatctaaagtttatacacctaaagtttatagacctaaagtttataagacagtttatatacccgtttcaaatttgaatttaaattcaaatatccgattcaaatttgaatttgaattcaaatatttttcatatatagtatttctatacatctaaagtttatagacctaaagtttatatacccgattcaaatttgaatttgaattatatctgattcaaatttgaatttgaattcaaatattttctatatatagtatttctatacatctaaagtttatacacctaaaatttatagacccaaagtttataagtcaaaagtttacatacctgattcaaatttgtatttgaattcaaattttttatatatagtatttctatacataattttttctaacttttgtttttcaaaaaaatttgtgtggtctactgtagtagaaagagaaggggaggaggaataggggagaggagggaggagtatagggggaggggggccggatccgattgcctgggcgatcgcctggcgatcgatcgcccattaaggccccccggtactttatatataacttataatcaaaccttgtatccaaaagtcactactttacagacaaatagtactatttcataccgggcatagaaaaaccaccattttgtgtttctttatgaagtttttactatctagtctacttaattagcagagcacaggttattttttgtttgtacctgttcagctgctgtcttacggctgtggcacaaccggcaccaatagtgcacacgcatacggcatggccacagccacaaccagcttgccgaacgggacctttgtttgggcttggactggtcctgaatgctcaaaagggcccgagccgcccggttgacccagctattgttgcttacataaacaggccgggttcgggctgctgaagcttgcagagccaagctgggttgagtggttgaggcgttgagccacacactacatgatgttgaactgggccacgtctcacgttagatgacacgaactaattaacaacactagcaggaatctagtaattaatcaaggcaattttatttcctggagcgtgtgtttcatatatatatttccaatgagctccatgttgtttttacatcagaattgttataaccactgctccttaaatattatattacttcacattattagcaccttttgtatccatcaaacagatcggcatattaatcctgaaacccactgggaatgagaatcttgttgggctttggttctagcctacggtcgatctgcagcccttaggtgctatataaacataaagtactaatctataactcattatttttgcattgccagcttgtgatcaccagacggtacactgggcattaaaaactgaaagcatgatcacgaatcatataagtgtgatttggacccatgaaacttcaatagaatacattatcaatcttatgcttatctcttgctagactctgtgtgttcacttcctccttagagtgtcagtggagtggtcctttgtagttggcatcggtttttttttctttcaagaaagatgaaccaaaagttattatgccttcgtacgcaagtggtaaggaagaatctgcctgaaacaaaatctgaaattgttggattggatgtttgggatatcagatttcccctaatgagagggcactgttgtgacattggtgtcaaggtctcaaagttgtctagctactcttgtctatgaaatgcgtattcgatcgatcagcatgatgatgttgatgagatgttcggctaagaagaaaacgagtagaaatgcagtagcatttagggatggtagaaagtaatctctggtagtataggtgtgctagtgcaacaagcttggactaatcaggagcaagtataagtctaggtagctttctaatgctgtaaagataagattaaactaaattaaagtgaaacaaagtgagatgaatgtaaagtggtaacagtactttgatcttcaggtgcaaccgtccaaggagaatatttatcttggcgaggaatatgtctggagaatattgacgatgactgatcgatccaagctgcaatggcttatctgaaactcatccaaaaatggagactcgactactaactcataaaccctgatccgacgaggagtttcgcgtgccttcgaagcagtgtgttttcttgtgctggaaagataagtttaattttttttatgacaatgaagataagattaagttaaagtgatatcaatgtaaagtattaaagttgtaatgcttcctgtttatccccaggtgcatgcaactatataaaaggagaatatttgttttcgtgaggaatatgtgtggagaatattggtgatgcctgatcgagtttgagatggcttatccgcagaacaatggagttcagactcatgcaacactctgttatgccagaagtttgtacgcctcttagagcaagtaaaatgtgttagatgttggatgggtcagaattaggccttctccggtacaccaataccatccaactcaactaagtatgtgaactatgaaatataagtccacttgctatccctcaactttgcgtcgagtttgtttgacatcaatctccaataccagaaaccttcaaccctaaactatataaaaccgtgtaatttgggtcccatagtagtatggatgtctcgtttcgctgacgtgggatcctagtcagcaaaaagaaaataaaaaatatgtgaggcccacatataagtgagaggaaaaatatatgtggggtttacatgctctccttttccccctgctacttgcttgcttcccagacggcgtggtgtggcctcggacgagtcgatggtggccttgtggacgctgtcgcacgggaggcgggggatcacggaacctaaacctgtgcttgtccatgtctttgcagatatggaaaattttgcgtgcctccaatcactgtcggcgtcaccatccccaccccccaaccccccctcctccgatgtgcatggtggatggcaccgccacagagatgcctctcctcctttcccaaccacgacgcgagcaagtgcacggcgtgtggccgtggcgtgggccccacatatatttttttcttttcactaacatgtgggcaccacatattttattattttctttttgctggctacgatgtcactttagcaaactcagacatccatatttctattggatccaaattacacggtttttgtatagttttagggtgaagatttatgatattggagaaaagaaatgttaaacaaactcgacggaaagttgaggtggggggggggggggggctcaagtggacttattcctaggggaccagtgcagttatgtatttgaggccttgttctaaatgtttattgggccaacattattcgcatattatttatgccaagctttcaaaagtatgatttctcaaaaaaaaaaaaacatcaatattgtttagtccatccattctaagctatttacaaggttgatgatagtactacttcctataaacaagttgatcatctattagccttcatccacattattagaaagaacgggtctccaattggaaagaatgaagttcacacattttttttaagaaactgtgcatggataaattattgtttttttttgaaaaccgaagtcagcaaagctggtgttattttaagtaggggagaaaaaagtatttacaagattaccaaaacggtgaaagagaaagagagaggaaacaagaagctactaaacaatgaatacatcctaggccaataatctcacaatatttgtagctccacatatcttccatagcttgatttcatcatgtatcttgtctagaagctgcggcagggatttttcctgatttcggaatactcgtctgttccgctcacaccattttcccatgctactagcatgtaaactttttttttctttggctatgtctttttcaccttgagatgcccttctgatccaccattccaacagcggctcatctatatcacgtctggtcaatttcgttacagttcagtctacttaggattctctcccaaatcatttttcataagaatccgaaacattctggagttctttctgaataaaaggaaattccagtcttccaaacttggtgagccggtgagcaatgttgtcaccttagggagtatttagtttacgttaaaattgaaagtttggttgaaattggaatgatgtgacagaaaaattggaaatttatatgtgtatgaaagttttgatgtgatggaaaaattggaagtttgaagaaaaaatttgcaactaaacacggccttatatgaactagtgcctgcagaaacttcaatacaggggatgtgttcaccaaatcaataccaactcaatgcatatggtacgtccgtacatgaatgtactagactcctgcaggtggcattgcaataaatcaaagcaaacgaatctctttaattaatatgccaccaatactttcctttctgttctttaatttgcttctgttggtgttggatgggccaccaatccaccatacatgtgatatctggcaccctaaaaaagatgaagagaagttgtaaagacgtacgagagatggatttgagatcagttgctgctaaatcaagcaaggctggttagttataaattatgcaggcattgcactgttatcatgcaaaaagtcccctgttcaaattaggcaaatattttggagatgccatttcgaccatgtaaagtatgtgatcagattacacatatggttggataaatagttcactaatgttcaatttttatacccacgaatattacgtatatggtgtgttttcaatagaaatttagtgaggttgacctccatctcattgagaccgtgttaggaaacacatttgcaggtgtgtgtggtgcgcatgtgcgtcttccttccataaaaatcgttaagaaaattctgacttatcataagctagcactggtcagccatcatatgatcccatttcaggtttccccctcccctgagaaaacacaaatcacaccttttgagtttttgaccagtgaccaatccatcattccaaatttctccagctaagctatgacgcattgtccccaattaatacacacactgttggccgcctgacaaccgaaaatggccaacaacaatttgctaccaacagtggcaacagaataatttgggcatatgcattcagcgttcatgcaggaacaggggcgtgaggtgacacgaaagaaagctcagctagcaaagcaaccaattgcatggcaatgctcgctgtctgcagatgagccgcatcatgggaggcatggccagggccaggccgggaatagtgttgttttcagctagctgcagctttgagctggctatcactaaccacagctcgagagtgtggctgcactgcaccaggatttacaaaaccaaccgatttttgtaaaaccgctatgtcttggtttatagaaacatatcggttttagctggttttcatatgacattgaaagaaagtcttcggtttttgttggtttttgataaaccggtgaggatcggtttttatttctaaaacgaaaaggcaaaaccctgcactgctctatggggggctagcttgacgcatcatggcccattacaccaccaccttgttgtagatcttggaccatggcacaagggaagaagctgggggaggaggaaatgtaggggatcatgtcccattttgcaaggacagatgggggatcatggatatcttttttccaggtctagactattttgattggacagtaaattctgcctttttctgtttggagaagatgaaataatgagttgactaatgcatcacgaagcaccgtcattggaatatctaccaacaaaaagtttgtcacaagtagtttgcagctgataaggaatagtaatactttaataattcatacaaatgaaaaaaaacatgttagaaattcttataaaaacatggatctcttagctgtaaaggctttgatttggtgggtactctgtacatcagcagttaaaatgaaaatgagaatgagttcttttttagcatagcaccgaagatgactgagattgtcaagccccacttgtaatgaaaagagtaaattgcactcacggtacatcaactttgtaagtgggtgcaatttagtgcaagaacttgagaaatgagcgatctagtgcaataacttgacatgtaggtgcaatttagtataaaaactttataagtgatcacataaatacaacaactagcataaggtaatatccgtaggattactatgtaatggcataatgatatcgtgcgaccaggaaaaaaggtattactttactgaactgaccccgggcgtgttaatatcagttgaaacacgctttggtccctcatccgtgaatcaatccctagcgggtcttgtctcgcgtgattcagtttgagcaacagatcctgacgtaatacatcttcgaaaaaaaattcacctaccatacttagccaagttgatgcaccaaaatactaaattatcaagttcctgtactagaacgcaccaatttatcaagttgttgcacttgactgttcaattctcaagttattgcactatatcgcatccacctatcaagttgttgtaccttgggtgtaatttactctaatgaaaatatagtaaaatatggatattttggaggctataaatcctataagaaattttggcaagggacgatagatatatacctctaaagtctgaaaaaaaaacagtcgactgtaagagcaagtttaatagtatagcccactaatagctccaattcatctatagctaatttaatagctaattcatataatagttgcttactatactattaatatatggtcccacctgtcatacacacattgtgtcttggagtccgcgctgcagctggctacagatatgtagtacgctgcttttctctctcatcttttatcttattaaaatatgtttacagctggctgatagcctgctattgtacctgctctaacacccaactcgtttggagtccgtagtggttcttgtgttggtccacgtggcccagttacggtgtaatggtggtggtttaatatcaccttgaaagtttaagtagtttagggttcctaccaatttttcaaaaacataaacacaccattgttccaagcaaggatgacctcggaacaaaagattattgggttacacaaactgtatcgaaattcttatgaaaatgggctggcgctttggagaagttttaattgagttcatgttttttcataccatggcgagtaaactaccccaaaattccttagaaaaaaaattgtgttgatgagttgtttggtttgttgcctatgttaaccataccaaaggaaacaaaaatggcaatatcaatccccatctagttgttggcctatcagttgtgaccaaaattaaaattttgaaagacaattttagagttaattttgggtttttttattgtggtctagattatcaatccttgacttttacaatgctaatagcatagatataaaagtttattcgtaaattatttttagtttgcttcgtttattttttttcacggcttatcagcttcagctcaaattaatgtccaaagtgtaaatttatcattaccaagaatcatggtcatctttacgacggtctcaatccgaacaagctctagttaattgtgtaggtcttttgcccgcatgagcgcgggtttacggccggtggtaggaaaggcgatggatggtgtcgttgaacatcgaagaacggggagacgacaaaccagagaaaaagacagtgatgaacagcggccgtttttttatatgtgcatgcgtgattgctttgagtcctgagacgagtgcagaatcatgatgtcgccgtactttggcctcctgcttgttcgatcgattcaaatgaggagaaggaagaatgaaagaaagaaagaaaaaaaagaagttcccggcatacatggcagcacaaagctacaagtacttatgactgcgtcgtcgcgtcgagaagagagaaaaagaaaggcaaattctgagcctcccggatgaatccacttcagagattctcttcatcattggggttgcaaagctggttaatttagttttccgacttttccccaagaaagatgcatctcgttcaaacatgcgattttttttttctgaaactggacgaaaaaacagggtgtttagataagaaactacagctactgcaacagtggcaactctgagatgttatggatgtatttcttctgccattttttcagtccattttgttggcttgcgaaatttttctggcaaaccaaactgggcatatatggatgctagctggggcacactgatcatcattggactgaaaattctatttgttgagggtatatacctgtacatacatgccatgtgctgcagtattatcgtgccataccgggggtgcaaaacgaaatcaggccaaattcattcacatggcatccatgctatgcactgcacgctgctacggaagcgtacaaagtatgagaattttgtcacttttgctgctccatctacggcggcagtacagtagttggtacagggtaccccatgtcgaccccatgcatgatctgaatatacatacattcacacagatatattgcacatttacagcatgagtgcaatttaatattgctttcttggcctaaattattgatggtcacacccccttcgtttgtgacacggcgctacctacgcagagagatggttgtttcgttctgcgacacatgacacatgagatcgatcgcagtttcggtttcagattttttcttttcgaaaatatacaaaagaattacatatctttatattaagaccgagatacttatacacaagcaaaggctatgtaaatgtatggctagatcttgcgatatatatggttttgtgaccacgacagggccatcggttggcacaaggctagcatccctgaggactcccgtagaggagaggggaaacccgcttagatagggcgtaaacgtgttacttcctctgcagctgcgccaaccacctttctccgagttttgtgttggttgttaaagatcctattgttaccttctttccaaattaacgtggctaggatgacaattgtattatatcctttcctcggggttttgataaccaacttcctactgttgtaccgccacagtgagaacgattgtggattggataggaagcaccaagattggccaatggtgtttatgataatccacccaaaaaggtctctgggtaaccaatctagatgtagttgatcgtttcctcttgctagtcgcagaagacacatttgctctgatgaggcaattaagccatgcttgcttagcctgtatgccgtccaacaacggcgataagcaaccaataggaaaaatacagcacggcggcacgtgtttttttttcttttcaaaatggcttggatgggcagatttcacgaccaaaaaagaggattatgtaagctgacttggtggagtattgccctgaagcttcccacttccaaatgagttgctcgccgtctaaggtgattgcacctgaactcagagatttagactttttttacaggagaacagtaagggaggacccccacggtaaatatcaaattaaggaatatttacagggtttatgtgaggcatgaaaattacatagcgccaatccatgattgaaacaaaggtctatctcaaattctgagccttaacgtcaactcatcaatcttttaagcatagctttccaagttacaggagaaggatcaatatagagatcatcctattcaagcatgctttgatccagatattcagtttcagattttgtatatgtacatgttaatttgttttatatctggctgcatacgttaactagaatacgaaatgaaattgtacgtattaccatatgtctgcaattctcgaagtactgctcggttcatccagccgtctagctgcgtaatatatttcagggtgtagctgtagtagtattcagagaaccaccatatggagccacatgaacacgtttaatttccgagataacagttcgtcaacatttgtgactgacaggacaagctggaaccgttatacaaaacttaaaaaaaaggtaacatgtgagatgtgagcatggaccatggatatgaaagagagacactagctagtgttctaattggaggtacgctctgcaagaatggtgccaagttgccggggttcagataattctcagaagttttcccaatcaaagttcagtagtgatcagctaccgatcgatctatcaatcaacaaacggaccaggcctagcttctcccctctctttcaaacccctgatcatggccgaaaccatcagctgccgctgccgctgcacgtactgcatgctttgctacagctcaacagtcaaataccgccaactcacaacacaacttctctatcagtcagtacagtgctcgtctgctcgacctacccggccggacagtgcaaaggtccccctgcgtttccacgaccccatcactgcacgatctagcatatgatattaggtaaagagagagaagagctagcagtagcaacagctgctagctaaacctgcatgcagctgtgtgcagcagcagcagcagcggtagcactgcatagcaagaaagagacacgagcacatttctctcttttggagcaacaaagcttaagctatagactagctacagtgccggccggccggccggcgtccatcccaactagtacgtgatataataattatatatgttaatcaaacgatatgttagacaggttcttgttcttcagaaaagagaaaaggaaagttggtggtataatagtcactcactatagtcatatgtgcatgcagggccctgtctttttggccttccaaaaggagagaattgaaaccgggcgataaattcgtggcaaaatccaaaagaaggccgtgtatctaggacctttctctactatccaaaagggagatctcacaaagaatgtactagtccagtatatagttgtatatgggttgggttgcagtagtggtggtggccggccggccttgacgacgaacgatgatggccaccgcgtgcacgccgtgctctcggtgcgagctccagcttttttgcttgctagctaagccccttttgtttttcagccgtgctagttgctagctgctgcatcacactgctgcttgctgcttgctgctgctgctgcctttgcttgcttcgatctgatctccatattcttttagcctttctttcatgtgtcgcgcatgtgtacagcctactgatgggctcgccagtgtacgtactactacgtagcagtacgtactgcgtgctgctgctgctgctgctgctgctgctgctgctgttgtgtagagagtataattccttcttcacaagtcacaactggagggcaaatgggcaatgcgatgggagattgggagcaatataatggcatgcagcaagcaagggaataatttttctttcctctcaactcatatcagcatgcagctgatgcctgacaaagcctccaaggtaggttgctgtcgtcctggcctgaacggtcatttcaggcgcgcactagctggtctttgatgtatcccaggattgttggggcgacgggggaatcgcttttgtccagaaattggaacggccaaaatgtgcggtgttagtttttgatcagatgttggagttgcgctgcttaagagagcatgattagtgagattaaaggccctgttttcaacgtggggttcttacaggaattttggagagtttggaacagagagaagacataaatttctgagaagatctatatacgatactaccttcgtttcataacatatggatcaatacaaacagtacattttattagtatgaatgatcagatggtgtagattaactggcctaccaacttaaattaattgtagtataaaattgaaaaggggataattgtctttctaaatgtttgcttgcagacaactgttgtacataaatgcacaatgctagacgtgttcctcacttgatttcattccccagtcccgtagttgtcgtccatcataggccataccgccatagagagacgccacacgcactgcaagttcacgcgcaccacgctattgtgcctgcctgcctgtaaattaattcgaattgcctttctttcgtcttctcaatttccgacccacccaaaaccctagctagttcctctacctggaggaggcagcagcaatgatgcccaactccccactctccaccatgctcacgcgaacttgtacatggaaattcctagtgtatctttgtatatgccaaaaatatatattgctagtgtattgtaccgtagaagtccttcaatttctttaatcaatcccttccaaaattctacttgttctcaacagaattttcataggattctcctagggtctattggctaacaccacaatctgattagccaacccagctcacatccctcctatcttaagggtttattcgattgaaggggtgtgggattaatctccttaatctcatgtgaaattaattgattgcccaataccctccaattgccatgtgaaaaggattaatcgaacaacatgtaaatagggtatatggggaataagtcttgttcatatgtactaatttgatcaagattttagtgacatttcaagatttgcgactcatatcccaaatgccgtagcacatgactacatgagcaataaatcctgatttttttcccttttaaaacaaccttaatttcatatatgaaacacgtctctttagtagaaacaattaattttaccattctagataaaaatgggtaaatggttttgtagttgttttcttacgttaaaaaattagaaatgtaacagtttttacgattgtgtgcaatattaggtctggcatggagtatagaggcacgaagcatatgttcacgcactccattctagagggagtataagagcagggttcgtgtttccaaagggaacgggtcaaaacccatgaaattatgaggtttccacgtaggataaagtatattgtgattgaaaatttgaatggtcttttataaattcaaatttcaaacaatatatatgagcaaaatttcatcaaaatttgacaaaaccattgcaccgccgaggttgggatccaacaatccatcgaaaaaataaaccatgtactagagtaaatgttacaacatttcttaataatctattacataggattttgatttgtacttctaccataggactatcacattgagtaaaaaaaacaaaaggaaaagacataagtcaaacctaaccaaagcaagcaagaggagttcatccaaaagagaaaaaaaaaagaattaggatacaagataatattggatgcttgaaatgtgttttacactagattcttacacatggtaaaagacaaatgctctagctaaatgtccgtcatagttgtgagagagccacaaccaataaactttttatagattgcgtgtttaatggatttattgtctctattactttagtcctacagaagactatttctctaggtctagatcatgtagcggtggggccaaaaaaaatttagagagtatttgttatgaaaatcttattccctatagtaacagtaacataacgattttataatgtgttcgtcgatgggtcaggtagccgcctagggttatcgagcggtggctccaccactgagatcatgtacgctcgcatagtaactcgcggtatttgaatcgattggacactattgtgtctctctcttccactaactaaaggcgataaattgaatttttaaaacaatggtgataaattgaattgagagtggtggggaaataataaacagtgctcctacttgcagggtgacagtaccggtccacctccaccatccatcccctacactgtcgcgagcgctctctctctctctctctctctgagttcgttagcaaagccaaccaaaaaaaacctaaaagcaaggcgagcctcggcagtgagatcgagatggagaaagcaagcaaagcaaaggcagaggcagcaaaaggcgcccacacccactgccgctgcctgctgctgctgcccccggtaaatttaaagaacccctccaatcagagcgaggcatcatcgatccccctccctctcatcctctccctctccaccctcctctccttctctcatcgatccggccaaaagctactcaaatgttatcgatctcaccaaaagagaagcaaagagaaagagagcatcaaaagcacaaacaccaagccactcaccacacctcgcaatttacatggctcctactaggttgtgtagctgctactagctagctcagctcggctcggctcggctcgccattaaaatccccttgttaccgcgcgttgtttggttgtaccgcgccatatgttgccgcctcctcctcgtcgccgttgcttagatggatacgctgtttaggttggttagcctccaagccgcctccgagcagcagcagcagcagcagcagtcggcgtcctacaactcgaggagcacgacgtcgagcgggtccaggtcgtcgtcgcaccagacgaacgcgtcctacagctactaccaccacagcagcaacagcggcggcggcggcggaggcggcggagggtactactacggcggccagcagccgccgccgtcgcagtactactacctggagccgtaccaagaagaatgcggcaacgccccacaccaccagctttacatggatgaagacttctcctcctcgtcgtcgtcgaggcacttccaccacggcgcgcgggtgcagcagcagcagccgccggcgtcgtccacgcccacggggacggcgccgacgccgccgctgtcgacctcgtccaccgcggcgggcgccgggcacggcctgttcgaggcggcggacctgtcgttcccgccggacctcaacctcgacttctcgtccccggcgtcgtcgtccggcggcgggacagcgtcgtcgggcgcggttgggggcggcggcggcgggaggtgggctagccagctgctgctggagtgcgcgcggtcggtggccgcccgcgacagccagcgcgtgcagcagctcatgtggatgctcaacgagctcgcgtcgccgtacggcgacgtggagcagaagctggcttcctacttcttgcaggggctgttcgctcggctcacggcgtccgggccgcgcacgctgcgcacgctcgccgcggcgtccgaccggaacacgtcgttcgactcgacgcggcgcacggcgctgcggttccaggagctcagcccctggtcctcgtttgggcacgtcgccgccaatggcgccatcctcgagtccttcctggaggtcgccgccgcggcgtcgtcggagacgcagcggttccacatcctcgacctgagcaacacgttctgcacgcagtggccgacgctgctggaggcgctggccacgcggtccgccgacgagacgccgcacctctcgatcaccaccgtggtgtccgccgcgccgtccgcgcccacggcggcggtgcagcgcgtcatgcgggagatcgggcagcgcatggagaagttcgcgcggctcatgggcgtgcccttccgcttccgcgccgtgcaccactccggggacctcgcggagctcgacctcgacgcgctcgacctccgcgagggcggcgccaccaccgcgctcgccgtcaactgcgtcaactcgctgcgcggcgtggttcccggcagggcccgccggcgcgacgcgttcgcggcgtcgctccgccggctggacccgcgggtcgtcaccgtcgtcgaggaggaggcggacctggtggcgtccgatcccgacgcgtcgtcggcgacggaggaaggcggcgacacggaggcggcgttcctcaaggtgttcggcgagggcttgcgcttcttctcggcgtacatggattcgctcgaggagagcttccccaagacgagcaacgagaggctggcattggagaggggagcagggcgcgccatcgtcgacttggtctcgtgcccggcgtcggagtcgatggagcggcgggagacggcggcgtcgtgggcgcggcgcatgcggtcggccgggttctctccggtggcattcagcgaggacgtcgccgacgacgtgcgatcgctgctgcgccggtacagggaagggtggtcgatgcgcgaggccggcacggacgactcggcggccggagccggcgtcttcctcgcgtggaaggagcagcctctggtgtgggcaagcgcgtggcggccatgatcggatcgtcgtgatcgatggatcaaagctcaccggtgagtggaacagcatggaagaaaagagctccatagctaagcaagcacgcatgcatatccaccatgcatggggtaagctagcaagctctctcgtgtgtgtcacgatcgacattaatggcggctcacacaaaggcatgtagggttttgaaacagcgtaggaagctacagaaatggatcacgtacgtacgtacacattgggttgcagcgatcgaggagggagatgatagttttagttcctagatttgcatccatttttattcatcgatcgccaacaagttcttggcgagaagatgattttgatttgcttgcttccatcttcttgtttatttttccccctttcgtttgtgtttcttcttaatttgtaagggttaacgacatttttcttcactctggagaaattttacgtgcatggtttttatcatgcgtacctgcatcgatctgatcatacctatatatattcatctagctagtagctagcatcttgcaaacattcatgctttcttgcatggttgttgagatgttacttcttgtcatcttgatgggagaaagtttagggcagacatttgcacggcctagtacttctagctagtcatcaaacatgaaagcactaattaaagtttgctactttgctagtgatagaccatagatatgtgcttacattatagtatttctttatgtacatgcattgtggttaaattaattaattaatcatccctttttcatcattctatcccatttgtaatatcactgcgctcaaaccacaccactaggcgtatatatatagtttggtcatagaagattatgcatgcatggcatggcatggatgtttatttaagttgtaaaatgactccccccgttcaaattattatggtttggatccttatttataggatatgtgatacatcaagttgatactaaaatactactactagtagtagaattcaagttctagccgaatatatattaaataacccctgatcctacacaggcgttgatcgatatatacatctgacttatttatatatgccaaattaagtagttggagcaaattgacctgcgggcctgctgtaagcattggttaaacttgacaaatggccggccttatgttgatttggttaagctaaagctagggaccatttattttctccatatatactactctctccgtttcataatataagtcattctagcattttccacattcatatagaggttagtgaatctagacatatatatctatatagattcactaacctccatatgaatatgggaaatgctaaaataacttacattatgaaacggatggagtactaatatctgatatggagtagtgaaaagatctgtcaatagttttgtgttcatgtacgtagttggtccaagaaaccagatcaagttttgttgactattgcaggctaagacctttgctatcttttgaaggaatgaccggcctgtcgttgacagattagtttctctcctcattaactactacttaatcagctaattaaatacttagagctttgatgctgtacagtataggacaacaagagttgttaagagaaactaatcagtggcgcactatgaaaacatatttataacaggttgacgaataacacaagagaaggatgaggaatgccagttctctcagaggattaggtgatggggtgatatcatgagctcagaaaccatttctagaaaaatcataagcttgcacactttctccttgtccttttcatgcagaagctgcagccgtcccactatagcagattacaatcttattttgactgcgtgcttgataatcctgctgcactttactttgtcctcagctttgtgtatatatttattattactctgtatcactaatgtctgacttgcctgttagagcacgcacttgctgtaaaaaaacgaaaggaaatggagtagttcataatcatcgtggaaaataaaacaaaaactttagtaattaaattaaattaaatgctaccagcaggagtatgtcgcaaacggcacgcagacaggatcacaggagctcacatatacctgaagaaaatgctagaaactgtagctctgaccgaatccgattcctgatctaattccttccgctggacacatcacacacatcggtgagatttcatgtgcagcatctctcccattttactggctgtggttggtatgatatgcacgctagccgtcacacgtacgctgaacaactgtgtatatgagattgtcctttttcctttaaccgaacggccggcgatcgaggcatgcatgggtgtacatgccgcctgctgcctacatgcacgtcagcatatagtagtacatgcatacaccgaagagaggaaggatcatatcgaaggtgctcttcgttgttccgatccgctcgaccgtttcccgcggcgatcgcgcaagccgctaggctacaaaaccggccgcgcaccgtgatgggaaacgtacgtcgtcatgggggcgcggggggtcgttatcgcgcgcgtcggcgccgcggccggttggggggatcgcgggttacgtacggggcgcggcgcgcgtatgcgtgagagatccccgtgtcgtcgctgggccggtgtgggggcgtgcggggcggacgggggggatgcggacgggggcgggagggaggcgaatctcgtggcggggcgcggggtggaatctaacaggagaaggtggtggtggacttggagtggacgggacgggacggacggccggctggttggcgggttggctggatggctagtggagtgcgtgcgtacgtgcgcctgcctcctgcgcgtcgcgtacgtagtacgtgccgggacccccacgatctttttcgcctttccgtccgttttctcccgcggaattattacgccgatcgacccatatgcaccccgcgcccgcgcgcgcgcgcgtcatcgccgcgctccatctcgcgacacggatcgctgtccgccgcgacggcacgtactacgtacgtaccggccggggacagcatcttggccccctctgctgcccggccgctgcgcccagcttagcttgcatgctacttcttctcgtgtacgtacatgcatatgtgtgatctagtactggccggccgatcgatcgagatcgatccaggcttgtctcgtcctatagtatatggatctgttgatcaccagccacaactaagggcatgttctaaacagctaattgaaaattgctactcctcgttttctgttatcatattttttaaactgttaaacggtgttttatgcccaaactttttatataggatatgctttaaaaatcaaataaaatcatttttcaaaatttaaataattgatactcattaatcatatgctaataattgtgtttcttgtttttacatacagccaaaacctgcagccgaaaagaacacgcctaacaacggaggcaatcgagttagtattatctattatatactaaaagtcctttaaacttcctagaaacactcttaagccgtcacttgtcacttctacaaacgtttctaagtcgtcacatggcactatctaatctcaccgttgatttttacactgatggacctgttattttacaccattagattagatttattatttaaaaaataataacttcctcatgtttatatcataccagcgctactactgttgtgccgtacgtacgtactaagttaataccatacaaacgttaatgttgttcttccggtacgtacatccatacacgattgaacgtacctacgtacgtacacaattgaaaacaaaataataaagcttgctaatgtctgccggaagaaaaaaaacatacgcatgtacataaaaaacgacagaaaaaaacatacatccataaaaatcgacagtctcttaaaatttgataatctacaatgtaaagttaaaatatattacttcacaaatataaatatatttagttaaataaatatttataataaatatccaatcaatgttccttaaaccatcttctaaatctatctattatataccaaaagtacattaaactttgtacaaacgctcttacgccgctgcctacgtgtctctctaataaattagataaattctaaaaatctattatatattaaaagtccaataaatatcgtacatatgttcttacgttgtcacatggcgctctaatttattagagaaatcctagaaatcgagagaacaaaaagaaaagcatccgatcttcaaatttcactgaaactggtggacctattattttaaatattagattagatctattaaaaatctcatgatactaatctctataaaaaaaacataatgtgcgtatgtgcgtacttcgtatgatcgccctcctcccgaaaaaaaaaaaacaaaacttaaatacctacaccatttacgataaaaaaagataaagcaaaaaaataaaaataaaataaaacacgcacacgtacatagtagaattggaaagaaacactaaccatcagtgccaacactgatgtgttgtcaacggtctttaatctacgattttattaaaatctttattactatacgagacacacttactgattctaagaatgtatttattttattttcacaaactaatttacactaactaattcgcctgattgcacttagtgttgggttcaatagtgtataacatttgtccatcaactatattcggcatataaatttctatcaaccataaaaaataggaaaaagcacgaattacctcctcaccctctgaaccatcgtgttcgaccgaattacccctgaatccgaaaaccagacattacccaccctgaattttcaatactggacgtataactctccttgacccaatccgaagcggttttgttctgcgtggcatacgtgtggtaatccagaggtcgagtcgccgagtgagctcgagacggcggcgaataaatttattaaatcgactaagcttaataaattataataaattagtcggggataccgtaagaacgcgtatcagctatgggacaccgaaaaaactggtatttagttgctggacacccgtgacattattttataatatccaaaggaaatggagagagaaacaaaaacaaaagtatgattgtgccccttgcctaccaagtccggctcgcatacacctccgacactgcaactgcacccgttgccggtgaggtgactgtctagaggggggagggggtttcgagatatggtattttgtagatttttatggtggtacgtctctttagctatatttttttaaggacgtgactacacagctagtggtagctggtttagacaaaccacctaccactccacatatgatagacactatccacctatacttcaaatacaattttctcttaaactactaatccaatttacgatatgattacaccgttgtgttcgtaacaattaaatctttataacaagatctcacatgattatattttgatgaaaaaatataaattacttttataatatatctaaattacttttagatttcactaagttacttcttaggcatataaaagtaattcaataaagcctaaaagtaatttacatatactatagaagtaacttataacaaaaagaaagtaacttctataatatatgttaattactttaaaactttattgaatttacttttatatgtttaagaagtaacttagtaaaatctaaaagtaatttagatatattataaaagtaatttgtgatttttttatcaaaatataatcatttgagatcttgttgtaaagatttaattgttacgaacacaacggtataatcggattgtaaatcggatgtgtaatttaagaaaaaaaaattatttgaagcatagatggttggaatattttttctacttgcttgatcaattagtactatagtaaagtaagattattcaagacacatatctggacaatggctgatcgtatctggacaatggctaatagcgtcgctcgttatgactaaatcgagagagctctcgatttagattgtgcgtatatgttactattgtcccttgaccgaccagaccggccagtacaccccctcatctatgttattgctatcattatgtggttataacatgtaaacacaagcagtttatgttttcgacccggtccgaaaagtatggaattcgctttaaatcggatcggttttgatatgttgtgtaaatcttggttcggaccattctgttttgcctctccctaaatttgctgtagtagcacgctagcacctcctcgatgtaatttgtactgaactcaattgcccacttattttctaattagtaaggttgtacgttttcaattaaaactaaaggagggtgtgatggattatggtaaattaattaagtcgctatcaccttgatgtatagaactgcgtggagtaccatcacctcgacacaccagaaagttttcgctttctgagatgtgggtcaaaatgggccaccagcagttccaattttcaacccaattctgagcaaatcatgatactagcggtccttttgcagcctttgtaatagttgggtatgcatgcttttggttttatccaatgagaaaaaaaataaagggctactaagctttttgtgcagtccagtggaggcttctcttctttccggtcatatatattttgtaatacaagaaaacatacacatatactgctgagaactgatcccttcagaagttgctcataaactacgaagcaagttgctgtggaccttgtggtttcacagccttacgactgtttgatcaacatccaaaaaaaaaaaggagaagaaacggagaaaggtatatagtgatcaaccactcaactcatagctagaagacccaaattaaagctggacagactgctaataataagaattgtttgaaccacacaatgtttgtgctattatattagtttacacccaaaaaatcaagaatcatgcatcagctggtacttactccatcaattccaattccaagtccatgtttcctggtctgttctgaacgtgtaaagtggtttttatttttaggctagcaaaattttcagtgtctttcaaccatgacatgtttttactatgtttacaaatagatactcccgacgttttgactttggacaaaatcaaactgctttaaatttaaccaaatttgtagaagtaataataatattttcaactcaacacgaatttattatgaaactatattcaattattgatttaatgaaattaatttggtattataaatattattatatttgtgcataaacttagtcaaattcaaagtagtttgactttgacccaagtcaaaatatcttataacctgaaacggaggaagtaatacaaattttgaatgttctacagcaacatattaagatcaattttactactaaattaacactcaaagtttgtgtagcttgctggtgggccgtgtatatggaggatatcaaaaattagtaatttgttcaaggacattttcagcctaaattgaagagagaaatttttgaaaagatgacaatgtccttagagtcaaaagcttctacgaccctagcaatgcacttggttgattgcagatttagagtggcataattctaaattttcacttcaacgtccatgttacgtacaatcctgtggtcttaggggcattctcgtctattgaagaatttctctctttaattggactgaaagtgtcttgtagcaaattactaaatttttaggtgtcgtttagtcatgtaattaacaatctttgatgtcctgtaacaatatgatttttaacattatgtaagtcaccactaaaagcaattaatcacaaggtgaagtttatctggttttgaaggtttagagtgaaaaataattagtttgtgttcagaatgaaaatggacttggatgaaagtttggggtccaaaattggactacccttatttaaaaaacaagtacacgacctcagcaaattaagtactacgttctatatatctaatgaagagttagcaaccaacttattcagcaagtaacaagggatcagttgtctcttggtatccatggtggcatggatgcttattagttttctcttggcaagaacttccatattatcccatgtgcttcactatatgatacactcaaattaatatgttgactaacaagtgatcagcaaatgacacactttcatgttgcattgtacctagtactatagcatatgcaagcaataagtgagggaatattgttttctttaatttgtgaggtttaacttgcagtggcaggagtagtctttcaccttattgttgctgaaccgaagtgtactggacaagcctaagagctagctatgcattggaccaagggaaaattgtaaccatgccattataaggagggtgagtgaggatcaaatagtgggagctcctttttaggggggtggaggtgaaggtgcgggcatggagagacatggcccttctttttctgcccccggcaataacccctttgcacaggtcctcttttagggcatggggttaatactagtttctccttgcctgtacagtcgcatgtctcttattgttatgatatgcagcaattggtgtttgttctttgcaggttcccctccatatgcaaactccctctctctacatatagagtatatgtacatgtttttttttcccatagcacttgttttatactatttttctcctgtcttgttcttgtataggagtactattttttccctgaaggtgttactgttccaaggagcgcgtggtagaaagacaatcattccaaacttctgcatatatatgttcgcgaggttacctagagaacgatgatgttttgctgcatttttagttcattctccttgggaacaacgttaatcctctatccagtgatgacaggaagcatctcgcgcatgtacatgtacttgtaatccttccctaccaacctcttagcgacagattcgaggaaatggaatgcttcttgaatcttgagcttaattgccactgtcatatggcaaatagtttcagataatgcagcagtacagttccatgatataattgtacccatgcaatgaaccaagctatagctagcaaaaagactgatttttttttgctcgagaaacgatgcaattaggtcgtgtatgagagaaagcaaaaacttttggtccgttcgctctcgcttgctcgatcatgcatggtggccatgacaaattggcaatggccctcagttttaagtggtgatcgccttgaaaaaagcctggagttcttcgcggtgtgcagcatgcgtgtatgcgagccctttttgtcaggcgacttgcacaagcctgaccccagaaagaccgacaaccatccaggcacgaaaattcatgcaatgctccaacattgcatccattggcagctagctcgccggtagcctctctcccctgccactactacacacattttatgcatttgccccatatccatcaccattattctagctaccactacatgcttacctctagtcctagtactagctagccacttcgccaagaaaatgcaatgcaaccgcacattccgtcacataaaaaaataaatctagtagctgatattggtatatcctactactacgaatataaacaaatattatggtctgttttggtttaatgccaagacttgccctaccaaatatttggcaatttaaatagtgttttgtagatgtttggattgatgcgaatatttgccaactcatatagtccaactctactaaaacattggtagtgccaaaacatgtctaagatttggcactaccaatagtttgataaggattaaggaatcaaaccacataaacccatccagattggtggtactataatatatcaacatccgatcctaaattgattttttgtgggacggatgaagtatgcaagtactccctcccatatgtctcgtgatagatttatttttaatggaatggatggagtggtagcttggtatctgctacctcctttgtaaaatgtagttgtttttagcacaataatttgtctcaaaataaagctaattcttgatttattcacatacctccttctctcaaccaatgaaaactattctctttcatatattttttcttctcaaccaatcacacattttctttaatcattctcacctattttcttaatactcgtgccaaccataaaaatgattaaattttgtactgaggaagccgtgaaggtgcagtgatggagacacccatattgccagtgagatactatatatgctagtacttgtgacttgtcctactcctactactactcctcccgtcctccgatccattgcttgcatggatcgatcgatcggtcactggttcacccacacactgttgagagtgcaacatcgtgatgggatcacatccacatctctatggactctatccccaaaggaggagtactttgcgaatggaatcatgcagaggaggaaagcaaccacgcattgttgcagttgcatatatatacatactccatggagaagagaagagggcgattgctgtgcaaaagtagtacgtgcacattgcccgcgctggggcctggttttgcagaatgattccatgcaaaagcggctaaactgctcgcgccattgacatatgcacatgtcctccgtccgccgtgtgcatcggcctttcagatgaaattcagaatttcaactgttgagagtagcagtaatacgcatgcagtcatgcagagtacgtcttgtctgaattggacgttgataccggcggaattaatggctgaagttctctgaaatgtatctgccagatcgatggtggcggatttatctgaaatgaatttatgtaacttacagtgattgcatggtactactactaattgattataagctctatatttgcttattgcagtgtgtacgtagtacggctatatatagttctattgagaatttcagtcgatgaaagaaagagaaaaaaaaaagaactgtgatctatatactgatgcatgatcatcgatggagagcgttggatggcgaaatggcgatgggggaagtggcatcgaaacggagagagtggtttcccccttttttctgcagattctctctggtttttgatgggagaaagataatggcacgtactgtgagcgtaaactgtgtggcagtttgtcgtgcctgcttgaacgtagcggcgaatggccagaacaaaaacatgtccaagatggcagacaacgacgcttgctcgccacgcacgtgccagtgctgcgttgcacagctcgacacattcgcagaaagctacccctttttaatattcatcttcagatacaagtattttgtcctaagatatactgatatagtatgtgtatattcaccggggaggaactataaacttttggtacaagttcaccacacacattcacccgaaaaaaaaaaaagagtttaccacacgcattcaccgtcaactcatccaaataatgacatactccatgcatcatctgcagagatcagtcatcagatgatcagatcaatatgcatcatctgcagcgatcagtcgatcatcagatgatcagtggtcagtcatctgctagctgctaatcaacggatgagccggaggccgtctggccgtgcgtacgaacgtcaccccatgaccccatgacccagctagctcctgctaacgatcgatatgattaggcgtattcacgagctcgaccaaacggaaataaacgcatgcatgcatgcagacgcagtgctttcaaatcgatcagctactagtatatacgtgtagtacgcgtactcctactgatcagcgtctcgatcgggcccaaataattaactggccggctgggctccggctgcagcgtgtgtcacgccccggcccgaccggccgggccagcgagatcgatgcatctagcttggtgtatatcctagtatagtcccgttgctagtccagttgccgagtgccgaccgtttgccaagagtacggaacatgtgtacatgtttgatggctaattgaaacgacgtgagaacagcagaactcatcgtcgtcacagattgatcaactgtctagcgatcgatacgcacatgtgcaaaagctgcagggcctgtgtacaaattaagctagcgctagctgttgttttaattgagagcttatcctcatttggtggatcaacaacaaccagctacttcctccgtcctaaaaataaaacaactaattatcataattcatcttagaaagttgttttttaaacagtggatatatatctagattcattctttaaaattagttttttaggatttatagaggggtatgactaggggtgaaaacgatcgagtaaattcctgatcgatcaagcgttattttcatataaggggtaccgtttccgaccataccgtttttagctatttataatttttgttttttctaatttctttctatattatattaatattgacaccaagtagtttaaatgataaatatggtcaattaccggccgatcgagcgtcattgtcaaagagacattaccatttccgaccgttttcacccctcaggtatatctagagatggtgtactgtagctaactacgtacgcactgataactgattgctgctgcgtaattgattcagcgattcagtggatgattagtagttgtccatatctaccccagcagatgctgaatgtacgttaatctacctccccccccccccccatnntcatnntntaaaacacttccggtaaaacatttacgcattctttttcttttccactttccaataattataagccgccccaaacagaggttataaatatacgctcagaaatccagaaggtggccaatctgtgttgacacataatttaagtccattggacttataagtccccggtcctaatccttctgctacccaaattgatattatggcaggtactatgcctatat

SEQ ID NO: 65835 - DNA, 7709 bp, Oryza sativa
ataaaaaaaaatttaactccaaagttgtagatcgcgttgagggctataagtttgatataaagtttgtcttcattagagttcacatgaaaaagttatgaatttttttaaatataaagtctttagatcgtcctatttgaattagatgatattcaaatccaagtttagggaccagggtgacacaactgaacaagttggaggacctaaacgagtgatttgcaagtttagggaccgggatgacacagtcgaacaagtttgaggacctgaacggtcgatttgcgagtttagggactgggatgatacaacggtacaagtttagagaccggtgatggactttactctatctattattacctctggttcttttgaactttgtagttgcgtcagttgggtgtaagtagatgcagcattattacatatatgggattatttggatcaggtgcagtcacaatagtgaccgtaacttgcagtagtagtacgcatcattggatataaattgaacggctcaggtcgcacatggtactgttcatattatcgtatcagcaaatactgttcatgtgggtactgtagcttttgatctgaaccggtgatcacaaaaatggatggtcgaagttgtgtgcagttgttaaatcacctaatcccaattcatatacgtggtatggctcccattcctttgatttgaaaatgtagtcatttatggctttccaaatcttcgaaagcatgatagagattttttatagcgcattttcagttttcatagtagcaagcaaataagccaaaatatcttgcattgtctgcattggtgtgagagcatctatttgaaggtgaaaatcagatacaaaccaagttagccttgaaaattgacaatgaaagaaaaggtgaaaatcatctacctgctgaccacatcttgaacaagttgaggcaatattagggaaattgtttttccaaacttctttaagaagattgattgttaaagtaggaacagagggttgatgaggatgaagatgagagtgaacttctttgtaagcacttttttgttgcactcacctgattgggtatgtttccagcaaagttggtcctccaaaacttgtggaataatttgtacctgtaagattgattcagtagctttctgatcaaacatttgtgaaattttttcagtgtcccatctcttatatatcttgataaaaaaatcagcaatatttataaaggcaataggtatggaagagtatcgaggacaaggtgaacatgaagacatgggtgcacagtgaagatggcatggacacggtcgggccttcacgctcgtgccaaaatttggtaaggctattttgttttcaatcacaggacgagtaatttcaccgtccttaagaaagtaggttaaaataactaaattttaaattaaaatttttttggtaccttgagatatttagtatctagagatatcaaatttgtcattaaaaatatatatctccagataccttctcaagaatgataaaattattcttataggactgacacacattactacacacgcaatacgttcacatactcacgaatgcatctcctaacaaacggcacattcctaatattgataaaattatttttaaaagtctacttaattacgcatgtgtaatatccgttggcacccaaacttgaatatcggttggtccctaaaattaatcttaaaccctagcattccacgaatattttaaggagaaaaacaaaagaccataatgcatttaattaatataaaagttgtatttgttgaatttgtagatgtggggtattgaagtaatgaaatttctcgttttgcgaattggtggtagccaagaaggtagaagttgatttattttgcgacaaacttcaatctttataagttggtttatttcgggacagaggggagaagtgccgtacaagatgacctggttgtccagacttattaattaacaaaataaaacacgtgtagtgtcgacgtgtagtgtgggcatgtcggatcggcgcgcacacacacgcgatgataacatgatagccagccggcaggtagatcgaaaatataggaaggagcttaattagccatggatggcgcgcaggtagctgcttcattcagttgcgcacccagagcatgtcgtcctgaggcaggaagtggcagactgccaccttcccgggcgccacgccgagcctcttgtacgcctccgccaccgccacgccgtgcccgtccacgtccccgtggcacgccgccaccgcctccgccatggtcccgtcggcgccggccagcgtcaccgtgtacgccgcgcccttgatcccgtgcaccccgaacacggcgtacgcgtagggcatcctgtggcatgccaccatgtcgcccccgggcaccggcacgggcctcacggcctccaccctgtacgcctgcctcggcgtcggcccggccctgttgaccacctccgtggacacggcgtggacgtcgcgggtgccgaggctggaggcgacgagctcgaccatggactcgagcgacgtggcgcagtagtgcttgtgcttgggcgccgtctcgctggcgatccgcgcggcctcgcacacggcgagcgtggaccgcatggcgtcggcggtcggcgagccggcggggatggagagctgggagaggatctccgggagcttttcggaggcgaacgggacggagtcggcgcggccgcgagggagcagcgcggcgccggcggtggcgcgggtgaagtggagcgtcatcttggagcccgggaagaggtccttctcgaggaagaacacggagcccaccgtatcctccttatccttcgaagctgaggccgctgagctcgccgggctgatgaggtcgcgaatggcgccgggcatcggcgaggtcgggagcgcgatcttccagtacatctccgccggcgacgcggcatggctggctcccgcggctgcgacctgaaatgcagtcagaaactagttgaattgaaaactatcaaagccaaaagttgcaactggaataagtactaattgtattacgttctcatcagaaattcaatgaactccatatgttgatccatcaaccatcttaaggtaaacatgttgatccagttagtttaaaattttagctagggttccccgcaaaaaaaaaaggttagggtacgtaattttaacttaatcttcaatctctaaataatatatatctctctcccaacttatctctgttctaggcttctagctcaaaacaactaaaccatacaaagagcgatatatatgtgtgtctgctcaccagaaggagaaggagagcagcgagagacctagccatgctaattaacgagctgtcaaggacacaagtatatgatctaattcactgataagagtgaaactgagcacaagcagttcatagcttttgggagctatttatagatcagggaagcgggaagaagacgaacaaataatacattgcattggccccactggattatgcagaataaaaaaatatgtcatgtagcaaagatgctatatcacattcacgatcatgccggatatctctattattgagcaactaggagggtagcctgcgcattcgcgcgggcatatattgtagtgtatttcagatatatacttataagtaatagaccgattgtgttaaatgtcgtatttgttatatagcaaaatatggcatattgatattatatatattgttggtttgattataaacagagtaatagttagattagaaatcagacgtggagcttataattattgattatttctcttttagttatacaaaataggaacgagagagtaatgaaaagcgtagagctcgagctagagtgggtgtgtagtgatggacgcatgtgagggtgatgtggagtggatttttttttgtaatttttctaattgatttaagtgaaagccaattattagatgttattttccttggatttgtaagatttttttttaaagttgtaacatgtcatggattaagatttttataaaaatagatttgatagttgaaaataatattagtgatacgtggtaacttaatatggctctaaaaggttataaaagttgactttgtactttcctaatttttattatgtagaatgattaacatgacataatacttgttgtcaattttttaatatttcagtgttgtttgcttgttggcctatgttcaaattacgtattttaaattttacatagtaaaatatgagtaatataaatcaacaattcaaataaattaaaaatcggatgttattaggttgtcattgctgacggtagttatagaccaattttgactgtcaatacttttgtagataatggagaactagcaatgcttgcatgcatatttatttagaaataatctagttccacttgtacttgataaagtaagtatttgtttacaagagatcatcacataaatggaggagaaatgattgaaaataaccgtttaaccaatcagaggtcgacatgtggcagatatatggatggatgtgcccagaatctcattgaaacacctacaaatgggcccaaccactatgccactgggccgaggatctgtcaggagacgtctaggacgaaggactggcccagggaggccaaccacggttcggccaaccttgggttccgctgacccatgcctggctccgatcgcccaggcccaagccgaaggcggttacataccgatcttctaatgacggttgtactggtattggcgctccaatcatcatactcaatctataaaaggacctccccaacttcacttcaatacacaccaagaaggaaatcaagtgaagaagctctcttaggctgagttcgggaatgaggtttgggaaccctcactccctggcacggaaaacggagcagcgattagggggtaattaactaagtatttgcttgttttttcaaaaatggattagtatggattagcaaaaaatacaccatttagcagtttgaaaagcgtgcgcgtggaaaacgaggaagggaagttgggaacaggaggtaacgagcgcaaccctagtttacatattttgctctagtgctagtagagttagaattaaatattcttccttagttcttcatgtcttgcagagaagtcgggtatggttctagtagctcttcctctcttgtaagactttattcaataattaaatattgttttttatatagttttggtcctttactatacttgcataattattcgagtaccaacttcggtttatacttgactcgtatttattatgtagctagcttactggagatatgcaatggtattggcttagtgttcatttatttggtaatatttagtaatgtaagcgcggtgattagattattagatatcattaagtggtgctatatgccacgcatacgtaaagataggccgctgatgctgacaactcaatacgtgtattcgttcacgtgcgtagatagggctaagaaaggttccgggtgcgggtacttctccatatctttaaccggttggatagtcatgacggattgtcgtaagaaactcgacaatttggggtggtttctcgatataccagtaggcatagttgtacattagcaagcatatactaaaataactatatattaaaaatatagaaatgatgcttttctttattcttctctagttagcctagacttataatttagtgagagtactctaaactatcccttctatgtgtcattcctctccccttcctactttgtatgactaaaagagaaataatctataattaattataagctccacgtctgatttctaatctaactattgctctgtttataatcaaatcaacgatataagattcatatacctatattttgctatataacaaatacgacatttaacacaatcagcctattacttataagtatctcaaatacaacctatgatacatgcccgcgtgagtgcgcgggctaccttcctagttttcctaaaagctacaactacaatagctcaatcttccctacaagctgaacttctggctctacaattgacaatataagtggcgatatttcttgattttgcaggtaccatatttttaacggacaacgagacgatcgcaaatacaatgaatatgagacattttgaagctgatccagcctattcgaatcttcagcggttactgagttaaattcaagcaaatattccttttagcttattgcaggtgttgtggtcttgtggataacgagagaggtcaatcgcatggctgacaagttagcaaaaaatgcgagagatgaccaatgaaatccagcatttgttttgccacaatatcgccaacctagcttatccaagcagaaggtgatttgctaaggatatgaaagaccatttcagtacgtactctaaattgtatgaaaaccatgtaattaatatgtttgagcaatggaataaagtttgagttctaaaaaaaattgcatccttttcatgttctaatgcatatcatctagaatatgcttaatgcttgggctggaatatatatacacggaatggtcatcgtaggcgggcctggcctgagtaaggtgtaaacatatccgagcccttaaatggccttcctgtgaaaaaccaagtcctcttcataggcagccagttttacagccagcatactatagatgaaaacggagcggataattcatggatagtccggataaagatatttttttatatgaatgtgaatatggtatatcagagttttcgatgaatatgaataatagaaggatatccgatgaacaaaatgctattcagatatccactgaaggcatgagacatatctcatttctttctaactctagaccttcaacttacttctttagaattttaatagtagcccatctcatgatactagcccacactattaatattacttaaatatttaaatatttttttgtaaattttactatattttatattataatttcagttagacatgtatttatatcaactctgatgtacatgttaaacttaattagcattgttgactctatgatcaaacttattatataaaacgatatatttatatatgatagtatttgtttctattagaaattgaagtgtttttcatgttctgagaaatatttatttccctattcgtgtccgatcatattcgatctttattcatattcgagataattcatatttgttttcatatccgagctttcgtattcgttttcctatccgacagaaaatacggaaagaaatattgtataagcattatccatccatatccgctccattttcatcctaagcacatacaggacactcaggagacccgcttgcgaaaaaaaactcaggtggagtgcttaagaacctatttgtgaagatgactttttcgcgggcagcccgtatactctcgggagcctatcgtattaccggcgagccttctcatggccggaaacggatcctctgactttggatggaaagtcacggtcttgcaattcacttcatcccagccaaccactgcatccaacggcacacatccatcttcccctcatttgcctgcatatgttgggagtagctaagaaaatattttacgtagtggtgtatacaaccgtgtaacattgtcatacaagatgtatggatcgatgaatcgtacatgcagacttattaacatgctgccacaagtatagtagtggcatttcgggtcgtcgcatacacatatgataagacatgatacgcatatagctccaaaatataggaaggagctatcttgagatcacacaatttttatcccctttca

SEQ ID NO: 65836 - DNA, 5125 bp, Oryza sativa
tttcagttgtggcataattaagctgagctctagtcaacgttttactagcatatgctatagcatggtgttttctatccttagtttgtccaagaacagctcccacggcaaaatcactagcatcgcacatgatttcaaacggcagcgatcaatcaggaggttggatgattggtgctgagatgagtgaatccttaaggattttaaaggactttaaacactcatcatcaaagtcgaacggaacatccttagctagcaaggcagttaagggtctagcgatttttgaaaaatcctttatgaaacgcctatagaaccccgcatgacccaagaagctacggactcccttgacattgacaggaggtggaagctgtcgaattacttcaatttttgctctgtccacctcaattcccctttcggagatttgatgtcccaggactattccttcacgaaccatgaagtggcacttttcccaattaagtatcaagtccttttcttgacatctttgtaagaccttgtttaagttctccaaacaatgatcgaaggatttaccatagactgaaaaatcatccatgaggacttccatgatgtcctcgatcatgtcagagaaaatagacatcatgcatctttgaaatgacgtgggtgcattgcacaacccgaacgacattcttcgatatgcatatgttccgtacgggcacgtgaacgtggtcttacttttatcatcgggatggatggggatttggtgataaccagaatacccatcaagaaaacaaaagacggaatggtttgctagccgctcaagcatttcatcaatgaaaggcagtggaaagtgatccttcttagtagccttgttgagtttcctatagtgaatacacattctccatcccgtgacggttcgttgtgggatcaactcgttgttcgagttttcaacgaccgtcatgcctcccttcttaggcactacttgaacagggctaacccactcactatatggcatgggataaataatcccggcatataggagtttcaagacttccttttttgacgacctccctcatcgcattgtttaacctcttctgaggttccctagatggtgtgcaagatggttctaagggaatgcgatgagtgcagagggccggacttatgccttttaagtcttggagggaatagccaaaagaaacatgatgcttttctaaaacggtgataagttgggtcgtctccctctcagagagtttgtcacttataatgactggagactccgcatcaccgtttagaaatgcatagtgtaggcctgaaggtaagggctttagctcaattggggcacgtgacggctgatccatttttggcagttcaatcgtttctccagattcatcctccccttcattgaattcttcgatggattcattgaaatagactctggggcctcgaatggagaaatggccatcaccttctcaattggttcaggaataggaagaggctccgtcaatgaattgattgattgcaacacaaggacagaggtggcgattcttcctatgttcaggttgaggacaccggattcgggcatatctaagagtttctctatgggatggcctatgagtatgtcgaaatcagatatatcgaacacatgaaaatctaagatgacctcaacgctgttgtgccgtgtgggcactccagagataatccctaaaccttcggtagtagagtttgtggaaattcggaaggttttgacggttggttccaacggtttgtcccctaagcaatcaaatgcaaaggttgctgacataatattggcaccaacagagggattatacagaacacggaccaaattacctccaatgagacacgtaatggttgaggagtggcatcgtatctgaatcgattcagatgagagctctccttcccttaaacattcattactcacgatggtggtcaacttcttcaccgtctctttaagcatagctttatcgagaggttcattagaattgaccttggtcggtggtctcttctcgcaggaataattcgaggtgttctcataatctttgaaaagatcctcctcgaattggaatggaatttccggaggatgaatttcttcttcctccggctcctgcgactgggatgaggattcgatagttgagtcgggttccgactccacgtgcagaggttcctcatggataatctcgacctccgggacggcttcgctttggccaaaagaatcattctcgaagataagatctaagagttctcttccttcgacagttgtcttatgtgcaaacgatcctccagcggaaatatcgagattttcaacagactccttatctaacctgtaccaaaaatgttgtaacaacacatggtcatgtaaagacaagtctgggccaaactgagttaacagtgagaaccttactcaggctgcaccgagggattccttctcgttgtcggaaagaaaggatgtctaatcgaagattgattacacaggttaatggaaagaaagtaaggcagaaattgcacttaagctactcccattcaccgtggaatttcttgacagacatagtgtaccattgcttcgcttcatctctatgagaaaaatgaaacaatttccacttaagagtttcatgtgtcatgcctacgatggatatgcaagaacacactagctcaaagtcccgaagatggaggtatgggttttcactgatactactagagaaggttttctctcgaaccatggctataaagccaggactgatttcatagccatccgaaagggttggttttgaagaacacgatggctcacaaagattagcccgaggagcagaaaggttttgaattgtgggttgctccattaaggaaaggaataaaagaagaagaaataaaaataaagattagcaaccgttctccggcaacggcgccagaaatgcttgttggtatttcttacgaccacagataaatccgcaagcgcacggaataccgctgtagcacttcaccttcgggtgaccccaaaaggatatcgaactcagggaacgcgtgtaatctacctaaggctaaggcaatccagggacaacaactataggtaggctaggcaagctagagaagacattctatgtgttttaattatctaagctaagcaaaggtaatttcctatctgttgcttcgggcaccgacccctgctggtctgccagcgtggttccggctatagctctatgatgtatccgaacgtggaggattattgggacgggattcaaagctatcaccacctgccgcctacctctgacaaatccgtggaatacacaataaacaaaggtaatctgtaacctagacaccacgtctaagttattaattactactctaatacttgtacatgaacttccttctttatcaagagtcctagtactagagcacttagtatgaatactaaacaatgaacccgcaaagatgaaaacctatcttacttagactaaataattaaataacataagaaaggaacacgaatgcttactttatagaagaagttctccgaacctggagcagagtgtaccgacagctccggtactcctctagaattcctcctaagaagctacactcgtcgaggtagaaatcggatgagcgccaaacttccgggcactcctccagagcttccccttactctctaccttattctaatgtacaaaagatacaatagagcctcttgtaattcagctcaaagttgtgtctattggaatgtgagtgagctcctccttatataggctccaaatgacagttaggggcatgggaattgtctaaaacaacctgcaaccgcctctgggaagaaatccgagccgtctaggtgaaagcagatggcgggaagcgctaggattggttcggccgaacccaaaaactctcctcccggcctctccttgggctgggaggttgcttattgggcccccaacaacctgggctatgttttggcccaattctaaatggtttttattgacttattgggcatctaatccgtgtaaatatgtcctgaatacgcggagatgcattttgtcatatgacggatgtgttttctcctcaaattacttgcatacacatatttcaccaacactagtggaaatgattagtaataatacctaccactaagttggataccatgttttatttcattatatacaggtattgacggtcagatattatgatttaaggaccgtcaacaatattcaccaacactcgtggaaattgttagtaataaatcctatcaataggtttaatatttcattgatttgcttttttacaggaattgatagttatatttggtatttaaggaccgtcaacaatttcaaaacatgagtaggtattacctctcatcgagagggcctaaggctgtattcgataccaggagttcctaactcccccctctcgttttccacgtgcacgcttttcaaactaccaaacaatgtgtttttttacaaaaagtttatatacgaaagttgcttaaaaaatcatattgatccatttttgaaaaaaagctaattcttaattaatcacgcgctaatggaccgctccattttccgtgtgagggtgatgggttcccaacaccaaccaacgtgcacagcctaaacctgtctaaacctttgtcctgatatccatccaaatttagatctcatacgctaccccttttactactgttgatataggacactgacagttggcgcgccatgtaggggttgcatcaagttttacaatgacaatcgtgatgaaatcatctttaggagtcgtcagatttgtcttccctccaaggaagacatttagtttcggcagttttgactttctcaccgacaacttcagcaagcattcagtcttcgactcagattcaaacaagttggcggggttcgagacttcctcggtcccttttggtctctcgaatgcggctgtggcccactccagatcggatttccatggctcggcctcaaattggccaggggagtcaatgccactagcttacccggacaacatctccaacaacggcggcaaactaccctaagattctgatgcaactctctccgcttctcgctgcgacgatttgggacctacaccgtccccgtgaattcaatccaggcatgattcgaccatgtccgaacatggtcccagggaagtaagcctcctgatt

SEQ ID NO: 65837 - DNA, 4133 bp, Oryza sativa
ttgtctttgcgatagacgtgtcggacctcgatcccatcgaacctcttctctaacttcctgacttctgcgagatattttgacaactcggggttagagcatttgtagtctttgtgcacctggtttgtgactagttcggagtcccctttgacgattagtcgcttggctccaagtacggctgcagctcgtatcccggcgagtagtccttcgtattctgcagtgttattggttgccctgaagttgaggtggattgcgtgcttgaattgatctccggagggagatgttaagataaatcctgcccctgctccttggctgttgagtgcgccatcgaacgccattgtccatgtttcattgtcaccttggttgtctgatttgttatctggcatagtccaacttgcaacgaagtcggcgagtacctgggatttgatggcagttcgcggcacaaaatggacatcaaattggcttagctcgactacccatttcgcaatgcggctgacgacgtctttgtttctcacaacttcgccaagggggaaggaggagacaactgtgactctgtgggcttgaaagtagtggcgtaatttccttgatgtcatgatgattgcgtaaagcagtttttggatctgtgggtatcttgtctttgcgtcatggagagcttcgctgacgtaataaactggtcgctgtactttctctctctcgacgataatgacggtgctaacggaatatggcgtggcggcaatatagagaaataattcttcattaggttggggagcaacaagtacaggggggtttgataggtagcgcttgaatgcaataaatgtctcttcggcttcctgtgtccatacaaatttgtcttgtttcttcaacaaagcgaagaaaggttgtcctcgttctcccatcctagcgacgaatatgcttaatgctgccatgcaaccggttagcttttgtacctccttgagtcttgtgggcgacttcatgttctcgattgctttgatcttctcgggatttgcctctattcatctgccagagacaaggaatctgagtagcttgcccgacggtactccaaacgtgcacttctcaggattgagcatgaggcgatatcgtcggagtttgtcgaacgttttcgcaatgagtcgcttgtcttggttttgacaacgatgtcgtcaacgtaagcctcgacgttgttgccgagctggttgctaagtgcaccctggaccgtgcgctggaaagtattcccggcggttatcagtccgaaaggcatcttaacatagcaaaataccccgaacggcgtgatgaacgctatcttctcttcgtcctcttttgcgatgctgatttggtggtagccagagtaagcgtcgaggaagctcaatagctcgcaaccggctgttgaatccaccaattgatctattcgagggagaggaaagtgatccttagggcacgccttgttgaggtcggtgaagtcgacacatattctccattttccgttggccttccgcaccataactggattggctagccactctggatgaagtacttctctgatgaagccagctttgagaagttcgtcgagctcttctcgtatggcttgtttccggtctggtgcaaatctctgcagtctttgcattactggcttggcatcgggtcacaccatgagtttgtgcccaatcacctccctggggacccccggcatgtcggacggctgccaagccaacacatcggcattatcacggaggaacgtgatgagcgcgagttcctatttctcgtttagtgtcgccctgatcttgacagtcttgtcggggttagccctggagagtggaacgatcttgatggtgccgtccggcttcggcgtcttatttggcttgctcactttcttgggtggctcagtcgtggcgggtgggctgggtgtttgctcgaccatgtcgaggctccgcttgtcgcactgcaccgccagctttgcgttcccttgaataatgattgttcccttcggtcccggtatcttgagcacttgatacgcgtagtgagatgcggccatgaacttcgcaagtgcagttctcccgatgatggtgttgtaagctgtatcgaattcagcaacatcgaaggtgatctgctctgttcggaagttgttggcttggccgaaagtcataggcaacgtaatcttacccaaaggtctagacgatgattggggagtaattccatggaagggttgatcggttggtgtcaactcactttgcggaagtcccattgcgtccagagtgctggtgcagagaagattgattgagctgccaccgtcgataagaactcgcgctaccttgatgttctgaatagtgggttcgaccacgatcggatatcgtcctgggatgacggaggttttggggtggtcttcctctgagaactctattttctgctcagaccacttcatcttgggtgcagccccctgccacgtcgaacagacttcacgttccactttcttgtattctcgcttggaggaatacgttgtggagccgccgaagatgtgtgagacgtggaggtcggagtctggatacgcagaatccggttcgtgaggaggcatctcttcgttcttctcgacaacgcgtactcgcttgcctttttcaaacgccatgtgcttctcgagcgactttttgaaaccaatgcaatcctccagagaatgtttgtccgttttgtgtatggggcaccatgatttctttgtgtcgctgccttgtgggtctgggcgcttgggagggttcgcgtattctgctgcgaggacttccgcttgagctttccttttcctatttttgtgatttttcttcttgcttgactcagatgcgtctgcggctggtttcttctctcccccggtcttcggtttgtcgttcttgcgtcttagcgcgtcatccacatgggcgcatcactcaacgatctcgaataatctccgagtagttgtgatgcgtcttgtcggcaactcctgggtagtgtagcgatctctgacaccggacttgaaggtgcgaattacagaagagtcggtaatttcgggaattgtgtttctgcactcgttgaagcgccgaacgtattccctcaatgattcccccgagttctgtgttaacgcgtgtaagtcgtcttcgatcgcgtggtgcttgtatgttccttggaaattggcgacgaattgttgccacaggtctgcccatgaagagattgagtaaggaggaagatgcatcagccatgaacgtgcagaacccttcaacgcggttggtaaatagttcgctaacgcgttgtcgtctgctccggcagcatagagcactgtcgagtagacttgaaggaattcttctgggtcggtgctcccatcatactttttaatggctctgggtcggaatctctcgggccatcggacatcacgtagggaacgaccgaaagccctacacccagcgttgggggcggtgggttgtcggcggtcgcgtgaccttcgtggatgtctgtctgacgatgaagaggatgcggatgatgacgatgacgatgggtcgcttggttccagcgtacggttacgaggatgatgacctggatctcgggaatcctctcgttgtctctcgctgttgtctcggcgccgatctccatcgtcgtcgtcgttgcggcgacggccatgaccagtattgtctggcccccgttgttcgcgatcgttgtaatctcggtcctcgtttgggcggtttcctcgatcatggcgccgtgaagagacatgacgccgagagcgatttgcgtcgtcccgtgtgcgtcgtgcttttcggcgaccgttgatttgatctcgaagatcgccagtgccacgaggtggaggggtagcctgtcgaggtaattccctctgctccggatcttcaccattggcgtcgccgattcgtggctgatcttggtgtgctgcggtagcggcttcttcaaacgcgttgctgaggttggtcatcgattcccgtaatcgttctatccaacacttgaggtcgtcgttcagaacgggatcgtaaggagtttccctcagtatagcttgaacagccctgatgtgctgggctggagtagtcgattgattcgccgcttcagcgttggcttgcgctgacgtgccaacgccatcgatagccaatacctcccgcggcgcacttgttgtcgatgac

SEQ ID NO: 65838 - DNA, 7031 bp, Oryza sativa
gggcgcgcccagcggctgccagatgggcccggccgtcagccgccagcgcccacgggtgcggctgacgcgtgggacccacagcgccggccggcgtcagccgcgtgcacccggtccaccgtggaccgagaggctgacgcgtgggccccactcccgtggacccggtccgcgcgccctctctcccggctgacgcaataaacgagtttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagtttattagagtaaaagccttttctttttcgttggtcgtgtagacgctgcagcttcggaagatccgctcttcgtggaagttgaagccgtcggttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccatattattattgttattgttattattattaccttgttcaccctagattaaacaaaacctcaactagtggacactctactcatggcaccactagtttaaatttaggtagatgcttcgcaatttaattaggtaacattaggcggttttacaactatagactttgggaaatattcatatcacctggatactctggaattgttggattattgtggaattggattcacaccgccccctctattcaaaatccccaaaagtggttttaggctgggctcggggtgcatggttttgatagtagcacctcggccatataaggaccggtcttcgggcctctgttgcaaagcactaccgtacttccacatgtctagtgggtaaggcttagtttgtggctcagtctagtcataaacaatagtacacggattggagatggatgaagtcgggggtcgatggacattctccagggcaaatgaaggctacacgagctgcggcccggtagtcgagatgtcatggcagagggttggtgccctgctgctaggggctcagtcttgcctgcctgtcccgggggttccggccataggcgggattgggtcggtactcttgtctatggctaggatgggttggaaactatgtcacgtctttcgtctgtataccgtggtggtatgtggcacgtggttacacgtgaggaagatgtgtcttgtgggcaaagatgtacacctctgatcagagtataatctattcgaatagccgcgccctcggttatgggcaagccgagcaatgtacccaagttagtgttttaattcttaaaacttgcttaacaactaaaatatggaatggttggcctgggttggcttgggacgagctgggacccagggtcgggttgccagttcggtctgaatcatcataggccttgggttaaggcaggttcgtgtgggttcacggccttgattaataacattgtatagttctaggatcgtgtttacaaaatagctttgagcaactaaatgtctttaaatgctgtttactgcaaccctaaccctttatggtataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttcccgtttgtctttgtgtgtgctgggccttcgctgcccatgtaataagttaactatttacgcttccgcttgttaaactctgatttgtatcaacttttggtgtaccttgcctcctgggacaaggattaatgcacgcacgtaaggaatgcccgttgggttatttctggtcgtggcaagttggtatcagagccccccttgaccctaggacgagccgtagaccccaagccttagcaatattttcacaaataaaaatcctttgttatttgtgaaaatcctctagtctctctctgtcttgctgcttcatttatcaccaaaatctgacctttgaaaatgttgcttttctttttgtttttgtttgtagatggccggcagcgtcacccgtcgtggtttggacatgactggcttcgtcttggagctgcgaggcatgtgcgtggtcctggggtatccacatggagtggactaccaggccaggccgcttccggatcaggagggtgatgatgcggagccccccgctgcttgggaggtcactgcagtgatcctctctggctctcccgagcggacttcgctggcagtcaccgcgggtggagattccttccccgccgcttgccagaacgccgccctcctcgccatcggcactcttcaccagcgctacccggacgagttgcagcactcgccctaccgctaccaccctcgtcgcggaggagcccgcgactacgccaccttccgggatgctagctcggaggatgacgctaccatcgtgcacctggcgcgcatggtggaggcgtacgacgcggctcgtatcgacttccaccagatggtacgccgcggcatggtcgagaacaacctgaagatcctggagctgcgtcaggagaacctgcagctcaagaaggacctggacgcagtggagacgcagctgcaccagctcaagatcgcccagggagagatctgccgccccaagcgtcgccgtgtctgccgcagccagaagatcaccgcccgcaagagcacctccaggcccgagcttgttcgtcagtccctggcgtggacttgtttcgtcgagacccctcgtgccgagcctgcgcccgtggttccccaggagggggaagcctccggcgttggaagcacggaggatgcgctgttgctcaccttccgccctggcccgtcgcagcagtagacgagcagttagtaggcttgcgcgtgtgttcttcctcgtttgtcttcttgttgagtcgtgtggggcatggttatgccggtgtgtggcataactatgtcggagcctgccttattttattcgcctaagcaacttgaactttaatgaaccaattcaatagcagtaataaattcaagaattatagtagtcgtgggtggttcgtttaattgttagctctttccctgtttgctggttctgtgtggggttttcagatggtgacgaccagaagaaatgctgccaccggtgatggcaaccaacccgaaggcagcaaccacaaccaccagggtaacccacctccacctcctcctccgcctccaccaccaccaccagacaccaacgccattctcacccaaatcctcgcccagcaagccaacatgatgactgctttcctccaccacctccaaaatccaccacaacataatgctccaccacctccccaacactctaaactcgccgagttcctccgcatccgcccacctaccttctctagctccaacaaccccgtggatgcgttggattggttgcatgccgtggggaaaaagctagacacggtgcagtgcagcgatgaggagaaagttatcttcgccgcccaccagctgcagggacccgcatctctatggtgggaccatttccaggctacgcagccagaggggcagcctattacttgggcccgcttcaccgccgctttccgaagaacccatgtgcccgctggagtcgtggcccttaagaaaagggaattccgagagttgaagcaaggcaaccgctccgtgatggagtatttgcattagttcaataacctggcccgttacgctccagaggatgtgcgggaagatgaggagaaacaggagaagttcttggcaggaatggaccccgagctgtccgtccgtctagtctccggggactatccggatttccaacgactggtggacaagagcatccgcttggaagccaagcacaaggaactggagtcgcacaagtgccgcttggcgaatttccgcaatcagcagggtgctaaccagagggtccgctacaccaatccctatccagggggatcctcctcgcagcagcaacaacagcagcagcagcaacctcgctccgcgcctcgacctcaattcgtggtgcgcatcccacagccgcagcagcagcagaatcaacaagggactcgtgcgccccgtcctcctacgccaactgtgcagcctggtcaaggccgcagggacgctcaaggtcagcagcgtctgtgcttcaactgcttcgagcccgggcactttgcggataaatgcccaaagccaaggcgtcagcaaggccaagcgcctccccgctccaacaacggcgggaaggatgtcattcggggtcgtgtgaaccacgtgacggccgaggacgtgctgacaactccagacgtcatcgttggtacgttcctcgttcattccatccctgctacaattttgttcgactctggagcttcccactcgtttatatctgtgccattcgttgggagaaatcagttgggggtagaaaggcttaggaaccctctgctcatcaccacccctggaggggttatgacagcaaagtactatagccctgccgtccctatagaaattcaggggattccttttccctcggatctgattctgctagacaccaagaacttggatgtgatccttgggatgaattggttggctcaattccaaggagtagtggattgcgcgagacgcactgtcactctgtaccgagggccagaacaaccggttgttttctttgcacccccaacctctgtcagaagttcagaactgcatcagattggactgtcagaaatccccattgtcagagagttcggagacgtgtttccggaagaactacctggtatgccgcccaagcgagagattgagttccggatagatcttgctccaggaaccactcctctgcataagcgaccctaccgtatggcagcaaatgaactggccgaagtaaagaaacagttggaagagttgaaagaaaaggggtacatacgcccgagtacttccccatggggtgctcctgtgatttttgtagagaagaaagacaagacgaagaggatgtgcgtcgactacagagctctcaatgaagtcaccatcaaaaacaagtaccctcttccccggatcgatgatctgttcgatcaacttaaaggtgccactgtattctccaagattgatcttcgttccggatatcaccaattacgtattcgtgaagaagatattccgaagaccgcattcaccacgcgatacgggctgtatgaattcacggtgatgtcgttcggtttaaccaatgcacctgccttcttcatgaacttaatgaacaaagtgttcatggaatacttggataagtttgttgtggttttcattgatgacattctgatatactcacaatcagaggaagaccatcagcaccatctccgtctggtgttgggaaagttgcgggaacatcaattgtatgccaagcttagcaagtgtgagttctggttgtccgaagtcaaattcttagggcacgtgatatcagctaaaggagttgctgtggaccccgaaacagtgaccgccgtcaccgattggaaacaacccaagacagttactcaagtccgcagtttcttaggtttggcaggatactaccggagattcatcgagaacttctccaagatcgctcgacccatgacacagttgttgaagaaagaagagaaatttgtgtggagcccgcaatgcgagaaggcgtttcaaactctcaaggaaaagctggtttcctcgccggtgttaatcttgccggatactcgcaaggacttcatggtgtattgtgacgcttcgcgccaaggattggggtgcgtgctcatgcaggacggtcatgtggtagcctatgcctcacgtcagctacgacctcatgaaggcaactaccctacccatgatttggagttagcagcggtggttcatgctctaaaaatctggcggcactatctcattgggaatcgctgtgaaatctatactgatcataagagtttgaaatacatcttcactcagtcggacctgaatcttcggcaaaggagatggttagaacttatcaaagactatgatgtgggaattcactatcatcctggtaaggccaacgtggttgccgacgctctaagtcgaaagagccattgcaacactcttaacgtccgtggcattccacccgagcttaaccaacagatggaagccctgaacctaagcatagttagtcgtggattcttggccgcgttggaagccaagcccaccttgctcgatcaaatccgcgaggctcagaagaacgacccggacatgcatggactcctcaagaatatgaaacagggtaaagccgctggtttcacagaggatgaacacggaaccctatggaacggaaagcgggtatgcgttccagataacagagaacttaaacagctgatacttcaggaagctcacgaaagtccttattccatccaccctggcagtacgaagatgtacttagacttgaaggagaaatactggtgggttagtatgaagcgggagattgcagagtttgtggccctacgtgatgtgtgccagcgtgtcaaggcagagcaccagcgaccggccggacttctccaacctctccaagtacctgaatggaaatgggatgaaattgggatggatttcatcaccggacttccaaagacccaaggtggatatgattctatatgggtagttgtggatcgattaaccaaggtagctcgattcattcctgtgaagaccacctatggagggaacaaactagcggagctctacttcgctaggatcgtgagtctccatggcgttcccaagaaaatcgtatctgataggggaagccaattcacctctcacttttggaagaagctccaagaagagctgggtactcgattgaatttcagcaccgcctatcacccgcagacagatggacagaccgagcgtctaaatcagatccta

SEQ ID NO: 65839 - DNA, 793 bp, Oryza sativa
cacgcacgtccaggaatgcccgttgggttatttccggtcgtgacagatcgatatcgattaccctaacgaatcgatctgaggctggagtcgctccttgttccttgccgttatccctgatggggacgtatgacttaggagacggagttttcatggcgccgaggaggactttgcagctcgagaggtcgtgattctttgtcttgtgaataggacaataaacatcccgagttggagaagtacactgaatttgtcacgcccgaaaattcactagtaatttccgaacttatttgtgcataaaatcctcgtccaggaatcagccgaggtacacaaactgacaatttaatatacagattcatcaaattaactaaaacgataaatacttacttatgaggcacttagtcctcatcatgaagaaaactgcagcggaaaataaaatctagcgaagctccggctccactcccacaggcagctcaactggggtataagccaaacgtcttctccttctggattctttttcttcaactgaggttgattgattattgcaaggtgagcatatgacatactcagcaagccacacagcaaatatgcaagtgcacaaggataccaaaggatggcataatatcggctcatttgcaaaagcagcatttagcaaaacatttaagagaagtaaaacagtggagtaattaatcagaaattttaaccaacactgaacagcacacccatgctgcacaggcccaaccattctgaacaaccatacccggctgaacagatctaactccaaaccaggagctaagca

SEQ ID NO: 65840 - DNA, 1949 bp, Oryza sativa
tttttattaaatacctgcttaattctataattcctagattcttctgggattatttgagctaaggaagtatttttagtaaatggaattgcatttaagaaataatttaaattgaaaaaggttttaaaagtcttcttttggctttgggccgaagtcggcccaaaacctctcttctctccctcctcggcccagccggcccagtccgcagccgcgcgcgcgcgttcggtcgctgacaggtggggcccgcttgtcggatccgtcttcctcgcgtcgccgccgccgcccgaaaccctagcgcaagccgccgccgtctccttccaaattcggccgcgtctttccttatccggccgaatcgtttgagggaaaatgatcctcgggatctcctctaccttttcttctttggaagcttcgcctaaatcggtttggaaatcgatggattcgagttcgaatcggatcggttttcctctctccaagccgagctttccttcgccgtctccgccgccgtgggccttagccgccgcctccttgcacctatttaaggacccccgagctctcctctacccgtcgccaccctcgccttcgcctctcgtcgtcggaagagctctagcgccgtgtgccctagcttcgccgtcgccgccgccgctccagccgtgcgccgccgtcgtttcagccgtcgccgtcgctcgggaagaccgccgtcgggttcgcaaggtcgtcgccgtcctcgtccgccccttcgcagccgccggagaccgccggagcttcatcgccgtcgtcaacccgaaggttcccgccgcttcctcctcgtcgccgtcgccgtccgttgcttctccgtcgctcttttggtcgtcggtgagttcgccgtgccgcccgcttcgtcccggtgccttccgtttgcgttctcgcgccgccgttcgccggcaagcgtgcgccgcccgagccgtctgcctcgccgagccgccgccgccgtcggtgacgtcattgctggcgtcatcaaggccgtccgccgtgaaccgccgtggacccgatcgatctcggccgtccatcttggatcggttagatctcggccgtccgttcgtgtgagccgtcgcccgtgcgcccggtccaccgaaaccctagccgctgacgcaataatccttcttttccttttcaaaaataattcattattgcgtcataattcaattaaaatcagtttaaaggttttaatccgatttaatctttaaaaattcatatctaattcatcttaactcagtttaatgtggttcaagttgcaaaagttgtataaaataaagatctacatattaaaattgtccataaattgaattaaatttatttaattctttttaaatgggctttaattagatttaatcttgtaaaattcataataaattcatatgaagtcagaatgaggccgttcaagtctcataattcatctaaaaatatgatctacatgtttgtttactttttatgtattgtttatttggtttttattagtctttttcctcgttttgcgtgatagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcattgggtggaattaacctattctttgttatggcccttttgttcttgattactttattccttgataccttgggtgattataattggactagttgagctttatatatattggttcaactagatattagatatgattgcttagccatgcttagaaacattagcacacatttgggataactaatgtttcactatcatttatggttatatttaatggtagctcacgatggtcaatcgtgattggttaattaattacttgcc

SEQ ID NO: 65841 - DNA, 861 bp, Oryza sativa
aaagagaagagaaaagctactagagccatacccgaactcttccgaaggcttccggacacctgatttcaacactatttctattccaccagctagatactactaaactaaacttgagagaaatgagagagctattgcttgaggtctgtgagtgaagtgagaaggcgaggggtttatatagcctcccaatgatggttgtgatggttggaatggtcggaatgatgtgcactagggttcccgaccttccgaaaggttctgataaacaacgatttgggcggagtcgcgacacaaatagatctggcttcttgaatgcgcacgctcttgagccccgcaattgcagcaccatgtctcctttggttatcacccgtgtcgaaacgcggatgacctcgccgagaaggctaatccctgtttgccaatcgaagaacacaaacaagaacgagatagaaaacaaccaaaattgcagatgaatgattaagctcacaagttggggtcttacaaaccgatctagcggcgaaactgttctcgacagaataatctaagcaaaacccaactctaaacgatgacggctactgaataaatgtgattagggacgtcctagggttgtcctagggcacacacccccttgggctaagcccaagacacaattacaaggcccaaaacccaaatcaaattcggactggatgagatacgtggcttgttttgaagattcccggtagctcgataggaattttgatgtgggaccacaaccatctgaaagtagactccataagctttccaacaagtactcatgggccccgaaattccttctagatcagcggctaggaccgttcgaaattgatggtgtcaggagaacaaggggatcca
